United States Patent 7,750,207 (ZEA MAYS RIBULOSE BISPHOSPHATE CARBOXYLASE ACTIVASE PROMOTER) - sequence listing, part 11

SEQ ID NO: 14568 - DNA, 2684 bp, Zea mays
aaaaacatataagtctatgatctgtaattattcaaaatttataaaatagtactaaccataaatagagactacaccaaaaaaaaatactatagaaataaaaaaatgtgtgcgcaacgccacacaaaaattccagtaatactttattcgttcgtaaagagtcaaagcatctaaaatttaaacaaatttataaaataaaaataatatttataatataaaccaatattattaaattctttaatacttttatagtatatttgaatttataattttatctatattttttaaaagttttacaatgtgaaagggaggtagtagtattatataaaaaatttcgcacgggctgacgtggactgaattccggaaaggacgtctcctccacgcctgctccctctctctagagctgactttaggacattggaggctttgacgccttcggtgtccttgcgtccgcgtcgtgtccgcgcgcctgctgcccgccaacccgcctctcccaaatcccatccaaattcctccgcgtctttcgaagatcatattttgggaggggcaccgcccccagatcggggaggaatccccattccgtctggtgggtcggtctcccctgtccgtttttggctcttttcccctctcacaagggcggctcttggatgggctgcctgccgtgcttcgggtcggctggtgagggggcggccaaggagggcggtgcgcgcaaggacggtacgtcggatcttcgcgtcacccgggtcgaatcagataaatcaaaaccacagggtggactagactctaagaaggatgcagtcattttgagggaggggaataatcaacatattgcagcacacactttcacttttcgtgaacttgcagctgccactaagaacttcagacaagattgcttattgggtgagggaggttttggtcgtgtttataaaggacgtttggagaatggacaggttgttgcagtgaagcaacttgatcgcaatggccttcaaggaaacagggagtttctggttgaggttctaatgcttagtctgttgcaccatgacaatctagtaaacttaattggatactgcgctgatggagaccaacgtcttcttgtatacgagtttatgccattgggatcacttgaggatcatttgcatgatattccacctgataaggaacctctggactggaatacacgtatgaagattgctgctggtgccgccaagggcttagagtacttgcatgataaggcaagtcctcctgttatttacagggatttcaagtcctcaaacattctactcggtgaagggtttcatccgaagctatcagacttcggccttgccaaacttggccctgttggtgacaagactcacgtttcaacacgtgtcatgggaacttatggctactgtgctccagagtatgcaatgacagggcagcttacagctaaatctgatgtatatagttttggtgttgtgttccttgaactgattactggccgcaaagcaattgacaacacaaaaccccatggagagcaaaacctagttgcatgggctcgtcctctattcaaggaccgcagaaaattccctaaaatggctgatccgtcacttcagggctgtttccccatgaggggactgtatcaagctctagctgttgctgcaatgtgtttgcaagagcaggctgctacccgcccctttataggtgacgtggtcaccgctctttcatacctagcttctcacacatatgatccaaatgcgcctgctcaacataatcggagtaattcatctactccgagggttagccgaggtggtgggagcaatgaccaacgccgtctccgctcatcaaaccaccactctccagatttgagaagggaagtcaccacagcatcaagatacgacgatgaggttagcagggcaaactctggtactggttctggtcgccggtctggcttggatgatgcggatatgtcaggctcacaattgggtagccctgctcacactggaaggaagaggggatctcctaggacttctgaaagccagcatgctatagcagaggccaaaacatatggggaaaattcaagaggcagaaagtgaccaaactctcagagcagcattgaccgtatgagcagaatgctgaaccagatggttcatccattcatcattcatagaaaaaaaaatgataagttccttgctagcgccagacaggaacattgcatcagtccatctaggtcccttggtctttgtgaatagagctttcctcttttccctttacgggctattgccactgcttcttaacttctccatacaaatatcattgccaccacaaccaccatcagaactcccattcctgtcatctattcctcatgaatgcgatcatcatgcttacgagccttcgtcgtcacggtgtataacaacattcggttcacaatgtggaggtaaggcaaacatctgctctggggagcacaggatctcatccagttgggcatcttctgttgctgttgcatgctgggtgtcagcagtcacaccattgtcgaggggtgtgatgttctttttcttgaatggtttgtacctggggttacagcagttcacctgtgtttgatacatctgccttgtgacatttttgtgttgagttgtcggaacacatctattatcatctctaccataaaattgttgtggcccttgcatcttatccaaaaaaaaaggccccta

SEQ ID NO: 14569 - DNA, 3001 bp, Zea mays
  misc_feature (11)..(11): n is a, c, g, or t
cacattttaanacgtgaaaaacaaaattatacactgttgcattatttggtgggcttagacactattgtacatcagtgggatatggaatgtgcatattagaattgttatagtttgttagttgcgtagttaatacatgtatgttttcagttatatatattagacctttataagaaacacacctctgtatatttttgcaagtatggaacgtgggccgacaatattattttacaccaggaggtgccttagcagcacaggtggcgccttagtctggttcctgttctagtaaggctgcatacaatgcattcttctttgtgtccatcaagtttgtgccttggaggagaatttggagatcctcggcaaccctggggtgtaaattttttttgtgtcttgctgtcaaaaagtggtctggatggctaatcaaaattgtacaaacaatattgtacaaacatagtttaacgcatcctgctgctagcttattgtgtgatcaagctgaagagaccatcctgcatattttagtttcttgtattttcgctcggcaggtctggaccttggtattacagaagcttggacttgtggcactagcacctgattctgatgtaacaagtttccccagctggtggtgtggtgctatcaagaagatacctaaggacgtgaggaaatgatttaacacttaaattatcctggtagcttggaaaatatggaagcatcgaaatgcatgtgttagctcaaacgtgcaaatggttttacaggcggtgggtactgagagaatcctttggtgctctccaggagcttctgctctttaggagctgctcccccccccccccttcagattaggtttgagttttcctggttgtggttatttgtattttttttaggtgtgggtgtgtgagtctcaaggttttcctgggagaaggttccatgccctctccccctggtgttctttcttccatcttaatgaaatgacatgcagctcttctgcatggttcgagaaaaaaattactgtaaggtatctctatctaatatcagaagcaatatggtttcttctagaaaccttcttgaactgtgcacatgaacagccatgttgtcccctgtctttccgttatcatccatgacgcttggaactagagttgtttatgtgcaaagttcagaatctatcttttgtatgccttctatgatccagtaagaatcaaaacacaattcacattctatcaatgcttactggtcaaacagtccatgtaccaaacggcaaacctcttactcatacatgcatgcagatgcaggcggcgtgttcgagcccaacacaccacatcattagagcatttgttttacaaaagaggctgccatggcatttttttatgaaagaagagatctgtgaggggaaaggataagctgtgctgtgtgcttgagcacatgagtctcatacgttattaggctgggagtgggagcgctggttgaggttaaagtgtgctggaccaggaagtggtggcccaagttgacctttattcattttattgtattacttttattgttctctttaaaacatgtaatttatgtatagcccaataaagatgtgcatcaaccagttgcttggaccctgggtcatcggcctcataaacttgggttgggtttgcataccaagtcctaaattgtcattaaatgatatattctattttctaaatgttgacagtaagatcgttactcttagcaacacatgggtatgtttactagtaaagataggtgctaagtgctctagatcaacttattccgaaatacttgatgcaccgaatttcttttagttttcatttactgctttaacttcgcattttcggttgtagttcatcttgattatgttgaaccctttaacccggatgtgacctaactctagactaacttctgctttagataaatcaaaaccacagggtggactagactctaagaaggatgcagtcattttgagggaggggaataatcaacatattgcagcacacactttcacttttcgtgaacttgcagctgccactaagaacttcagacaagattgcttattgggtgagggaggttttggtcgtgtttataaaggacgtttggagaatggacaggttgttgcagtgaagcaacttgatcgcaatggccttcaaggaaacagggagtttctggttgaggttctaatgcttagtctgttgcaccatgacaatctagtaaacttaattggatactgcgctgatggagaccaacgtcttcttgtatacgagtttatgccattgggatcacttgaggatcatttgcatgatattccacctgataaggaacctctggactggaatacacgtatgaagattgctgctggtgccgccaagggccttagagtacttgcatgataaggcaagtcctcctgttatttacagggatttcaagtcctcaaacattctactcggtgaagggtttcatccgaagctatcagacttcggccttgccaaacttggccctgttggtgacaagactcacgtttcaacacgtgtcatgggaacttatggctactgtgctccagagtatgcaatgacagggcagcttacagctaaatctgatgtatatagttttggtgttgtgttccttgaactgattactggccgcaaagcaattgacaacacaaaaccccatggagagcaaaacctagttgcatgggctcgtcctctattcaaggaccgcagaaaattccctaaaatggctgatccgtcacttcagggctgtttccccatgaggggactgtatcaagctctagctgttgctgcaatgattttccaagagcaggctgctacccgcccctttataggtgacgtggtcaccgctctttcatacctagcttctcacacatatgatccaaatgcgcctgctcaacataatcggagtaattcatctactccgagggttagccgaggtggtgggagcaatgaccaacgccgtctccgctcatcaaaccaccactctccagatttgagaaggg

SEQ ID NO: 14570 - DNA, 1019 bp, Zea mays
  misc_feature (940)..(940): n is a, c, g, or t
ctcgaaaggccggccgggcccgggaaaaaggccgaccccgcccggagctgactttaggacattggaggctttgacgccttcggtgtccttgcgtccgcgtcgtgtccgcgcgcctgctgcccgccaacccgcctctcccaaatcccatccaaattcctccgcgtctttcgaagatcggattttgggagggcaccgcccccagatcggggaggaatccccattccgtctggtgggtcggtctcccctgtccgtttttggctcttttcccctctcacaagggcggctcttggatgggctgcctgccgtgcttcgggtcggctggtgagggggcggccaaggagggcggtgcgcgcaaggacgataaatcaaaaccacagggtggactagactctaagaaggatgcagtcattttgagggaggggaataatcaacatattgcagcacacactttcacttttcgtgaacttgcagctgccactaagaacttcagacaagattgcttattgggtgagggaggttttggtcgtgtttataaaggacgtttggagaatggacaggttgttgcagtgaagcaacttgatcgcaatggccttcaaggaaacagggagtttctggttgaggttctaatgcttagtctgttgcaccatgacaatctagtaaacttaattggatactgcgctgatggagaccaacgtcttcttgtatacgagtttatgccattgggatcacttgaggatcatttgcatgatattccacctgataaggaacctctggactggaatacacgtatgaagattgctgctggtgccgccaagggcttagagtacttgcatgataaggcaagtcctcctgttatttacagggatttcaagtcctcaaacattctactcggtgaagggtttcatccgaagctatcagacttcggccttgccaaacttgngccctgttggatgacagactcacgtttcaacacgtgtcatgggaacttatggctactgtgctccagagtatgcaatgac

SEQ ID NO: 14571 - DNA, 1757 bp, Zea mays
gcacgagaccattacctagaacatcctaatcgaaaaacactctcctcgcgtttcccgccattaactctgcaacctattctcttcctcgcgaaaccgcttccttcgattcattccccctctcccctctccaagacccaaaaccctaacccctacgacccccgtgaccgccgccgccgtcgatgcctgcgctctccgacgtcgcgcttcaggctgccatcgccggcaacctccgcctcctgaagctggtggcgagcaagatgaatctgcgcgaagcgaaggacgccgctgggcggaacgcgctccacctggccgcggagatgggccgtcttgaggtttgcaggttcctggtggaggaatcgggcttcgaggtgaacttcgcctgcgccgaaggcgggtcgccggtccactgcgccgcggccgggggcagcgagagcgtcttgggctaccttctcgaccacggtggcgaccctgtgatgccggactccatgggctccactccactgcatgatgcggcagaggaagggcattgtgcggctgtgaggatgctgctgtccaagggtgtcgatgtggatccacacggctgtcgtgggacgccgctgcacttggcctgctccaatgaccgggatcaggttgttaggatcctgctggaacatggcgcagatcccaacaaagttgtcggtcatgtcctcccaccactcatgatggcatactgtggcggttctttgagatgcatgaagctactgattgaggctggtgcggatgtgaacttgattgctccttctggagtaattttggctcaggcagtttgtgatgggtcaactgagattgtcaagtttttgctagaggttggagctgatcctaacattcctgatgaggatgggaaaatcccgatcatgtacccagcatttaatgggcatcgggagcttgttgaaattctatttcctaagacaagaccagtttcatctttgccagactggagcgttgatgggattattagaagtatgaaagatctgtttttcaagcctcaggatgcagctgtggtggaaaaaaagatagctgatgcgaagtcacaagggaaggaagctttcgcaaggggagagtaccctgcagcagtatacttctataccatggtactagagaacgaccttgatgctactgcgtttgccaaccggagcctgtgctggttgcggctgagggagggggccaaggctctgttagatgctcaacagtgcaaaatgatacggcctcgttggtcgaaggcatggtatcgcgagggcgcggctctcagcttgctgaaggactaccaaggggcagtcaacgcgttcacggaagcattgaaactggatcctgcaagtttagagatcaagaaagccttaagggaggccaccgattccctggcgaacgttggccgctccggagaacagaacccatgagctgctgctgcatccatgtgctttatctcacgttaagaatcctctaacactatgtggctcagcctcatattatatgttgatatatgtcgccttaacgcactgctggagatactagtttcgatctcagcctatatgttttgctccttcgggatgcagcctaagatacatgtggcaaccaagtgaggttgggcagggtagcatatctatggactggttgaactattatatgtatctggatatctaagtgcacctgttgctcctagtaaagttgcagttctaatgaccccttcgtcaaaaaaaaaaaaaaaaaaaaaaaaaaaaaag

SEQ ID NO: 14572 - DNA, 2477 bp, Zea mays
ggaccctcgaggccggccgggccgggaatctccatagggatgcggccactccatgtttctgacatgtgcggccgaacataaccaaatccgtgcgaggaagatccccgcgggctgccgccgcgccggccggggtctcgttccaaactagcctgaccaggtcgtccaacgactccgctcacccttcgcggtcgcccgcgcgatctctccaccacttccccgccggcgcctgctaggcgtccgcgaggagggccagcgatgaagggctcctcccactcgcaggcgggggcgcaggcggtacggaggcggcgctgggggtgtcttctgccgctcctcgttggcgccgccttcctcgccgagatcgcgttcctcggccgcctcgacatggcgaagaacgccgaggcggtcgagagctggaccacctccttttaccgccgctccgccgatttgggcgatgccgttggcgggggcgcagcctcgagggcaggcggcgacagcgaggacgaagagatccggctgtgcgagcagcggctcgagagggaggatgccgtgccctacgaccgcgactttgacagtgatcccgtgcttgtcggtggcgctgccaaggattggaataaatgctacgtaggatgtgaatttggtttttctgcgagtaagacacctgatgctacatttggaattgcaccagatccttctgtagatggtatcctcagatcaatggaatcatctcaatattattcagagaataatattgatgtggctcgagggagagggtacaagattgtgatgacaaccagcctttcttcagacgtaccagttggctacttttcatgggctgaatatgatatcatggcacctgtgcctccaaagactgaagaagctcttgctgcagcctttatttctaactgtggtgcacgaaactttcgtttgcaagcccttgagatgcttgaaaacttggatgtcaaaatagattcatatggtagttgtcatcgtaaccgtgacggcaaagtggacaaagtggacactttgaagcgctacagattcagcttggcatttgagaattctaatgaggaggattatgtaactgaaaagttttttcagtcactagtagcaggttctattccggttgttgttggtgctccaaatattcaagagttttctccgggagaaggcgcaatattacatattaaggagcttgatgatgttgcttcagttgctaagacaatgaaaaatattgcttcaaaccctgatgccttcaatcaatctttgaggtggaagtatgatggtccatccgattctttcaaagctcttattgacatggcagcggttcattcatcttgtcgtctttgtatacatattgctaccaagatccatttaaaggaggaaaggactccaaaatttacaaatcgtccttgtagctgttccaccaaaaagggaacaatttaccacttatttatccgagagagagggcggtttaagtcagagagcatttacatgagatcaggccagttaactctgggagccttggaatccgcagtgctcggtaaatttaggtccctcaaccacgttcctgtatggaaggatgaaaggccaccgagcattagaggtggggatgacctgaaattatacagaatttacccagtcggtctaacgcaacgtcaggctttgtacggttttagatttagggatgattctgaactcgagcaatatatcaaagaccatccctgtgcaaagcttgaagtaatttttgtgtaactactatgccctaggcttaacgttttccccccgattcttactgaactctgtgtgcgagtttcagttgtactgtaatgtagagtgttatgtgtagcaaagaaactcatgccagtacggatcatgtgtcggttgtaaattttccatgacagtaaacatcattccttcttttcagtaacaaccgcaaacaaattaacacgtttcttcaagatttcatgccaaggctcgcaaattaagcgctgttctaaattctcttcgaccttctattcttctaatctcgatcatgctactctgctaccaggggacgttgtcgatgtctcagctaggcagctacctagtagacttgggcggtgttttggttctaccccaaagtttaatccttttcatatcgaaatttgataataattataaatattaaatatagtttaattacaaaattaattaaatacacagacaaaaaataaataatgaggccagtttattaaattgcataattaatatttaaatattttaatgtcacacgaaccatagtcagtaaaccatacaaccaccgcagggagccatttgtcctcacgtgatgacgtgaataggtgactgcctcggtgcgctggagcttggcgtcctgaaaagctgcaatctttgacctgttcttgcaacctcggcagctggcatgggcatgtcttggctttatagctggacacctggaaggctggacctggaggctgcag

SEQ ID NO: 14573 - DNA, 3395 bp, Zea mays
ctggaggtggaacttctgaactgacggatgatgtagccagacagcaggatgaggttgccgtgactggggaagatgctgtgttcgacgccatagatggaagcaaatctagtgagaggaattctgtgcaaggtgatgagcttgatctctcctgtcaagatatactacaaacggagactggtggggggcacagtagcactgtagtggaggaagattcaggtagcaaggatcctactgcaagtgacggccaagaaatcctgatcgaagaaactgaaccaaatcagcagagcaagcatgcgttaactggctcatttgagaaagtccctgacattgagtctgttgggtcttctgctgagaaatctgtcggtacaggtgatgacttgcttcaatctggtaaaggtgcttgccactcagaaataccagtcgatatcatagctcagctgcaacttgaccctacctctggaacggcagatcatccggcaatctccaaaggggcagacaattttgaaggacaacattatcatacaacaggttagagtttctggatgttcttgtgtactgcatttaattttgatttttattgtataatgttgaactaatgcctcgttgatcttttgaaagaagtttggttaggagccgcaaatgtttaattgagcagtgtactttgattttggttagttgagctatcaagtaaatatccctgttgcacttgcattttgataaagtgttagtgtctggccaattgtgaaaggggctcagtggtaatgcatgattagttgacatttctttgctcgtgtcataagtatcatttgaccttgtacgtaacgtgcaattataactccctacttcaagtgcaatttgataaacactgcaatatttcatatgtatgaagtacgatatgtagttgacgacaagtcagtctaagtcgacagagtcataagtggcctggaaacatttttgaacaataccctttaggtactgtatgggtttgatattaactgtttacaaactgaaatttgatgcacattctgcagatgaaagcatcggagcaataccaagtacatttgaacctgctgttggtgccaaagttgtatcagttgatgtcactgctgaccttacagaggatgtttgttcgtctgacataacaatagatgacggcatgcaggaaaatgtgacaagtggtactattgtaccatctcaagttgatatactggattcgagtccttccgctacagcacatgaagtcaacattgtcggtagcataaacgatgatgacgaaaagagtcaggatggaaaaagcagtgcagatcttgcttcatacgaggtaaaagagatggttgtcaaggataactttgaagaaaagcagcagaccaaagaggtcattgtagatcccactccacatgaagccaacaactttcccagtaccgataatcacgaggaaaatgagcagaacaaagaaattgttgcagacaccacttcacacaagataagtgctgtacaaagcatgggtagtactgaagaaaaggaacatattgaagatttcattgcgaaactggcttctgaagagatcattgttacaagtaacagagatattgtcgagcagcaggatgagactgatatgaaaacaaactatgaaatagacagggcacgcaacttagaagctactgaagaaattgctgctggtggtgagagtaacacgggaaccatcacagatgttgttgaagacaaattccctaatgaagaaattactttaggcactatctctcttaacatggcagacagcagcgttaaggaggaaaagatgcatgacgaagaagtgaacgaggatctagattctcgtgatgatattatggtacatggtcctgataatgtcaaagagaagatgtgtgaggagaccatgtcaggtcccaccttagacaagttcagtttgcctacatctactgacagtcctgaagagggtaataaggacgaaagcacgcgtgcagaccctatgtcacacgagaccaatgtggcgcaaaccagcgatggtgctgatgaagagaagaagatcagggagcttgctgttgaccctacttctagcattggtaccatgggcaacataggcaacgctgaagacaagccgagtgaagaaactacaacagatcctagacctgttgagaacaccacaacacaaggcacagaggacgcgacagatcctaaacctgttgagaacaccacaccacaaggcacagaggacgcggatagcagcaagcagaatgaaaacactgcgagcataggtggcgttgaaggcaagaagcagggtgaagaaactacagcggatcctagatccgtcgaaaacaccacagttgaaggcaagaagcagggtgaagaaactacagcggatcctagatccatcgaaaacaccacagcacagggcacagaggatgcagaaagcagcaagcagaatgagaacacaaatgtcatggaagaagaaagggtgacggtggaagatacaacctcaagggagatcagcgccatagaaagcacagatgacctgaagggcaaggctaccgacgagaacgaagagatagccgacaaggaaatggtcaccgactcggacaagaaccacgtctcgctgaaggtcctcctcgcggacaagaacgtggaagccaaagagaaggagaagaaggcgactagcgccaaggaccgggtgctgtcgttcaggcgccgggtatccaaggacaacgtgtcgccgccggtgaagccaggctcgcccaccaaagacaaagatggctcagggcagcaggactggaactccccggccaggttgcccgtcgagaagaaacccaaggggaggaaacagcagtgggtaccgtttatttgctgctcgtcggtacagtaatccgtttgccagcatcagctttgggcatccattgttgtgtttgtacttgtacgctgatggtagtagattgagtaggaccttcgttccaggattggaccttggcagctttgctactctacttggattgtgaacccggctctgccgtttttgtatgttataaatatttgttggtggggggctgaggagggtatgccccaaactctggtaaagtaggaaggttatgataggactgacgagttaacttttaaacctagctattttaattaaaatgaaacccgaaagaaaatcccgtgacgtagatataatgatgtgcctgaacctacatacgaatgataatagatcataatctaaatgtttcttcataacaaattaaaaccttaattaattttatatagaatttagagctcattaccacctctaatccaaagtgcccattcattgatctgcaaacgttgtgcagttccggtgatcttcaggttgacacatcctgacacggcagtgcgtgacggtgaggcag

SEQ ID NO: 14574 - DNA, 2066 bp, Zea mays
cacaaagtttaaccaaatttattaaaattttttttttttttttggcagaataacattagtatttttaaaactattataaaacatatatgttaatatgtttttcctataatatcagcgaggcaaactgatctcagcacaaccttgtataatgtctatctctacttagcaactcttcagttagccgtataaacatctaccagcaaaagaaaagtatgtcacttgactgcgccaaatttaaattataccaatgttttagacaatgttgaactgctgagccaactcagacattggattctttgaccgtggattcaccttcctcagttttcctcttcttggccctaggaaccaatcttttaacgtacgaaatataagcatcaacgtcaaattttctcttgcaaccagcataattcatataacgtatctttccaaataccggacgttccttccaaccctggtcatggaggccacaaatagaccacatgcaaccaacatagccattgggatccctgccatcgatatgatacttgtcgttcaaatatattgctatggaaagtgcttcttcaggttgactggtccattctagaatctttttggcccaatacattcgcataaatccatgcattttcccatggtgcaccatctccaattgagatgcattccaaagctgataaagtttgggaaatgagggacagatagtccagtcaggaactagataaaaatgaattcaagaacttcagtagagtacaaggaatatgctaatacaaactggatcagatgttttggcattttcgagctgctccctcgtatagatatgctctcttttatcaccagtgtgatccgttaacgtctttctagcccactcccatgcaccagccagtgaatcatattgaggctggtaatagcagaaattgtcagctagttccctccttattatcagctcctccaagaacgtgtccactgactttggactaagatgacggcgtttttttgcttcaagagcacacctttgtgcagaaatgtgcccaaaatgtaagtacggtgaaaggcacgacaatgcatgtggctttgtaggatcattccggccagtgtcatagttcttaatcctcttcgtcaagaacccatccttattcccaagaaggacctccatcgctgaggactccccaggctcgcaccagttaatctccggcacattctcagcctcactgaagatgctattgatcagtgcatcccagtcaacactcttcggctgctccatgcaccaaggcgcccactgcggaacctcagggtactccaccagatactcgtttatcaccttgttcaccttacttctaaaggttttggccgagtactcgagcttccctgacgccgtccagacaggcactacattgtgtgcgtccacctggtgcacggccatgttggcggcgtcacgcagaagctcctggacgacagcatccaatgcctcccgcaccggccgcagcggagagaagtcggcgacgagcgccgaagccccgagccgccgcaccaacgacggcagctccgcaggtccgccctcgagtagaaagaacgggaggccgcgggcgtgcgcatcggcggcaaggcggcggagcccgcggaggaggaaacctagctggcggaggtgcgcgcctaggaggaaaggccgtgggaatagcgtgaaagcgatggcgagcggcgccgcgggggtggacgcagcggcgagttcggccgcgtggaggagggcccagttgtccgcgagacgttggtcccgcagcatccagtacaccaccggcccgtgaatatggcttccgcccgggtggagaatccgcacacgggacgggtggaccaggcttgggatcgccggcggcatcccggcggtgggacggcgtctgcgcgtaggaggggaagtcaggaatgtaggcgtcgtttggggtggtgggcgcggtgttgggtgaggcgtcttacgaccgcggttcaatggaagagactggtggcggttcaatggaggggaacccgggagcccacgagacggcggttcaatggaggagcccgggttggtggtagactggcag

SEQ ID NO: 14575 - DNA, 717 bp, Zea mays
gcacgagaccattacccacgaccgagatgtgtatctgtgattctggataggggcgctggcaccgattggctccggatatcgcagcgtggcggtcgctcagttcagtccgccatggaaggtgcagccggccaaatgctcgtcccgatcctcggcatcgttgccgtggccgccgtgaccttctacaccgtcagcttcatggagatgcgagacaaatccttcgaggagctcgacgagaagtactcggacttcgacgagtcaggcgggcggcagcggcggtctcgccgcagggccgagcgcgacaggaagaagtccaaatgattggccacgccgccatttgtgtccctgctggtttgagaggggactgacgggggatgaagacgcagctgctacttacaaatttttgggtttcaagtcatgggtgagtgtgagtgtgtgtggttatgaacatctgcctatttcctagctattagccactgaagcagctaaaacgatggatttatttaaaagatcgactccgtaatacattatgataccctctgttgtgctttcagttctgtcatcgggacttataaaacaaatttcccatggattgcttctaaaaagggcagtaggagcgccgccttccctttgcataagcttcacgagctgttgtgagtcttttttttttttgaaaaaaaatagtttataaaacagttttacgggcggggaaaaaaaaaa

SEQ ID NO: 14576 - DNA, 2482 bp, Zea mays
ggtactagtcggcgaggaccacgtgcacccgccaccgcgccgcgcggctccaccgttcggcggcgctcgggcacggcacgtcgcacggcacgccgtaaaaccctagctcttgcgccccctcctccccaccgcgccggcgagccgtggagacgcggagctaaggatgccgcggaccaccgtggtggagagccccggctgcccgccgctccgcgccctcaccaccgacatcctcggccttgtcaaagtcgtcgaggcccacgcgaggccggcgggtgccgccaaggtcgtggagacgtggggcgcacccgacgcctcctgcgccatcgtcgctgcctccctcgccgatcgtgccaccgaccccgttttggctgtggcgaggaagaacggcgtggttgagttgctgaatcccctgaacggagatactttggctgctgtcaatgcagtggggccagcaccaaatgatggtggcgctgaaggtgatcccctcactgcattgcaccttttcacaagacaggcttcggactcgatcttaggaacgtttcttgcttgcactgagcaggggaaagcttctataaggtccatcacgaaagaaaatgcagcttcgggctcacatattgagccatctgctacatgggatgtgtgcggtggggccaatgtgcaattttgctcagttgatcatggtgaaaactatgtgatgtttggagggaaaggtatagaagtgagtttgtgggatattacatcttgtagtaagacatggtctgctaaatctccccgagcaaatagtcttggcatattcactcgaccttggttcactgctgggaccttcttgtgcaagaatgatcatcgtaaaattgttgcctgcacaaataatcatcaggtccgcttatatgatactgcattgcaaagaagacctgccgtctctgttgattttagggagtcaccaatcaaggcagttgctgctgatccaaatgggcatgatgtctatattggcacaggaacaggggaccttgcttcctttgacatgagaattggcaatatgcttgcatcctgctatatgttctcttcttaaacacataattgagaacctgatcatatgatattctttagaatgttacgttagttcagtttctatttgttgtaatgttggatggtttcaactggcattgcaccttctgttccactgttgctacttagtttttttccagctagccagtaatctgcaaccaaggcagtattacaactaaaacaatgctgacctacatgtgtactgaactactgataggaatactcattgggggcaggatgaatatacaatataggctataattcgtgtaaaactgttatttagatggtagttaaggacagaaaataggctaccagtaacacttgtgtaaaactgttgtttagatgattgttaaggagaaaaaaatcattatcagaaacgctgcagcaggaagagaatggttgcaagaatcacatgtgcaagcagcgatgagctaccatttgacagctttattaattattatcagtattattattacgatttttctctgttactaaaattgtaaaaccaatatttccccctttttttcagggaaattgcttggatgctattttggcaaatgcagtggaagtattagatccattgttaggcatccagatctacctttgatagcatcttgcggactggatagctacttgcgtatttgggacacaaacacaagacagttgctatctgctgtctttctgaagcaacatcttacaactgtggtccttgattcacatttttctgttgaagagcctggagagatgaaatccaagcaactggagtcttcagtggagactgaggctgaagtccgaaaagaaaagaagaaaaagagtaaggcaattacagaggatgagactgaggcacaaatccgaaaagaaaagaagaaaaagaagagtagaacaattgaagaggaagaacaagctggattgttcgaccatagcgatattaatgatgaagtatatgccagaaaagaaaagaagaaaaagaagagtagaggtattgaagggggcaaggagcgagacagcgacggggaaatttgcagtcccaagagaagaaaatctggagaaagaagcaaatgcctgaagaagaggagcaagaaacagctggttgcctagtacaagtatcatttctcattacccgccttcttgattttgcagaattacacaattttgtgtggtagtttgttcggaattgtatcccttttgaaaccctgcaagggaagtgcatcattttcgtgtgcgcatttttttactctggtgtagctaaattttgagacatacacgctggagtagttacagccaaaacttgaaactaatttttgagatagacatgtgggactaaatttcgagatatacgcgtaggagtttctactataaaagtagaaagttttttgtcttccccaaaaaaaaaaaaaaaaaaaaaaaaaaaaaagac

SEQ ID NO: 14577 - DNA, 1879 bp, Zea mays
gcacgagaccattacctagaacatcctaatcgaaaaacactctgcgactgctcacgccaccacctttgtttgtttgaggaaattctaagcaccacctggccaggctgaaactctagcgcgactggctttttccacggcccggcccgtcaaatccatgtactgtactcgttgtccggagaacgcgcccctgccacctccgcgcgggcacggcacgtcgtagtaaaaccctagaaaaacagtagcccaccgcgccggcgagccgaagcgagcgcggagctaaggatgccgcggaccaccgtggtagagagctccggctgcccgccgctccgcgccctcaccaccgacatcctcggcctcgtcaaagtcgtcgaggcccacgcgaggccggcgggcgccgccaaggtcgtcgagacgtggggcgcgcctgacgcttcccgtgccatcgttgctgcctccctcgccgatcgtgccgccgaccccgtcttggctgtggcgaggaggaacggcgtggttgagctgctgaatcccttgaatggaagtgctctggctgctgtcaagaccgcggggtcagcgccaaatgacagtggcgctgaaggtgatcccctcgccgcactgcatcttttcgcaagacagacttcggactcgatcttaggcacatttcttgcctgcacggagaaggggaaagcttctatcaggtccatcacgaaagaaaatgcagattcgggttcggatgttgggccatcagccacatgggatgtgtgcaatggggccaatgtgcaattttgctcagtagatcatggcgaaagctatgtgatatttggagggaaaggcatagaagtgaacttgtgggatatcacatctagtagtaagacatggtctgctaaatctccccgagcaaatagtcttggcatattcactcgaccttggttcactgctggaaccttcttgtgcaagaatgatcatcgtaaaattgttgcctgcacaaataatcatcaggtccgcttatatgatactgcattgcaaagaagacctgccgtctctgttgattttagggagtcaccaatcaaggcagttgctgctgatccaaatgggcatgatgtctatattggcacaggaacaggggaccttgcttctttcgacatgagaacagggaaattgctgggatgctatattggcaaatgcagtggaagtattagatctattgttaggcatccagagctacctttgatagcatcttgcggactggatagctacttacgtatctgggacacaaacacaagacagttgctatctgctgtctttctgaagcagcaccttacaacggtggtccttgattcacatttttctgttgaagagcctggagagatgaaattcaagcaattggagtctttagtggaggcggaggctgaagtccgaaaagaaaagaagaaaaagaagagcagaccaactgaagaggacgaagaacaagttggagtggtcgaccatagtgataataatggtgaaatgtatgctagaaaagaaaaaaaaaaaaaaaagaaaaagaagagtagaactattgaacgggacgaggagccagacaacgatggtgaaatgtgcagtcccaagagaagaaaatctgtagaaagaagcaaatgcctgaagaagagcaagaaacagcaggtcgcatagaacatagaacaagtaccatttatctcagtatttgcattcgcttgattttgcagaattacacaattttgtgctgtagttgttttgaacagtatattccttttgaaactatgcaagggaatttcgccgtccattctacgagatacttttttttatggctgcaaaaaaaaaaaaaaaaaaaaaaaaaaaaaactcgaaagagggcgccggtacc

SEQ ID NO: 14578 - DNA, 2178 bp, Zea mays
atatatccacatagcgcacacctgcttgtgaaaagttcaatcttgagtgtcgcttgtttcaaatcccacctttgcttgctccccccggctcctcctcctcgtaccaaatctagggttcccgatcgaaatcctgcgccgccgccgccgccactgccgttggcgataatgtcggccagcaccgagcccgagaaggacgccgctgccgctgccgccaccgagggcgacgagaagacggaggcgaaggacagcggctccggctgggagctgctgtactgcggcgggacgagcttcgacgccatgggtcggaaggtggtgggcggggcgcagggcaacctggtgtcgccgactcggctgcggccgctcgtgggcgttgatatccgcttcgttgcctctggatgcactgcttgccactgtgttgctttagatgctggaggcaaatgttatacatggggtcgcaacgagaagggacagctagggcatggagatactcttctgcgtaacctgccgactgttgtttctcaactatcaaaatacaaaatcatcaaagcatgtgttggaagaaaccatacagtggttgtaactgatgatggcaaatccttatctttcggtcataacaagcatggacagttagggacgggttccttaaggaatgagattgagtcatcgccagtgtcctgtatcgttgcggaagcaaccaacgttgcatgtggggctgattttactgcctggttgtcatctgtggaaggctcttctatacttacagcaggtcttccccaatatggtcaactcgggcatggaactgataatgagtacaatgctaaagaatcgtctgtgaaactgacctatgaaccccagccccgtccaagagcaatagctgcattttctgggaaaactgttgtcaaagttgcatgcggaactaaccatacagttgcagttgattccaatggctttgtttacacctggggtttcggtggatatggaaggttggggcatagagaacagaaggatgaatggcaacctcgccttgtagaagtcttccagaagcacaatgttctgcctcctaatgccattgtctcagctggttctgtgagttctgcatgcactgctggtggtggacagttgtacatgtggggaaagatgaagaatacaggcgatgattggatgtacccgaaacctgtgatggatttaagtggttggaacattcgctgcatggcttctggtaacatgcaccacattgttggtgctgatgattcttgcataagctggggtgtcgcccagaatggagagcttggttatgggcctaacgggcagaaatcatcagcaaatcccaaaaaggtggacattcttgagggcatgcatgttacaagtgtcggctgtggatttggactgtctctgattgttgtggacagagcaaatgttggtgatcgacttggtcagctggaaatttatgatggtgacaccggtgctgaagtagagaaagtggaggtgcaagtaaccaagaaggcatctgccagcaccaactcacgtgccaacaagcgcaagaaaacgaaggatgtttctgaatctgaatccgaagaggatgatgatgatgatgaggatgaaagcggagacgatgaaaatggtggtgtagaagagtcaaagggcaggcgtggccgtaaacccgctaatagagggagaggcaggggaggcaaaaaggcgacccctgaggcaaagccatctggaaggggcagaggccgccccaagaaaaccgagagttctgctcagaaagccggaggaacctcgggcagaggaaaaagaggacggccacgcaagtgatggtccgccctacagtaatgcggcgttgaaaatcagtaacgcctgatgtgatcccattgacattgaggattcattttggtagcaatgcccgttgcactctgcccattttctcactctgattgttgcagctatccaatccaaagacattattagtctcttccccctcccccaatttccgaaatggggtttgccatcccattgtaagtctagaaatgcttaacatgcacatctgtgttcttcattgacgatgattttcttcagctttaggctattaatgaacccttgattcgagtgatttaaaaaaaaaaaaaaaaagcccctagggcctttttaaaaaaaaaaaaaaaaaaggcccctagggcc

SEQ ID NO: 14579 - DNA, 1338 bp, Zea mays
ccggccgggaaaaaaaaaaaaaaagactggaaaagcatcggcacgggcggtaggataaagtagcatagcataccacaaaaggtgctgcttgacagatggcaagcttcccacacctcacgcagatggagcatggcctagccagtggtgcctcccatggcacgccgagcttcttcttctgccatggcacagccacggcggattcagcctcgctggagacctcgtctggtgttctcgacacctccccacgaggcacttcttctgacgacaacaaggcctgcaggaagcacaaggaagatagtggtgccagcttcagctctgctcgctccaaggactcaaactcaaaggaaagcagcaaaaggagcggaggaaaaagagacagaagcagcaagaaggtggacgaggaggagcccaaggggtacatacatgtcagggcgaggagaggacaagcaacggacaaccacagccttgcagagagggtgaggagggagagaatcagtgagaggatgagggtgttgcaggccctggtccctggctgtgataaggtcactggaaaagccctcattttggacgagatcatcaattatgtgcagtccttgcagaaccaagttgagttcctttccatgaggattgcttccctgagccctgtgctgtatggttttggcatggacagtagtgatgctttcagtgaccttataactcagaagatcgaagggatggcccaccatgaggcgttcgcgatgcctagcagctctgtcctgaacggcactccgtcggaagctctcgtggacacgcacacctccagctcctccccgtcctacgaggtccacggcgacggcggcaccgccagcgtctctttccctcaggacagtggcagctacatggtgcaaacagtaggtgagccaaggcaagagctgttcagccaagtggtgttcagtaaccacatgtgccctttccagtagggagagagcgagaggatggaaggacgacaggaagcaataatgttgagatcctatggaggtggaggccaccaccagacgagtttgtgatgttggacgcaatccatcccctcgtcggtggccgtaacgggaacccctgcggtagctagcattagcagtagtaataatagtaggctgttggttacatcatcctgttagatctcaaggtctctgtcggtaccgcatcatctagtaggcattgttgctgcttagcttttgggctctcttattaccaagggttgcatgcatgccattgtattgtactctccaattggaaaaaaaagaaaaaaaatatcatttgttcataaacacagtcaatttgtgctcaaaaaaaaaaaaaaaa

SEQ ID NO: 14580 - DNA, 1456 bp, Zea mays
gaactcaatcctgttgttgcttctgatgaactcctccttgccaagaaaactactacactgaaaaggcgtcggcacgcgggcggtgaggatagcgtagcgtagcgtagcataccgcaggcgctgctggttgacaaatggcaagcttattcccacagctcgcgcagacggagcacggcgtagccggcgcctcccatggcgcgccgagcttcctgttctgccatggcgcaggtgcagccacggcagactcagcctcgctagagacctcgtccggtgttctcgacacctccccacgaggcggaggcgctgattctggcggtaggaaggcccggacgaagcccagggaagacagcgccagcgccagcttcagcttcagctctgcgcactccaaggactcgagctcgaagggaagcaccaagaataggggagggaaaagaggcagaagcagcaaggaggtagaagacgacgaggaggagcccaaggggtacatacacgtcagggcaaggagagggcaagccacggacagccacagccttgcggagagggtgaggagggagaggatcagcgagaggatgagggtgctgcaggccctggtccctggctgtgataaggtcactggaaaagccctcgttttggacgagatcatcaactacgtgcagtccttgcagaaccaagtcgagttcctttccatgaagatcgcttcactgagccctgtgctgtatggctttggcatggacactactgacgctttcagcactgatgaccatactactcaaaaaatcgaagggatgctccagctccaccacgaggcgcttgcgatgcctcctagctctgccctgagcagacctccattcgaagctgtcgcgaacagcacgcacgccaccgcctcctccccccggtcctacgacgagctccacggcgatggcggcggcggcggcgccggcatctctttcccgcaggaggacggcggcggctacatggcgcaaacagtaggtgggccaaggccagagctgttcaaccaagtggtgttcagtaaccacatgtgctctttccagtagggcgagggttatgagaagacgacaggtaatgcagcaagcaaacttgcaggacggaggagatgatgctggctgggaggatatatgatctatttgggaagcgtgtgtgtcgccggatgagtctgtgatgttggacgacgcacgtagtccatccccttgtctggtggccgtaacgggacggggcatgcagtagcttgcaatagcattatttagctgttagatttgaggtctctgtcgccatcgcttcatctaggctctggaaaatcatctgttcatacacaatgttaatctgtgcttcctgaacttcagatgtttacgggattggaaaatgggaagcattttgtttgctcgaaaaaaaaaaaaaaaaacaatataaataataaaaaacaataaaaattacaact

SEQ ID NO: 14581 - DNA, 5438 bp, Zea mays
ggtctgttggagatgctcttagtgcattcactcactcggggccttagaatgattataggaattggtttattttggaagggagcaagtatatcggtcgacaactttacgcgaacgggcatgtgcctacaggaccgaaaaacatcccgttcctatcgacaagaagaagaaaaggactgacccttgtattataatccaatccacataaagacttgtttgacgagacgagcaaagggattaaatgatattgagggattgcctttcaattcctaccaaacaaggactgaggggattaaaatcctcttcgtattcaaattaaatagaaagtagattttagtcttccgatctcctgcaattcttactctcagataagctctaaatgcacttcgcctcagttggaagccacagaaaaacaaaacaaaaggtgctgccagtccgccacgcgaaaaagaagtcagtttcgcagttcgcagcacgtagacgggtcgccccccccgcccgcccatcgttgtcgtcagctccgggcagccgaaaccggaaacctcccgttccccatccccagtcggctgtcgccgtggattcagcggaacccccggcgcaaaaacaagcattatctgggagcccagcccagatgcgggcgcgttcagccgtcagccacacacgcagagacacgcacggcgcaagcgcaacttggcgcgagaataacagaaaaatatgcccactccacagctggtgaccactgccaagcgaaaggaaccggggcgatctgcctcctgggggaaagatcttgttcacctggacgcacgcgcgcgcccgcgcccgcacggacgggggccccgcggcctgctcctggaccgaaatcttcccttcccagcgcttttgcatcatcctcgtcgtcgtcgtcgtggtggtggcacctaaaagtctacgtacaaggtatttgcccagggtcagcttgcagagacaagaagaaaaaaaagggggggagggggtgtccactccactgtggccagtgggcactggcagtccccatcggctgctgccttttcgctgcacattcagcaaagcagagcctataaataggtacgtccgtcgcctggtggcatgcacaccactgcaccgagcttctccatctccagagctacactgactagggaactgctttgctggcttggaggttcacgacgaggcatgccggtctgcttcttaccagcatccatggcgggccaggtgcagcggacggcgccgtcctcgtcctcgccctcgccgcggcagctgccggtcatcaaccttggcaggctcgggaaggacccggccacgcgggcgctcgccatccaggacattaccagagcgtgccgcgagcagggctgcttccaggtcagtgcgtgctgcttgtctgttgctctgtccgtgtcctcccaacacttgttcgctgacagtcacagtgaactcagtcagccagccagcctcagccagccatgagtattctctaggggaaaaaaaaacaaagacacacgtgtcctgtgtgccctttaaaacaagtgtcagtcacccatgcagctcacgctgtgacccaagctgaccagcttacttaccatggaactttaagcggcaactcaccagtgatcaagtcaacaaactccatgttgtgcaaacctcggattctggtgtgatgcttcagtgccaatgctgatcaatacgctaccatatccttgtggtgccgattgacaggtggtgaaccacggcgtcagcaaccccgtcatggcaggcgcattcgaggccgcctcggagttcttccagctctcgccagagcacaaggagctgtttgcatcgaccgacatcggaaggcctgtcaggtatgacacgagctcaagggacgggatcagcagggccaggtcgttcctgaagcactacgcgaaccctctggaagactgggtccagtactggccactgcaccctccatcatacaggtaattaacctgcaaaaaaaaacaaacaaactgcacattgttatgaatatatacatcacaattgtttttgcaccagctatcctaattagctagctccgccattctttttcttgtctaaaatgactggcaggaagaaaatgggggagtatgcagttgaaatacagagggtgtcaatgcagctcatggacgctatcctgcaaggtttagggttaaagccgctgtacatgcaagagaaacttgacaagggagtgcagttcctggccctgaacagctcccccccgtgcgcgcacccgggggtcaaggtcggactggctcctcattccgactatggcttcctcacaatcctgatgcagagctccccggggctggaagtgatgccccatgaccgtgacacctggacgcccgtccccgcgatccccggggccctccatgtccatgttggggaccacctagaagtcttgagcaacggtcgtctcaagtcccttgtccaccgagccattctcaaccctgatgaagcaagaatttccattgccagcatccatggtctctccaaggacgagaaggtctgctgcgccgaggagctggtcgacgaggtgaacccagcaatgtacagggagagcagcttccaggacttcctcgacttcctaccgtcaaatatcaacaactacaagaggtttgttgagagcctcaagatcgacagagcttgagaagaaaagcattggttcggttccgctgcaccagaacatagctaaatggcattcttcagatacgaatggaaagccagatgataccaaaaataataataaaagattggatgtctttcaattaatagggtattgtgatgagaagacgggtctatatggcttgcagcattgctacattgaagatacagattcatatagacatagcaagcacattggcgctgctatgtgtattctgcagagcaggtctctccaagtgatgtcgatgtctctctgcaaattaaagagtctagttctacatccttagtactaaaatgctcatttaactatgtccaaacggaggagagccggccggctatgtactgttgcgttgtaccatatgtgtagcgtgtatctcttattactactactagtctactactgtatctgcagtgtatatgcagtcaataatcgctgcaggtaaggtaaggtaaggtaatgtatcagtagagctgcacccgcactcagcctggctgcatcaagctggactgaggtcccttttttttctccttttctttctttggggaaatgcattgtggctgcatgtctctttcactaaaaggaggacctggggaaccttgctaggtttttcaggttgtttggtcctacactatgtgtataccaatcttgtatcagctacccaataaataaagtctaataactattgcatgagatttgctgcccaccatatgtccatatcatcatagcatacattggaaaggtttttcagttatctgaaaaaaacaaaagagaagtgtgtggagatccatgaaaagattgaccagcatgattgaggacacgacccgtttatgtatgtgcttgtgcttgtgctcgtgcagtcgtgcttgtgagcttgtccttactgtcagcggtattggccgacagagcaaaagtagatgtaaacctgagaagaagaagaagaaaaaagaggaggtgggcaatgcaacgagaaagagaagtgcgatggtacacggcacatatataagggtcattttcatgcagtccctattagccaataattcaagacggagatgtctgtttcagctgcagaaattcaacaaaagctgcttgcagctacagagggcaaaaaaaaaaggatcagcaaatgatcagatcatgaaggcacatgaaagttcaaattgaactgcaaccaaatccatatggcatgacacatcttttattggttgaaaatgagcagaggactgacgaagtgtcaattttattttattttagtcagttattttagtctagaatgagctcccccacctgaatgttgtggtgtttacctttgctgattgctaagacttgggcccttgggcaaggcccaaaaactaaaagaagaagaagaagagtgtctattttattttccagatccaggatgagcctgcccagccttcgttgaaagagattatctgcttggatctggaaggacagggctggaagggaacccattcttcttcagtttgacttgactgcgcggagcatttatccattgcaaagtcacatctgacatctcatggtgggaggtaagtatgatacacacctatagttgtttccttttttactttcccttttcctaaaatccaatgattatattttcatagggtatatctgcaaatttcttaataacattaatttgctgctagaaaaaaaaaggaacaacaaaacaatttgagtttaaaaaacaggaaggtcaatgtgaaaagaaaagacaaggaggtagcactcttagaacaaaattcgtttgggtactcacaaaatacaaaaaccaaaccaaaccaattctcctgtgacaatgaatgaagaatacattaaaaggggaagaggtttctttttagcacacgcgggacacgcacgcgcgtgtggcgacgtggcagtctgcaactcgtcagacgaccccgctagttctgcaactgccaacgaggtgaggagaaaggtggatcgcacgaaatacaagccagaaccggaacactgattcctcaggaaaccctaggccaaaccaatcgcaattaacgagagctcacgccggcaccggcattactgagaaaatggagaggagaacgaagcagcggtcgagcaagcagcaggtgcggaggggcgctgagctgaggctgactgaccagtacgcggatggggggtgcggtgcaggctcggacgaccagccgcatcggcgtcatgtccgccgcgcccgctgctctgcttcctcctcctctccgcgcccggagggatggattggatatgggtcaggctcccgctccgcgcctccgccccgccctttttataggcgtcgtcttggcccttccggcgtctccgctctggtagtcccgtccccctatagatgtggccagccatgccaggccttaaaaggaaggagctggcaccagacacgtgatattaacgctctcgtgtcgtgtccgtatacgtccgatcagtgatttgtgtcatgtttatactagaccagttagatgttaatatatttctacaattttaatatattattttctctgttctttgtatttatcatattttagtttaaaatgaactaaaatatttgttcaagtacattttagttcgttttgagtccagtccgactcgttgtccattagattcatgccgactccgtctgatcgtcgtgccgtgtctaaggcttagatgcaatatgataggctagacccggcatagccggttttactttagtaaaaaaatctcatattatgattgattatataat

SEQ ID NO: 14582 - DNA, 4441 bp, Zea mays
  misc_feature (501)..(501): n is a, c, g, or t
  misc_feature (1761)..(1761): n is a, c, g, or t
tagccaaaggggtgttttctttgcctcatccaccgctggttccagtattaatggctcatgaaactctaggatggggaggtttttttctttctttttccccagtattatgtgaagcagtcactcattatgaaaataccggtattactgcactgataatttttcagagaaataaaacccttctttttttccggaggaatggatcaaaggatggatgcagtgaaacatagagtgctgcagaaggggagagagatctcatgacagtttcacctctcgtgagcaaagtaaaattaaaccctgcctttgataagggtgaaaggctgacagcagcagcgagtgaaagagatgaactttttagtctagtccactctgccctgcctgcacatgtcggcgccctaaaggcctaaacccctgccctgctctctcacacacacatgtcgtcaccccacaggcaaaccgcaatggaccacagcttaaacatcgctgtgatgctcatgcatgcangggttaacaactctttctgaccatgatgcaaagacgctgttaccttcataacctagtgctgccaaggacaagggtggtggtggtcagtggttccagttttcccatgcgatgccattcattcactgctgcagagactgcagcagttatatatatatattgtcttcgcactcatccatccgtgctagataaaatagtgctgcagatgcaaaccaaaaaaaaaagaagaaaaaatccatttgattgatagagaaacacgaagcagccctttaatctgctcgctttctctttcatccatgcctgcccggctgcccctcccctgccctcatcatggctccgctcccttcccttctccctttatcgtctcgtctgcatgcaccatcgccgcagctaaagctcgctcctgccgccgcgcccgcgcgcgaggggttccttgatgccgcccagctcccagatggtggccatactacaactcacgctcctactcatttcatgtagcctttacagcatgctgcattcttcttcttcttcttctccttcctcctcctccccctcctcggcaccgtcctcgctcgcgttgctggtgctgctggtcgtctccacctgcctctccttgctcttcgccagcctcagaaggctactcagagacaccaccgcccacagagctaaccacagggcgccagctccttccatggaggcggaggctgcggctgcggctgcggctgtgtttccggagaagagcgttgtgtcgtcgtcgccactgccacagggcgaggcggcggaggatttcacggtgggcgggagcggaacaagcccgtcagattcttcggagtgcgcgacgaccaacgacgacgaggacgagggcaccgaggaagaaggctcggtgtcagacgaaaccgacgccgacaacgacgacgacgacgacgacgagagcctcattgagatctcccttgtcgacggccactacgtgggctccgagcagcgccgcgcgtacaactgcaactacaagaaggacctcctcgcggacctgctgccggacttgctgctcgacaggagagacttcatcttcgacatcttgtcggagatcggcgaggaggacgacagcctgatcgagatcgacctcgcgagaggctccatcaagtgcgacgtcgtcaaggcgtgaacatgaaccgtgtgtctgaaacctcccgctgcatgcattaatttgttcaaagctctggtctctctcaggtgcccctctttgcgagagctagcttattatgnatgtcttttcttcgtggtggtggtggtggtgaagccttgttttgtcttgtactctgtttcgcaaaataccaccgcagcagaaataacgtgattaattgcacatattttgctcaaacgaaatgtattcttggtctttccgcgcattcaatagatggtaattgtgtcagcactgcacgtttgtttgtgtgtgtgtgtttttttacattgatctggatgtagtttgtggggtaattatgccatgcgaaaagactaaactgcttgggttagttggtgtagagatagggtcaactttttctgtccttccgaatcaaaagctcaggaccaattgtttagcttgtgcggcagagtccgtccctcccttcttctttttttacaattacaaagtttggttctttgaaaaatcccaaagaggttgggatctttatgatgattcgggcctctatcattagcatcagcactcaagtaccagtgtcctctaaactagcactactgctatggtttggtggttaacgggtactgtatgcttaaatatggacacttattgttgagaggtgcctagctagttagctggaaaagatcactggatttcgaaccgttcttgttcaatcgttattcagagggaagtatgcaatgtaccccctcccctttattttgaattgtatttagcctttctaaattattagagtttattgtgtttagatcatttacttaacaatgaattccagaataaactgataactgataacataatttgaaataaaaaaagatatgatttaactcccctcgaacaccggtcaaatactatttttaaaggctcggatactactgttccaattgttgcataggggataacaaatttcagaaactgagtctcgagcgtaccatggatacagtctgctctccgttgtatcaggctgctttctcttctcctcattcgctactccatttgtgcatggaaacgatgtctcaactctcaagtgtcaagtgctgctactagacggatgaaggtgtaggtgtagtgtactgctctaagtttctaactgtggggttcttgccaacaggcttaggtcaatttattttgcagtgagttcggctactgtcacttttggttttgtgttgatgtttctcaggcaggaggattatgtcagtattcttactgggaggatatgatgggtgtcgcggatatgatggtggcggcatgttcttgcccggcccatacagcaacgccaggcgttcgatcgatttcctatgcatgtgaccaggatcatttgccttccggtgtcaggaaggctgccatccaagcacgccctacctacgccggttcttcctgttgtttccgttgcaggtccaacagcgattcaggcagtagcaagcaaatttccaagtccgataagaacacaaaggcttggctgaagcaaaggaccttggatcagctaaaatggatcaagaaacttgtttgcgtttgcgtcctgcttgtgttgtatgtggcgtatggaataagtgaaccgatgatgcaatggagggcgtagtgtttgcagcagttgtggcatgttttgtatttttctgctgcaagtgtaattgagccaagtgcatgatgaatgaatgtagtaatttttttttagtttcataaaacatgctcatttttttgaatatacgttgttcttagctgcagcatgtcatgtagaatatgaattgacattcaactacgcatatttcgtccagattaaccgctagctagaacaaccaattttcacaaaccagtcatagtttttggtcatgagttcatgacacagaccagaccattgttttggtcatgcacagaccacacgactttaaaaaaaatgcaagttttggtcaacagtcaacacacagaccacacgagttacgaaatataggttttggtcatcacagagaccgcatgaattacaaaatattatttctaccatcacacagaaaactaattgtcaagctgcttcctcttgcttctggtacccgtagctcttgtattcatagcaggactgtctccactgtgttgcttgcctacgactttatttttcatcactgcattctctggtctccctttgttctcaactgcgttgatctcttcagcagtgccgagagactcaggttctggcccctattgtggctccacgctagtagggtacaaaatgctcaaaggcacaggctctagtctactagtttctggctggttggagcctgttccagatcttctaaaaaaaggagtattaattgggtcagttcatcaataaacctatagtacaaagaaaatgtcaagaacatgagcctacctgactgaagctgttgaggcagaagatgagctctttgatttcttagaagtagctgttgttttggatgtggccctcttatttccagcagcttcattagttttgtcagttgcacgaggaggcaaagcagggaatagcattctggtaggaatatgaacaataacaatgcttgttccagttgaggctgtggttgccttcttccttttagctggtcccctgcaatagataaatagaatctatcagtactaatagctatggcacatacaacccaaactaaagacctcaaacaaagaacctaacctatcggcaagttcacatacaacccaaaataaagacctcaaacatggacgaaaactagtgccaatcataatgga

SEQ ID NO: 14583 - DNA, 988 bp, Zea mays
actcctaagggcgaatgggaccctcgaggccggccccgaagggcgacccgggattcctgtccccggccgggcctcggaatcagactgacaataccgtcctcaggacaaggcacctcagaagcccttctcgtccgcgccgcctccttgaccccgctggccggcgagctgctcagcgcggcttttttttgcatccacaatgccgcagcttggcacatgttcattgcctggagctgcaatctatggcacttcaactaggagatttggaggtttggagtttcagcaacataaagttaatcacatctcatttggtcggaaagcgtctgttaaagcaacattgaaaactgtgagatgcaatgccactcaaacacaaagcgtccaaaagaaatcttcaagtgcaactattcagcgtgataagaaaggaaatgtacaagggccaaaactggatgacggaagcggtgggttccctccattccgctttggcaaaggtgggggtggtggtggaggcgggggaggtggcagcaactactttggcggattccttctcttctcatgtgtgttgctcttggactacctgaaggaattcgagaagtacctgcttgctcagaggcaccgagctggagatgatggcggcaacgggctgttgcaggcatgattgctttccgctggtctcactggcactagcagctactagtttctgatctgaagtgcttccttttgaacataacatgtgtctctgggttaaaatccaactgcaattgattgttctgggaacttgctctgccaaagaaaaaaaaaaaatcaagtactgtggaaatcgtctgctgcgtccacgccaactttctcacctcgtcttcagcaaggttcataggaagttaggaacacagtggttaaaactccaagctcttcggaggaacttttttatggtcataataaggaaaacatctcctaggatgatgggaagttcatagtcaaaaaaaaaaaaaaaaaa

SEQ ID NO: 14584 - DNA, 2245 bp, Zea mays
  misc_feature (1)..(81): n is a, c, g, or t
  misc_feature (88)..(88): n is a, c, g, or t
  misc_feature (91)..(92): n is a, c, g, or t
  misc_feature (94)..(94): n is a, c, g, or t
  misc_feature (108)..(108): n is a, c, g, or t
  misc_feature (110)..(110): n is a, c, g, or t
  misc_feature (118)..(118): n is a, c, g, or t
  misc_feature (140)..(141): n is a, c, g, or t
  misc_feature (149)..(150): n is a, c, g, or t
  misc_feature (157)..(157): n is a, c, g, or t
  misc_feature (162)..(163): n is a, c, g, or t
  misc_feature (169)..(171): n is a, c, g, or t
  misc_feature (174)..(175): n is a, c, g, or t
  misc_feature (178)..(229): n is a, c, g, or t
  misc_feature (231)..(245): n is a, c, g, or t
  misc_feature (247)..(344): n is a, c, g, or t
  misc_feature (346)..(459): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnttttttnttnntntttttttttttttntntttttttntttttttttttttttttttttnntttttttnnttttttnttttnntttttnnnttnnttnnnnnnnnnnnnnnnnnnnnnnnnnnnnnnnnnnnnnnnnnnnnnnnnnnnntnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggaagcccctattttcccccccccccccccccccccaataataagagccttgataagcacctttctgatatggctgcagcagttccagaaccacaagtgggtgatctcaccaatttgttcatttaaatgttcctatacagctgaatctcatggggttgagtggcatatcagatatgagataatcaaaggaatttgccatggtttgcattaccttcacacagattgccaaattgtccatttggacctaaagcctgagaatatattgctagatgacaacatggagccaaaaattacagattttggtatgtccaggctctttggtctacaacaatccaaaatcatcaccaaaacttgtggaggaacacttggatacatggcaccagaatacttactaaaagggttgatttcagtgaaggccgacatattcagtttgggcgttataatcatagaggtgatgaccggaggccggaattatcccacttgtgaaaaatcttgcgagcaattcgctgttgatgtggttggacgttggaggaagaggttattggaggaggcaggaaggtacacacccttggaaaaatacgttgagcaagtagagacatgcatcttgataggattgatgtgtgtcgatgatgatcctaacaaaaggcccacgacattggacattatcgaaaggcttaccaaagtagatgtcacgaacacggacagagggccacccaaaactctggaggccgcgacagggcttacaggccaccccaacctcgcaactagatcatttcttgacaggttccgccgaaccatcgtgatagggatgctgaagaaggccctgaaaatccaggacgtatcgcagttggagcagctcctggccaaggaggtgctgctggagctccacaaaatcggcacgaatgcaactggaaacagatcgttcctggagaggctccacgcaagcatcaccatggctacgctggttcaggcgctgcattccttggacttggatccatcggcggcgctgcgtatggaggtgctgttcttggcgctggagaatatgcgtggaaaaaacaactcaaggcgaagaagcgaggacgtccttgagctggaggagcggccagagcagatccggtcggtgctggaggctggcaccagggccaggctcagtgatgaggaacacatgccgtcggtgtctgtgcaggctgaagaccaggcctttcccaaaccgaagttggccaaagtacgcgccaccgccccggtgtgcgtgtcagcagtgtggttggcggccggcataggattcctgtgtggattcaccctaggagagatgaggggattaaggcggacgagggtccacgaacgcacgtgatgccaatgtgcccacatgacatggccagaaaatgtcactgcggtggaccatgcatgcacgaattaaggagcaccagttagaatacgtattctagattcattttacaaattctgtatttaaaaggaacttgtgcattgtgacagaggcggcggactggatcaggttgtattgtttctgctggtgtcctggcgtatgtataagccacggagtgtatcggatgaaattgaacagagaaatgtgcaatatagaaccgtgttgagggcagccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccccgggggggggcccggaacccaattcccccaaaaggggggcgaaaaaaaattcccggggcgg

SEQ ID NO: 14585 - DNA, 698 bp, Zea mays
cagatggtgctgtgtgcgctggcaaatacctttcagcattgcaagaaaaaggctactactctaggagagctgaacaaatcatacatcgagatttgtagatcaacccaagttccagcacttggaatgcttgaattttctaacatgtgtatggttttgagtgatcaggggttcatgaagttggggcaatccaaggaagataagcttaggagagtaacacttcagattgacagttcagatatcacttttgcctttaagggaaatcgtttctttcaaaaatgcctggagcagcgatgctaaccagactcaatagtagatcaatacatgtagccaattgttgttatacactatagtattagtttattgacattatcaagtaccatcagtttcaaccctggatgtatactcaggtgctttcattcaacatgatcaaaccttggttacatcacgaaactcttccttggagtgcagagaagtgtacatgtgacgagttatgacagtattacgtgacataatttttccaaaatatagctgagtgtagttatgttttctcaatttttggttcatccagaactgattgatcatgtagctaaccatttagcataccaagaacatttattgacacattccttgctggaagttgacaccagtaatgagaaaatgcaaataattaatttgtccaaaaaaaaaaaaaagggcgg

SEQ ID NO: 14586 - DNA, 1697 bp, Zea mays
  misc_feature (1125)..(1125): n is a, c, g, or t
ccgaacaagcccctaggcgggaatcgcaatctcaggatccagccgagcactcgacagtcctaaactcctaatccggtaatgccctccgccagattcccattcccaatcctgcccttgttctcccttctctctcttttttttatgtatgttcatgatggcgtatcaggctatcagctaacagatcggtgacggagttgcaccggtcataccagcataccactgcttgtgctagtttagattgctgcttgcttggatcggaagatactttgtggtttgtacgcttctagtaagcgtcaggcgtacgcagggttgatcctttgcttaccagaagatgcagttgaaggggggattttggatgcaacggagtttggaaacttcttgcgtggatacgcatggactgctcgagagctcattcgtcttgcagtagcgggcaggcaagtcgcatggaatggtggcggcagttgtcgggcggcagcttagctgcctaggttattagtagatctataggagttcgccggtggggttagcagcggctctagaccgtgtcttcttcctccgggccgatgatgtgcccatgggaggcgccgccggttctccttcccgagccagccgtcgacgtgcttgacggggtcggatttctctatgcccggctcggcgaggtcacccgaaccattcatcttcctaacgcaccccttggtgactgctaaaagtgtaacggccattactggcccctcctcatcggtgcagatttgagttacgtttcctccggtcatgtctggcgatggtggattggattggagatgaagctctgcctgttgggagccatgtttttttatcgtacattatgtgtgtaccagtgttttccattgtagattttgtgtgtaccaggttcctgttatgtaatatgcatgctattcttgatctaatataagtcacctcatctcataaaaaaaaaaaaaaaacacaaatttagatgaggtttttactttctttatttttttatatataaaaaaccttcaggggccccagtgctgaccttgtctgcatcttgtgacgcttggcgtgtcaaccaactttggtcttcacagatcaggtctgctttatcactctctccagtttgtaatncatttgctttgcttggttcagtcagcatagtattttgtagcggggcattgttatagtaggaagcgattcagtagtgtcatgttgcactacgaagcatagtagtgccatgttgtgctacaaagcattaggcacacagactaatttgtatacattttttttgcattttgtgttctagagatgaaccacagtcaaggttctagaattattcgtggcaggggtagaaataaaaggatgtggacatcagatgaagatgacgagcttgtcaaagctttgtgtgagatatctgctgatcctagatataaggttgaaggaggggcctttaagaactgttactctcaaggcatagagaacattctttcacaaaagctacctggtcgtggtattaaagccagccctcatgttgattctcggctgaaagtgatgaagcggaagtattattcgatcaaggatatgatagcatcgacaggcttctcttgggatgacacaagaaagatgatccagtgtgaaaaacaacgatatgatgaatattacagagtatgttcttctgagtatctttgcacctgtatatttaa

SEQ ID NO: 14587 - DNA, 1767 bp, Zea mays
gctgacttcagcgagtgcgacgtgctaataaccacctcccgcgacgaggacgtgatcggcagcggcggctccggcaaggtgtaccgcgtccacctccccgcttcgcgggcgcgggcgcggctgcgccggcacggtggtggccgtgaagaagctgtgcagcagggggaaggccgaggagaagctcgaccgggagttcgacacggaggtgaagatcctcggcgacatccggcacaacaacatcgtgagcctcctctgctacatctcgagcgaggacaccaagctgctggtgtacgagtacatggagaacggcagcctcgaccggtggctgcaccccaaggacaacgcggccacggcggcgctggactggccgacgcggctgggcatcgccatcgacgcggcgagggggctcagctacatgcacgacgagtgcgcgcagcccatcatgcaccgggacgtcaagtccagcaacatcctgctcgacccggggttccgtgccaagatcgccgacttcgggctcgcccggatcctgctcaagtccggcgagcccgagtccgtgtccgccgtcagtggcaccttcggatacatggctccaggtgcgttcttaatcggccgtgcggcagtcaccagccggccaacccttctggtcttctcaggaggctgaaatgaatcgacactctgctgatctgctatggttggaattggatgcagagtacggacgcggcgccaaggtgaaccagaaggtagacgtgtacagcttcggcgtggtgctgctggagctggcgaccgggagggtagccaacgacagcagcaaggacgccgctgactgctgcctggtggagtgggcgtggcggaggtacaaggcgggggaccctctccacgacgtcgtggacgagaccatccaggacagggccgtttacatcgacgacgccgtggccatgttcaagctcggggtcatgtgcaccggggacgacgcgccgtcccggccgtcgatgaagcaagtcctgcagcaacttgcccggtacgaccgcaccgccagcgttgccggcgcgtgccaggacgaccgcggcgtcgaactgggacatctgcccaagggaaagcaaggtcgtcaccaagttgccaagagatcgttagacgccggatcatttttgggtggcgacgaggagagcggcaacttcgtggcccatcctgtttaaattttcagtttaactttactttttcggtatgacgttaaatatttctcgaatgtaaatttttgtggcttcccgtaatatgtgctgcgtgtacacgatgaagacgatagacaaattagggatttactaaaagtaagtgtctcaatttaagttttccatacgatggtcattgcatatattctaaacaaaaaccatagatttggtttctcgtaacttatgtagtcataatctgcgatttttatttctaagaataaaagatccgttaaaggttagtttgaaaacttaaatcttctccggattctcggagattgagtgaaaaattagctcattttcccatcaaccctagggaatcccggaggagatttaagtttcaaaactagtcctaaacaaaaacacgaacccaacaaaactgggaaaacaaatcactacagacggctataaacaattagctctggacctttacttctacttattgattgaaatcggggaaacaaatctctacagccggttataaacaattagctctacacctaatttacttctacttattgattgttgttgcgatagttaagtagca

SEQ ID NO: 14588 - DNA, 8041 bp, Zea mays
acaaacaaccttagaaaaattcagacgatatatggtaagcagcgaacaaacaagcccagctccctacaacagtcaacagagccgcggacaaagagattatctatgttagcagaatttacaacgtcggaccgggttttagcggtacaatttcgcgacaatagacagatgtttgaaaatgctcggaccattagtacagtaacgtgacgggcgcagcttatccaccatccttcttcttccctggccacggccgccaaacagcagtcaacaccaaccgcccccaccccacccccacccccacccgcgctcctcgtcgccgcccggggccgcctccgtctcctcctccgccccatctcgcggcctcatctccatccccttccgcctcccatgtgccgcctccgtctcctccttcccttcttcctcctcctccgccccatcccacacgcgtcccaaccggccgccccctctccggcgctgcaatgcgctctcaacttcacggcgctgctccccttcctcgcgccgccgctgccgtcggacgacgcctcccgctgcgcggtcgccacgcagtccgtcgcctttctcctctcgctccacctcgcggccacatcgtccttcgtgctcccacccgacgcctcctcctgcctgtccccgctccgcgccgcgctcccctacccgctccccgcgtcggcctgcggcctctcgggcctcgacgccgccctcgcctccccgggctgcggcaacgtctccacggtcgccgacttcgacgcgctcgtcccgcccagctcgcgcggggacatcgacgccagctgcgaccgcgacctctccgccgtccctgactgcaccgcctgctccaccgcgctcagcaaggccgccgcggcctatctcctggctggatccccgagcgccaggagtaacaacgtcaccgggtgcgtgcagtacccctccatctacgctggcgccgaggctagcccgcacgggcccgccgacccggccactgcctactgcctctttctactcaaggcgaacccgcctcagtcccacagctccggtgccgccccctgggtctacggcgtcgcattcggctccctcgcggcagtgctgctcctcgccgcagccttgggatgctgcttcgtcgtgaggcgaaggcaggcgcgagatgccgctgccgccctggctgcggacagcaaaggcaagcgctctcaggccatggagtccatcagcgccagcaccacgctcgtcaagttcacctacgacgatatcaaggctgccaccgacggattcgccaggaagagtattattggccagggtggctttgggaatgtctacaagggggtgctgcgcgacggtgctgaggtggcggtgaagcggttcaagaactgctccgcggctggggacgccgcctttgcccatgaggtggaagtggtggccagcgtgcgccatgtcaacttggttgcgctgcgtgggtactgcattgccaccacacagagagaaggccaccagcggatgatcgtttgcgacctgatgcataatggcagcttgtatgaccatctgtttgctgccggagaatgccagttagcgtggccggtgcggcagaggattgccattggcatggcaagagggctggcctacctgcatcgcggtgcacagccagccattattcacagggatatcaaagcgagcaacatcttgcttgatgatgaatttgaggccaaggtggctgattttggactggccaagtttgcacctgaagggatgacgcatgtgagcacaagggttgccggaacactaggttatgttgccccagagtatgcactctacggccaattgactgagaagagcgatgtgtatagctttggtgttgtgcttcttgagcttctgagtggaaagaaggcattcatttctctcagcgagggacagagctttgtgctcactgattgggcttggtctttggtgcgaagggggaggacagtggaggtgatccaagagggaatggttgatcctggtccaactaaggtgatggagaagtacgtgcttgttggtgcactctgcacacatccccagctgcatgcaaggccgacaatggagcaggcgctgaagatacttgaggctgattcagtaccaagtcctttgattattcccgagaggccaatccctgttgttgcaaacctggccgagattgagaggtcagccagcagcagtggatcaggtcagctgtttagcccctctggtttccgatctttcattcatgcaaatgaggatgctgctctggtgtctccaaatgacacatgacgatttacttagacaattagtgagatgatatcactataattcactgtgtaccatatttgtttttgtttgctcgattttgttccatcggcttacaaactcatggcaaatattgtatatatcaatttgtagttttgccccaacacaaaaactgaagttcttgggtgacttcattgaacttttttggtgacatttccattgctacatattgaactttccaatctccagtaactgttcattgggatgttgaagggtaactcatagctccatatgaccatatatagtcatatcattttgtcggaagagcatgccaatcttttggatagaagatttcatcagcttatgtattttatggcataaagatatgaggaaacataaacccaaattcattgtcttgtactatgtctgttaaattgtttttggcagtatcaaggttttatgtcagttatttgcctgagacgcaatttacaattgccaagaaaaatgccaaaggataagcttttggacccgacgctttattattaacagcaccaacattctctgatttaaggttttgtaacacaaatctctgatgcatgtatgtagcattaaggtaaataaagtaaccaaaccaaagtagaaacatcagcattgatattgtcgtttatttatcaatttaagcactgacataaccactagagacatcatgatacattactaatgtagtagccaaaatattgttgtagtagttattgtttggaaagctaagtaatacttgataaatgcaatgtaaggcacacatacctgataccttaactgtaatgtgtatataaaccataccttttgttttaaaaaaatcgacctgtggggtaagacggtccaggttattatactaagaagaagattcttgagatttttttaaacccaacctgaaatttatttccactgggaatcaaactcaggatctgaggagctctactcagagcacctaaccaactcggctagagcccctttcgtcatacctgttgtttagatgcaactgtgtttaaatgacatacaaactagatgcaataacattttttaatgtgaccagcaacactgaaattgaataaaacttcagttgctttcttgaggacatttttttgtctacaaaccagctgaggtttgcgtgatctgagagcatgtaccatgtgatttctattataacgtccttgtttactctacctttcatatactgtatggaatatttttccaactaagttccatgtttcttgcatctatgcccacctttactgttggtggggtcaacaaagcatatactggcttacagtggttcaatcatcattcgctagagtttaggctccttatgatctttaggtgagtgtgttctccttttcctttattttttatttttttggtgttgcatttttatagctctaatctttgtttgaaggattaatttctctgtctacggagattggtagtgcctacttattaacataaatgtcaaaatagaaatgtgctcttctttctttgctcctttccttcccaccttcccccttcttgtaccgatgccatattcatgaacacacgcatattttgtgttacaccatagcaacacctagtgttatttattgtatcctttattggaaataatcgtatgtctaggtgcaatgctagtgtctaggttaatagcatttaagactatgttacttcattgtgataatgtagctacaatcaacatagcaaataattcagtccagttttacttttacggcatgaaacatgtagagatcgatagattctttattaaggagaagattgatgctgcggttttgaagttgaagtatgtcaagttttgtaaccagctagcagtctcacgaaaggtctaggttctaaggataatgagttgacatgtaacaagatgagaatgttgaataaatttagcccatctaaagggagagtgttgatgacctgcttgtatattgtgtaatataagttgtgtgggtgctctggttgtagagagtgacacaccccaaatcaacactttgtgtattttgttgatgtaaaagtgattagcttatagtttacttgtggtttatgttgggttcaactctagcctacccaacttgattaggactaaaatgttttgttgatgttgtaaaagtctaattaacttctgctctttgataggtgtaactatgatgtggcggatgaaaggttagccacattaggtttatattggttatggatgttctaaattcactcatttactgtgccacttagttggggatttatgtatctctatcacaatagcaacagtaaacatttttggcggccaaggctattttcggcggtcaggccctggctgccaaaaataagagctattttcggcggtctgcaactgccgccgaaaataatgccatgaactgccaaaaataaaccttatgttgtcaaaaatggcttctgttctgatgacgttatcttgtttttacggccaaacacagaaacactaatgatattaacttcatcaaggagctgttaggtctctagactagtgaccaatattgccatgaactcagtatctccaagtcaatgttcggatgatgatcggttactagtctccaacattctatcttgtgaaatcaaggatttttcttgcttggtcttcctttgagcatccgaaaaatcattaaggtcttattcgaactagagaagcaaacattttagtaattgttctatgcctccattccggaaaaaaacgaacgcctctaaagtcttgaccgtttttatcctaatttatatggattgaagaggattcggtgagtttaaatctctagttagtcagaatatctcttaatctatgtcaatctccttcaatccacgtgaattacaaataaccgaacaagctctaaagcagattcgctaaaacaggttgacaaggtggctaattacctcccaaaatggaaagcttctcttatgaagccagcaggccgtcttgttacagtaatggtggttctgaccggtatacccatttactctatgattggttttgatcttcctaagaggtaagagctggtttagaacaaaggggagatagactaggagacaaaagcacacataaataactaaataccttatgcaaatactagtattcaaggttgcggtcgaatccatagttggtagcggggaacaggaacacatcctgttgcggtctcacaggtggttgggaggaaatacagtttctggacttttggtttatgtctaactatatcacactttatctaaaattagtcgttctaagtgaagaactaaccttaaagttagacaaactatgacaagttaggcagcaaaccaaacagtccactaatctgctagtggtatatcgggcaaatttccaagcaatcaaggaccgtactaagctcatttcaccggcggtctggaaaatttggaagcatcgcaatttctattgcagacaatcacaaacgaatgcatcctgtggtgctctcgttgtgcaaaaggactccaggagcgtattcgctcgggccagtccttgtatatgatacaatggctaacgctatgccatcaggctgtacaaaaatctgtctgttctccctttatttgtacaaaccaggctctctagagcatattgcagaagctggtaatgatcaaatgtgttggcggattgtgtcgacggccaaggcactgtcaaatctcctcctcgttcgcatgagaaatttcaaacggataacaaattttcaccaataagccactaaaaactgagaactcgaaggacagactggctctttttaaataactaaatagcactggacgatctgagacagaattagaacaccgtcctaatatacacatggacacacactacaaaatttgttttgagccatacagctcagtccaaaacaaagatggctggcaccaggtggtgcccaaaaccagctttctctccatcactgtccatccgtgcctacagaaccggaacagcctggtccatggagacaatagcgtgtcattttcagtgcaagctgggtgcatctgatgcgcacgagtgaacttaattcacagaccccgtccacattagacacctttgtctcaaagtatcatcagtccagcaaagacccgtcgtcggtctctgccaaataccaaatgaaaacggcaactcctacgcggttcatcttctctcgaccttctctgcaaaataccaaataaaaaaggcggcaactcctacggttcatctcctctcggccttttctgtcccttcgttccaaaaagaactacagcgctaacttgcctccaagcatccgtatccgacgtgtaaacaggagttgggagccctccaacctcctggatccttctcttccgtctggtcaggttcctgatctctgttgctgcacctgtatccttcggcccaccactacgaacaaggtaagcaagaccagacttcagagctctctgattagaccgctcttctggcctctgctcagagttatggtctctgtgtctttgacaatgctggttctctccatcctttcctcggcaccagtgcccttcatgccttggcgacctgtctctgggcttctcgttagatgaacggcctgcaggcacacgtctaggagcttctgtgttgctgctgctgctgttaagcttctccttgaagattgcgtgtccctcggtgcaggaaccggggtgcttactctctgacatctgtccgtcggagctggagctgcagccggcttgttctgctgtttgtccatcggagttggagctagcttgttctgctgcttatccatcggagttggagctagcttgttctgctgcttatccatcggagttgggatgggagttggaaccggcttgatatgatgtctacacgttggagctggagctgggatctgcttgatatgatgcttatccattggagttggagttgggaccggcttgatctgatgtctattcattggagctggaacctgcttgatctgatgcttatccattggagtatgagttggggccggcttgatctggtgtttatccgtcgcgcttgaagctggtactggcttggtaacaggacccacggagcatggggctcttttctcaaagagctcagacatttgctgcacaacaactgcaaatgcgtttgatcatcagacattttcatgatgtcagtgagaatacataactgatatagttcagtgaacggtgaaaggaaaataacttcatctgctgtgtacctctcaacggatctggagcaacatcgaacacatgccaccatattgtcccattctgggaaagattaacgttgtgaaatttggcagcaaaccacagtgatgccgcagcaatatactgtggtttgaactggatgactagagttgacggaagcctgcacgtatgtatacgtgtgaggggagaaatattttaacataatagctagaatatttgacagaatagaccagataacttacgtatcgttaatgagactcatagcagattgtctcagttccgtctcggcaatgcccagcttcttcagcgcgagctttagaggttcataaggatgatgtatattgaaatcaaaccttattgttgaaagcagcagtgtctcccccaccaaaatcagtgccttttgcttcgcaagcacttcatgcttttcattgaaaacaaaacttgtttagtaaataaatcaaacaccgtcaaggagtgataatagtgcaaaagatgagcataattagatacctcctggtggattctcttagcagcatccgga

SEQ ID NO: 14589 - DNA, 1373 bp, Zea mays
gtgcgggcggatgcacttgtttgcgtcccgtgcgcgcgtgatctgatcagcgcgttcgcgtggctcggtcgccacccaactcgacaccgcccacctccacctcctcctcctccgcgtccgcttttttgtccgggcacacccccgcccgacgccgccggaaccagaccagaccacaccacaccacaggagaggagaggagctccggcccgccaaaaaaaaatagcaggggcaggggccgcaggcgccgcgacccatgggcgtcaagcaggtcctcgtccgcccccgctacggcgacgaggatgtcgtcgaccagtcgccgccgccgcccatgtcgtcctcgccctgcggccgctacgtcctccaccgcgtctgcaggttcgacacgctcgccggcgtagccatcaagtacggcgtcgaggtggcggacgtgaagcgcgccaacggcctcaccaccgacctgcagatgttcgcgcacaagacgctgcgggtcccgctccacggcaggcacgcgccgtctcctccctcctcgtccccaagccacgccgccagagaatggactaaaaatgctgcttccctggacccgctccttaaaccaccacggagcacagtttcgccatccatgagccttctactacaggggtgccatggcctgacgccggctccaaagggggacctgaacctgaccgatgaatgcgctcaaggccatcacaggaaagccggaagcttatcgagcaccttgttgccgaggagagccgggcaagggctggccctgaggccaaagtctggcggtcgggcagacacgaacggcatccaccaggacctgttggctgcgtgggtgccctcgtacggggacgggttgcgcgcggtgaagagatcgtcgagcgctccggagttccaggattcggacagcgtcagcctcgcctcggcgtggctgaagagcaagtggaacctgaaaccggattatgccttcaccctggcgctgttcgacggcatctccaagcctctcctggacagcatccccaagcctctcctcgacaacatccccaactcgatcgttgcttggagaaacaaggcggccagagattagcagcttcgtttcgtctctttacagccaaaaaaaagaaggcctcgaacggttggacacactgtgctgaaatggcgcgatggatacagtgacacattacttgcacatacatactgtgctgaatctattgtgccaaagcagcagcagcagcagattgggagctgggagatgagcctgggggtgtattcttttcatttttgtacgtacacatataggaatgaaggcaaacgcctagcagcattcccatgacctaataaagaaatagcttgttctaaaaaaaaaaaaaaaa

SEQ ID NO: 14590 - DNA, 1747 bp, Zea mays
atcagactacagtgcggttggaggaagggaaccggacaaatcaccccgtcgtctcgtcccgtagtcactcgcagagtcgcagtcgcagcccctgcgcccaccgggatcgtgatggagagctgggtccgcgcggtggtggaggccatccactcctctcgctcccagacagtcatctacctcgccggcggtgcatcccaggcgctcggttggctcctctccgtgcccggcgcttcgggcaccgtcctcgaggtcgtcgtgccatactctagggcctccatggcgcagctccttggcaagatgcccctgcaattcactagcaagcaggctgcagaggacatggcactggccgcatacaatcgagcactcaagctttctggaccaggtctgcaagttatgggtgttggatttactgggtcactggcgagctcacgtccaaaacatggtgaccacaggttttacgtgtcaacatggacacataattgtctcaggacatcacatgttaccttgtcgaagggtttacggagtagggaggaagaagacaaggtttcaagctactttttgcttaaggcaatagcagatacctgcagagtttctgcaaccattcagtcagacattcacaaatctgaaattccagaagaaatcatggaacaatttgatgaagatcaagaactccagcaagttattaatgggcaagtttgcatgaaagtatataattttgctgctccggcggaaagtaacttgaacagaaaaataattctgcctggttcgttcaaccccttgcacgatggtcaccttagattgctagaagctgcagtaagcatgtgtgatgatgggcttccattctttgagatatcagcaattaatgctgataaacctccactatctattgcagaaattaagaggcgtgttgagcaatttagaaaagcagggaagaatgtgattatatctaaccagccatacttctataagaaagcagaacttttcccaggaagcgcttttataattggtgcagacactgcagcaaggcttgttaaccctaagtactatggaggagattacaacagaatgctggagatacttctcgaatgtaagagcatagggactacttttcttgttggtggtcgaaagattgaaggagatttcaaggtccttgagaacttagacattccagaagagctgagagaaatgttcatttctattccggaggaaaagtttcgcatagatatttcatctactgaaataagaaagagccaagggctctgatgtatcaagtggtcgtattctacagcagatttgggatgattctccacgactatagaaggtacatttggatgctagcagtcaagtctgaattctccaagcttactttttcacatttgtggggttgtattcacgcattctattgcagattatgataggtccattcatgcatccttgcaaaggaactgttgatgtattctcagggagaatattttatttaacttttgtcttgactgggccccttggtattttgttcagcaaattggaatcaatcctcttgtagaacctcttgatgtcttcactaccccttgcggctaggtggtcaacctctgtctcatatctttggtacaacgctggcaaagtgtgggcgcagagaaatcctgtggatgaaatataagaattgttaaatgtatgtcataactgctttatatattgtcttgccttgttataaaagtcacatttttctgcgctaaaaaaaaaaaaaaaa

SEQ ID NO: 14591 - DNA, 2899 bp, Zea mays
tccagaatcacacatgtcagatctttgcagtgttctctatcttcgcactgtaacaattgccacatgattttctcataaacgtagcaaagtaaatgtaccaggaggaatttcttcagatccttcccgcatgcaatgtcataaagagcagacacggtgtgtgccagtttgtaatggatgatctgtgctatttgtcggaaggcatgctcagagatgatcacttctgggatccttggaggagctctgcaacgcaaaactggttagttgaattatgttccttgtggctttgtgtcatttgaaatttctttaagagcatatctagcatactacctaaacagaatatttagtatttggatagtggagagaaagaaacataccctagcagactacctaataggtcttccaaatttattagagggtgtttaaatgcattagagctaatagttagttagttaaaaaattgctagtgggattaactagctaactattagttaatttgctaaaagtagctaataactgaaatgttatcttgactatttagatgtcttcagctaattttaacactatttctctccctttccctgcttttctccctccaccaacacgtgactaccaaaacaaattctccatgccatttcttctggtttctttccgacgctctctcgcacaagttccatggggtgactgtgactcctctccccggcgcgtagccccctcccttgtgcgtggccctccctggtgtgtggccctctccgacagtgccgtaccccggcttctctccctatcccgttcctccacgaccatctctgggtctgaggggtcagatggtgctgacggctttctcccgtcccccgtgggctcttccccccagtctgcggtggtctcctccctcctatcctccatcggctcttcccggaaaagtagagaggatgatacgtggctgtggctctcacatatcattctgctagaatggatttgagaggccagtttttaggtagtgctgctggtgagtagtatcaaagtacaagcctggtttagataataaaataataaaagaacgagcctgttttaggcagcatcctgtaatttgctctccctcgcgtaactgggaagtctcgtacatgttcaagaggggcgcagcattcgaccagatgaagacgacgagcatggccaggatggctatctggcaaacgagcggtacaatgctgtactcaactacctcgaacaggtaccgtaccaacgtggccccagcgagcaggcctgcagacaaattcctgtccttccacagcaagatgtccgcggctgcgagaggcacagataacaacgggggtccatgagtaaaccgggccatgacgcacgcagatggcgtcgcctagctaatagtttcccagaaagaacaagaacagcagagagcagcagcgtacgtacctcgccctccaccgagaagctgatgaatcggcttgcgcctgctatggccgccgccgccgcccacccctcgtccgttgccatgatcgcttggaaaattagggtgcatgatgtctatgtgagttcgggggcgtataacctggtatatatctcggttcacctgatcgatcggtctgttgcagaaagcactgtctttatatatatgcgcccaaaatgccgtggcataatcgtcgatatcatatctcgctcagggggcataggccgcgaagaaaaggatagcttcatgtgtaggaattgaagaatccgtggctggcaagtgtatgttgctccaacagatactttgcctcaggaatggggggaactagttgttagggacaagaagctatgcttatttttcttatagaagtttgccataatatctaccgtgtcgatatcttcaaaatcagaaagatcgagctgctggctctggcttcctattcgggaatagtacaggatcatgacgtaaccatgtgttgaactgaaaaaaaaactcaacaatacgttcgcaggatgagcacgtacctccctgttagaatcatagtgatgactgatgagaaagcatcaaatggagagccctttcaccgggcgtgcagcgtgcttcacctaacctaacggacactgctgggctcgctcgacatgcttacgccgtgactcacctcaccttccgccgggctaataatccataccatagcacacaactaaccggcgcctacaaaaaaacctcctgacgacgctcgtacgtggcctcccactgcacccagtccactcgcagtcgcagctagtccggtccccggtccgacctatcccagtgacaccatctatcgtcggtcggggacgatgaggccggccgcgctcttcctcgccgcggtgctggccagcgtcgtcctcctcctcgccgccggccgcgccgcgggcgacttctcggccctggcgccgtgcgatgtgacgcagctgaccccctgcgcgagcgcgttcgcggggaaggcgtcgcccacggccgcctgctgcgccaagctcctgtcccacgggcccggctgcctgtgccggtacaaggacgacgccagcctgaagcgcctcgtcgacgccaggcacaagcgcagggtgttcaccgcgtgcaaggtgcccgtcccgagttgctagccgtactcctagtcctccaagctcatccgtcggccgtcggcgcaagcagccacgcacggcgaagaaataagatggacggaggagagaggggaattgttcgccgtggtctgtggtgtccggccaaggatttggctggttagatttgttcgcttcttcactgtctcgcacaaaaaaccagctcgtgggaggtagtgtgtttgtgttggattgcgttagttcgaagttcgaactcatgtcgccaattttccatgcattgcgaaataaaaatcaccacaccatcgtcgctaaaaaaaaaaaa

SEQ ID NO: 14592 - DNA, 865 bp, Zea mays
gcacgagaccattacctagaacatcctaatcaaaaaaataatccgccatagcacacaactaatcggcgcctacaaaaaagctcccgacgacgctcgtacgtggcttcccacccagctagtccactcgcagctagtccggtccgacctatatatccagtgacaccatctatcgtcggtcgggacgatgaggccggccgcgctcttcctcgccgcggtgctggccagcgtcctcctcctcctcgccggccgcgccgcgggcgacttctcggccctggcgccgtgcgacgtgacgcagctgagcccctgcgcgagcgcgttcgcggggaaggcgtcgcccacggccgcctgctgcgccaagctcatgtcccacgggcccggctgcctgtgccggtacaaggacgacgccagcctgaagcgcctcgtcgacgccaggcacaagcgcagggtgttcaccgcgtgcaaggtgcccgtcccgagttgctagccgtaatcctagtagctcatccgtcggccgtcggcgcaagcagagccacgcacggcgaagaaataagatggacggaagagagagggggagttgttcgccgtggtctgtggtgcccggccaaggatttggctggttagatttgtttgcttctttactgtctcgcacaaaaaccagctcgtgggaggtagtgtgttgcattgcgtttgaactcatgtcgccagttttccaatgcattgcgaaataaaaatcaccaccatcgtcggtaaagaaaacataccgacgtcatgctcttaggtagtactggaaaaaaaataatacttgtggctcgtgagcttgctcgaatcgtcataagcttaacttgtttcaaaaaaaaaaaaaaaa

SEQ ID NO: 14593 - DNA, 3023 bp, Zea mays
  misc_feature (2929)..(2929): n is a, c, g, or t
  misc_feature (2931)..(2931): n is a, c, g, or t
  misc_feature (2962)..(2962): n is a, c, g, or t
  misc_feature (2972)..(2972): n is a, c, g, or t
  misc_feature (2991)..(2991): n is a, c, g, or t
aataagattttatctcaaccgttttcttccctagtctcagtgcaacagccagactaatggtaggtctgctcggggctattgtttggtttgctacctaacttaatataatatgctaaatttttgtacctaaggtttttcttaaatttaaccactaaccttaagtaagctataacacaattagtcaagaatcagacagatccttagtcttataaaacacgttatcagctcttagaacccttttgtccctgtctctcgtaatcaacatagtagataaaagtggaacatatagacacaaaagagaaatgagattattcttcatttctcaaaatattgatgattacaatatatacctctcacatatatagccctacggaggcttaagagtttagtaagagtacacgtaacaaatatactataggtgttgtttggttcacatattcgtgaaaggtaaccgataacgttaaatcatatttgatcaagtccaaccgtaatcaaataccacactagaaactgatatcgtcatattcaaactttaccactgataatcaagtgtgaatcattaccgttactatttacgttatattttgtgaaccaaacatcaccataattaagattggtccttctccttaatttctaggatatagtccatatgttttacaacactccccttaaacaattatgacgaaatgcacaagccatgcacaagtgacaagcctcaccgaagtctccgtcagaaaactcggtgggaaaaacggtgttagcgtctaagggaaggtataccctaattaaaaaatcgattaaaacccatttataatagagatttgctatttcataatgaacacaaatatttagactaaccttatttgttagtatctttggttatagtttaaaggatgaagcaaggacttgaacaaagacaaaatagtgatcgaaatgatcgacataagaagactcgttaaagaataaagatctacaacaagtccaagtccaagcgtataggttacaaagaaatgaaataagagaaatgtttgaagagcgtcagaccacaacacggggctgcgcagagacaggcatcagattatacttagctgaagaacaggggctcatacgcgatcatcagccacgggagcgtaggaccatacggtcgcacttttcatcccccagtggcattggacagtaactgttctgtgataaaagttgattaatatataaaataataggcttagtcgcgggctgggctttaatgggccgtaactgggctcctctaatcggagcgataagcgcaggaagtggcccgagactcccagttgaagggaggagagcaaagcgagcagcacgggatccaaaatccaccacgatgagcagcggtggcgggcggaaggcggcgggccccggcggcgaggaggcggaggtggaggcgcttatccgggcggcgcaggacgcggtgctcctgaagctcaaggcgaactcccacctcgtctcctcggcctccagccctccttcgctcgacgcggcggagctcgatcccctggacagcgacctcgcccggcgcttcgacgcgctcaagtcccgcgcggcggcgccgaatccgaaggcggccggagccggagccgcccttggagggatggatgagctggaggcgcggttcgctgcgctgaagggggcggcggggcccgagaaggacacgagggtgaggctggaggatctgggaggggagtcgtcggaggacgaggcggacgaggtggacaaggtgatgcgctgggccatggatgccgcgcggctcgacgtcgctgcggcaggctccggcggccaggcgacgaagcgcgctgacggcgacgaggaggaggaagagaaggatgagaagagcagcgtgagtagcgaggacgaggacgaggatgagaggttgcaggtggagatggcgaggaagaaggagatggccaaaaccaaaaccaaatccaagaacaagtggttcttcttgtgatatccatatcctactgatcatatgtacatttcatatctattttcaatccaagtatatgatttatcgtatgctcttccctcggcaaacaaccacttattccaaactgtttgagactcacaaacttgcaagaatgcaatatgcaaacgaagagtattttgtccacaatcctttgcccactttggctcgtggggatcgttttctttttcactcaggcagctagttaacgccaatacaaatatcataaactagatacaatgtcatgctacacttcagtttggagtacgacgatgtgtcacagatacttgaggcaaaacgccaaccatcattcctggcatagtttatcttcacttgccactgcatgcagaggtagaaagcaactgattttacaagtccactcacttgaaattacaaggttcagatttcatagccagaacagaatacaaagaccatgagctaagcttcaatcagcatagtacaatcgcggggtctaatgagagcaaaatcagatcgaggttgctgtggagaagtttgtgagtttatctattctgataatggaactgtaaccattgtatatcatgtgaatatttaaaggaactgatagagagatacaatcaatctcaaatgaacttaaggataataagggtcaacatgagatatgttgttctaaaattgaaacaataaagggtaaatggcttccaactctgtggattcattcgtaactttcaagaaatggcagttgctcactactaacagcttatctacaacctaatgaaattcgttggtagtgtccacttcatatgtcataagttgaagagcataaatattctgaaagctcacggtaaaagcatcaaggatagttacatgctaaatggctatgcactaaagactaaacacaggccgtgcaggtcaaggaatgcctatgagagtaactcctactagaattacttntnttgattttaacattcataagacaaaaatgcnaacagatccnagggaacttgataagattngtcagagttatttgttaaaaaaaaaaaaaaaa

SEQ ID NO: 14594 - DNA, 2429 bp, Zea mays
agaaatgcgcggcacacgacaggaattttgatccgccttcctatgttggccgggcgcaaactcgtaggataacgcctactattcggtaccccgtggccggccgcgtattaatgcgcccgtcctcgccagtcgccacgaccgcagcaatccgccgcccttggccgtgccccgtgctgccgtactcgtaatccgtgagggaaagcgtccgcgctccgggccccgccgccgatagttccttcaagggagcgacgagcgcgcggtcgatggagacggtggaggaggacgtggaggagtacagctggcgggaggtggtgctgccgcacctcgtccccgtggttcccggcgcgcaaccggagctcgagcgggagaccggggagcggcgccgcggcagggacctcctcgtcgccgtcgacttcggcccgaactccaagcacgcctttgactgggcgctcgggcacatcgcgcgcatggccgacacggtccacctcgtccatgccgtctccagtgtgcaaaatgagattgtgtatgataaaagtcgggagctcatggaggatttagcagtcgaggcattcaagacgttactggtccggaccaaggccagaattgttgaaggagacgctggaaaagttatttgccgagaagcagatcgactgaagcctgccgctgtcattcttggtacacgtggtagaggccttattcaaagtgtgttgcagggaagtgtcagtgagtattgcttccacaactgtaaagcagccccaattatcattgtgcctgggaaagaagctggtgaacagtctgtgctttgaaggaagatgagtaggagagttgttcctgttcgttgtactgtcagtttaggtgataaagtgttgtatattggtgctggtttgttgtgggaacatgtccttaagtgctttgctttgcttgtaatctgaagctctgaaccctctgtctggcttggttatgaaggaatgcttagaaaccgggagagtagcagacaaacatataacacaagaaatgtacttgtattgccattgctgacagaatacttcattagtacagttgatatgaataaagaatcttcagccacaagtttttttccccgtggttaaaactccagcaatgaggattaattcttctcacatttccattttgaggttgtctagcaagcagccactttctaccgactgaaattgtgcatcaaatccgctgaacaaattctgggagccaatatcccaggcagcagttccattcacgttgaggcacggctcgatggtcgacggtccggcggccaccgaaaccgacggggcagccgacacagggcagctcgcggcggcgggcgcgtacaggttgctgaggaccatttccagcccaaagccagtggagcctgccgctgcagacgggtgcactacctgctgcatggggctcatgctcatctgaaggcaggacggctccagctggccggccgccgggccccccgcttgcttcagctggcggccgaagaggtcctcgacgatgtcgaagctcaccaccgggttggaagcggcgatcttcatggacaagaactcgacttgcttctgcagggactggacgtagttgatgatctcgtcgagcatgccggccttgcccgtgaccttgctgcacccgggcaccagctcctgcaggtaccgcatccgctcgctgatcctctccctcctcacctgcacgccaatccacccggccatgagttctgacttctgacgcacgcggcagggtcgtcggtgcccacgaactagcagagcagcatggagcacgcaaaagtgtttgctcagtaatgcggctgttaatattacccgctcggcgaggctgtggctgtccgtggcctggccgcggcgggcccggacgtggatgtagtcggtcttctggccggccgccgccgccgccgccgccgccgccgccgccgcagcctcggccttcttcttggtgctagcctttggcctctcctgcttccctttctcgggcgccgccgcgatctcagagaggccagatggctgctgcttccctctgggtctcttgctcatgtcgttcgcaccaccctgccaattaaaaaaaaaaattgacacacaactgtcagtcaaagacttgacaattcagcagaagcagcaccgccgtccatgcctgaacctctcaccttggcatcgaggtactcgtccggcctcctcttcctcaacccgccgctgacgctgcaagaggaggagtcgttgccgtcgccggcgctcggcgtcgccacggcaggcggcacggcgagattggcgccgcgcatggcggcacccaggtccggccactcctggaggtagccgaaggcgctgcacattgcaccgaacttgtcgtcgtcgaggtcgagcagcccctggcagaggctctcaacggtcccctggcaccgcgccattatt

SEQ ID NO: 14595 - DNA, 828 bp, Zea mays
attgggtacctcgaggccggccgggaattatgtgcccgtcctcgccacgaccacagcaatccaccaccgcccttggcagtgccccgtgctgccgtactcgtaatccgtgaggggaagcgtccgcgctccgccgctccgggccccgccacccatagttccttcaagggagcgatgagcgcgcggtcgatggagacagtggaggaggacgtggaggagtacagctggcgggaggtggtgctgccgcacctcgtccccgtggttcccggcgcgcaaccggagctcgagcgggagaccggggagcggcgccgcggcagggacctcctcgtcgccgtcgacttcggcccgaactccaagcacgcctttgactgggcgctcgggcacatcgcgcgcatggccgacacggtccacctcgtccacgccgtctccagtgtgcaaaatgagattttgtatgataaaagtcgggagctcatggaggatttagctgtcgaggcattcaagacgttactggtccggacaaaggccagaatcgttgaaggagacgctggaaaagttatttgccgagaagcagatcgactgaagcctgccgctgtcattcttggtacacgtggtagaggccttattcaaagtgtgttgcagggaagtgtcagtgagtattgcttccacaactgtaaagcagccccaattatcattgtgcctgggaaagaagctggtgaacagtctgtgctttgaaggaagatgagtaggagagttgttcctgttcgttgtactgtcagtttaggtgattaagtgttgtatattggtgctggtttgttgtgggaacatgtcctt

SEQ ID NO: 14596 - DNA, 2095 bp, Zea mays
  misc_feature (87)..(87): n is a, c, g, or t
aaaaaattgaactgaatggaccagtcgacgtcatcgcctccctcgcctatccgctcggccgttggcgctcaccaaaaccacccaganggccccgcttggccggccgggactcgctttccgcccgccgcgccatgagcgccgccgcctgcctgttcgctgccgccgtctccctatcattcccgtcgacctccgcaccctcttccgcaagacgccgccgcctccggagccccaccaccctcctccgctgctccccgactcgccgccgtgggccggtccggcggacactcgacgagcggctgctcgaggccgcgccggcggagaccgaagacgtccaaaccgctgttgatgtagaggatggaggagggatcgctgagggcgatgaagtgggaacagaggagatggaggagctggagcagcgaccgccgacgagggctttcgtgaagagcaggcggcagcggcaggaagaggaggaagccgcggcggggcaagaccggttcaagctcatcaatggcaaagagatatttcaagagaaggcttatctggttggtgttgagtgcaaacggacaggagggaacctgttcggcatagaggagtcccttaaggagctggagcagttggctgatacggcgggccttctggtagtcggctcaacctatcagaagctttctaccccaaatccaaggacttacattggttcaggaaaggtttctgaaatcaggactgcaatccaagcacttgatgttgagactgtaattttagacgatgagttatcccctggacaactacgtaacttggaaaagtcatttggtgggagtgtccgagtctgtgatcgaactgctcttattcttgatatttttaatcaaagggcagcaacacatgaagcttctttacaggttactttggcacagatggaatatcaacttcctaggttgacgaaaatgtggagtcacctggaacggcaggctggaggtcaagttaagggtatgggtgagaagcaaattgaagttgacaagcgcatcttgagaactcaaataagtgccttgaggaaagaattggaatctgtacggaaacaccgaaagttgtaccgcaaccgtcgccaatcagttcctattcctgttgtttctctggtaggatatacaaatgctggaaaaagtacactcctgaaccgcttaactggagctgatgtgcttgcagaggataagttatttgccacattagatccaactactagaagggttttgatgaagaatgggactgagttccttctaactgataccgtcggattcattcagaaattacccactatgctggtagcagcatttagagcaacactagaagagatatcggaatcatcagttatagttcatcttgtggacattagccatcctttagctcaacaacagatagatgctgttgaaagagtactgaaggagttggatgtcgagtcaatccccaaattagtcgtgtggaataagattgacaatacggatgaaccattgagtgtaaaagaggaggctcagaaacaaggaataatctgcatatcagcgatgaatggtgatggtttggaagatttatgtaatgcagttcaagcaaagttgaaagactcgatggttcctatagaagcttttgtcccatatgacaaaggagatctcctgaatgacatacataaggttggaatggttgaaaaaatggagtacaaggaaagtgggacatttgtaaaagctcatgtgcctctacctctggcaaggcttctcacacctctacggcagcaggtggcagccactgtgtgatgtgcatgtccccgatcccttgatgccattggcactcacaaaattaccacatcttgtagattcacaaaaggaatagctttgctgtagaaaacttaatcatagattatcttcattgtgtttctacggttctaccagagtaccgtatcaacaggtgcacaggactagatagctgtatgtacgcacaacagaaatgtaaatgttctcagcagaatttaagccccgtttggtttgggtagtcaaaaaaaaaaaaaaaaaaaacaaacatggtgactaaaatagggtaactaaatttaagttctttagtc

SEQ ID NO: 14597 - DNA, 919 bp, Zea mays
  misc_feature (4)..(4): n is a, c, g, or t
  misc_feature (176)..(176): n is a, c, g, or t
gggnagtgcgccggtgaaacgagggaaaaaacggaagcatcaagtctgaaactgaaaagaagggcgaatagcggtttctctgattctctccctcccttgccttcgtctccgcctccgtctttcctcaagaagtcgattcccttccccaagaacccaagcccctaccatgacaagtnctttttctccttcccgaaaggcgctgagcaagatcgcttgcaatcggctgcagaaggaactcgccgagtggcaactcagcccccctgctggattcaagcacaaggtctccgataacctacaaaggtgggtaattgaggtcactggagcggcgggcaccctttacgccggcgagacctaccagttgcaggttgacttccctgagcattatcctatggaggcacctcaggtcatttttctcaatccagcgccaatgcatccacacatctacagcaacgggcacatctgcttagatattttgtatgactcgtggtctccagcgatgaccgtgagctctgtgtctatgttgtctagttcgccagcaaagcaacgtccagtggacaatgaccgctatgtcaggaactgccgcaacgggaggtcgccgaaggagaccagatggtggttccatgacgacacggtgtaattgagcgcctgacagccttccttgctgtggtatatctcgtcaaggggagattggggatgatttaggcctatttgtaagcatccctctatcggattgcgaagcttaccttgctgtggtggtgtgttaaatgagttgcacacatgtgtcgagtctgagaatacatattaccatcatcaatgatataagtaatatagaataagcatgagtgtaccctgcctgaatcactggaacgagctcaaaaggaattacctgtgcaggtttaactatgactgctttgctcag

SEQ ID NO: 14598 - DNA, 1118 bp, Zea mays
ggccgggaaaaaaaaaaaaaaaaaaaaacccccgagccgggccgggagggaaaaaacggaagcatcaagtctgaaactgaaaagaagggcgaatagcggtttctctgattctctccctcccttgccttcgtctccgcctccgtctttcctcaagaagtcgattcccttccccaagaacccaagcccctaccatgacaagctcctcctctccttcccgaaaggcgctgagcaagatcgcttgcaatcggctgcagaaggaactcgccgagtggcaactcagcccccctgctggattcaagcacaaggtctccgataacctacaaaggtgggtaattgaggtcactggagcggcgggcaccctttacgccggcgagacctaccagttgcaggttgacttccctgagcattatcctatggaggcacctcaggtcatttttctcaatccagcgccaatgcatccacacatctacagcaacgggcacatctgcttagatattttgtatgactcgtggtctccagcgatgaccgtgagctctgtctgtatcagtatcctgtctatgttgtctagttcgccagcaaagcaacgtccagtggacaatgaccgctatgtcaggaactgccgcaacgggaggtcgccgaaggagaccagatggtggttccatgacgacacggtgtaattgagcgcctgacagccttccttgctgtggtatatctcgtcaaggggagattggggatgatttaggcctatttgtaagcatccctctatcggattgcgaagcttaccttgctgtggtgggtgtgttaaatgagttgcacacatgtgtcgagtctgagaatacatattaccatcatcaatgatataagtaatatagaataagcatgagtgtaccctgcctgaatcactggaacgagctccttgcgtgatgtccggggctgctgcaactatgacttgctttgctcaatgtgcctttgtatcagtctgcagtctgcttatggattagcctggttgttcattgtaaccctgccctgctgctatggggatattggacctcccaagggacccgatggattggaatccagttttttttctcaaaaaaaaaaaaaaaaaaaaaaaaaaa

SEQ ID NO: 14599 - DNA, 889 bp, Zea mays
cctcgaggccggccgggccttcttcttggccttcgtctccgccttccgacttcctctagaattcgattccctttcccaagaaaccaagaacccagccccccaccatgacgagctcctcctctccttccagaaaggcgctgagcaagatcgcttgcaatcggctgcagaaagagctcgccgagtggcagcaaaacccccccgtcgggttcaagcacaaggtctccgataacctccaaaggtgggtaattgaggtcaccggagcggcgggcaccctttacgccggcgaggcttaccagttgcaggttgacttccctgagcattatcctatggaggcacctcaggtcatttttctcaatccagcgccaatgcatccacacatttacagcaacgggcacatctgcttagatattctgtatgactcgtggtcaccagcgatgaccgtgagctctgtctgtatcagtatcctgtctatgttgtctagttcgccagcaaagcaacgcccggcggacaatgaccgctatgttaggaactgccgcaacgggaggtcgccaaaggagactagatggtggttccatgacgacacggtgtaatgatctctgtggcattgcctgtcagccttctgtactgtgatatatctcttcaagggggagatgagatgatttaggcctatttctaagcagccctctattggattgcgaagcttaccttgctgtggtggtatgtaaatgagttgctcacgtgtcagtctgggaatatgtgttatcaccatcaatgatataatatagaataaagcaagattgtaccctgcctaagtcactgaaacgagctcaaaagtaatgtgcaggtttgactaataaaaaaaaaaaaaaaagaaataaaaaaaaaaaaa

SEQ ID NO: 14600 - DNA, 1947 bp, Zea mays
accaaaataatgtttcaccaggatttaaatttattaggttgccatatctcatgatttactgtactgaatgtagtctaccagagatcaattttaagttgatgtaaccaatggatctgaaattcatgtagctgaaaatggttcaaaaagcagcgtagcccccccgtccgtcaccttactattctacattagaaaatctatactgagtgtgaaaggaagcatataccctgttggacgttgttttcacaagttctttgttgaccttggtggatttttctcagtttgtgaatgagatgaaaataatgaccttggagccccgtcaaccatggtctacaatcgccttgtaaattgtataatagctaaagcctacatcaaagtatttataccctttacatttgcgtctggagaatttactctcttctgttttccattaatccactgtccacttactcatgagttctctgagatattgaatggaacgtaaacaatttttgtggagccttgatggatgtggattacagtttactgtatggtttgtgattaacaaattcctgctgttactcttgtctgcagatattctgtatgactcgtggtcaccagcgatgaccgtgagctctgtctgtatcagtatcctgtctatgttgtctagttcgccagcaaaggtgacacttagtcatcatactacttgatctattcaaacctcggtgctctcactccatagccagactctaactagctagaatgtattgtttgcagcaacgcccggcggacaatgaccgctatgttaggaactgccgcaacgggaggtcgccaaaggagactagatggtggttccatgacgacacggtgtaatgatctctgtggcattgcctgtcagccttctgtactgtgatatatatctcttcaagggggagatgagatgatttaggcctatttctaagcagccctctattggattgcgaagcttaccttgctgtggtggtatgtaaatgagttgctcacgtgtcagtctgggaatatgtgttatcaccatcaatgatataatatagaataaagcaagattgtaccctgcctaagtcactgaaacgagctcaaaagtaatgtgcaggtttgactatgatttgttgtggtcaatgtgccttcgtatcagtctgcagtctgctcacgcccttgcctatttgttcattgtagtgctgtactgctgctactgtgatagttccaactagtcacaaattatctgtgtgctcatggatttggtatttccagttttcagtctctgtttatggatgttttgaaatcaagtgtgaagtgggggtagcctgacgctgagtttgaactgcaatggtgtatattctcgagatcctctgtagagtatgctgccaatggaagttttggctgcagaattcatggctacagtttcaaaacgtaaatgaaaatattctattccattcatagattgcttcgagaggaaaaatagtgctacagtttcgtagaaattgaagtcagtcttcatactgtttgctagcgccattaatttcatatgttccgactgtctaagctcgcaccttgtccaacaagaaagctccatcgcgcacggaaaacacttgcacatgcacctaaatcctttaggtctaaaactcaacttcatgtttttttttgcttcaatccgtatctgcttctataatgtgttttgtctataagaatagcgagcaggtgtacatggaagtttagtgcatatgtgcacatattaaatcataaatattcatctcagatttaatgtctctagtaggggtgaaaactgatcgaatacgcatggatacgaattcgaatgttacagtttaccatattttagctcgaattcggatacgaatacaaaaccgatagtcgaatccgaattcttattcggatatttactcaattcaacacaaacagcataccctaaaatttaac

SEQ ID NO: 14601 - DNA, 1096 bp, Zea mays
gcacgagatcaagtctgaaactgggtaccctccacgtccggcggttcgcggtttctctccctcccttgccttcgtctccgcctcccgtctttcctcaagaagtcgattcccttccccaagaacccaagcccccaccatgacaagctcctcctctccttcccgaaaggcgctgagcaagatcgcttgcaatcggctgcagaaggaactcgccgagtggcaactcagcccccctgctggattcaagcacaaggtctccgataacctacaaaggtgggtaattgaggtcactggagcggcgggcaccctttacgccggcgagacctaccagttgcaggttgacttccctgagcattatcctatggaggcacctcaggtcatttttctcaatccagcgccaatgcatccacacatctacagcaacgggcacatctgcttagatattttgtatgactcgtggtctccagcgatgaccgtgagctctgtctgtatcagtatcctgtctatgttgtctagttcgccagcaaagcaacgtccagtggacaatgaccgctatgtcaggaactgccgcaacgggaggtcgccgaaggagaccagatggtggttccatgacgacacggtgtaattgagcgcctgtcagccttccttgctgtggtatatctcgtcaaggggagattggggatgatttaggcctatttgtaagcatccctctatcggattgcgaagcttaccttgctgtgggggtgtgttaaatgagttgcacacatgtgtcgagtctgagaatacatattaccatcatcaatgatataagtaatatagaataagcatgagtgtaccctgcctgaatcactggaacgagctcaaaaggaattaactgtgcaggtttaactatgacttgctttgctcaatgtgcctttgtatcagtctgcagtctgcttatggatttgcctggttgttcattgtagcgctgcgctgctgctattgtgatagttgtaactcgcactgacaccgatggatttggtattccagttttctttctctgcttatggacgtgctgaagtctgagtgactcgggatgggtaacttgacattctgtagc

SEQ ID NO: 14602 - DNA, 1088 bp, Zea mays
gggggctacgggctagggtcttcttcttttttgaatagagaaaaataagaggataataaagaaaagaaaaaaacggaagcatccaagtctgaaaatcgatataatcgttggctcccggcaggccggccggcggtttcgttccctctccttggccttcgtctccgccttccgacttcctctagaattcgattccctttcccaagaaaccaagaacccagccccccaccatgacgagctcctcctctccttccagaaaggcgctgagcaagatcgcttgcaatcggctgcagaaagagctcgccgagtggcagcaaaacccccccgccgggttcaagcacaaggtctccgataacctccaaaggtgggtaattgaggtcaccggagcggcgggcaccctttacgccggcgaggcttaccagttgcaggttgacttccctgagcattatcctatggaggcacctcaggtcatttttctcaatccagcgccaatgcatccacacatttacagcaacgggcacatctgcttagatattctgtatgactcgtggtcaccagcgatgaccgtgagctctgtctgtatcagtatcctgtctatgttgtctagttcgccagcaaagcaacgcccggcggacaatgaccgctatgttaggaactgccgcaacgggaggtcgccaaaggagactagatggtggttccatgacgacacggtgtaatgatctccgtggcattgcctgtcagccttctgtactgtgaactgtgatatatctcttcaagggggagatgagatgatttaggcctatttctaagcagccctctattggattgcgaagcttaccttgctgtggtggtatgtaaatgagttgctcacatgtgtcagtctgggaatatgtgttatcaccatcaatgatataatatagaataaagcaagattgtaccctgcctgagtcactgaaacgagctcaaaagtaatgtgcaggtttgactatgatttgttttggtcaatgtgcctttgtatcagactgcagtctgcttatgcatttgcctatttgttcattgtagtgctgtactgctgctactgtgatagttcc

SEQ ID NO: 14603 - DNA, 1398 bp, Zea mays
ttgggtacctcgagccggccggggcacagagtggtaagcatggcgagcaccacagacaaccgtggcctcctcctcgtcgtggccgccgccaccgtcgtcctcgccgtggccgcggccccggcgcatacaccggggggcaatactgctacccctccgccgccgttccggacggtgtacgcgttcggcgactcgttcacggacacggggaacacgcggtcgacgacggggccctactcgttcggctacgtgtccagcccgccctacggcgccaccttcttccaccgctccaccaaccgctactccgacggccgcctggtggtggacttcctggccgaggcgctggcgctgccgtcctacctcccgccctacctcgccgtctccgtctccaacgccaacgccaacgccacggcggccggagccggcgtcaacttcgcggtggccggcgccacggccatcgagcacgacttcttcgcgcggaacaacctcagcatcgacgtcacgccgcagtccatcatgacgcagctgggctggttcgacgcgcacctgctccgctcctcctcctccgccgccgccgccgccgacgcgctcttctgggtgggcgagatcggcgccaacgactacgcctacacagtggtcgcccgcgacaccatccctcccaagctcgtccgcaccatggccgtccagagggtcaccgccttcgtcgagggcctgctggagcgaggcgccaagtacgtgatcgtgcaggggctgccgctgacggggtgcctgccgctggccatgacgctggcgcgcgccgacgaccgcgacgccgtgggctgcgccgcctccgtcaaccgccagagctacgcgcacaaccgccgcctcctggcggccctccgcgcgctgcgccgccgccacccggccgccgtcctcgcgtacgccgactactacgccgcgcacctcgccgtgatgcggagccccgcgcgccacggcttcgccgagcccttccgcacctgctgcggctccggcggcggcgcctacaacttcgacctcttcgccacctgcggctcgccgcaggtcaccacggcctgcgcgcgccccgccgagtacgtcaactgggacggcgtccacatgacggaggccatgtacaaggtcgtcgccggcatgttcttcagtggcgacggctactgccgcccagcgttcaaggacctgctggccatgaaagcccgccaggggaagccgtgattttgagacaatcagaatgcacgttccaattacaataagtagagctgcatgcgtgacgaatccatgtcatcttcatcgtgaacccttaaccatttatcaggcatttataattggatccacatacgtatgatgatgatgagcacaaaggatttaacttcaaaaaaaaaaaaaaaa

SEQ ID NO: 14604 - DNA, 1515 bp, Zea mays
ccgggattattcgttgccgtacaccgacaggtttagcagccagagctcgccatgcatgtagttcgttaccatcccatttctttttacagtttcttggtccaggagctccaggtccagctagctagctagctagcccgcgtggccggccggggtgccccctcggcccccggcggcacagagtggtaagcatgggcgagcaccacagacaaccgcctcgacctcggcctcctcctcctcctcctcgtggccgccgccaccgtcgtcctcgccgtggccgcggccccggcgcatacaccggggggcaatactgctacccctccgccgccgttccggacggtgtacgcgttcggcgactcgttcacggacacggggaacacgcggtcgacgacggggccctactcgttcggctacgtgtccagcccgccctacggcgccaccttcttccaccgctccaccaaccgctactccgacggccgcctggttgtcgacttcctggccgaggcgctggcgctgccgtcctacctcccgccctacctcgccgtgtccgtctccaacgccaacgccacggcggccggagccggcgtcaacttcgcggtggccggcgccacggccatcgagcacgacttcttcgcgcggaacaacctcagcatcgacgtcacgccgcagtccatcatgacgcagctgggctggttcgacgcgcacctgctccggtcctcctcctcctcctccgccgccgccgccgccgacgcgctcttctgggtgggcgagatcggcgccaacgactacgcctacacagtcgtcgcccgcgacaccatccctcccaagctcgtccgcaccatgggccgtccagagggtcaccgccttcgtcgagggcctgctggagcgaggcgccaagtacgtgatcgtgcaggggctgccgctgacggggtgcttgccgctggccatgacgctggcgcgcgccgacgaccgcgacgccgtgggctgcgccgcctccgtcaaccgccagagctacgcgcacaaccgccgcctcctggcggccctccgcgcgctgcgccgccgccacccggccgccgtcctcgcgtacgccgactactacgccgcgcacctcgccgtgatgcggagccccgcgcgccacggcttcgccgagcccttccgcacctgctgcggctccggcggcggcgcctacaacttcgacctcttcgccacctgcggctcgccgcaggtcaccacggcctgcgcgcgccccgccgagtacgtcaactgggacggcgtccacatgacggaggccatgtacaaggtcgtcgccggcatgttcttcagtggcgacggctactgccgcccagcgttcaaggacctgctggccatgaaagcccgccaggggaagccgtgattttgagacaatcagaatgcacgttccaattacaataagtagagctgcatgcgtgacgaatccatgtcatcttcatcgtgaacccttaaccatttatcaggcatttataattggatccacatacg

SEQ ID NO: 14605 - DNA, 6296 bp, Zea mays
  misc_feature (889)..(889): n is a, c, g, or t
ttgctgcctgcagggaccgtgacaatgactaagactttgatcatcacatctgttatcaaccatgctaccaataatgctattgatcatcatcactatttatctaccataggtcctttttttggacttttttcagcttctgtccactaaaagttgtcgcggactgccaaacgacccagtttttcagtccgtttcaataatgatcggtttagtaaaaactgtctaaaatcacgcataaaacacaatcgaccgagtcatcgcgatagtaagaatccatcgttatctagatcctggactttttggaccacttcatttttctccacgcataatcctcacgatcaaccagattctcttcgcagccagattctcagaaaagctgatcgaaaaaaactgaaccaaacaaaccatactgattcgatacatagtcttcgttagcctacaaccacctcaacaccaaacgttaccttttcttttaaatatttttagttaaaatgaaatatgacattttattttgcaactgccctttctcgctctcgcccctgctctctcccgaactttcgctcctttctgtaattagcggcaccaatctccagcggcgtgacatatataagtcattcttgtcaagcatttacattaccagaattggcatgctagtatagaattgggatttaaggtataaaactctttatcacatcattagacacaaggagacgaagtttgggcttgattatatgtttgaatttgtgcaagaaaattcagagaagctcattttttttctgccttcttagatatcttgatattttcatatagatatatagtaaaaattacgtacctaaaaatctaatattaaattataatacaaaatagaagaagtaactagcgcgtgctcatncaaagcaacgttggtgtgcatccaagcagcaataatccaggtagcagatggtagtaagggtaaatgtactgtggagccagcaggacaaggaagctttggccggccgtctgttcttgaagccattctgtggctgctatgggatctggatcggcttatttagctggtagttgcaaagaagtaggaaccgtaaatggcatgcattacttctatacatggaccgcatgcacgtagcattgtagcaacaaattttgtaattatattacgtgtcatatgatcatctccatcgaaagcatggtttctttaaaagcaaatttatattatggtcccgttttggtttgagtgactaaagattagtccctccattttaatctcatctagttattaaattgccaaacggtgaaactaaaacagggactaaagtgttttagtctcaagtcgggttgactaaaagagactaaatcatattaattccattttttatctcttctttatttcaattgcactaatagcggaagaatattaagaggtattttggtcctcttatgatttatttaatgtgttctggatacttttagtccctataaatcaaacatggtagagaataaaatttggtcccctaactaaattttagtcgttggactaaaagaaccaaacggaccctaacactaatttttgtagtacaagtagatctaaatagacctgctaataaacatcctaattatagcaggtttagagttgctaataatatacatatgtctaactatctattagcaaatggatacgaccagagataccagtagccagctgatttttagtggtgccgaattcaaacagaccctgcatggtcgatgcctcgatgggctgatcttatttctcggtgcgtgcatcaaggtgtgtgtgtgtttacagaggtaggcgttgattgtgtcatggtctatgctgtcgttattattaaaactagtgttagcagtgtcgacgtgtggagtgagaagagcaacttccggcccacacaatctggacagatccgatctcaggcatcttcgccaaaaccttgtaaaccgacgtgtaaaatattattttatgttgtagattatattttttacataaaatttttgaaatagagagtaaaacagagaataagatagaaattctgctggctcgagggtggtcatgcccatcgtcccgacacgctggccccacctgcagtgaggtgtcgtgcaaggtgcctctcgtgcgacagatggggtggggccccggtggtccaagctggcacgctcgtgactcggtactcggtagctggtggttagtggttacagcagttgccgtctttgtcgtcccgtggctcggcttcgcacggccgatcgagcgcccgagccgaacacacacggcttggcttgcctgccgttcggctcgagtggtgcagcgcagttaggcttctttgtctactgtggtagcgattagacagggatgattagcagcagctcaaaaacgctagctgctccagatacatgcacgagaaacagcatatagatttgtttaattagtgaggttgtagtgcgcgtcaatgagcacgatcagtattctaaatctcgcccactcgttaaagatgtacaacttcgatgttcctaccgatcgatgcataccatttgtgactacagaagcatacgatcagtattcattatgtagacgaaaaaaaagagagctaaaaataactgtattttgagacgggggagtaggttgattaaaccacgtggaggactagtgctaattattgtcatacgtgatatccaaagcatgatatcgaattgtttacaaattttcgagagcgttgttgttgtagggagtacgtgtgtgtacgttagaggtgtcttcttcgtgcactagacgtacggacgggacacaatgatatatgcacgccactagtgatcagcttacacgtgtcgtctgttgccgggttaacatcaccgcattagtccattttttttcatcatcacccgccataaccactagtttcccccactaatcaccgaaccagcctcgggttaggcagcaaatcagctcgaaaccgagccgaaccaccacaaacttacgacgtggccccaccggtcatcctccttacctaaccctcgtggggctgggccgcctccgagtggaggagcagctgctgcaacggcagccatctcagagaagaaccatcaccactcaccactctcctgcttcgccgtcaccagcggagagaattggctatttatagaacgtttgaaatggtaaataggcgcttcatccaaccacccggcggctcgtctctcgtctcgctctcaccaactccggctccaggcgcctataagtaccctcgcccccgctctcgttcgtcccaggacaaacaccgcgcacgcaccgccttctccactacttacccgaatcctaacgctattccactgcattctgctccgaaatggccctcgccaccaacgccgccgccgcagccgccatctccggagggtccgcctcacagccccgccgcgcgtcgccgtcgctgctcctgctcaggcgccgctgcgccgtcggcgccgtacacgccgcggagccgtcgaagaaccccggcgtcgtcccggccgccgcgaaggcctcgacgccgacggtcgtgcccgagaacgacaccgtcccggccccgtcccttggcccgaacgcgtcgttgcgcgcgaggtgggcggtggacagctggaggacgaagaaggccctgcagcagccagaatacccgaaccagacagagctcgaggaggcggtcaacacgatcgagaagtctccgccgatcgtctttgccggggaggcgcgtcacctggaggagcgcctcgccgacgccgccgtcggccgcgcattcctcctccagggcggcgactgcgccgaaagtttcaaagagttcaccagtgctaatatccgcgacaccttccgcgtcatcctgcagatggccgtcgtgctgacgttcggcggccaaatgcccgttgtcaagggtccctgcctacccatctacgccgcacgccacacaaaaccacgtgaatcgaaattccctttgccttggaaggaactgggcggatggcttttatgtgttcgactgttcgtgcgccctaggtcggtaggatggccggccaattcgcgaagccgaggtcggacgcgttcgaggagaggggcggcgtgaagctgcccagctaccggggcgacatcatcaacggcgaggctttcgacgagaagagccgcgtccccgacccacagaggatgctcaaggcgtactaccaatccgcttccaagctcaacctgctccgcgccttcgccaccggtggctacgcggacatccaacgcgtgacacagtggaaccttgacttcactaaacacagcgagcagggcgacaggtgaaataaaatcttgcacgcactcactcactgattgcagttatattatatgtcatgggtgactgagtttcattattcagttatgttatatgtcccaaaatttcatcctttttttatgacatgcatgactgagtttgtaggtaccgtgaattggcacatcgggttgatgatgcccttggattcatgggtgcagctgggctaacagtggaccagcctttgacgacgatgatcgagttctggacctcacatgagtgcctcctcctaccttacgagcaagccttaacccggcaagactccaccaccggtcttttctacgactgctccgcccacatgctctgggtcggcgagcgcacccggcagcttgatggcgcccatgtggagttcctgagggggatcgccaacccccttggcatcaaggtgagcgacaagatggagcccggcgagctggtgaagctgatcgacatactgaacccgacgaacaagcccgggaggatcaccgtcatcacaaggatgggggcagagaacatcagggtcaagttacctcaccttatccgcgcggtccgccaggctggacagagtgtcacctggatcactgacccgatgcacgggaacaccatcaagactccttgcggacgaaagactcggccatttgactccattctggttcttcttctttcttcttctgtcgacgtcgtactcctcaaaccaatatgaatgtgatacaccatgcatgcatatatatatttacaggccgaggtacgggccttcttcgatgtgcacgaccaagagggaagccagcctggaggtgtccaccttgagatgaccggtcagaacgtgaccgaatgcacgggcgggtcaagcaacgtcaccttcgacaacctgagagaccgctaccacacgcaatgcgaccccaggctgaacgcgtcccagtccctggagctcgccttcatactcgccgagaagcttaggaagcggaggatgcggcggtcgtcggtggcgtctgggctcggcggcagcatcttgcccttgccgccctttggcttttgatgtcttgcacgctggctgtgtgcatgcagggtgcagtgcaggggtgtggtaggagaatcttacgttgtcgtttgccttgctatgtagtatgtaatgctttaatttactgcattctacgtcgttttttcccttcttcttctatttgtttctttttgtacgtagctgcagctcataagagattgaataatactattgctgccacatatatagacggagttggctttgtgaattaataaagtccattgctgctgtcgtcaactgtttccttcaaaaaaaaaaaaaaaaaacggcacgaggtctgtgttgatgaccatccctacatactcctgctccgtgtgtggtgtgtgagatgctcaaaaagtcacgcctgccgtacattcttgacaagccagcaggcgagctaaccgaacagatggaggaggatgtgattcgatctccaatatcgactacaattctgtctagagtcgagacacatgtgcggtagtgctaggttgattctgtctgcacgcaattttcgcgtttattatacattttgattcgtctcgcgctataaaataaatctctcctttccaatatattagggagtgctgcttggttccctcccttttagtctattttattactaaatacgaggatcaaaagggaataaatcagtttttcttccatccctttagtcctatttttttggtaatttagggattataaaaagagagattacaatttagtgtcatggaacccttagtcattttagcatttttttgtccatactcaaataaattattataaatctagacacatagaatacattgaaatggagggagtagcgttttttcttttgaagcattatttggaccatttttggaggctgtcaactaatggccgcttggtctggtgtgtttgcaacatagtactccgtataataaataaactgaagttttttttttggcttccgg

SEQ ID NO: 14606 - DNA, 2908 bp, Zea mays
tgcagtgaggtggcgtgcaaggtgcctctcgtgcgacagttggggtggggccccggtggtccaagctggcacgctcgtgactcggtactcggtcgctggtagttagtggttacagcagttgccgtctttgtcgtcccgtggctcggcttcgcacggccgatcgagcgcccgagccgaacacccacggcttggcttgcctgccgttcggctcgagtggtgcagcgcagttaggcttctctgtctactgtggtagcgattagacagggtcacagggatgatatccaaagcatgatatcgaattgtttacaaattttcgagagcgttgttgttgttgggagtacgtgtgtgtacgtcagaggtgtcttcttcgtgcactagacgtacggacgggacacaatgatatatgcacgccactagtgatcagcttacacgtgtcgtctgttgccgggttaacatcaccgcattagtccattttttttcatcatcacccgccataaccactagtttcccccactaatcaccgaaccagcctcgggttaggcagcaaatcagctcgaaaccgagccgaaccaccacaaacttacgacgtggccccaccggtcatcctccttacctaaccctcgtggggctgggccgcctccgagtggaggagcagctgctgcaacggcagccatctcagagaagaaccatcaccactcaccactctcctgcttcgccgtcaccagcggagagaattgtctatttatagaacgtttgaaatggtaaataggcgcttcatccaaccacccggcggctcgtctcgtctcgctctcaccaactccggctccaggcgcctataagtaccctcgcccccgctctcgttcgtcccaggacaaacaccgcgcacgcaccgcctcctccactacttacccgaatcctaacgctattccactgcattctgctccgaaatggccctcgccaccaacgccgccgccgccgcagccgccgccatctccggagggtccgcctcacagccccgccgcgcgtcgccgtcgctgctcctgctcaggcgccgctgcgccgtcggcgccgtacacgccgcggagccgtcgaagaaccccggcgtcgtcccggccgccgcgaaggcctcgacgccgacggtcgtgcccgagaacgacaccgtcccggccccgtccctggccccggacgcgtcgtcgcgcgcgaggtgggcggtggacagctggaggacgaagaaggccctgcagcagccggaatacccgaaccagacagagctcgaggaggcggtcaacacgatcgagaagtctccgccgatcgtctttgccggggaggcgcgtcacctggaggagcgcctcgccgacgccgccgtcggccgcgcattcctcctccagggcggcgactgcgccgaaagtttcaaagagttcaccagtgctaatatccgcgacaccttccgcgtcatcctgcagatggcggtcgtgctgacgttcggcggccaaatgcccgttgtcaaggtcggtaggatggccggccaattcgcgaagccgaggtcggacgcgttcgaggagaggggcggcgtgaagctgcccagctaccggggcgacatcatcaacggcgaggctttcgacgagaagagccgcgtccccgacccacagaggatgctcaaggcgtactaccaatccgcttccaagctcgaccggcccagcgccttcgccaccggcggctacgcggacatccaacgcgtgacgcagtggaaccttgacttcactaaacacagcgagcagggtgacaggtaccgtgaattggcacatcgggttgatgatgcccttggattcatgggtgcagctgggctaacagtggaccagcctttgacgacgatgatcgagttctggacctcacatgagtgcctcctcctaccttacgagcaagccttaacccggcaagactccaccaccggtcttttctacgactgctccgcccacatgctctgggtcggcgagcgcacccggcagcttgatggcgcccatgtggagttcctgagggggatcgccaacccccttggcatcaaggtgagcgacaagatggagcccggcgagctggtgaagctgatcgacatactgaacccgacgaacaagcccgggaggatcaccgtcatcacaaggatgggggcagagaacatcagggtcaagttacctcaccttatccgcgcggtccgccaggctggacagagtgtcacctggatcactgacccgatgcacgggaacaccatcaagactccttgcggacgaaagactcggccatttgactccattctggccgaggtacgggccttcttcgatgtgcacgaccaagagggaagccagcctggaggtgtccaccttgagatgaccggtcagaacgtgaccgaatgcacgggcgggtcaagcaacgtcaccttcgacaacctgagagaccgctaccacacgcaatgcgaccccaggctgaacgcgtcccagtccctggagctcgccttcatactcgccgagaagctgaggaagcggaggatgcgccggtcgtcggtggcgtctgggctcggccgcagcatcttgcccttgccgccctttggcttctgatgtcttgcacgctggctgtgtgcatgcagggtgcagtgcaggggtgtggtaggagaatcttacgttgtcgtttgccttttgctatgtagtatgtaatgctttaatattttactgcattctacgtcgttttttttccttcttcttctatttgtttctttttgtacgtagctgcagctcataagagattgaataatactattgctgccacatatatagacggagttagctttgtgaattaataaagtccattgctgctgtcgtcaactgtttccttcaaaaaaaaaaaaaaaaaacggcacgag

SEQ ID NO: 14607 - DNA, 2578 bp, Zea mays
ttccacggatccatggattggtgcacgagaccattacctagagccgcccgaccggcaaaatcgaagccacgcggcttcttccttctgcgttccgcccctcctcttctccctcctcgcacccgcactgcccgcccgttcgtccgtcgtcgtcttcgccgctccctcccggcctcccgggctggacgaaacgaaccctcgctcgccctccttataaccgaacggccgaacccagccaacccagccgtttctcttcgtacggcctctgccagccagtgtctgctactagggaagcataccaactccccattcttctcttcgccgcagccaggaaggaaggatgtgcgggatcttcgcctacctcaactacaacgtctcgcgggagcgccgctacatcctcgaggtcctcttcaacggcctccgccgcctcgagtaccgcggctacgactccgccgggatcgcgctcgatgccgaccgccaggtcccctcccccgctcccgcttcctcttccgacgcgcggccgtacgccggggcgccgccgctcgtgttccgccaggagggcaagatcgagaacctcgtgcgatccgtctactccgaggttgatgagaaggatgtgaacctggatgctgcgttcagtgtgcatgctgggatcgcacataccaggtgggccacacacggtgtgcctgctccaaggaacagccacccccaatcgtctggtgccggtgatgagttcttggttgtccacaatggcattatcaccaactatgaggtcttgaaagagacactaactaggcacggcttcacctttgagtctgatacagacacagaagtcatccctaagctagcaaagttcgtttttgataaatctcatgatgaacaaggtgatgtgacgtttagccaagttgttatggaagtcatgaggcagcttgaaggagcctacgcacttatctttaaaagtccgcactatcccaatgaattgattgcatgcaaacgaggcagccaactgatacttggtgtcaacgaattgagtggtcaacagaatgggaaatcatttcatgatgtcaaaaccttgacaacaaatggaaagcccaaagaattattcttctccagtgatctatgtgctattgtagagcatacgaagaactacttagctcttgaagataatgaaattgttcatattaaggatggtagtgtttcgatcctcaagtttgaccctcacaaagagaagccagcatctgtgcaacgagcattgtctgttcttgagatggaagttgagcaaataaagaaaggaagttatgatcacttcatgcaaaaagaaatccatgaacagccacattcgttgaaaacaacaatgaggggtagattgaaggatggtggggttgttctaggtggactgaaggaatatctcaagacaattaggcgctgtagaagggtggtatttattggttgtggaacaagttacaatgctgccttagctgcaagaccttttgtggaagaactgactggtattcctgtgactatggaggttgcaagtgacttgctggacagacaaggtcccatctacagagaagacactgcagtttttgttagtcaatctggggagacagcagataccctccttgctctagattatgcactagaaaatggagctctctgtgttggcataacaaatactgttggaagcacgctgtctagaaaaacacactgtggggttcatatcaatgctggttgtgagattggtgttgccagtacaaaggcttatacaagtcaaatagtagccatggcgatgatggcgttggctattgggtccgatcagatatctactcaagctaggagggacagtatcattagtggactgaacaacctttcaagcaatgtcagcgaagttctcaagctagatgctggaatgaaggagctcgcctcttcgctgatcgactcagagtcgctcctcgtgttcggaaggggttacaactacgccaccgcgctggagggcgccctgaaggtcaaggaggtggcgctgatgcacagcgaaggcatgctcgctggcgagatgaagcacgggccgctggccctcgtggacgagaacctccccatcattgtcattgcgactcgcgacgcgtgcttcagcaagcagcagtcggtgatccagcagctcctctcgcgtagggggcgcctgatagtgatgtgctccaggggagatgcctcggctgtgtgccctagcggtgggtcgtgcagagtcattgaagttccacaggttgcagactgtctccagccagtgatcaacataattccattacagttgctcgcgtaccatctgactgttctccggggattcgacgtggaccaaccaaggaatctggcgaagagcgtgaccacgcagtagggagaggtagatgagatgtttgtattgtagttaattgtccttgctcttgaggtggctagtacgtagcataagtattatggtgcgttaaacttgttgttttgtgaacgaaatgcacctctcttttttttaattatggtatattggtgtcaaaaaaaaaaaaaaaaccctgggatctctcatgtcagaaacttcagtaag

SEQ ID NO: 14608 - DNA, 1398 bp, Zea mays
  misc_feature (15)..(15): n is a, c, g, or t
  misc_feature (32)..(32): n is a, c, g, or t
aagagcagatcgagngccgttcgcttcattcntcctctggtctgcgccgcgggcagtctgctctgaggaggaaggagtccgtcaggtcgagatcgaaaccgactccgcttccgccttccccgccgttggggttcatcagcagttcgcagggtaaagaaagggcggccgcgatgtgggtggaaatcctgtgcggcctggtggtctacaagatcatccaacgcgtcttcttcgccggcggcgacgacgcttcctacctcgccgacctcgactcctcccactccgatctctgcttcgccgtcgcctccaggctcgagaagctctacgccggtcgatgcttcgtcggtctccgcatccccgaccccgacgccggcgagcgccagcatatcgacgttgtcctcgttaccaagagggaggtgatggtggtagcgatcaaaaacttatctggttttgttgaggctgacaaggatggaaattggtcttgtcccactgacaagaagcataagcatgagatatttccaaacccggtattagaagtcaacagactagctgctaatcttcaatcatacttggagcaaaggggagcaaaactgcctgatgggcatatcatcgggagagttgttctgccaaatcccaactgcaggccttcctatactataagcacccaaccagaggtcatgctgtatgatcaatggaaggatctcaagacagactcaaagactggactctcagcatggattaaaggtgcatttactggaagcagaagtgacatgcaagattctgtactccagaatctacattttattctcagctcatcgcctatgtgggacaggttggaactcaaaggagacaaaaatgttcttggtgaattcattgaattcaaaggcaggcatgaggacgttcaacttctcaaaattctcaagaggtcaaaagtcagtcgcttcatcatccagaagtcaactctttttggtggttttggtaggtcacgagttcaaatattgtattctcctcgtgactatcgagctgaggggacttcatcttcagagttgaaagagatttctgtgaagcaatacacggagatcgttttccaaccactgcgttccaaaaaggctcggaagttcaagctgtccaatgttgtttctgtcacactgagtgcctagcaagcagaagcttgcctttcaaatttaggctagccaagtagccatatctcttgtattttatatttctcgtccgtgtgtgtaactcatcagttgtgtgcttctctgtttgcacttgtaattatgtgtctgttcttgatgatgagggaagtaacttacaacgacggctaactgaatatgcttcgtactgttgcttgacaaaaaaaaaaaaaaaatacggggacctgattgaatatgtttcgtc

SEQ ID NO: 14609 - DNA, 2081 bp, Zea mays
taagaacggtaatttaaacttaaagagaaagcatgacaatttgatgaaggagaagggagagattgctaaagaaaatcaaagccttgtaaagcagatggaggatcttaaatcaactcagaagacaacatctgaaacaacacttgagcaggctattaaagaaaaggatttcaggatacagacattagaaagaactctggaaaaggaaagagatgataacaagaaagagaaggcaaagagtaggaggaatgagaacacaatctttggtgcacttcagaaggtgcaacaggacaagaaacaagtagaggagtctatagataagcataagcaggctgtgagagagttgattgagaattatcctggattatcatctgaagtgccacctatctctgcactagaagagcaacttctttcatacttccgtgcagctaaagatatggaggaatcttctagtcccttccgtgatggtgcagcaactcaaactccagttgttgaaactgcccctgtggatgcacctacttcagctggagttgcaggacgtccagtagatacttcgtcaaggccagctaaagctaaaatgacggaagaaagagcagttcccaaaccaagcagtgaagtacgtaggcctggaggaagaagaccccttgttcgtcctactcttgaacgaactgaagaacctcatgctgatacagatatatcagctgttgatgcctccacagttcaggacaaaggggggccaccagcagagcaagaaacttctggaattttacctgtgttacagcctttgagtcgtaaacggcttatcacatcttcacagacggtagacagtgcctcgcagggtgaggctaatgatgtcaatcctccatctaagaagcccaaggaggaagaatcttcacaagggactagtgaactcaaaagtggtcaaccacctcttggggatgtagcggcacaggttaatgtgcttccagccactgatgacctagatggacaacagcctacagaagagatcgatactgatcaggcacctgagccaatggtagaggttgaggcaacaagggaagaggatgggggtgataaagatgactctggagatgcatcaacggacatcaaaggccaggatgctgatgctaatattgacgcaaatgcaattcctttagaagaagagcatgtagtggcaaagtcagaggcaataattgaatcatttgatgatgaccggaaaacagaagattcgaaggaagatgctcagcgtactactgcaactgatgttgatgatgacatggaggagggagagttggcagaggaacctgaagacaagagtgacgttgatatgtcagagatcgagggtgaggctacagccgaacgtgctgctgtggaaccggaccaaagtcctataacacaacctggtgcagctgatgcctcaccaagcagaactgcagatgcatctcctgctcgtgaaccttcccctagtccggtccaagctggtgcatcttctcgaccccagaatactagcactgcaacagaggcacgtgaaccttcctctaacccagcccaagctggtgcgtcttctgaacagcggaacaccagtactgtagtggaggctgctgaaactcgttccagaacaatcaacttaagtgagagggccagacaaaacaggcaaaccaggtttcaacgcgcacaacaacctggcactgctcggggtcgtggccagcaatctgttacactcaggaaagatgctacgggtcgaggatcaaggggccgcggggggcgtggtcagtcctagtaaagtagattgtcttttctcgtgcagggataattttgtccattgggatagagacccttgtatttttagattgatcgacgaacttcatggggatacagagacccttgtgtttttagattgatcgacgaattttgtctcattggtttttactaaatgttccctgacctgcgtgcgaatccttgtgggttctgagaccgctatatctaatccaaactgttgtgtttgttggtactaaaaaagaaaaaaaaaaaaaaaaaaaaaaaaaaaaaaaaaaaaagaaaaaaaaataaaaaggcgaccgatc

SEQ ID NO: 14610 - DNA, 635 bp, Zea mays
  misc_feature (28)..(28): n is a, c, g, or t
  misc_feature (63)..(63): n is a, c, g, or t
cgcacacttttgttgcgacgacccggcnccagggagggcacacaaatagtaggggggcagcanagactcagacgatcacaagcatcttcaacggccactggaacatgagcatgaactatctcggcttgcattccctccggaacagaggtttccggcagctcatccggtcctacttcatgtccggtgatcatgttccggacgtcgtggtcctgaactctggcctgcacgatggctgctactgaacgagcgtccgcatctacgcgcaggctgcggatttcgcagcacagttctggtccggagtcatggacaaagtccgggctcgtgggcatgcagtgcccagggtgttctaccggacgcagatgcctcagggtggtatagatgcagggaaaaaccaggcgactcccttcacggaattgagagatgaagctggtgtcacatactcacatctgcagggatgggtcacgttgcagacacttcctaatgaagtccttgtagtgttgcgaaaggtgtggttggtgcaaggtgattcttcactgtgacggcaacgccaacagcgaactgggaaggtgttgcgggtctgcacaacccttgattttgttagtagacagcacaaggaagtttaacctgtacagcac

SEQ ID NO: 14611 - DNA, 3543 bp, Zea mays
tactgtatcgttgtcgttccatcatgaggaatcagagagtgtacatagatctgagctttggagttggaagaagctcagtcaatgaaacgggtacacatggccttatgacctagattatttgatctataaaaagaaatggcctaccttgatggctttctagacaatccgtgctctctttctgattggcatacacttctattcttgctctctgtagacagagcttatatgtccatcatatttggagggtctgtgtaaactgtaattgtagttgttgaagcctttgttaaattattgtttaacatttcttatttttagggagataatgattatcttgatatggtgtttactcaagtgtccttggaaggttacctgtttatttgtcttatttgaatgtaaatgtgaagtgaacatttttagataactgagttaaaccatgtctaagttctaatcattttcatctcctttatcgtaataaggtctctactgaccatgttattaataattacccacatatatatttctttgacttagcatgaccaaagtgttctctttcgcagaagtagaaaacttgtgccggtatgagcttcctaatgagagctgggaagtaaatttacctgctcaaaaggtgtctcctgagctcctagaaccaacattaggcataaactttgcaagagatggaatccaggaaaaagaatggttgtccatggttgttgcacacagtgatgcatggttactttatgttgcattttaccttggtgctcgatttggtttcaataaaaagtaaaggttaattttcattccatctttatggaatatgtactacagtctctttatcttttactgcctgcctttttttgtttatccgtgatgttttcctactttatgcaaagctttcctacatgcttgctttgtcctgcaaaatattagacctattttgataggcaacaggtacaaataatatagtataaattataagtactacttaagaactgtgaataaaaatgaatctgcacaatatctccacttggaattatttgtctcagtgaaggaataacatagtcaaatcacatagagtctgcactgctcatactactcaccacatctaatgtgctaattacttttatgttctcatttatgccttttcagtaatgatgttgccaatctcaacaagacgctatgagcgatttcctttagcacgaaacaatgctgagcaattgtagccattttctggattagccttgattattttattatgtttagctttatcatttgcttttctaaaaactacatatttcggtgactaacacgacaatgcaaccgaggatgataaatggtgagcatgcggcacttcgtcgacactgcccagctacacccagtttccctcctggcttctctgattatcgaatttttgtctgagcgcgtgcggacgctggagccggaagagttcccgttgaggagaagcttgtcgcggtccaaagagagaggaggcatacgtgtggacgcgagatggctagagccagaggaggagtgcgcacgcagaagagcgaggaggacaacgagtcctcacacctcaccgctaggacgtcgtaggtacaattctcatcccaacccagttcaattaatctgtttaggtccactttgaccactgcttattattagtatgttacaatcaatttgtatcatctatctcaatgtatctgtgtgtgactcgatttgagttcttatctgaagcatgtccagtgttgctcttacaacttaaattgaagtcttttctgatctcttttactatgctttgtccccaaattttagttggtagtaccctaactccagtctctaggaacaatttgcaccagcagtgcttctcctgaaatagagacaatagggtgatcatcaatataatttcgcattgcaaatgtttaactggaggcgaattctatttatgatttctatacaacaacaataatttcacaatgcaaataatatgtttattatgtattgtttgcatttcttagtacactgctatagtttgtttaattattggatctcttaaattgttgtatattagagcgttggcttgtgtttttgtagtagccaaataagcattgaattgataagttctagaaaactgaagtggtagactagacaagttccacatgactaaatagagtgaattgagttacagtcaagaagtatattcaccttgtagagtgactgaatcataactttctcatcaaaacaccaactacagtttgcgtcacttaaatctacataagcaaagatgaaaaactgtaagacacttctgcgccatatagtcctatagttctactctagcaagtcgcactattgtattatgtttattttttaaaaaaattgtactactactgtactagcacccttctattccattcagacatgtaaagattagcaatcagtatgtgagacgttgatgcaatttcgtccaagaaaacagagagtggatataacacatgccatttatacgacaaaactaatatcgatatgagcataatcattttagctttacaacattaggatataaaaattataaccaattaagacaaatttaaaacataaatcaaactattgcagatgcttaaaaatgtagagtgtttgggacagagattggtcatctccaaaatggtcagttattgactatttcaatcagacaaaaatcacaaactttaaatttattgtagggaggagtgtttcttgtgtttttgtagtagccaaataagcattgaattgataaaacactatttgactcgctgtggttccactaccaccatcgcccactttagtgacccattcatttaggctatccttgagattgataatttcagtaccacttgcttcactaacggcctccaggatacacccttgcttgctctaataatagatgtgtttgtgtctttacacacgttttcatactcctaatgggcatgcttatggaccgtgaggactcaacattctttgtctattttctctctcttaggaatggctttgtgattttataatagttctttaacatgagtggattaggcggtggcagggatttggctgcgctggttggtttctcgagagtaaggcacttgcgttgttcccgattagcataacaccatgcgacccgcactcatagatagagatattattggtagtttgaataattattagtgaactagggttactatattaaattttcttgttaaatcttatataatacaatgtcctattatggaattaacgtgttttatttgagatgttgattaatatccgctacatatttatttttttatcagtgacaaagcacgagtacaactttatatctatcttttatggtatgtaaacatctacttttagtaatgcgaacagaagtatagaataacaattagtgttttggcatatcaatatattttatcgtcgctccttgtcatagaccacactacgactttctgctcgtgcttcggcttccatgctacccctcgcctgaagacagcactcgcatcatccaaccttcctttttagact

SEQ ID NO: 14612 - DNA, 1208 bp, Zea mays
ttttcgattgggtaccgggcccccctcgggtcgaccccgcgtccgaccgccgtacgccccactggtctcccacgcatcccgtctcgtttcgtctcggtctcgcacctctcacgacggcaccaccccagcgcggcgcgagtggagacgccgctgctccgtgcttcgccgcgcctacctaacccaagacctgctagacctgagtggctgagtgttcgtgttcggtcaaaacccaccgcgcgagcgcctccagagtccaaacccgctacaaatctcgcgctgcgcattctccccgtacgatacggcggcacggcccacgagccaggcggtggcggcagctagctagctgcggagtagcaccagccaccggagggaagtgggcggcgcgatgggggacgagccggacggggaggcggaggagtacctcttcaaggtggtgatcatcggcgacagcgcggtggggaagagcaacctgctgtcccgctacgcgcgcaacgagttcaacccccactccaaggccaccatcggggtggagttccagacgcagagcatggccatcgaaggcaaggaggtcaaggcccagatctgggacaccgccggccaggagcgcttccgcgccgtcacctccgcctactaccgcggcgccttcggcgcgctcctcgtctatgacattacccgccgctccaccttcgacaacgtcggccgctggctccaggagctcaacacacattcggacacgacggtggccaagatgctggtgggcaacaagtgcgacctgggcgacatccgccaggtgcccgtggaggaaggcaaggcgctggccgaggccgagggcctcttcttcatggagacgtcggccctggacgccaccaacgtgaggacggccttcgagatcgtgatcagggagatctacagcaacgtgagccgcaaggtcctgaactcggactcgtacaaggccgagctgtccctcaacagggtgagcatcgacggcgactcaaaagacgagcagaagcaggggagccggttcgggtgctgctagaagtggtcggggggtagcggtacattattggatcgggttggatttgaaccggagatgatgctttttcattttttttgggtggcgggtgggggcttgcttgtaaactgtaatacaaggtttgactctttgtttgctgttacgttacacttaaaaaaaaaaaaaaaaaaaggcc

SEQ ID NO: 14613 - DNA, 2913 bp, Zea mays
  misc_feature (2730)..(2730): n is a, c, g, or t
  misc_feature (2738)..(2738): n is a, c, g, or t
  misc_feature (2749)..(2749): n is a, c, g, or t
  misc_feature (2781)..(2781): n is a, c, g, or t
  misc_feature (2784)..(2784): n is a, c, g, or t
  misc_feature (2788)..(2788): n is a, c, g, or t
  misc_feature (2808)..(2808): n is a, c, g, or t
  misc_feature (2859)..(2859): n is a, c, g, or t
  misc_feature (2873)..(2873): n is a, c, g, or t
  misc_feature (2886)..(2886): n is a, c, g, or t
  misc_feature (2889)..(2889): n is a, c, g, or t
  misc_feature (2895)..(2895): n is a, c, g, or t
ggatccagatgtctgataagttgatggatgtttggttggatttctgcagttggagctaaggtgtggattgctagttagacattctgagttctagacatttccatctatggagtcttccttccagtgataaattattctatgcactaactttatttttaagctgtctttaacctatatgccatcatacgatggtgcaggttcactattattcttgatttaagatttttaaaacaattggttcctagtaggatgttttacctgagcgtatgaccgtatgttcatattttatatgtccaaaattctcgatttctctgttagggcccatactaatgttagtctagttcttggattgcttctgattgcactttggtataacccccttactcaatatggccattctttatcaaattcatcatattgcacagttcctttcagtaatatattaggcattaggtattattatcagcaaatgcaacttgctaaccgtattcctttttgagttgtaatatgtgaaatcttgagagatcgatcttgtggcaccgttaattttgttggttatcattagattgattgcctggaacaaatggaacacctcctcagtctggtttgtgacgttgccccccttgcctttttagaacattgttcatttgttctgtaatttcctcactctggactttccatctgacgcatcttatcctttgtggaacaataaccaagaaagattctgctgcttctgttcctgccaaaagtaaatctgtctgaacaaacttgtttggctgaactattgttgcccttgattacacaagcctatgtgactgtcttggggatgcaactgtggagtctttgagatggaactgtcctttgtggaacaataaccaagaaagattctgcttcttctgttcctgccaaaagtatatctgtcacaaacttgtttggctgaactattgttgcccttgaatacacaagcctatgtgactgtcttggggatgcaactgtggagtccttgagatgaaactggatttacacaaaagtaaatcctttgtggactagcagtagttgcatatacatggatgggttgaagtttagccatcctggttcatattcatgtagtgcagttcatattcatgttgatatgcaatacaggttggtgtttgttcaacttgaatgcaagctaggatcggttgcttctatttatgtaactctgtattatctccagattagtatattcatatattcatcttgttatatggtgcactaggatcttgaacaataattttattggagctggttgttgtggcaatggagcatcttctacctaggccaaatgagatggagtctgtggcatgttttggtttgagtccggtcattccatgatttttattggagctggtcttgtggcaattgagcatcttgagcctaggccaatctagatggaggactcctagttttattggcgaagatgtttttgtggagtccgatcgttccatgatttttattggagctggtctttggcaattgatgagcatcttcttccttggccaaattggatggactctagttttggtttgagtccgaccatagaatgatttttattggagctggttcttgtggcacttgggcatcttctcccttggccaaataggtggactcactaattttgttggacgagattaactgtggaaggtttcgatgttttacaattggaacacattcactgttcattcctgagtatttaaacgcgatacttcagataccttctcgtactaggtttacttattgatcataaaaaaattcctgtttttttacgtagcgtctttgttgcttctctgttgttttacacatgtgctctgctgctttgtattttactgcttctttgttgttttacacatgtgctctgcttctttgttattttacacgtgtgctcgatgttcatccataaaatatgctaaaagaatagctacttcgtttggcgcaaaaaccagttacgtgttttgtttatttttataatgtctgagaacatgattttttttttgttgtattatttgtgttccctgtttgtttgtttgtttgcggtttaacactgcctttgccggtcccaagcccggatgcgaaaatgtggagggaactgcaggttgcttggcgagctgttcaggtttagtgttgagacttccttttaagacatgctgtgccactgaatgaacgcatcataatgaacttggacaattgtcaggcgcgcagcaagctgcttacctgaacccgtttcatctattgagatgtgggaattaaagtttgagccacaggcaccggctgacagacttctcatgaaagcgttgatcttcgaaatggacacctaacgcgcgttaatattgtttatcttaaattagcgtacctcaacgttatcgtggagataaaccagcatatcaaatagcattatctatccagctccttcttttttacgctacctggacgtttttagctaattttatcagacctagcagtaatcacagagctgtcaaacaaaactgtcaaacagagcagagagacgaagttttctgaaactgaggaaataaccacaccctgaaagttcgctgctcgcagcgtcggcatggtgtgcttcattggtaatgtgtgttcagacttacgtttcttgaagacagaaaacaaactttggtaattgaacagaagacgggagaaggagagaaagcgtggggcacgtcacacgtaggtgtncaagaggncaatattcttntaagggcccgtttgttttattggaattgaatnccntttnaataattataatttagacanaactaattaagttcatatatttatatatgtaatatatttgtatattatccnaaattatatgaganagatagttatatnctnaaaaanaaaaaaaaaaaaaaaaaa

SEQ ID NO: 14614 - DNA, 968 bp, Zea mays
aatgtatagatggtggtggatggactgaggcggacccgccgttcatgggaccgtgagaaactcggctacacctgcaaaatggatatggcaatggcttccttcgtcgccgctacgcaccaccacggcagtcacctggccgccggcttcccctactccgcgcgagcaggcaggagcgttggccgcagcggcgtcaccatctccattagagcccagaagaagagtaatagcgactctgggagtagtagcggaggtggggacgtgcggaccagcagcgggaggcgagtgtggcgtcgtcggaaactgaccaaagaagatgacatgttgcgttacaagttggatcgtatccctttcttagaagagaaggtgagaaaggtaagggagaatgggaagatcatatgcctggatattaatcagctgatgttatctcaagagaatagatttgcgttcaccatggaggtggctgaagaagctaatgcctatcttgagaagaacaggcatgaatatgggttaaagaagcctatactgcatgttctcagtgatcgcatgaatgaatctgggttttctcggcctgagggttacctttatccttatcctatcaagcctggcccttatttcattaaagaggaaggaaactgagtaaatcacatgctacttggatcgtaaagcacaagctgggaggcagcctttttcagaaggaagtagtcctgtagagcttagtcatgttgtatacactattcactctacaattgggaggagccaaaaattctctgaaatatattgcgtatcaaatgctcgaagaacttgaaatcatggtggcaggcgtcagaaatgttgcaataatatcttagtattaatgcaaagcgaagacaacgggcctttcaatttgggcggttgtatttgttgcttcagtgctaacaggtgaccatattccttaagcaagcattaaaatgacaaaaaaaaaaaaaaaa

SEQ ID NO: 14615 - DNA, 1070 bp, Zea mays
ttgccgggaccgtgagaaactcggctacacctgcaaaatggatatggcaatggcttccttcgtcgccgctacgcaccaccacggcagtcacctggccgccggcttcccctactccgcgcgagcaggcaggagcgttggccgcagcggcgtcaccatctccattagagcccagaagaagagtaatagcgactctgggagtagtagcggaggtggggacgtgcggaccagcagcgggaggcgagtgtggcgtcgtcggaaactgaccaaagaagatgacatgttgcgttacaagttggatcgtatccctttcttagaagagaaggtgagaaaggtaagggagaatgggaagatcatatgcctggatattaatcagctgatgttatctcaagagaatagatttgcgttcaccatggaggtggctgaagaagctaatgcctatcttgagaagaacaggcatgaatatgggttaaagaagcctatactgcatgttctcagtgatcgcatgaatgaatctgggttttctcggcctgagggttacctttatccttatcctatcaagcctggcccttatttcattaaagaggaaggaaactgagtaaatcacatgctacttggatcgtaatgcacaagctgggaggcagcctcttttcagaaggaactcaaggaagtagtcctgtagagcttagtcgtgttgtatacactattcactctacaattgggaggaacaaaaaattctctgaaatatattgcgtaatcaaatgctcgaagaacttgaaatcatggtggcaggcgtcagaaatgttgcaataatatcttagtattaatgcaaagcgaagacaacgggcctttcaatttgggcggttgtatttgttgcttcagtgctaacaggtgaccatattccttaagcaagcattaaaacgacaatctgcagtgagaaccatatgaaagctgggccagtagccattcctcgtcaggattttttttgataaaccttacctgtcatttggtctttgttattgtttccatttggtaggaatctatgcgattaataagttcagaaaggtgacttt

SEQ ID NO: 14616 - DNA, 971 bp, Zea mays
gactccttagggcgattcgctctccccacccccccccggcggggggaccgtcagagactcggctacctctcctgcaaaatggctatggcagtggcttccttcgtcgccgcttcgcaccaccacggcagtcacctggccgccggcgtccccttctccgcgcgagtaggcaggagcttaggccgcagtggcgtcaccatctacatgagagcccagaagaagcgcaatagtgaatctgggagcagtagcggaggtggggacgtgcgggccagcagcgggcggcgagtgtggcgtcgtcggaaactgaccaaagaggatgacatgttgcgttacaagttggatcgtatcccttttctagaggagaaggtgagaaaagtaagggagaatgggaagatcatatgcctggacattaatcagctgatgttatctcaagagaatagatttgcattcaccatggaggtggctgaagaagctaatgtctatcttgagaagaacaggcatgaatatgggctgaagaagcctatactgcatgttctcagtgaccgcatgaatgaagctgggttttctcggcctgagggttacctttatccttatcctattaagcctggtccttatttcattaaagaggaaggaaattgagtaaaatcacgtgctacttgtaacaggattatcattttcaacaactatagtttggcctgcatccagacaaaagaacatattcaggtatggtattaatggtctagcaattaatatattgcacagaagcaagagcgaatcccatacctgcagatacattgaagagaagaattaaaaggatgatgccaagtgcaaaagtgtctttaggcatattttgttctcttcgactggtatgttattgccttaggaggattcatggggacgagctatcacacttctgccccttttatacatgggtgctggctgagacagctaaagatgaaataagttgtgacatt

SEQ ID NO: 14617 - DNA, 1510 bp, Zea mays
actttaaaattatgattgaggtctcatgttcctgcagagtaatattcttttgaataattgtgagaagtattggtatggtgcttatagacaaataaagtccatctcgtaagtatgctttgttctgtgtctacatttattcttttttacatgtgtagttgtgtccatattttgcagattgagtagctgagaatattgtgacaacgtgtcattccatgcatcaccctgtttccatcttttgtattatataaaactaagttgaaatcaatgcaaccaactgattgactttaccaatcttcattgatccagatcgctgtcaagaggttgaagagtgcaaagaatggcacagaagcggaatttgcttcagaagtcgagatattgggaagaataagacacaaaaacctcctgagttttcgtggatattgtgcggatggacccgaacggattctggtgtatgactttatggcaaactcaagtctctatgcacatcttcatggaccacattctgctgagtgtctccttgactggcggaggagaatatctattgccatcaacactgctcgggctctcttgtaccttcaccactatgcaacacctaagataatccatggaagcatcaagaccaccaatgtgttactggattcagacttccaggcacatgttggcgatttcggtctgataaggtttattcctgatggaatggatcatgaaaagattaccagcgaaagccaacgaggctatcttgctcctgagtacattatgttcggcaaaccaactgcaggttgtgatgtatacagctttggaataatactattggagcttgctagtggcaaaaggccgatagaaaagtcgtgttctgttaagacatatggaattcgaaactgggtgctcccgctggcaaggcagggtagatatgatgaaattgcagactcaaaactgagcgacaagttctctgaatctgaactgagaagaatggtcttagttgggctagcatgtactcattcagaatctgaaaaaagaccaacaatgcttgaagttgtgccgttgctgaaaggcgaatcaaaagaaacccttattaagcttgaaagagatgagttgttcagctcagactcgatggtgagttcacaaggaacaccaaccccagatgggggcacagactctgtgccaaaggaagatcaagaactggttggagcgtgaaatgtgatatgttgctactgtaggcgatggtagaatgcggatttgtgttattggttgatgattggtttgtgcggtttgacatgaatgtaaattgtataggcattgttttctgtaaggaggtatttacccatcccttttgagagattaaggaagagcatgggggctggagatagctgtttatgcgaagtggtttttgtatgcaccgcatagaaaatgcacatgttttttcaggatgtttgtatatttctctgatcaggctgtccacatattaagggtccgtttggttcgtgccttgtttttaaaaaaaaaaaaaaaa

SEQ ID NO: 14618 - DNA, 3910 bp, Zea mays
  misc_feature (2643)..(2643): n is a, c, g, or t
  misc_feature (2914)..(2914): n is a, c, g, or t
  misc_feature (3134)..(3134): n is a, c, g, or t
ttatggagaatataaagagtctccgtaatataaagagtctcttgtagtgctcaatgctctaataaagctatatacctatagaaagagaacccatatagaaaatgaaaccgatgaagtactaattattatcaataatattaggaagacaatgctgagttaggcgagatatttgcaatgtgagcacgatttaactgggacccacttcaatttgattagagagcttaacggcattccgcccccacttcctccacctcatgagtgcaacctccgtggacgaagcattcgcctcgccttgatctccaaccccttccttccttgcttaggagagagagggaggagaggagaggaggaagaagatggagagggcggccccagtgaggagttcccacacctccacggccggcctactcgcgtggcctcaacccgatggcgccgcgtcgcaggcaccacgtcggcctaaccaggtgaccccgctcttctattctccctgttcgatcctccaccatctacgtataccccgcgcggcgcgccgcttttgatcgtcgttgatctcttattgttccccggcctccctgcagccgacggaggaattcaggaaggtggtgttcggggggcaggtcaccgaggaggccgacggtctcaacaagacgaagatgtgagatagcttccgcgccttcacggccggattcctccctccgttcctgtgattcgggatcggatcccaagccgttctatgcgatcggtatccgcatgcatgatcctcattttgtggctgcttcctaattacggttgctccttcctgctcccatcattccaggaggacgacggcctccgcacccaagtcgaaggagacaacagggatcggcatgtttaaggccgagagcgccgccgccgccgtcacaactgcatcccgtgatcgccaggtgcacaacttcggatctgcattctatatgtggggtggaagtgtggaacattgtttagcaattagcattgatgttttgcacagagtactgttgtatgtgctggggatagttccttttgtttcacatggcatgtcggcaggatcaatgaagaatgcctatcggatttgtcgcataaagtgtcaggatagataccaggtttcgtagatgttcaataatgctacagaccttagcctcaggttactacgagtttgcagacttacagtgttctcaagccctcttaacaaatttttattcaacagagcggaagtgcaaatctggtcaattaaaacatgaccaagagattctgcattgtcagtttgtcaccaatctgtttgattggagattcaaccccttatgatgttctgtgttcttcttaaatactagtaaaaaatattggtctcttcgtgaataaaaatcgatgtagagcagaagtcttcttgtgtgatatggtgagacaattagcttttataatctgcaggctagccagatcactttttctcaggacgggaccattcctcccaggaagccaacttcagttgctggggtggcgaggcagcgcgaacttagccataccgttgagagttcgggggacggtaagatgaagcggcaggtgtccaatgcgaaatccaaggagctcagtggtcacaacatctttgctgatcatgaagatccgagtcccaacaggtcaagcagctctgctgctgctctggcacatgtgaaaaatgcaaatgtactgcctgagccatcctggtagcttattcaacttgtggtggctacaaactctactgaacaactaactgccgttatctttgtcagcaggtgagctccttctcctttggaaaggccgacatggacagcacagtgaaaacagcaaagaagaaagggtccagcaacaagtctactgatctgatgaatggcaaggccatctccgagagggattcagcgcctgcagggaaacagcctctgaaccgcgcgaagccgaaaggattgagtggtagtagcatttttgcagacgggaaggcctcgacaactggtgatcatgcaggccgtcggacccggcagccacctggcggcgacagcagcatcttgctgggctagcgtgcatatggatattgtcctatgccgccacacgggtggttggtccgtccgtgtgcggccatgttttcctgatcaggcgatgagtcccatctcagatgatctggttcacttctggcgtgtgtatgggtttgtgtctgtgttggttgtgacatgtccaatggaacaaccctatcgctactgcgtgtggtgccgttttgttgtgtagtagtacaacggatgacatgtggtaccgtttcgttgtgtgtacgtggatatacatatgtgtgtttggttattaaatactccctccgtttttaaatagtgctcgttttaacactttgttttatatctatattcaaattgatgatgataaatttagacacttatataaaaaacatacatcaagtagtctaaaacaaattttaatttgagacaaagagtgagaaattagtatatggtgccattggtccgatccagctcacgtgcaacgaagttgcaaacccattgcgctgatctcattcaaggttgcatgatagtgccacataccaataggtattttcattgttttttaaatttcttgatatagagcaatatatgaaccaanaggtgtcataaaattaattgttcaagaaagtgagaaaaattatgagtaatagtttattaaacatggtcttttatactgaaagtttgaaacaaaggcatgaaaaaatgcaccttataccactaagagtaattatttcaaattctaaattcatttatgaagtgtcagattgaatttaggggatgtttgaatgcagtacaactaatagttagttgactaaaaaatttctagtagaattagctagctaattattagatgattgactaaaagtagntaatagttgaactattatctagactgtttggatgtctttagttaattttaatagctaactaatagctctagtgtatgttcaagaaagtcaacggaattttaacataaattatccgatccaaaattttcgggtaacccaaatatctaggcataaaccaatttcaagtctaggaagaattacaattggcattaaaaacaggaacaataaggcagatgcatcntcaggacttgttcgtttgtgtcggattacacccggaatcgttccagctaatcaaagtttatataaattagagaagcaatccggttagaaatcgttccgacccaccaatccggcacaaacgaatgaggcctcaatggctgctcttctaggcggaagaaatccgccgctcatgtgaagcgaggcagagcaccaacgagcaaaggtcagatcaaaactggtctcaagaagatgtggtcggtgatcgagcgcaggggcggatccaagacaaaacgagagtaaatacacagttacaacgacgagtatctaaatatcaaagtgagacatctagattggactgagcatgaaactttatggtgaaaatctagattatactacctgcaagaaataaatgagcgagggcctatgctctcactcagggcaatgtaggtccgcccatgatcgagagtcgacgcttgcggcttaaacacctaatagggcaagagcggcgaagccaaccggatggtctatggcacgacgggtttctgccgatggataaaataattgtggctcgtgaactcgctagactcataatcaggttggcttgactcaactcgtttaaattttgtcacgaattgatcgaatatgttataggatcttaaaaaatatttatcagattgcaaacatctattgcgaggtcattttggcctcaaatagaatttctcggacttattttgtcgatggagggaatgagggacatctcgagaatgtgttgttgatttcagttctgtgggagtagag

SEQ ID NO: 14619 - DNA, 1250 bp, Zea mays
ccccacgcgtccgctgcaacctccgtggacgaagcattcgcctcgccttgatctccaaccccttccttccttgcttaggagagagagggaggagaggagaggaggaagaagatggagagggcggccccagtgaggagttcccacacctccacggccggcctactcgcgtggcctcaacccgatggcgccgcgtcgcaggcaccacgtcggcctaaccagccgacggaggaattcaggaaggtggtgttcggggggcaggtcaccgaggaggccgacggtctcaacaagacgaagatgaggacgacggcctccgcacccaagtcgaaggagacaacagggatcggcatgtttaaggccgagagcgccgccgccgccgtcacaactgcatcccgtgatcgccaggctagccagatcaccttttctcaggacgggaccattcctcccaggaagccaacttcagttgctggggtggcgaggcagcgcgaacttagccataccgttgagagttcgggggacggtaagatgaagcggcaggtgtccaatgcgaaatccaaggagctcagtggtcacaacatctttgctgatcatgaagatccgagtcccaacaggtcaagcagctctgctgctgctctggcacatgtgaaaaatgcaaatgtgagctccttctcctttggaaaggccgacatggacagcacagtgaaaacagcaaagaagaaagggtccagcaacaagtctactgatctgatgaatggcaaggccatctccgagagggattcagcgcctgcagggaaacagcctctgaaccgcgcgaagccgaaaggattgagtggtagtagcatttttgcagacgggaaggcctcaacaactggtgatcatgcaggccgtcggacccggcagccacctggcggcgacagcagcatcttgctgggctagcgtgcatatggatattgtcctatgccgccacacgggtggttggtccgtccgtgtgcggccatgttttcctgatcaggcgatgagtcccatctcagatgatctggttcacttctggcgtgtgtatgggtttgtgtctgtgttggttgtgacatgtccaatggaacaaccctatccctactgcgtgtggtgccgttttgttgtgtagtagtacaacggatgacatgtggtaccgtttcgttgtgtgtacgtggatatacatatgtgtgtttggttattaaatactccctccgtttttaaaaaaaaaaaaaaagggcggc

SEQ ID NO: 14620 - DNA, 1574 bp, Zea mays
acgcaccagcctgcttgctcctcctcctcctcctggcttctttggctggaagctgaaagttccgtgcccaggccagcaacggagcacaacatacagatacagctcggccggagctagagtagcgggcggcggcgagaggagaaaacaaggaagcgaggagatggcgggcgggggcagggatgggccggcggcgcgtcttctccggcgcgtccccgccgccgtgtccgtcctcttgatgctgacgctgtgctcccccgggccgcccggcgcggtggtggtggtgtcggcccggaaggtgggcgagacgtgcgcgctggaccggaactgcgacgccgggctgcactgcgagacgtgtgtggccgacggcaacgtgcggccgcgctgcacccgcgtcgctcccgtcgacccgcagaccaaggcgcgggacctgccgttcaaccgctacgcgtggctgacgacgcacaactcgttcgcgcggctcgggcagcggtcgcagaccggggtcgccatagccacgccgtggaaccagcaggacaccgtcaccgagcagctcaacaacggcgttaggggtctgatgctggacatgtacgacttccgcaacgacgtctggctctgccactcctacggcggcatctgccagaacttcaccgcctttcaaccggcggtgaacgtgctccgcgaggtggagcgcttcctgtcgcggaaccccgccgaggtggtgaccatcttcgtggaggactacgtggagtcgcccatggggctcacccgggtgctcaacgcgtcgggcctcgcgcgctacgtgctccccgcctggcgcatgcccaagagcggcggcgactggccgctgctcagcgacatggtccgcgacaaccaccgcctgctcgtcttcacctccaaggccgctaaggaggccgccgagggcgtcgcctacgagtggcgctacgtcgtcgagaaccagtacgggaccaaggggatggtgaaggggacgtgccacaaccgcgccgagtcggccgccatgaacgacctgtcgaggtcgctggtgctcaactacttcagggacctcccgaacctgccggcggcgtgcaaggacaactcggcgcagctgctggacatggtcaccgcctgccacgacaagtccggggaccggtggcccaacttcatcgccgtggacttctacaagaggagcgaccggggcggcgcggcggaggccacggacaaggcgaacggcggcctagtctgcggctgcgggagcatatcggcctgcaacgccaacgggacatgcactccccggcacggcaggacgcccagaggcatcttcaacgcctcatctgacgcagcggcgtggaggccgccgccgccggtgctgcaatggcagaggctcatcctgctgccttctctccttgctcttcttctgggcctgtgagttctacgtattttgttgtatagacgggtacggatcggtttggttgcaggcaccgagcgtattttgttgtgtatatatacacacagatgacagattggtcgaagccagctagcagcttagtccatggtagtctgtgtaaaaaaaaaaaaaa

SEQ ID NO: 14621 - DNA, 889 bp, Zea mays
aggtaccaagtttggaggaacgcaagctgcactgttactttgcagctgcctgcaggaggtcagcatcgcgtcgctgaaaatgagatattggtgctgaggtattatcctcgacggcggccttgctgggatgtggtgaaggacctgggaggtcactcgctttttgtgggaaggaacaatgcggtgtcgatgtatggagagggtgtgccaggactgaggggcaactgtgtctactggattggtgggcgtggtagggatcaaggcatggtttttgacatggaatctgggaggtccacgccgtgcagggttcctcctgttggctttttacctgggcatccgcatagcacaatctgctggtatttcttgagcgatgtaatgagcatcaataactgctacagcaatagtgtcagcagcagcaacagcagtggaggaagaaaaatttatcaaactcgagcaagagcacgagcagatcttgcacaagacatggaagaatgactgcgtcgccgaacttctcggcgacataatgagtaccaccaagcaccttggtgggaattgagttattgcttgtggtcttgggagttggagtttgatttcaaggcggagcaaaatcttacagagatggctgaggaactgcctcatctgtagcctgtttcttaaaataatgtccagtttctttacttgcctgtagcctctataagtttgtatgcttattccatgtaaccagataataattattatctttctatactcaattttcatgttgtgtttaaataattcaatggattatgtaatatttttggtgttggtaatgttctgaattttactaccaaaaaaaaaaaaaaaaaaacctaaaaaaaaaaaaaaaaaaaaaaaaaaaaaaaaaaaactcgag

SEQ ID NO: 14622 - DNA, 1343 bp, Zea mays
ggcgattgggttcctcgaggccggccgcggaaccgatccgcggtcgtgcccgtgcccgtgccgcgcgccagcgccacgcttcctacaatcctactcctactgtagtttaatccgcttgcacggaggagcaacaccgagcaatggcgctcgccgccccttcttccctcctcctcctcccgaccacgccatcgcaggcgccatctccgcgctgtgcctcccgcctccgctcgcgccctctgcgggagctccgtctatgccagagactcgccaccgccgccgccgccgccgcggccacggctccattcgcttcctcgcccaccacctccgcggacacggagcggaggaagcacgaactgctacgcgcggttcaggaaacgcggcgcggattcgcagcggggcccgaccaacgcgctgccatcgaggaggccgtcgtggccgtggaggagcgtggtgcggggaagggaacgccgatagatctcgcggcgctcgatggcacctggaggctgtgttacacatcggcatcagacgtgcttgtgctgttcgaggcggccgagaggcttccactcctgcaggtgggccaaatataccagaaatttgagtgcaaagatcgatcagatggtggaactgtgaggaatgttgtaaggtggagcatcgagaacttgctggaggagcaagaaggtgcaacactgatggtctctgcgaagtttgttgtcctgtctaaacggaatatctttcttcaatttgaggaggtcgctgttgaaaatatcaagatcagcgagcaactgcagacactaatagctcctgctatacttcctcggtcatttttgagccttcagatattgcagttccttaaaacctttcgaactcaagttcctgttagtggtcctgaaagacgatcacctggaggattatattatctgtcttaccttgatcgtgatatgctcctgggtcgttcagttggtggtgggggaatatttgttttcacaaaggcacaacctcttacataaaggttttctggtaaccgagggcatatcatctgatggcatgacagctgtccttgagcttgccaacttacaacgggtatatataccttgcaatgcaaatatgtgattatcacctcattctactttttaaagagattgccatgatctactttgaattcgaagagtttacatgcaacatgttttcttttacacaccagttgtggtgcatatgtctggctattggctgtggatatataaagcttcctggatagttctatttcatctgtgttgtacgagtactggaactgtacctacttatttctcattttcaatgattagtaattcaacattacgaccagc

SEQ ID NO: 14623 - DNA, 3446 bp, Zea mays
acccggtagagtcgacctgcagctgcaccgtgaaaccatacataccttggtgagcgggtgatacagtctgtggcactgctgtgccgtgcagagatatatatggaggggggacaaggatccacgagcgaaagggcgtgtgctacagcagcggttgcgttgcgggtactactccagttaagcgccattggccattccgtccccccacgcattggttgcattgccagacagttgtgctgggctgggcttggcatccgaggcaggcgcctttcagctactcctctcttcgagtatatatctaggccggaggagcagaagaacatgcatgattgatcgatcggtggttggttaatccggctggctttcaggctagcaagctgcatgggggcaccacgaaccacgtgatccgaccggcggcggcttcttccccctcctttccggtgcaagcgcatcgtcgtggcatgtccacctccctcccctccctggctccctgcacaaaccacccgtgtccggttcggcctacggcttccctgttgcttcccgccgaccgaatcccccccgtcgcatttcgtttcgtttcgttccagcaagcgcatgcagcacgcacccgcatacctgcaaccgacgcaacgacctgcacgttatgcgtggtccccccgagcccaccggcacggcgtacgtacgtacgcgccgtaatattattgggatcggacgtgacacaacacaacgcctgcaaccaccgttgtatatccgtggacgtggagtgtgcgagtgacaagcgcatgccgacgggggggcatcgctgtagctgcttgcggctggggcactgttccgcgccaccgaaactgacgtggcggcccggtcggcatcaacgaacccaaccacctgataacgcgactgcttgctttgctctgttttgtgtccgtgcgagctcatcgtttccactgcgacatggctgggctgggcaggttctctagccatctgggatcggtgcaggcagcagcggcgtgggttcggttcacgcctgggtaccgcaacagtgcgttcagtacggacatgtggtggtgcctacggcctgtctgtcctgtggtttgctctaagctccggatgtgggtgtgagcagacctgttgcttaacggcactcactcgtccaacgccttgacctcactctcttcgcgctgtgtgtcactcactgtgtgtgagtgagagagagcggcaaggcaactaggcaagcaagtaaacgtgacggtgggggcggccgtccccagaaacgggcgaataaagagcgtcaccagacaaagatttcagagcgcatatgcaacgctgcgttttcgcgtcaggcgaggcggaaatcgtggcagcggcagcggcagccgagccgagcctgaacggctgccactgctgccacaccaccatcactcacctctcccacgcccccaccaccagaccttcatgagttgatgtgattgataaataacgcgtcaggtcgcgctgtccacacctcccgcggctcgccaagctccgctcacacctcacagtcacagcagcatgactctgtagtccatctccctttgcagccgccgccgccgccgcctcgagtggctcccagatccgagccgacgccggagcagggacaagccgctgccagcggcaatggcggacgccgtgggggcgctacctcctcctcctctgccgccgccgccggagtgcgagtccgggaggtcctcgccgtcccacgccgcgtcgccggagttcgagttctggatggtgggcaggaacccgtccccggcgctgctcaccgccgacgagctcttctccggcggcgtcgtgctcccgctccacaccctccaggcgccaggcgctccggacggcgacggcgcgcctcagcctcaagccgacgcggacgcggacgcggacgccgcggcgctcccgctgcctgacgcgcaggcgcaggtggaaggggaggccgcgcagccgctcgcggagtccgccatcgcgccgacgccggacctccccgcggtcacgttcaagtggaaggacatcttcaaggcgggcgccggcgccggcgccgagggcaaggagcgcaagaaggtggaacggcgcgtgagcagcgtcagcgggaacgccgagctgattaacatcaacatatggcctttctccaggagccgctccgccggagcaggtgccggcaccttgagtagggccaagcccaatccgaatccaaacccaaaccccaaccccaacgccgccgtcgccgccagcggcggcgccagcgttaacgccaacaccaccgccaatgccaccgccccgagcgcgccgccggccccggcgccggtcccgcgcaaggtgagcagcgcgccgtgctcccgtagcaactcccgcggggagtcctccgggcctgtgccgaccatccccaccgccactgcaactgcagcgccagaagcagcagccggagaagaagacgccgacgcggccacccaggttcaggcggcgccactgaccgccgccggcacatccagcgccacgtccatgttgaggaggtgggtgcccggacagggccgtaataacaacaacgcagcagggcccggcggcatccgcgtggggcggcccagcgccgtgtggaagctgaggcgcaacaagctgcagcaaaccgccgccgagcagaagcaggtgggcggcaagaagaaggcggccccggcccaggaacccgccgcggccgcggacgcggacgcagatgcagccagcgacgacaaggcgtcgccgagcgtggccgcgccagctgccgggtgccggaacaacgtggagggcgccggcgaggaagggaacccgccgcaggtgctcttcgggctccggaccttcttctccaagaaggtgtactgatcagcagcaagccatggcattgtactttgtacatacaaattcgagctctaggctcgctcttccacattttcaccttacctgcccccttcttttcttttttttttttgccttttttttattactctccttcctctgctctaattcgatcgagtagcttcgatatcctctgtactgtactagaacgaagctaggcctcatgcctcagtagtcgcctcaagcaggccagccatgagccatcgtcgtgtgtcgaccatggatgaagcagaaagcccccgtgcccatgtaaacggtagtaatgtaacaagcatgcatcatccgtgtcgctcgctcgtcgcgtcgtgtcgtgtgtgcgtgccggcagtaacgatcagtggtgaaactttcggtggtgggtcggcgactttgccatggcgcggaccgcggaggcgcccatgcccggtgtgtccagtgccgccgtgccgggacgacgagacatgacgagatgccaaatgatttggggggggatgatttggggggggggggggggcaaaaggctgggaaaaaaggcagtgcggcaggcagctagccag

SEQ ID NO: 14624 - DNA, 1479 bp, Zea mays
agcagtggtaacggacgcggagtcgcggacgcctgcgcgatcggccagcggacggaagaccgtggaagcaaagaggcgcaagcgagcacggaacaaatacaccttcaggtggcctccctccgactgccgactgaatcttccacctcgcttcgcgcctccggctccgcgccgggcccgcataatctgtgctcgggatcgcctcttcccgcggcaaatgggggccgactccgaggacgccgtcaagcagctcagcctcctcatggagcaagtggaggccccgctgaagagatcgtttcagaatatgcaccagggctatcctaaagaaacactggtgcgtttccttaaggctagagagtggaatgtagcaaaggctcataaaatgattgtagaatgtttgaattggaggattcaaaatgaaattgatagtgtgctagagaggcctatagtcccagtagatttatacaggtcaatacgtgattcacaacttattggcctgtcaggatacacaaaggagggtctcccaatttttggcattggtgttggacatagcacatatgacaaagcttcggtccactactatgtgcaatctcatatccagattaacgagtaccgtgatcgtataattttgcctaggctgacacaacagtttgggcggcctgttaccagctgtataaaagtgctggatatgactggtttgaagctatcagcactaagccaaataaagatgttgacttccatatcgacagttgatgatctaaattaccctgaaaagacagagacctattatgtagtcaacgttccatacatattttctgcttgttggaaggttgtgaagcccttattgcaggagaggacaaaaaagaaggtcaaagttttgactggctgcgggagagatgaacttctgaagatcatggactactcatcactcccccatttctgccgccgggagggctctggatcatcgaagcattcgtctaccgacgtcgacaactgcttctcccttgaccatccattccacaaagaactgtacggtcacatcagagagcaagcgtcgcgcagggagctcatcaagatgggatcgttgcatgtcagcatccccgagccggacccagacgacgcgaagatcgtcgaggtcatccaggccgagttccaaaagattggcgagcaggacgagtccaccaacagccacaaagattgacatcatgaccctctgatgttcatttctgtatttcggttaacagtccccccggttgcctggggatttatagcagcaaaagccttgcagtcgcatggtgcaagtgcaagcttgagttcatgtagctggagaggctgagagataaaccagccagtgtatattagatgcacaagaagcgataatcacctttttgttagtatataaccaacacatatatgatatatttagctgtttattaaaagaggaagtccatggaagcgcctttggcaaaaaaaaaaaaaaaa

SEQ ID NO: 14625 - DNA, 1795 bp, Zea mays
ctcttgtctgtgggtaccgcgtcgccgccccggaggcaaacaacggaacggaaaccccggccgtcactgcgccagagctggagacagagatcatggtgcgggcatgggggcggcggacggcgctgcctccgctcctcatccttggcctcctccgcctgcactactcctcgctggtcgtcgcccaagaaggacaagaaaaagaccctgctactttgttcgcacaagcctcagggatgatggacctgaggaagtatgatggggcgcttggcctgctaaatgctgtgttggaaattgacccaaatcattctgaggcttataggcagcgtgcatccgtgcttcggcataaatgcagatacgaggaagctgagagggactataacaaacacctggagctaagtcctgggtctgcttcagtggtgaaggaattatcccagcttctgcaggctcaaaattcattacaatctgcttatggccaattcgattctggagacttctcaaaagtcgtggaatacatcaacaaaattgtgctggttttttctccaggttgcttaaaggcaaagcttctcaaggctaaagcattgctagcactgaaagactactcaagtgttatttcagagaccggattcattctaaaggaagatgaagacaacttggatgcactgctattacgtggtcgtgcctactattaccttgctgatcatgatgtggcctccaggcactaccagaaagggcttcgtcttgatccagagcattccgaattgaagaaagcatatttcgggttaaaaaatcttttgaagaagactaagagtgcagaagataatgctgccaagggtaagctacgtgtgtctgttgaggactacaaggcagctctagcaatggatccagaccatactgcttataatgtacatctttatcttgggctgtgtaaaactctggttagacttgggagaagtaaggaggcaatcagcacttgtacggaagcactgatcatagacagtgaacttgttgatgcgcttacacagagaggtgaagctaaacttctctcagaagattgggaaggagcagttcaggatttaaaagaggccgcccagaaatctccacaggacatgggtatccgtgaagcacttatgagagctgaaaagcagcttaagttgagcaaaagaaaagactggtataaaatccttggtgtttcaaagacagcatcagctgcggagataaaacgcgcctacaaaaagctggcgttgcagtggcatccagataaaaacgtggataaccgggagaaagcagaaaacatgtttcgagaaattgctgctgcttatgaggtgcttggtgatgaagacaaacgtgtaaggtatgaccgtggagaggatgtggaggagatgaatatgggaggcgggggtggcttcaatccttttgggggaggcggccagcagtacacgtttcaatacgacggtggcttccccggcggcggcttccctggaggtggcggctttcagttcaactttggataaactgtgccatgcaccatgacattttcttggcactggaattgttttaggaattcttaacggcagctggtagctattcttaggcaggctgagactgttctactatgttacataataatgacaagtgttacgattttttccttcatcatttgtttcctgcttacatacacacgcacacattgtctctctgatacatcagttgaatgtaagaatggaaataaagttacttttttttttaccccttcggcaaagttccaaaaaaaaaaaaaaaaaagaaaggccggccg

SEQ ID NO: 14626 - DNA, 2222 bp, Zea mays
ccggccgggagtccctaactcgcggccgcccactgcccaccgaggcagagtagaaaccccatcatgccgcatcacggcatcacgcgcgtgccttcctcgaccctcgctactgctactgtctcgtctcttgctcgcatcgtctggggaccgcggagcggcggcggcgtggcgcagcggcacggcagcctccccctcgctcctcctcctccggctcttcccctctccccctcagccgtacgcccctgcgcggctgcgtgacctgcgtccagccgcagcggctggcgcccatcggcggcaagtagcagagcagcagcagccgccggcggtcctcccctcccactcggcctcgctccggctctcccagtcccagctcgagctccggactgaaggttgaagcaaggacccaaaacagattgccgccatcaaagatggaatctgggagcacgttctatggaggggaaggtctctccatcgaccccaagtggtttatcgacccgaagcttctctttgttgggccacgcatcggcgagggcgctcatgcaaaggtctatgaggggaagtataagaaccaaaatgttgctatcaagattgtgcacaaaggggacacccctgaggagatgaccaagagggaggggagattcttgagagaggtgaccatgctgtcaagggtgcagcacaagaacctcgtcaagtttattggggcctgcctagaacctgtcatggtggtcgtgacagagctactagtggggggttcgttgcgcaagtatttggtcagtctccgacctaggagccttgagcctcgtgtagcagtggggtttgcattggacattgcccgagctatggaatgcttacatgcacatgggatcattcatcgtgatcttaagcctgagaatctgttgctgactgcagaccagagaacagtaaaacttgttgatcttggtttggctagggaagagacattaacggagatgatgactgccgagacaggaacataccgttggatggctccagagttgtacagcacagtaacactgaggcatggagaaaagaagcattacaaccacaaagtagatgtctacagctttgcaattgtgttgtgggaactcctccacaataaactgcccttcgagggaatgtctaaccttcaagctgcctacgctgccgctttcaagaatatcagaccaagtgccgataacttgcccgaggagctgtcagaaatcctaacatcctgctggaaggaagacccaaacgacagaccaaacttcacacagataatacagatgctcctacactacctatccaccctttcgccacaagagaccttggcgggcccccgccgcacgttcagttcggagaacacaatcctgcccccagagtctcccgggacaagctcgctgatggcttcgcggggcgacctcggcgacacgcccaagggcaagaaggaagacaagccgaggggcttcttcttctgtttcagcgagtgctattagcacgagcccccccaaagggggaacactccgagaagcttgcaaatactgaacgaacaccgtctcccccccagccccgatgccctgcgactcaagccatgtccagccggtcaagtcccaggcatccatagtccgcaccctgaagaacggaagtgtagtcgaacactgttttgttttcttctgctaatcaaggtctcctgcatcgctgacatgctgatgacatataccagcagggtaaaacgacgggtaaaccttttgactccagatagtaatggtgggaatagcttacctcccctgtgttttctggcgcaccatggtgtaacggagttgctagagcgcgactatagattgccttcctgcctgcctgtctcgcccgacatcgtatagaaataaaaccaataattcgcatcaaaaaaaaaaaaaaaggcccctgggtaagctgccagtccttttgtgttcttgttctgccagttctttgtgttcttggcctggtcgtcttccgttgctgtacagctgcgttttgttgcagctgcaagatttgtgtagcaggggagactgttgcagctatgtgtatgcgttgcagcagcagcaataaggcaacacactactacaggggagggataaactgttcggtctctcctggcagcagttgcagctgcgggtaaaaaggccagccgaatcggggaaagggttccaaaagccaagccctgccctgatcggttgtcattgctgcag

SEQ ID NO: 14627 - DNA, 1931 bp, Zea mays
agtaaaaaactacatttttttttaggaaaaagccaaaattgtcttattaattgggaacataggaagaccaatgttatattcttctgttctggcgtaagaaacatcattgctggagtgcctttgttgttgagtgggttgacttatcactacctgtttattcctgcataagaactgtatgactgcatcttgaactttttggcctgaaaaccactgataagaaactgcattacagagaacaacttctggtgcatctgtttcattgggcagttcaaccggaaacctggataaactaggagtaaacaaatgcctaaatggtaaccgtgatcaaccaagccctacctcagttcttgatgcaccctctgaagatagcagttgtaatgagcctgaaacacttggaacaactacttccaagaatgcgagtaagtcttgtttttctgtatcaaaattctccattactcggtctggtttatatgttgattgcgtctgatttataagcagtatcaagatcttcagcaattgaaactgtggcccgtttcttgtcattggatgacaccgcctcagagtcacagtcactttgtaacccaagaccgagttctcttctccctgatgcagatgatgatgagtcagagtgccacgtccttgtgcaaaatataatgtcatcagctggattaggcacttcacagtcacgtatggttttcgccggctggcatttacctgatcaccctcttgacccggtgctgcgcaacaaagtatctcagctgcaggagaaaagttcatacagaaggcttctttttgactgcgtgaatgttgctctaattgagatcggtgagaacgccttactgagcgccctcccatggagtaaaaggagctccagaacatggaggggcacctcatctcctgatctgggggtggaggtctggagtattctcaaggactggatacacggggcacggatgtttgtggtgagcaagagagataatgctgggatcatactggacagaattgtgaagcaggaggtcgaagcaagagggtgggtgaaactgatgatggcgcaggtggttgtcatcaccgaggagctcgaagggggagtaatggaggagctggttgaagaagcggtgctggatttttacagtctgttttcagtggtgagatatcgattgtgactggtaaaactttccacggagcagctggtttgcgtatgctctttgttttgcagctacaccggtcgttcgccgccgtatccattcccccctggttctctttctagctggttctgcttcttgtattacaaagtttgtataaacctctggtagatgagaacatggtaattgtgcagttcatgagaagttttgtaggcaaaataaagtgagccaaactttccatggtgggatctgctgtttgtgcatttcacattgttcgttcattgttaatgagcaagagcagcgaaaggttttgccagattaataagtgctgtggagcatatattatctcattgagaatgtatttattaggcgcatagtaaaatgtaatgtaaacactacatacctcaaaagacaaaacgactcataataaagattggagaatattcgaagacaattattattaataattagccaatataactttttttacaaatgtttagtaatgtttacaacttgtgtatgaattttattttgctatatataatatattttcatataaaatggcgtatcgcgtatccgtacgaagtaggagtatatctgggtttcgaacttcgatgagatctggaatgttacgccccttggcccctggtgaggatcgacaccgttcacgttcggcaccgtcacggtcgtgacatggaagaggaaatgagaacgacggtcgctagagaaagaaggaaacgaggactacccttctatggatcccttcaggcttttgggccacaacctagc

SEQ ID NO: 14628 - DNA, 576 bp, Zea mays
aaatatccccaaggctaaaaccctaaatctctaatcctcgaggcccgccgcccccctctcctctccgtggtcgcgttggcggctggccagtggccactccctgtctcgtgctcacggcgggcggcagaccgccaggcgccagaccggcaggcggcagtgcaggccgtcacggctcacgggctcacggccggcggcagaccgccagaggccaggtcggcagtgcagccgtgcaggcggccgaccctctccggctctccctcaggccctcactcccttggcggcggcggcggcaagctgaggttataagtgaagtcaaatactcccttgtttgcttattaatccattctggacgccacgagatcctactcccgcgggcagaatattgaagaatatgcatctccgttcatggacttgttaatccatttcaggtttttttgatttctatttgtaatatcaactccgggagacagtgcgttcattttatcttagcaaatattgtaatgactcattatcaggatatgtttgagacgtgtttctggatgatcaagcggccaaaaaaaaaaaactcgagcccgg

SEQ ID NO: 14629 - DNA, 1582 bp, Zea mays
ctgcggagtaataaagtaacgaagccgcgtgacgagattgttacaatctcaaataactctccagtagggatggcaattctgcccgcgggcgcggatatccgcgggttccgtacccgatgggcatggatacgggtaaaaagtctcgcccacgggtaaggatacggacaacacttctcacccgcgggtaattagcggatataaaatttcgcccgcgggtattacccattacccgcttaatttattagaccacaaaaacattccctggtccggcccaattctcagtcggcccatcaaatatccctaaaggctaaaaccctacatctctaatcctcactctcctctagtcctctcacgcggtcgttctcacgttggcggctggccaccattccctgtctcgtgctcacggcgggcggcagaccgccaggcgccaccgcgccagaccagctgaccagcaggcggcagtgcaggccatcagccgtcacggctctccctcaggtcggcagtgcaggccatcagccgccaaccgatctagtagtgcagaccgccagaggccaggtgaccaggtcggcagtgcagccgtgcaggcggccagccctctccaggcgtccatccagctaccaccacacacacacgaagagcaggcgatgaaaatgtccgcttccgttgcggccgcctcccccaccctccgcttctcctccgccactcatcctctccaccgaccgctccgccggcggctcccgtcggttcgatgctccctcgccgccgccgccgggccccggtgtccgggcgccccctgagctcgtcgactccatcctctccaaggtgaagggaactgaccgaggagtgctgctgccaaaagatgggcaccaggaagtggctgaggtcgcgctgcagctggggaagtactgcatagacgaccccgtcaagtccccgcttatattcggagaatgggaggttgtgtactgctcggtgccaacctcgccgggcgggctctaccggacgccccttggccgcctggtattcaaaaccgacgagatggtccaggcggtggaagcgcctgacgtggtcaggaacaaggtgtcgttctccgtctttggcctagagggcgcagtgtcattgaaaggtaagctgaatgtgctggacagtaaatggattcaggtcgtgttcgaagcgccggaactgaaggtcggctccttggggtttcagtacggtggcgagagcgaagtcaagctggagatcacctatgtcgacgagaagatcaggctagggagagggtccagaggctcgcttttcgtcttccttagacgatgatagaatggcatgcatgtgtgttgagacttcagacccacaagcaccgatgaggggtggcgctgacgcggtcgtttgtacaatactgtgttcaggacttctatacgtttatgtaaaaattctggcgtccagctgggtaattctggcgtttcagtacggtggcctgatgaatgttgttgtgtagtttgtagcatccattattagtgctgtaagatgatgttttgaaaaaaaaaaaaaaaatgcgagtgtgatgaaccaaattccggacgcgtgg

SEQ ID NO: 14630 - DNA, 940 bp, Zea mays
accacacacacacacgaagagccggcgatgaaaatgtccgcttccgttgctgccgcttcccccaccctccgcttctcctccgccactcatcctctccaccgaccgctccgccggcggctcccgtccgttcgatgctccctcgccgccgccgccgccggccccggtgtccgggcgccccctgagctcgtcgactccatcctctccaaggtgaagggaactgaccgaggagtgctgctgccaaaagatgggcaccaggaagtggctgaggtcgcgctgcagctggggaagtattgcatagacgaccccgtcaagtccccgcttatattcggagaatgggaggttgtgtactgctcggtgccaacctcgccgggcgggctctaccggacgccccttggccgcctggtattcaaaaccgacgagatggtccaggcggtggaagcgcctgacgtggtcaggaacaaggtgtcgttctccgtctttggcctagagggcgcagtgtcattgaaaggtaagctgaatgtgctggacagtaaatggattcaggtcgtgtttgaagcgccggaactgaaggtcggctccttggggtttcagtacggtggcgagagcgaagtcaagctggagatcacctatgtcgacgagaagatcaggctagggagagggtccagaggctcgcttttcgtcttccttagacgatgatagaatgtcatgcatgtgtgttgagacttcagacccacaagcaccgatgaggggtggcgctgacgcggtcgtttgtacaatactgtgttcaggatttctatacgtttatgtaaaaattctggcgtccagctgggtaatgcagacttagcctgatgaatgttgttgcgtagtttgtagcatccattattagtgctgtaagatgatgttttgaattcctgatacaccagtgcgagtgtgatgaacc

SEQ ID NO: 14631 - DNA, 2572 bp, Zea mays
tcacacgcgtccgcggacgcgtgggttctgtatacaattcaggaaaggctgtttcttcccacagtatccataataaaaaaataaagtgccctataaagtgctcttgcccctatcctcgcattgcaagtctgaggtttgacctcacggcaatcatgtccacacaaggcatgacaaacagcaatagtgataggcatttgaaagatcatctccatagtgagaatcctaaagaaatgttgcagcctggaactttagacagtccttctcgtgttcatgaaatggatagcccctctagagagtcattggaagggtgtttacttcgatttagcctctgttttttgcatttatgggatgttgattgcgagctagacaaattacttgtagatgagatgcaagtttgcaagccagaaggctgccatatagcaactggggtggtaggagacaaaggctcatttacattgatgttcccaggcaaagaagccactcttgagctttggaagtcttcagccgaattttgtgccatgaggtcactgtctataatatctcttgctcaactcatgattaaattatctcgttcttgtacaaattctagcagtgctttggcagcattttatacaaggcattttgctgaaaaggttccagatataaagcctccatccctacagcttttggtgagcttttggcaacacccttcggaacatgtgcgaatggctgcacgttccttgttccactgtgcagctccccgttctattccacaaccactacgagtaaacaaaaataaagtggtcaatgcccccttgtcttcatcagataatatgaatgttcttatatgtgctgtgcagactgcctctgtatccaatcatggagagttgaaggaagatgacgaaaatgttgataaagatgatattgacactgctaatatgatcttatggttggaatcatttgaaaatcaggagtggttatcatggataggaggcacaagccaggatgcagtggcgtcaaatatcatagttgcagctgctttggtcgtttggtatccaagtgtcgtgaaagctaaactttcaagtttagttgttagtcaactaatcaagttagttatgtcgatgaatgatcgatatagttcaactgcagctgaacttctagcagagggaatggaaaacacttggaaggcatgcttgggtgctgagatcactcattttatgagtgatatccttttccaaattgagtgcctaagcactgcaccttctagcaatgctatcaataaaactgcagtggccattacaatgcgagaagcattggttggcacccttttaccaagcttggctatggctgatgtaacaggattttttggtgtaatagagagccaaatttgggctacttcgtctgattcacctgttcatgtcgcttcaatcaaaaccattatccgtgtagttcgaggtgcgccgaagtccttggtcccatacctcgacaaggcaatcaactacattctacacactatggatccaagcaatctaataatgcgaaaagcttgtattatcagttcaatgatggctctaagagaaatggcacgtgtatttccgatggttgctctcaatgagtcaatgacaaagctagctgttggtgatgctattggagagatttatgatggtacaattcgagtctatgacatagaaagtgtcacaaagataagaattcttgatgcaagtggaccaccaggccttccaagcttacttgcaggatcatcgaatagaacaacaaccatactgatatcagttctgagtttctcaccggatggagagggtctggttgccttctctgagaacggattgatgataagatggtggtccttaggtagtgcctggtgggagaggctgagcagaagccttactcctattcaatgcacaaagcttatctatgttcctccatgggaaggattttcacctaactctgctcgcttgagtataatttctagcattttagatgataaacctggaaggtcagagaaggaactaggcgaggcggataatctgaagttattgcttcataatcttgacctttcataccgtcttcactggattggtggaaagactatcaaacttacgaggcatggccaggatttgggtacatttcagttgtgatgggcttacccatgaatattgagttgctttgtagtgttgaaagacagctaattcgatggctggcaagtctaacaagaatcaccagtacattcatatgtcatgtgaggtaccttgatgtttctttgactgttaaaagcattgtctggtacagttcataaattggatccctatgtatggtaaataaaaaaactgaatgcaatttgattccatgttacaagactgctattcacatgcagcccaggtaagtctcatctgtttccatgttacagttacagaactgcattcacatgcagcgcccaggatggggctcatctgtcacacctttgagctacagagttcaggatgcttttagtttagttgtggttcgcttgatatcatcacaatcatatacatattttgtggatgattggctatacttcatactttggagtttttgc

SEQ ID NO: 14632 - DNA, 1501 bp, Zea mays
gttgattatagtaaatagagcaacaactttagctaactttctcgcaagggagtctagataataccaagtttatggtttataaaaatgccatagtattttataccataaaatgtttggttgcacttttaaaaactatattttaaaatcataatattttagataccatgatgtttttgaagtattgaaaacttcactcaaaactaaaatttttatggtaatggtttataatgttatacctaaacaatgtttctcgaaattatgatattcttagagccagccaaaacttttgtattgtccgcaaagtatggtattgtaaagctatggttttgtgaaacattgtcctaatctgctccaaatttaccaattttagctagggcaaaacggatcccgattcccggatggatgtgccggcccggcccggcccgctcggcgctcgtgcttctccccagtcccgtccatccaaagcgttttgcacttgtgcacaaactgcggctgctgtagatacgcgcgccgccactccaaggtccaagcctcccttgctcccgccaccgcccctcaccatgggcagcgccgccgcctctccgcagccgtctgggaatctgacgcaggacgagctcaagcgcgtggcggcgcaccgcgcggtggagttcgtggagtccggcatgacgctgggcctgggcacgggttccacggccgcgcacgcgctggaccgcctgggcgacctcctccgcgcgggcgcgctgcccggggtcgccggcgttcccacctccctcaagacggaggcccacgccgcccgcgtcgggatcccgctgcttccgctcgacgccgcctcgggcgccagcatccgcctctccatcgacggcgccgacgaggtcgacccggacctcaacctcgtcaagggccgcggcgggtcgctgctccgggagaagatgatcgagggcgccggcgatcggttcgtcgtcatcgtcgacgagtccaagctcgtgccgaggctcggctgcacgggcgccgtccccgtcgaggtcatccccttcggcgcgccccacacgctcggcctcatccgcaaggtgttcgatggagtgcctggcttccacgccaggctgaggacggtccccgccgccaatggggaggactcggacgcgccgttcctcaccgacaacggcaactacatcgtggagatgttcttcgaggacggtatccgcggcgacctgctggacatcagcgatcgtctgctccggatcaccggcgtcatcgagcatggcatgtttcttggcatggccactacagtcatcgtcgctaacaaggacggcaccgtcacagtcatcaacaagaagaagtaataatctacaagtagcctgtatgtgtgcgtccgtgtgtgatccagctacctaagttctgctcgttaccgttgtgaaaccatcattttgttttatcatctcatatctttcctactggtgattccaatatatcttatttattatccctcaaaaaaaaaaaaaaa

SEQ ID NO: 14633 - DNA, 3454 bp, Zea mays
  misc_feature (2009)..(2009): n is a, c, g, or t
tcgcggttgcgtgagttgttgcggtttcacgtgccgtgtgtggacacgtccgtctcctttgtcttgtttattttctcattttttttgttttagaatttggggtaaccgtgactgtgagttggcggtcacatctacctcattttttgtgctctaaatgccccacgtagaggtaggcatccaaattattagaacaaatttaatgttttaaaatagtttttatagaatttggtgctaatttttagttatattattaagcacaatatgaacaacaagattaaaattttgcatagttttgtctgcattatttgctccttacaactacaatgaaaaaaggtcaaaatcatctgcatacaactacaacaagattattattattttttttttttgcgcctgatgagggacgggacggagggaatacgcttgctggtacagaggatcgtgggtattcacacggaaatggcgtacgcacggcacgctggaaagatggaaagctacaaattcgggccatccattgctgcctctgcagactgtattcctgcttccagatagtagtagttattttgtattgtattgtatgtacagcgtatccatgggtgccgccgtgctatcagacgtgagtatatatacttcctgtgattgatgcatcgcctggacgtgcccaacgcgggccagcatttgttaactaatccatccagtcaggcagtcaccgtacactattgcctgcctgcacggttgctttgcttcgttgggctagactactagagtgacacggcgaaacgaaagcggcggcaggcacgcatcttgcttgcgtttcccacactagcaggcagctagctgactacagtacacccaacagtggctgaacgtggcggcccacagcaccgcatcaaccgaccctcccgctcccggaccccacccgtcctggcccctacgttcttggtttcccacccccaccgcgccgcttctccttggcttgcttgctccagagtccagagtccagaccgagctattagctatatatggattccgtgatgcaaatgcatcggcaccgcgtccatcccatcccatcccatcccatcccatccgcaaccggacaaccgtcacttccccacatcgcaccgcacccaataaaacgccacaccacgccaccggggtccagggtccatccatcactcacgagcaggatcgagtcgaggcctcagctccctcctcggcgtcctcgcaacgaaggaaaggaacaatgtcagcggctcgtcgtcggtccccaatccccgttctcctcttcttcctcctcctccactccgcgtcgccgagccccatcaagacggtggtggtgctggtgatggagaaccgctccttcgaccacatgctggggtggatgaagcggctgaacccggagatcgacggcgtgacggggcgggagtggaacccggccaacgcgtcggacccggcggcggggcgcgtctacttccgcgacggcgccgcgtacgtggacccggacccgggccactcgttccaggagatccggcagcaggtcttcggctccgacgacgacgccgcggacaacccgccccgcatggacggcttcgcgcagcaggcgcgctccatcggcggcggcgccatgtccgacgccgtcatgcgcggcttcaaccccgccgacgtcgccgtctaccgcgagctcgtctcgcagttcgccgtctgcgaccgatggttcgcgtccgtgccgtcgtccacgcagcccaaccgcctgttcgtccactccggaacgtccggcggcgccaccagcaacaacccgacgtacgtacttgcattgcatccgacgttctcgttcttctgtcaactggcaccggcacctcgtttaattattccaatttcttgccgtgtttaatgattttccgagcagcagctggcatagttatattgttattgccactagctactactgcgcctcctttagaattattgattgattgattgctggtgcactagctgccgaaagcaaaagaganagataaaaggaaaggaaaagaaaaagaaaaagataatgataacaagcgtcctgggaaggagcaggctccactccattccactccatcatgtgtgtgatcatgtccatgtgaaggcaacaattccagccactggcactgctacgcacgcaacgcatcgccttttgagggagcttctgttcactgtccctactccctccctcccccgcaggctgctggcggagggctacccgcagcggaccatcttcgacaacctccacgacgccggcctctccttcggcgtctacttccaggacgtgccggcggtgctcttctacaggaacctccgcaagctcaagtaccttctggacttccacccgctgcgcccctccttcgccgaccacgcccgccgcgggacgctccccaactacgccgtcatcgagcagcactacctggactccaagctggacccggccaacgacgaccacccgtcgcacgacgtgtaccagggccagatgctcgtcaagtacgtctacgagacgctgcgcgccagcccgcagtggaaccagacgctgctcgtcatcacctacgacgagcacggcggcttcttcgaccacgtgcccacgcccgtcgccggcgtgcccagccccgacggcatcgtcggcccgccgccctacaacttcaccttcgaccgcctcggcgtccgcgtcccggccatcctcgtgtccccctggatcgacaggggcaccgtcgtccacgggccccacggccccacgcccacgtcgcagtacgagcactcgtccatcccggccaccgtcaagaagatcttcggcctgccgcaggacttcctcacgaggcgggacgcgtgggcggggaccttcgagggcgtggtgcaggggaggaccgagccacgcaccgactgccccgagcagctgcccacgccgacgaggatcaggcagacggaggcggacgaggaggccaagcttagcgagttccagcaggagatcatccagctcgcctccgtgctcaacggcgaccaccacctcgccaccctgcaggaccggatcaagaacgacatgaacgtcagggaaggcatcgactacatgaaggccgccgtcaaacgctacttccaggccggcgcgtccgccagaaggatgggcgtcgacggcgaccagatcgtcaagatgagaccctccctcaccaccaggatccaacgcccatagacagactgtctaatcaaagcgggatcggttatgttcacaaacaggattggactacatatatatattctaaaaatacagatcacagtcagtgctatagaaaaaaaagaaaaagcggcccgagacccgcgagcccgacacgaagcccgctgtttgggtccgatacgatcccggcacgatccgattctatgcgggttcagatagcaaactaggcacggtgggctagcctggtatggcctgtttccctct

SEQ ID NO: 14634 - DNA, 2145 bp, Zea mays
ggcaccgcgtccatcccatcccatcccatcccatcccatccgcaaccggacaaccgtcacctccccacatcgcaccgcacccaataaaacgccacaccacgccaccggggtccagggtccatccatcactcacgagcaggaacgagtcgaggcctcagctccctcctcggcgtcctcgcaacgaaggaaaggaacaatgtcagcggctcgtcgtcggtccccaatccccgttctcctcttcttcctcctcctccactccgcgtcgccgagccccatcaagacggtggtggtgctggtgatggagaaccgctccttcgaccacatgctggggtggatgaagcggctgaacccggagatcgacggcgtgacggggcgggagtggaacccggccaacgcgtcggacccggcggcggggcgcgtctacttccgcgacggcgccgcgtacgtggacccggacccgggccactcgttccaggagatccggcagcaggtcttcggctccgacgacgacgccgcggacaacccgccccgcatggacggcttcgcgcagcaggcgcgctccatcggcggcggcgccatgtccgacgccgtcatgcgcggcttcaaccccgccgacgtcgccgtctaccgcgagctcgtctcgcagttcgccgtctgcgaccgatggttcgcgtccgtgccgtcgtccacgcagcccaaccgcctgttcgtccactccggaacgtccggcggcgccaccagcaacaacccgacgctgctggcggagggctacccgcagcggaccatcttcgacaacctccacgacgcccggcctctccttcggcgtctacttccaggacgtgccggcggtgctcttctaccggaacctccgcaagctcaagtaccttctggacttccacccgctgcgcccctccttcgccgaccacgcccgccgcgggacgctccccaactacgccgtcatcgagcagcactacctggactccaagctggacccggccaacgacgaccacccgtcgcacgacgtgtaccagggccagatgctcgtcaagtacgtctacgagacgctgcgcgccagcccgcagtggaaccagacgctgctcgtcatcacctacgacgagcacggcggcttcttcgaccacgtgcccacgcccgtcgccggcgtgcccagccccgacggcatcgtcggcccgccgccctacaacttcaccttcgaccgcctcggcgtccgcgtcccggccatcctcgtgtccccctggatcgacaggggcaccgtcgtccacgggccccacggccccacgcccacgtcgcagtacgagcactcgtccatcccggccaccgtcaagaagatcttcggcctgccgcaggacttcctcacgaggcgggacgcgtgggcggggaccttcgagggcgtggtgcaggggaggaccgagccacgcaccgactgccccgagcagctgcccacgccgacgaggatcaggcagacggaggcggacgaggaggccaagcttagcgagttccagcaggagatcatccagctcgcctccgtgctcaacggcgaccaccacctcgccaccctgcaggaccggatcaagaacgacatgaacgtcagggaaggcatcgactacatgaaggccgccgtcaaacgctacttccaggccggcgcgtccgcctgttgggtgggcgtcgacggcgaccagatcgtcaagatgagaccctccctcaccaccaggatccaacgcccatagacagactgtctaatcaaagcgggatcggttatgttcacaaacaggattggactacatatatatatattctaaaaatacagatcacattcagtgccatagatatagatgtccaataagcatgagacccgcgagctcgacacgaagccagctgtttgggtccgattagagatggccaaacgggccgcacggcccggcccggcccgggcccggtgaagcccggccgaaaaccgggccgggcctgctgatcccgtgggcttaattttctgtccaagcttggcccgcagcgggcctaaacgggcccgtttagcacgaaaaaacaggccgaaaagcgggctaaacgggccggtaagcatgttttagtgtaaaaaaacggacttagaggtaaaaaataaaaaaactg

SEQ ID NO: 14635 - DNA, 2175 bp, Zea mays
aatatattacaggctaatttagaaacttaaatctcctttatcttgaagggatttaagttctaaactaatcctaagatatgaagagtcatttaatgtctgatgtaggatagctgtttaaaaatcatcatgtcgttctgaaaatcctctctggacactgacctgctttcccgctgtgtgacgcaaatcgtgtcttcggtgtccactctcgtgcgactgagacgagcagcggctcccagagttccgcgccacgaggcgtgcggctgccgccgcgcagctccagcagcagcgcgaaaatttgccattgtgtatcatcgtttcagacaagtttgcattgtgagttgtgtgtgaccttcacaacaaggtggatctatacacgtattattatgggcatggatgcatatcgtgcggcaagccgatgcacccaagcagaagaaaccaagaacttccgacatgctgcattgggggcacaggttcagtacacggcatccattccagacgacagacaataagcaaccacctcacaatcacaacgcacgatttacacctacagcaacagcaagagctacacagtcttgacaccacctacaagctaccgctgcttctcaccgagtgagcttcggcctcgacgagtgcctcacgcgcctttagtcctttctgccagttctaccacggtcagacggtgtccgggggtctcgtcatttccagaacagaccggagaagccacctggctgtggctgctgctgctgctgcccatggccaccgctggcccctgcgtgcggcgggctcggcggggcgccactggacgactcgcttaggctcaatgtgcctctggacggcgggctgctcggccctgccgccacgcccgtcggcgcgagatttagtggcgccggtgacggagcaagctgctgctgctgctgctgcttcggctgcttctttccaccggcgtcgaagctccccactacgatctgtaccggtgaagcagccgtcaggagtccggcaacacagccacccaggacacggccgtcggggcctgctagcgaaacgctgagcccaccagttcgactgcgctggccaccgttctctgacagaagaaacgacccggacagagacagtatctcgaaacgaccctcgtatgtcaccgttccacccgaagtggcagattgccgaagcgtcacatttgatatggcgccgtttgctgaaaggatgcagaccgcgcgtgtcccgtgctgcgagaacgacatgatctttgccgatacgtcctctccggcttttacaaaaataagatgaggcgtaaaacctgcccccgctggcccgagcgcagccacgtgcttcttgttggtggagcccttcggccggccccgcttcttcgcgccgtccggcgacgctgacggcgcagtgttcggcgccttcgggccgttaggcgagaaaggaccggaagctccaagagccgccggcgccggctccccagccatggatgcgggcaccaatgccagcgacatggagccgtcggggccgtactttcttggccggccacgctttttcttggtccccggctcacccgcgccacccgagtgcacgggcgcgccaccattgcctcctacgccagccaagcttgaagcagacgcggcgctgccgcccacgggctggtatgtcgccgtcgcgggcggcacggagctcaccggggtgaagatggcggtgccgtccgtcgtgtacgccatgcgcaggccctgcgtgcccccggaggacggcggcgttgccggggtcttcggcagcccgaacggctcccttcccgccatcactccttgctccggagacgggctcacctccatcattccacaccgaacaggtgcgccgaagcagaagcggaactacgaatctgggaatctgcggctgtcttcagcgattttccttgactgaaggcggccgctctcccgctcgagaaatgaagcagagaattcctccaggaggtcttcagaaattagtatagcactaggaaaatggagacagaaggcaggaaaatagtcagggatgctaacgatagaattcaatggatttggcttatatctcacgtaatttcccctcacatcacatagccttcttctacctcgattttcctttctttcgtttcttttccttttccgagctctcctccccaagttggcctcgtgccgacaa

SEQ ID NO: 14636 - DNA, 2764 bp, Zea mays
aattattatgcactattttaaagttttataagataacaaatgtaaaatatagtcaaaacacttacttattctctgatattattaataatatcttctaacattttgtgatacaaagtcattgcttatatcattgagataaatctcatccaacaactttttttgatatatagaatcgccaagccatttgatctctcttgagttattgttggccataaatagttcacaaaaatatttcaattttaaaaagcttctctctatcgatgtaaccatcatatgtatagtaaatagtactctctctatatcaaaatagaatttgttttgcttctttagcagattcatcatcatctagttgaatataaacataaaaatcaagagctaaactatcttacggatagagtattcgataagtaattgagatattagtttaataatctaaacgagactggtcgatagcgcaatcgttttttgcgtatttgtgtctagaatagataaatttaataggaaaaaatgctagcgtttaatggctatggggctctatatttttggggctccggtgcggccgtaccctcggcaacccctcaggaacggccttgcctggaaggctggaacagcatgtcggtgacgccgaagacgcccaactggaacgtgactgtcgtccacaccatcacatacgcatacgccgcatggccaccatgagcaaaccgctctgactcgcgccatgaccaaatatctgaatatgaatatcatgcggaacggggggccgccggcgctcccgcgcgacgccgcatcactccctcgccactcgcgcgcccgggctccttcccgccacgctcacgacgatgccgtccccgacgtcctatcttctcctgaatccctccaaaccctcctccttccgccgactctcggccccgcgcctgagccggttccatgtctcctgcgacgcgccacggggcggcgggaggcgcgaggtcatccccgccggtgccagcaaggccaagaaacagatcgtattcttcgacgccgccccgccggtgtcccaggagggtggaggcgccgtgaagaaggcggggagcgagaagcttacccaggtgggcagcggcaacgcagcgctggcgttgttgaggagggcaaccaagatgacactctcggtgctgtccaacctcccgctcgctatctccgagatgttcgccattgccgccctcatggctctaggaacggtgattgaccagggagaggcacccagctactacttcgagaagttccccgaggacaacccggtcttcggcttcatcacgtggaggtggatcctcacccccgggttcgaccacatgttctcctcgccagtcttcctcggcctccttgcgctcctcgcgacgtccctcatggcttgcacctacacgacccagctccccatggtcaaggtcgcaagaagatggtcgttcacacattccggagaaagaatacggaagcaggaatttgcggactcgcttccccaagcatccattcaggatttgggagtcatcttgatgggtgctggatatgaggtattcaccaagggtccatctttgtatgctttcaaagggctagctggtcggtatgcgcctatcggcgtgcacttggcgatgctcttcatcatggctggtgccacgctaagtgcgacaggaagctttaagggctccgtggatgtgcctcaagggctgaactttgttataggagatgtcatgaaacctagaggggtcctctctgttgcgccggatgttttcaatactgaagtccatgtcaaccggttctacatggagtactatgacagtggagaggtctcacaattctacagtgacctctccctattcaaccttgatggtaaagaagtgatgagaaagactatcaaagtgaacgatcccctgagatacggaggggtcaccatctatcagacagactggggattttcagcattgcaagtgaagaaaaatggtgaaggccctttcaatttggcgatggcccccttgaaactgaatggggataagaagctctttggaacattcttgccacttgaagattcagactcgtcgaatccaaatgtcaaaggaatatcaatgcttgctcgagatttgcagtctattgtgttgtatgatcaagatggtaagtttgtaggggtccgtcggccaagctcaaaactgcctattgagatcaatggcaatgaaatactcattgaagatgctattggtagtactggactggatcttaagactgatccaggagttcctattgtttatgctggttttggtgcgcttatgttaacgacctgcattagctatctttcacactctcagatatgggcattgcaagatggaagtacagtggtcgttggaggaaagacaaatcgagccaaacttgaattttctgaagagatgaaccggctacttgataaagtaccagagctgatcagcgccgatgagaatctattagataccaaatcgacagccacatgaaacatttttttgtgtgtttttgtttgggattgctgaagatgcagtagctctgttcaggtgaacacacgttcgaattcacaaaacatggccttcaagaatagaaaaactgttacaatctttcagtagaacttcttagatcacacttcaattgagctctttgtacatctttgaatgaggaaactaaactgatagcttgttatattaccaatttaccaattgccatactttagagcaaaataaatatgtaattttggttctgttaaaaaaaaaaaaaa

SEQ ID NO: 14637 - DNA, 831 bp, Zea mays
  misc_feature (830)..(830): n is a, c, g, or t
acgactacttagggcgaatggtccctgaggccggccggccggccggcaccgtcaacacacccagagaccatcacgacaatcggcaaaaatggcggacaacgactctcccgtcaccctccgaactcgcaagttcatccgcaaccctctgctgggccgtaagcagatggtcgttgacatcctccaccccaaccgtgccaacatctccaaggaggagctccgcgagaagctcggttccctctacaaggcccagaaggaccagatctccgtcttcggtctccgaacccagttcggtggtggcaagaccaccggcttcgctctcgtctatgactcccccgaggccatgaagaagttcgagcctcagtaccgattggtgcgcgttggcctcgccaccaaggccgagcgtgcttcccgacagcagcgcaagcagcgcaagaaccgacaaaagaccctccgaggtacggcaaaggtcaagggtgccaaggcgaagaaggagaaataaacgattcatggcttggcttgtgtatatcctcgggctggttggggagcggctgctgttatgtctgcagctgcgtgcattcggtggtcatgcgggtgcgtccatttactacggtccatcctcgtcgtcggcgccggctttggcatagggtacagggacttgctggcggacgcgggggctatctggactcgacgaggggggattgaaggctatgctttcaccttccttgctcaatacactagcatgaaatcaatggtctttttcgggtttcggaccaaaaacaaaaatagcaacgtctctgattttcacgcgcaaaaaaaaaaaaaaccgcggnc

SEQ ID NO: 14638 - DNA, 1784 bp, Zea mays
  misc_feature (1778)..(1783): n is a, c, g, or t
gaggggcggcggcgccgtcggcgtccaccgctgcatcctcgccgccaggagcgccttcttcctcgaccacctcgcctccctcccggctccggccgccgccggcgagaggccacggctggagctcgccgacctcgtcccgggcggccgccacatcggccgcgacgccctcgtgcccgtcctcggctatctctacaccggccgcctcaagcccccggcgcaggacgccaccgtctgcatggacgacgcgtgcggccacgggacttgccgcccggccatagatttcgtcgtcgagtccatgtacgcggcgtctggcttccagatctcggagcttgcctccctcttccagcgtcgcctctctgacttcgtttgcgaagcgctggacgaggacgtggtgccgattattcatgtcgcttccacctgcgatctccaggacctgctcaatctgtgtattcagagggtcgcagtctccgctctcgatagccgctacctggacaaggagcttccggctgacatatacaacaagatcaaggagatccgccgccaaccagagaacgccattattctggaccctgagcatgacaagagggtcaggaacatcctcaaggccttggattccgacgacgtcgatctcgtcggcttgctgttgaaggaatcgacggtgaccttggacgatgcattcgcgatacactatgctgcagccttccgtgcgcccaaggtgtttgcagagctgctcaaactggactctgctaacgtgaacctgaagaacagcggtgggtatacgccgctgcacatagcttgcatgaggagagagccggacatcattctttcgctggtggagaggggagcctgtgtgctggagaggaccctggatgggcgcgatgctcttactatctgcaagagactgacaagagagaaagacgcccgtgggaagttggacaagtacgaggagaaaagtaaggcttacttgtgtatcgacattttggagcaagaactcaagaggaaatccttcgttttggaccccatctctatctctatagaggagtcgattgccacgcctttgctggtcgataattttcacatgaggctcataaacttggaaaacagagttgcgtttgctcggatattcttcccttctgaagccaagcttgtcatgcgcatcgcacaagccgattcaacccaagagtttgccggcatcaccaacttcagcagactcaaggaagttgatctaaacgaaaccccaacgatgcagaataggaggcttcgcgaacgccttgatgccttaacaaagacagttgagctagggagacgatacttcccacactgttcggacgttctggataagttcctcaacgaagaatccactgatccgatcttccttgagactgggaccccggaggatcagcaagtcaagaggatgcgtttctctgagctcagagaggacgtgcgcaaggcgttcacgaaagataaggcagcagtggctgcaatagcttcctcggcgtcctcgtcttcgtctccgaggtgcagacgacccaataggaaatcacggtgatgtcagtctgttcaggacacctgcactgggttgtgtgtgttttgacatgtaacactgtttcagtagataatgctgattgtcagatttgctgccgctctacagaagattaagcgaccgtctgtttcaagaattattcagacagttacttgtgattctttcaagcagcagttacaaaaaaaaaaaaaaaaaaaaaaaaaaaaaaaaaaaaaaaaaaaaaaaaaaaaaaaannnnnna

SEQ ID NO: 14639 - DNA, 2978 bp, Zea mays
gccagctatgtattatgagtgggttttggtagtctttacagatataatcacggacgagttttttgcttcactcgatctaaatccgactcattgccatcccagtctaagacattttaactttttggacagtcaaagaatcttggtttaactaaaattataagaagaaattatgaaggattattttgactccagaatttaactaaaattataaaggtttataacataaaaagctatatacttactatttgcgattgcgaccgatgatgggccggccggcaggatttcctaaacccgagggcctccatccctccacgttctcagaaaagtcgtccacgcgtctataaaccacaccaatcttttggcccttcgcttctccgttctcccccaattcgccttcacctcgccgcttcctccttgaccgccaccgttgacgtcgtcttccggcgaggtagctcgccggaagacctcacctggacttttccgacgcaccctccacacactctttaaccctccggaatggccgcctgcttctagctcgtcgacgccccaatctccgcttgcttcctcgacagccccatccgcctcttctcgctctcgctacggctcctctgcctgttcgccatggcgatccgcatcaccgtctcctactccggctacgtggcgcagaacctcgccgcgtcgctcggccaccgcttctcctccgcctccgcctcgggcagccgcctcctccatgacggcgcctggcgccccttctgcatcttcacctccacccgccagcccgagcagcaccgcggcagcggcagcgaccgccatgacggaggcgactacaaccacccgaagccccaggccatcgccgccggagctcactcgttgctgctcacgcgtgcgtgcttatcgtccaagtcgccgccgccgtctcttgccgtggggctgctctcggtgcttgcgcagaggacgggaccgacgcctggaaccaccggatcggcggcatctctctcagtctcgtcgccgatttccctcggtttcaaccccacctccttcctcccgttcctgcagacagcgaggtggctcccgtgcagcgaccttgccacctcgtcgtcttcggaaccctcttcccctccccgctcgctggcgccttcggctccccccaagaaggcgttgattggtgcttctgctggttctaccggaattgcgacgagcagtggtgctggtgcagcgatgagcaggagcaactggctgtcgaggtgggtcagctcctgctccgatgacgccaagacggcgtttgcggctgtgaccgtgccacttctctacgggtcgtccctggccgagccgaagtccatcccgtccaagtccatgtacccgaccttcgatgtcggtgatcggatacttgctgagaaggtagatagagcctttgcctgacagaacattttggttttcagagatgtaccatgccgtttttatgtttgttgttgtgcatgatctggtgttattgtgatctgcaggtctcatacatattccgggatccagaaatttcggacatcgtgatcttccgggctcccccaggacttcaggtgccatttccagcctccctggattgttttctcatacctgatacggtgaatggtgatgtctgaatcgaacgttttcattgcaggtttatggctacagctcaggtgatgtgttcatcaagagagttgtggccaagggaggagactatgttgaagtaagctttcgtttcgatggtagtgcagcgatccttttgtttcgcgccattatgctgctcgaaacagctcgattcttttatgcttgagttgtaactctgaaaatcttggctcttttaacaggtgcgtgatggcaagctgtttgttaatggagtagttcaggatgaggattttgtgctggagccacacaactacgagatggaaccagtggtatgatatatgttctataacattaggaactatgcattttgtagtgtgattctgctttcatatattgttctttttttacttaggttagagacgttagacatattttcgttggaattcttgcttttgttagcgtaagtaattgagatgctgaactaaagtctctagattgtgcggtaaagaagtatcagctgttgcattttcggtatttgactgctagttgaattgtcgaatgcttgatagccacatagactattcccttagtcatactgcttagcattcttgcatttctgtaagcatgatggttcatcatgcggtacctgggtggctaggtgtcctaacgcatttcatatttgttggttgttgctgcagctcgtgccggaaggttatgtgttcgtgttgggagacaaccgcaacaacagctttgattcccacaactggtacgtcgcaagctactgtaattcgacctgttacactagaaacgcacagatatgcggatatgcctgaatcgtattgaatgtcttgcccctgctggggtccacttccagtgaggaacattgtcgggagatctatcctccggtattggccaccatcgaagatcaatgatacaatttatgagcctgatgtgtcccgcctcacggtgccgtcctcgtagtagtcgctgcagtgatgctggatatccagtgtgtgtacaatgaccttatacttcgtggagcctcatttgatgagttgagctccagttccaattctctcagaatattgtctcctgagtgttccctgtaaattctctttgcctgactgatttgttttcgctgccggttggcagatgcttgttcaaagcacgggaaagtgcagtaccttgcatcttgcaatacaaactaattaaaccggttacccttttttttcttttatcgagataaactctgattttaagaaagcaataaggtttcgtacactagataataactagagtacttgaaagtcaagatagactgtaatggacaccaaaacctgctgagaaaaatgatggtaccttggcctggaccacgc

SEQ ID NO: 14640 - DNA, 1824 bp, Zea mays
atccctccacgttctcagaaaagtcgtccacgcgtctataaaccacaccaatcttttggcccttcgcttctccgttctcccccaattcgccttcacctcgccgcttcctccttgaccgccaccgttgacgtcgtcttccggcgaggtagctcgccggaagacctcacctggacttttccgacgcaccctccacacactctttaaccctccggaatggccgcctgcttctagctcgtcgacgccccaatctccgcttgcttcctcgacagccccatccgcctcttctcgctctcgctacggctcctctgcctgttcgccatggcgatccgcatcaccgtctcctactccggctacgtggcgcagaacctcgccgcgtcgctcggccaccgcttctcctccgcctccgcctcgggcagccgcctcctccatgacggcgcctggcgccccttctgcatcttcacctccacccgccagcccgagcagcaccgcggcagcggcagcgaccgccatgacggaggcgactacaaccacccgaagccccaggccatcgccgccggagctcactcgttgctgctcacgcgtgcgtgcttatcgtccaagtcgccgccgccgtctcttgccgtggggctgctctcggtgctcgcgcagaggacgggaccgacgcctggaaccaccggatcggcggcatctctctcaggctcgtcgccgatttccctcggtttcaaccccacctccttcctcccgttcctgcagacagcgaggtggctcccgtgcagcgaccttgccacctcgtcgtcttcggcaccctcttcccctccccgctcgctggcgccttcggctccccccaagaaggcgttgattggtgcttctactggttctaccggaattgcgacgagcagtggtgctggtgcagcgatgagcaggagcaactggctgtcgaggtgggtcagctcctgctccgatgacgccaagacggcgtttgcggctgtgaccgtgccacttctctacgggtcgtccctggccgagccgaagtccatcccgtccaagtccatgtacccgaccttcgatgtcggtgatcggatacttgctgagaaggtctcatacatattccgggatccagaaatttcggacatcgtgatcttccgggctcccccaggacttcaggtttatggctacagctcaggtgatgtgttcatcaagagagttgtggccaagggaggagactatgttgaagtgcgtgatggcaagctgtttgttaatggagtagttcaggatgaggattttgtgctggagccacacaactacgagatggaaccagtgcttgtgccggaaggttatgtgttcgtgttgggagacaaccgcaacaacagctttgattcccacaactggggtccacttccagtgaggaacattgtcgggagatctatcctccggtattggccaccatcgaagatcaatgatacaatttatgagcctgatgtgtcccgcctcacggtgccgtcctcgtagtagtcgctgcagtgatgctggatatccagtgtgtgtacaatgaccttatacttcgtggagcctcatttgatgagttgagctccagttccaattctctcagaatattgtctcctgagtgttccctgtaaattctctttgcctgacagatttgttttcgctgccggttggcagatgcttgttcaaagcacgggaaagtgcagtaccttgcatcttgcaatacaaactaattaaaccggttacccttttttttcttttatcgagataaactctgcttttaagaaagcaataaggtttcgtacaaaaaaaaaaaaaaaa

SEQ ID NO: 14641 - DNA, 1286 bp, Zea mays
ttgggaccctcgaggcccgccggggcccgagcctccggaggggagctcgagggggaataaaatcccagcggcttcccccaaacaaaacctcttctccgccagagtccgcgtcggccagatcaaacgaatcggcacgacgcatcggcatcgcctccgacgatcttgagacaaacaaaacccaccgctgcggcaactccgcctcccgctgacacggggatcgcctgacaacaggcagagaaaagaggcgcagggtttgcccgcgaagatggaggacgtggacgtctcgcggcagctgaagcagatgacgaacttcatccgccaggaggccgtcgagaaggccgccgagatcgaggccgccgccgccgaggagttccaaatagaaaagttgcagctggtggaagctgaaaagaagaagatcaggcaggaatatgaccggaaagagaagcaagttggcatcaagaagaaaattgattactcgatgcagctcaatgcttccagaattaaagtccttcaagctcaggatgatttggtaacagatatgttggagtcagcaaggaaagagctactgtgcataagtagagatcaccccacttacaagaagctcctcaagacacttattgttcagagtttgctgcgcctgaaagaaccagctgtgcttctccgctgcaggaaggaggatcttcaacttgttgatttagttttggaatctgcaaggaatgagtatgcagataaagcaaaagtatatcctcctgagatagtggtagatcgtcaaatctatctgccatctgctcccagtcattatcaggcacctggcccctcatgctccggtggagttgtgctagcttcccgagatggaaagattgtctgtgaaaacacactggatgctagattgcaggtagttttcagaaagaagctgccagagattcgtcagagccttttcgggcaggtagctgcgtagccaattcttgaaagcagaacgtggcccagtactctttggggtaccctgacgatgtccaggagaaactttggcagctctcaatagtgatttatcacacttttggacctcgattattatttgtgtatacttttttcctggttatggatacctttgaatcctgcacagagcaaataaactgtgttcatttgtgggacgatcgtttgttgcaataaggcatcgagatgtgttgcgatgccacttctgttatagcatcatgttttttcgttgaaaaaaaaaaaaaaaaaaaacccgaacgacttctcctcgtgcaagaaaaaaaaaaaaaaaa

SEQ ID NO: 14642 - DNA, 1300 bp, Zea mays
caagaaacaaagccatttgcttgttttgaagccaagttacaggaaccttggcccttttggaatgcaagagtttcggaggaatcatataggatttcacatggaaaatgagagggcatttgccttgaaaagagaataaaaaaggcagcagtgttacacatgagttattaataaaaaaaaagcatgcatttgtatccacctcaacaggcagaaaacatatactctgcatattggcagtgttacagtgctcaagaattggaatagggcaataggcacatgccttgtcttgtctcatcgaaatggcaaggtgtcaattttcgggcacaacatgttgctggacctctccgcatacatatttagggtttatgtaccgtgggcggctgctgctgctggtgctggatgacatcgcatctttcatgtcagcctgaacgatccaacagccttctctatctgaggcctgtacttctccgagtcatcgtcgtcgatgtactggcccgtcacagtgtagaggcggttgtaccagccgttgaaggccatcccgatggccgagacgatgtggcgccgtcgctcgccggggttctgcagcgtgtactccaggtagtacaggccgtttgccgccctagagtcgatgagcttggcggcgagccccggcggcctctgccagctcctgtccaggccgttcaccaggccctcggcgaaggcatcgacgtcgccgaaggacttgaggctggtgaagtccggcccgatcccggtgatggcgacgctgacgttggagtcggcggcggcctgctcggggtagaacgccgtgacggacttgatgccgctggcctcgccggcgccgaccagccagccttgcggaacttgaatgctgaacttgttggcctcatcctcgtacgtagtgaagccctcctgcgactcggcggtggcctcgtccgccagagcgccggcaggggcgagcagcggcgggttcgcggcggagaagacgatgccgagcaataaggcgtccctccggcccagcagcccctcctccccctcctctacccgagcagggcggcagtggcagactgtcgtcgctgctgcctgctgcaacctcctgctgccgctggtgggcttgcgcgtgatgaaggacggcagcgaagagagggcgccggctgcggccgggcagatggaggcggtgctggtcacggcagccatgcggtgccgcagctagcgcgggacgctggtggtggttgcctcgccgttcccggccgggctcgattttgcgggcgccggggagtgcaccccgccggctcgaggtcccaat

SEQ ID NO: 14643 - DNA, 842 bp, Zea mays
tggggcccccggcgcccggccccatgcccttcctcgagatagctttatttcccttgcccttttccagagcacctccgccgtcggccatgggtcaagcctggggtaatctccaagataggctccaagggcggcggtggaaggagcaccaggtgaggaagatcaccgacaaggtgttcgaccgcctcacggaggacgcccagaagcgcgacaaggaggccctcagattcgaggaggtctacatcgccgtcctctgcgtctacaatgacatcaacaagtacttgccggggccgcaccacgaccccccgtccaaggagaagctcagggccatgatggaggagtacgacgtgaacctggacgggctcctggaccgcgaggagttcgcggagttcatccggaagctgaccgcggactcgctgtgctcgatcagcgtgaagctgctgatcacgctggtggcggcgccggcgctggcgatggcgaccaagcgggcgacggagggcgtccccggcgtgggcaaggtggtacgcaaggtgcccaacgcgctctacgcctccgccatcaccctggggcgttgtgctggtgcagagatccaccgagggcgtcgagtgactcgcgctgctgaaactgcaatgtcgtcggctgtgtagatggagcagcgtatctaggatagctgttggttcttttcggcttgtgcggtgaattgatctgtgtatcgattcgatgtgatttatcctggatttgggacaaataggtgcggatccttggcggccgtcttgcttttttacctttaagatcccggaacaggcttaataagaagagagagagttacatgcgtcagcggcggc

SEQ ID NO: 14644 - DNA, 872 bp, Zea mays
aagattagggacccattaaaccagaatcatacacctcatcgatatagctttatttcccttgcccttttccagggcacaccccctccagctctccgccgtcggccatgggtcaagcctggggtaatctccaagataggctccaagggcggcggtggaaggagcaccaggtgaggaagatcaccgacaaggtgttcgaccgcctcacggaggacgcccagaagcgcgacaaggaggccctcagattcgaggaggtctacatcgccgtcctctgcgtctacaatgacatcaataagtacttgccggggccgcaccacgaccccccgtccaaggagaagctcagggccatgatggaggagtacgacgtgaacctggacgggctcctggaccgcgaggagttcgcggagttcatccggaagctgaccgcggactcgctgtgctcgatcagcgtgaagctgctgatcacgctggtggcggcgccggcgctggcgatggcgaccaagcgggcgacggagggcgtccccggcgtgggcaaggtggtacgcaaggtgcccaacgcgctctacgcctccgccatcaccctgggcgttgtgctggtgcagagatcaaccgagggcgtcgagtgactcgcgctgctgaaactgcaatgtcgtcggctgtgtagatggagcagcgtatctaggataggtgttggttctttacggcttgtgcggtgaattgatctgtgtatcaattcgatgtgatttatcctggatttgggacaaatagttgtggatccttgtgaattgtcttgcttttttacctttaagatccggaacaaggctcaataagaagagagagagttacatgcgtcagcggcgcaaccaaaaacaaaa

SEQ ID NO: 14645 - DNA, 2720 bp, Zea mays
gggtacctcgaggccggcccggccgggcgcgccggccagtcgtcttgtccccctcgccgcctccgcgctcgtcttgctcctcttcggctcccctccccgccacctcgtcccaccccgccccttgggttgagttgagctactcgaccgtcagtcaattcctgcacctggcgttgggcgggttttcatgggggcagcataaaagcctcttcggttcttcccctagctctgcctcgcggcaagtccccctccgctacgttcgccatggctcgcaacagggaagtggtgattttgctgttggatgttgggccttcgatgcatggagtgctgctagaggtgaagaacgtatgcttgactcttgtgcataagaagctagtttataacaggagcgatgaagttggtattgtcctctttggtactaaaggaacatgcaatgagcttgcaaaggacattgggggctataagcatgtgacggtcatacatgatattaaagttgtagatgaaggaacggcacaggctctgcaaaaccttccattaggatctgcccctggtgattttctggattctattgttgttggcttggatatggtgattaggaaatttggtattaccaaagggaagcggcggctctgtctaatcactagtgcacaagaactgttaagagatccgcctgaggggaccaaagaagatcaagtggacaccattgcagacatgttgaaaaaacacaatatcaagatggagtgcattattttcagagaaccgggagtgcatcataatgatataatggaagaaaatgaccgactattgcatcagttcagaaatcgatcagtagcaaaggtaattcaggttgacaacccaacatcactgttgggtgctctcaagacaagaaatgtgctcccagttaccgttttcaggggagacctggaagtgaactccaattttaaaataaaggtgtgggtttataagaaaacagctgaggaaaaattccccactttgaagaagtattcggacaaagctcctccaagtgataaatttgcttctcatgaagtcaaagttgattatgagtacaagagtgttgttgagccagacaaagttgttccaccagaccaaaggattaaggggtatctctatggtcctcaagttattcctgtatcaaatgctgaatgggaggcagtcaagttcaagccagagaaaggtgtgaagcttctaggatttacagatagatccagcgtaccacggcaccaatttatgaaagatgtatgcctgtttatacctgagccaggtaacatgaaagcaagtcttgcagtttctgcgggaccccgcgcgtccggccgggtgaacaaggttgctatagtgcgatgtgtgtggaggcaaggtcaagggaatgttgctattggtgtattgacgccaaacatttcatcagtgaacaatatccaagattccttttacttcaatgtgctcccatttgctgaggacatcagagagtttcagtttcggtccttcagcagcctgccatcatcatctcagcccactgaagaacaacaagaagctgcagataacctagtgaagatgttagacctagcaccacctggaagagaggtcctcaagcctgagtttacgccaaatcccatcttggagagattttacagttaccttgatctcaagtcaaagcagccagatgcaaatgtcccaccgcttgaaagatctctaaggaggataaccgaacctgatcctgatgtggttggccaacaaacacaattaatccagaatttaagcaaagcttttgtgctgaaggagaaccccaagaaaaagaaagcacgaacacaggacatgttggcatatactggtgcaggtgatcaagctaaatctgtagaggacagagttctggaaaatacacatccttcaacagagaatgttgtggcaatcagagattcaaatccagttcaagattttgaggccatgctggctaagagatctagctcaacatggactcagaaggctattggagatatgcagaattacatagcagctttgttacagaactccagtgatgggggcaactatcaaaaagcacttgaatgttttgcttctctgcggaaggcctgtattattgaacaggaaccacaggaattcaaccagttcctaacgaagatttacgagagattgaaggaaggtgatgctgccaagttctttcaacttctctcctcaaaaaacatttcacttatcaacaaagaggaagcgcctgacagtgatgtgactgaagagatggcaagaagtttctacctgaaacgagaaaaggcgtctcagtaggagctggaagaagccggtaactcgaagcgccttgggtttggagggtatctgcatgttttgaaactgggtatctgggtggaactggaactaatactcaaactctctgggttgagtcactgttttgctgcacaatctgctgcctactacgtttcgactagattcagctttgggtactactgtatgttgtttgactggagtagcatgtccatagatcacatacttctgcagtgttcattggagtgaatgcatgcatgcggtgaaatgcagcatggataggtctaggaagaaacattaccatcatttcctaatgttggagcgctgcctagaaaaggatctttttctgtaagtggtctggtgcgtcaaaccctccaaagtccaaaataatcctttctacaaaaaaaaaaaaaaaaaaa

SEQ ID NO: 14646 - DNA, 1028 bp, Zea mays
cagttaccatccaccgccgcctctctccctcctccaacagaagaccccaacccctcggcatggcgtcgtggatcctggcccgatccaaagcccatcccctcgcggccgccctcacccgcggcgccgcctacgcagcgccgccgatcgccggagcccgggcgctctcgtccctgccccactacccgtccgccccctcctcccatgggctcggcaaggttctgggatatgaaccaacatctcacgtcagtggagcacaagttttacctcggttttcctctctaccgtccaatggatctcaggtgcagaagtcacagatccctgagacatacaagtcgggtggtgaaatgaagcagtctgatgcacggaaatcaagtgaggaagccacacccacaccaaaggttgtggccttcagcccgcaagaagcagctatagctgaatccagaagtagtcccctgacaattgagagttggaaagtaaggcggtcagagatagcaaccaaagtcaccttctacatgatcccagctctgcttctcgtctccaagaacagcatgagtacctctcttctggtcggggccgtgttccatcaagtgtacatgttccagaaggagattctcctggactacgtgcaccatgatatcaccagaaagtgggctttgatatacctgaagctgcttctgctggtgatggcgaaggacacaatcatgtactttcatccgttctaagctcacccaccgtgtcagttcctcaaatatcccagcaacgcatccggctgcgcactcagagaataatggtagtggacgaattctggagccctcgttcgtgtattccccctcatgagcttgcttcttgccatctttttttttcctgccgcaagttggttcctctcttgttaagtataattcatcagcctgagggattgattagtgaccaatcagatgacatccctgattctgcacctctgtttgcaattgcaataacagttgatatcgatcgtgcaactaaatgtttactgctgttttgaacgcccg

SEQ ID NO: 14647 - DNA, 1136 bp, Zea mays
ttgggtacctcgaggccggccgggtttcgggtcggggccggcccggatactagcgtgagtagttttcattttcacccctgcctctgtatccgagcatactagcggatcctggcccgatccctcttcccaccccacccacctccgcttctctccaagtgaggaaccccaagccctcgccatggcgtcgcggatcctggcccgatccaaggcccttcccctcgtcgccgccctcacccctgccgctgccaaagcagcaacgcctatcgccggagcccgcgcgctctcgtccctgccccgctacccgtctgccccgtcgccccatgggctcggcaaggttctgggatatgaaccaacatctcacctcagtggaccacaagttttacctcgttggttttcctctctagcatccaatggatctcaggtgcagaagtcacagatctctgagacatacaagtcaggtggtgaaatgaaacagtctgagacacggaaatcaagtgaggaagccacaccaaaagttgtggcgttcagtccgctagaagcagctatcgctaaacctagaagtagtcccctgacaagtgagagttctaaagtaaggcgatcagagatagcaacccaagtcaccttttacatgatcccagccctgcttcttgcctccaagaacagcataagtacctcccttctggtcggcgccgtgttccatcaagtatacatgttccacaaggagattcttctggactacgtgcaccatgatatcaccagaaagtgggctttgatttacttcaagctgcttttgctggtgatggcgaaggacaccatcatgtacttcaatctgttctaagctcaccttctcagtttctcaaatatccagcaatgcatccgtctctgcactcgtagaataatgatgatggatgaattatgcagccttcgttcttgtattctccctaatgagcttgcttttttccagctgccagtttcactcttattaagtatatcagtctggatgggattgatagtgaccagtcagatgatatccctgattctgcacctcattaataatatgattaatgtcaattgtgcaactaaaaaaaaaaaaaatataaaaaaaaaaatataaaaaaaaaaaaaaaaaaaaaaaa

SEQ ID NO: 14648 - DNA, 1248 bp, Zea mays
gatatcgcccgctctcgccgggcgtgagtgccgtcgccctctctctccctctcgcctgcctatcgcctcacgcgggacggtagagggcccttctggcctcccttctagccccaattggcaccagccttaccagttactgtactgtaccagttaccatccaccgccgcctctctccctcctccaacagaagaccccaacccctcggcatggcgtcgtggatcctggcccgatccaaagcccttcccctcgcggccgccctcacccgcggcgccgcctacgcagcgccgccgatcgccggagcccgggcgctctcgtccctgccccgctacccgtccgccccgtcctcccatgggctcggcaaggttctgggatatgaaccaacatctcacgtcagtggagcacaagttttacctcgttggttttcctctctagcatccaatggatctcagatctctgagacatacaagtctggtggtgaaatgaagcagtctgatgcacggaaatcaagtgaggaagccacacccacaccaaaggttgtggccttcagcccgcaagaagcagctatagctgaatccagaagtagtccactgacaattgagagttggaaagtaaggcgatcagagatagcaaccaaagtcaccttctacatgatcccagctctgcttctcgtctccaagaacagcatgagtacctctcttctggtcggcgccgtgttccatcaagtgtacatgttccagaaggagattctcctggactacgtgcaccatgatatcaccagaaagtgggctttgatatacctgaagctgcttctgctggtgatggcgaaggacaccatcatgtactttcatccgttctaagctcacccaccgtgtcagttcctcaaataatcccagcaacccatccgtctgcgcactcagagaataatggtggtggacgaatcctggagccctcgttcgtgtattccccctcatgagcttgcttcttgccatcttcttttttttttcctgctgcaagttggttcctctcttgttaagtataattcatcagcctgaggggttgattagtgaccagtcagatgacatccctgattctgcacctcagtttgcaattgcaataacggttgatccatagttgatatggatcgtgcagctaaatgtttactgctgttatgatcgccggtctaagttctcaacagtttttatgccatgtgcttatcatggactgccagcatgtttgctttcctgctgc

SEQ ID NO: 14649 - DNA, 1461 bp, Zea mays
  misc_feature (6)..(6): n is a, c, g, or t
cctcgnagccggccgaagctgaagtgtgctccgctccgcctccgcccgcggccgtacgctcccgagctccacccgtcgcgccccgaccgagatcgtccccggcgatggcttccgcggtggccgcttcgaccgctacgcggttcctgccgcggcttccggacccgtggtggacgcgtcgtgcgcgagcggcgctcccgccgccgccgctcacgtggcggcctctcccgttcacggtgtccgccgcgtcgtcccgccctggggaagcggaaggaggacggcgcgggaggatgcggaggcggcgcgccaggagggcggaacaggaggaaggcgtctcgctaagctctgaaaaggagacggtaaattctactccacgtgctcaacccaaaaagggtgcagaacccgtagcggtgtccagcacgagtgggaaaggctctgccattagaagggtgacacttgtgattcttgctgccgtgctttttggagttagcattgccttgaaggacggggccgagaaggcatcggagtattttgctgggtatttattggaacagagtttgtcggtggacaatctctttgtttttgttctggtctttaagtatttcaaagtgccaaatgaataccagaatcgagtactttcttatggtattgctggagctgtggtcttccgggctgtgatgatcatcctaggaacagctaccatccagaaatttgaggcggtgaatttgttgttggctttgatcctgttattcacttcttacaagctctttgctgaagaagaagaagaatctgatctatctgataacttcattgtgaaaacatgccaaaagttcattccagtcactgattattatgatgataatcgttttttcacaaatcaagatggtgtatggaaagctacaccattgctcttgactttggcagtgattgagctgagtgatattgcctttgctattgactcaataccagcagtttttggcgtcacaagggatccacttataatactatcatcaaatatttttgctatttctggtttgcggtcgctctatgtgctcgtttctgaaagcatgggtgaattggagtatctacagcctgccattggtattgtgttgggcttcattgggacaaagatgatctttgacttttttggttatcatataccaacagaagcttcgcttgcaattgtaactacatgtcttagtggaggcgtcatattaagtcttaggaaagcatcaaaagagaagggggacaagtagactgatgcaacaacacatgcaggcataggaatccagcttgctccatatttttggcagatagtcaagttacaaaaataattataataaacacttaaaagccaggtaaacatagtgttttcactaaactaattacttgtataaaaaaatctaacctgacagaatatcttttgatcagtatatgtagtcttagcgaaaaaaaaaaaaaaaa

SEQ ID NO: 14650 - DNA, 1764 bp, Zea mays
acggccaccagccgatgtaggctcgatctcaacgatgggagacgacgtctgggctccacggtggtaatggtgatggagtgctgctaaccggatgggtggacaacaaatgattttgtcgtgtctatttcagcgtgttgaagccgtctaaacttccattttatcgagtgtgtcgtgtttcataatgccaataatctctccgcagccgactcgccccggtggggctgactgagctccggtccgcctcgacccgcggccgtacgccccggagctccacccgtcgcgccgcgtcggagctcgtcgccggcgatggcttccgcggtgggcgcttcgaccgccacgcggttcctcccgcggctcccggacccgtggcggccgcgtcgtgcgcgcgcggcgctcccgccgctcacgtggcggcctcccgcggtcacggtggccgcggcgtcgccccgacctggggaagcggaaggtaggcggcgggagaggacgcggaggcggcgcgccagggggccggggcaagaggaaggcgtctcgctaagctctgaaaaggagacgctaaattctactccacgtgctcaaaccaacaaggatgcagagcccgaaccggtgtccagcacgactgggaaaggttctgccattagaagggtgacactggttctcgctgcagtgctttttggagttagcattgccttgagggacggggctgagaaggcatcggagtattttgctgggtatttattggaacagagtttgtcggtggacaatctctttgtttttgttctggtcttcaagtatttcaaagtgccaaaagaataccagaatcgaatactttcttatggtattgctggagctgtggtctttcgggctgtgatgatcatcttaggaacagctagcatccagaaatttgaggcggtgaacttgctgttggctgtgatcctgttattcacttcttacaagctatttgctgaagaagaacaagaatctgatctatccgataacttcattgtgaaaacatgccaaaagttcattccagtcactgaatattatgacgacgatcggtttttcacaaatcaagacggtttatggaaagctacaccattgctcttgactttggcagtgattgagctaagtgatattgcttttgctattgactcaataccagcagttttcggcgtcacaagggatccacttataatactatcatcaaatatttttgctatttctggtttgcggtcactctatgtgctcatttctgaaagcatgagtgaattggagtatctacagcctgccattggtattgtgttgggcttcatagggacaaagatgatctttgacttctttggttatcatataccaacagaagcttcgcttgctgtagtaactacctgtcttagtggaggcgtcatattaagtcttaggaaagcatcaaaagttgagggggacaagtagactgatgcaacaacacatgcaggtaacgcttttgacccgagatgtgaaatgaatttatcctctacgcatgctgtgtaggaccatgtgtgtaacgttctgagaattagtcacagaaaagaagcttgtagaaaagggaagaggaggaagaaagggcattgtgtttagattaccttgctccgtattggtgttgttagggtggtggtctgcttgtatagtggtctactttgtatcgcatcgttgaatctgatctagtacatgctgctggtgtcccttgtaaacggaaggaatcattcattattcgccccgccaatttgttcc

SEQ ID NO: 14651 - DNA, 2280 bp, Zea mays
agaggtggtcaggtggagttcgccaatcgccagttcggagtcgctgattgagtcgggagccagagaggccgagaacggatgtttcctgttacttgctgcgtgcacctcgtgggctggaagttgggcgtcagctaatcttccgctccgcaccgcctgcagccccgtgcaccatatccgctcttagcaatcataacaaacattcgagaaggaagccaacagatttcagtatttcacggtcaccagtccctcctacccgcttcccataaaatcttctgatctgtaacgcattcgtcgtcgcccacatccgcttcgctctcttgctcttttagtcccatctcccatcccacctggaggcgaatttcgtctggggaaaaagtcggcggccatggccgggcgagactccctcccggagggctctctcttcctcggattggacagctccactcaatcactgaaagctacggtgctcaataatgagctcacaatagtagcttctgaaattgttaattttgactctgaattgccacactacaaaactgaaggtggggtgtacagagacccagcagatgataggcacattttttcaccaaccattatgtgggtggaagctttggaggtgctgcttgagaagctaaaaccaaagatcaacttcggtaaggtagtggctgtttctgggagtgggcagcaacatggcagtgtttattggaagaagggcagccatgctgtgttatcctccttggatgctagtaaaagcttgttatcgcaactcaaggatgcattttctacaatgaactcaccattatggatggatagtagcacaacaaagcaatgcagagaaatagagaatgcagttggaggtgcactggagttagcaaaactgacaggatctcgtgcgtatgaaagattcactggcccccagataaggaagatctatcagacagagcctgatgtttatgaagataccgagagaatatctttggtgagctcgttcatggcatctatccttgttggaagctatgcaagtattgatgaaactgatggtgcggggatgaacttgatggatatcaagcaaaggacctggtcaaagtctgctttagaggcaactgctcctggacttgaagcaaagcttggaaatctggcaccagcatattcagctgctggccgaattgctccttattttgtagaaaggtttcagtttgataagaactgtttggtcattcagtggtctggagataatcctaatagccttgcaggtttaactctgaatacccctggtgatcttgccattagccttggtactagtgatacagtattcgggataacaacagaagctaaaccaagccttgaaggacatgttttccccaatcctgttgagcctaatggttatatggtcatgctatgctacaaaaatggctccttgaccagagaagatgtacgaaatcgctgtgcagacaaatcatgggacgtttttaacagctatctggagaaaacgccccctctaaatggtgggaagttaggattctactacaaagaccatgaaatcctccctccacttccagtgggtttccatcggtacactgtcgaaaacctcaacgacgtctcatcagacgctctgttggagcgtgaagtggaagaatttgacccaccgtccgaggttcgtgccatcattgagggccaaatgctgtcgatgcgaggccacgccgagaggtttggcatgccgaaccctcccaaacggatcatagcaaccggcggggcatcctccaacgaaagcatcctcaagtcagtcgcgcagatcttcggctgccctgtcttcacagtccagagacctgattcggcatcgctgggcgcagcgctgagagctgcccacgggtggctatgcaacgcgcaaggtagcttcgtccccatctcgtgcctgtaccagggcaacctggagaagacctcccttggctcgaagctggcagtcccggccggcgacaaggagcaggaccgggagctcctccagaagtacaccctcctgatgaggaagagaatggagatcgagagacgcctggtggagaagatcgggcgatcgtaggaaaaaaaactcatgaagcgctgctgaggctggcaggaccgaataatttgtgaataaatatggattatctcgatcgtaggaaacaaattcatggcaggaccgaacaattcgtgaataaaagtggattatcgtccattatgcagaactttctcaaaaaaaaaaaaaaaaaaaaaaaaaaaaaaaaaaaaaaaaacacccaccgtccg

SEQ ID NO: 14652 - DNA, 888 bp, Zea mays
cagggggcccctcgaggccggccgggagcgtcggctcgccgtctccctccctccttccagatctcggcgcgagttcacccttcagatttccatttccaacacgacggcgaagaagagctgcgatccggaggagtaaaccctacccgccggttgcccggtgcgcgggcgagatccgggcggagatctagggcgcggcgccggccatggcgagctccggactcgcttaccccgaccgcttctacgctgccgcggcttacgctgggttcggagccggcggggccacctcctccgcagctatctcccgcttccagaacgacgtcgccctcctcctctacggcctgcaccagcaggccacggttgggccatgcaatgtgcccaagccaagggcgtggaaccccgtggagcagagcaaatggactagctggcatgggcttggaagcatgccttcagcggaggcgatgcgtctttttgtcaaaatcctagaggaagaagatcctggatggtactctagggtccctgagttcaaccctgagcctgttgtagatattcagatgcataaaccaaaagacgagccacaaagtgtaccggcttcaacaaatggaacatcaatttcagaaccaaaaatcatttctggaaaatggaagttctggtggagactcaggacaaagatgttattctgggaggccttagtactgttatttctcatgatgagtggactccattatctgtcagtggtctccgtccgaagcctcgttatgagcatggagcaactgtgttgcaaaataagatggtatatattttggtggaaacccataatgggacgtaccttagtgaccttcaggcttggggatctggaagaagttgatctgggtccaaggttgataccaa

SEQ ID NO: 14653 - DNA, 2260 bp, Zea mays
gtacgcatgtaccaatgtcaccgcagcacgagcaactgcctagtaatggctaccaagtacgttgatttaagattaaagtggacggttctgtaatgtcacccacctaacaaatagaacatacatattttttgttttattaaaataaagtgtacgcatgtaccaatgtcaccgcagcaggggcaactgactagtaatggctaccaagtacgttgatttaagattaaagtggacggttctgtaactttgacgtgcactgcatggcagcggttctgttacatatgctatgtctctcaatctcatttcatatctctatatgtccgattatttatgtggtgtcttggtagctagctcggagcttaattttaattcgcagctgcgcagtagtataaaatcgttgttggccctttgctttccctctccctcgttgtccatggccctcgagtcatggctcaccaaggtccgctcggccatgtcctctgcctctggaggttcgggggcgccatcgaggccccggaagcagagcaccgtcggcatcctcgccttcgaggtcgccagcctcatgtccaagcttctccagctgtggcgagccgtgggtgacgctgccgtcgcacgcctccgccacgagaccatgaacctccacggcgtccgcaagatggtctccgacgacgacgacttccttgtcggcctcgcccgcgccgagctcgtggacacgctcagggccgcatccgactccgtggccgcgctcgccgcgcggtgcgcggaccccagcctccgcgacttcagggacgccttcctggagctggccgacaccggccgcgaccggcaccgctggacggcgcccagctggaaggagatggacgcgagggcgagcaggatggggaagcaggtggccaccaccgccgcgctccggagggccatggaggagctggccgaggccgagcacggcctccggaagcttgtcgtcctccagtgcgccgccagcagcctttcggcgagcaagatctcggcggcgtcggagcagcagcaggtggtcttctccaagaggcaggaggtgaagcacctgaagcagacgtccctctggggctccaccttcgacgctgccgtcgcgtcgctggcacgggcggcgttcaccaccctcgcgcgcatcaaggccgtcttcggcgccggccgggagcagcgccacccgccgctgtaccgcagcctgacactctcctcggcggtgcacccgtcaggcgacgcgcggtccccgccatcgcgcaagtccatgtcaatggaggaggtgctgctgttcgacgtggacgaccagccgtcgttcgctccgaaacggcaggtgcggggcggcgggttcctggaggacagctcggcggcactgacgcccccggcggggacgctgggcgcggcggcgctggcgccgcgctacgccgggctggtgatctcgatcgagcggatggcgcggtcgccgctgctggtgggccccgaggagcgggacgagctgtacgggatgctgacggcgagcgtgcgcgcgcagctccgggcgcggctgcgcggcgcggtgcccgcggcggacccggggctcgcagggcagtggtgcgcggcgctcgctgggatcctggagtggctggcgccgatggcgcacgcgacggtgcggtggcaggcggagcgcagcctggagcagcggggcgggagcggcaacggcagcgtgctgctgctgcagacactgcagttcgcggagcgcgacaaggtggacgcggcggtggtggagctcctggtggggctcaactacgtgtggcggttcgagaaggagatgagctgccgcgctatgctcgcctcgcccgcccgcccgcccgtccgatgacgatgcatccatggattatggatggtggtggtgatacgaatgatgcaagcacatctgcatctgcatctgtttgttgctcattctggatggatctgttgacgacgaataaatctctactacttattggtacacatggttagttgactcaatcatcatctcaacgattccatcatcacatggcggcagagcagactgttgttatacactataaataaatatcaaacaccagtggcagcgtcgatcaaaatacaggttaaaatacttcagcgacagtaagggagggggccatggctttggctcctctcatgctcctcttttctattggaatggaacaatctgtaccttagctggatgaaaactagctactcaaacacaaatattccagcattcaaggattctaagaac

SEQ ID NO: 14654 - DNA, 722 bp, Zea mays
ccggccgggaattccacactcaggcaacccagctttgggtccctcgaggccggccgggagttctttgccccctgttcctcctcctcctcttttcgcacctcggcgcctgcttcggcatcaactgcgaccgagatggaggcgcaagacgactgcaagtggcgccaagtcccggcgttcggcgactggaacctgtgggacgacatgcccgtcacccagtactttcaggcagggaccttcttcttcgccgcgccgacgacagagaaggacgacgacgaggatctcttcaaggtgccccagttccctgccacgccctacagctacaagaagtgcgttgttcgagtgaagggggagaaaggaactgctgtgcctccggcggcgaggaagggaggaaggaggcgccgcgtgaacgagcaacagaagtggaagcccaagggagctgtggacgaggacctctacaagatatccccgcagcttctctgcaagaagaagctcctgaggaatctgctgggagggtgcctgggcctgagctgcatcgcatgaccgagagacgcatcgcttaataagtttctggggagtttgttgttcggtgggtgctctggagagttgtatagtgtctacgctaatatggaatcaatggaaacttactgctgcttttgcactcttttgaatgtaaacactagctcgcattccatcacaaaaaaaaaaaaaaaaaaagcggccct

SEQ ID NO: 14655 - DNA, 1213 bp, Zea mays
ccagctttggctgcccttgcttgctgctcagttctttgccccctgttcctcctcctcctcttttcgcacctcggcgcctgcttcggcatcaactgcgaccgagatggaggcgcaagacgactgcaagtggcgccaagtcccggcgttcggcgactggaacctgtgggacgacatgcccgtcacccagtactttcaggcagggaccttcttcttcgccgcgccgacgacagagaaggacgacgacgaggatctcttcaaggtgccccagttccctgccacgccctacagctacaagaaggtgaaacaaaacacaacgctgcatttaatttctttcaccaatcaccctcgaaaaaaagctttcttcttccaccagctctaaagatatcagcactgtttcatgcaggactttcatttcaaatctccacttccatatagtagtacatatatacatatacccagtctgcactagcgatgagaaagatactgaccaattctgtggtcgatgcttgcatgtgcagtgcgttgttcgagtgaagggggagaaaggaactgctgtgcctccggcggcgaggaagggaggcaggaggcgccgcgtgaacgagcagcagaagtggaagcccaagggagctgtggacgaggacctctacaagatatccccgcagcttctctgcaaggtgaagaaggcaaggatcctgtaatcctaatttgcaccccacgtgtacctaagtgggtctacttcttatctagttctcgtcatgtgattggcataagcctttatctagcctaagctgaccctttgcaagtagcttttgttaggataacaacactagatagaacagctatactttgccaatatatgctgtgacctttcttcaaaagcttaagcacttcatttttcacagcaagtggagctttgccaaagatcatgagcaataaagctggactgtaaactccagaaagattttaggtgagagttttgttctcatgctcttttgtttgtgttgcagaagaagctcctgaggaatctgctgggagggtgcctgggcctgagctgcatcgcatgaccgagagacgcatcgcttaataagtttctggggagtttgttgttcggtgggtgctctggagagttgtatagtgtctacgctaatatggaatcaatggaaacttactgctgcttttgcactctttggatgtaaaaaaaaaaaaaaaaaaa

SEQ ID NO: 14656 - DNA, 924 bp, Zea mays
cccccgaggctcgccgggacgtgtgcggtgtgccctcgcattctcttcggcccaaccgcccaagcctttgggcgctcggctatgtatagatgagcgcccccctgccctgctgcccaattccaacactcaggcaacccagctttggctgcccttgcttgctgctcagttctttgccccctgttcctcctcctactcttctcgcacttcggcgcttgcttcggcatcaactgcgagcgagatggaggcgcaagacgactgcaagtggcgccaggtcccagcgttcggcgactggaacctgtgggacgacatgcccgtcacccagtactttcaggcagggaccttcttcttcgccgcgccgacggcagagaaggacgacgacgaggatctcttcaaggtgccccagttccctgccacgccctacagctacaagaagtgcgtcgttagagtgaagggggagaaaggagctgccgtgcctccggcggcgaggaagggaggcaggaggcgccgcgtgaacgagcagcagaagtggaagcccaagggagctgtggacgaggacctctacaagatatccccgcagcttctctgcaaggtgaagaagaagaagctcctgaggaatctgctgggagggtgcctaggcctgagctgcatcgcctgaccgagagacgcatcgcttaataagtttctggggagtttgttgttcggttggtgctctggagagttgtatagtgtctacgctaatatggaatggaaacttactgctgcttttgcactcttttgaatgtaaacactagctcgcattccatctctcttggtgttgttttggtgcctcactttgttactagcagtacattaaagcggttagggctctcggcagagagcggtaaaaaaactggaatttacagtactatcttatctaatgccgcc

SEQ ID NO: 14657 - DNA, 2270 bp, Zea mays
aaaaaaaacctctccgccgaactcctgcagatcctaattaacctccccctgctgcaccaattgccgctggcgatggatggtagcggacgagctctcgattgtcgcagcttctggaaggccggcgcgtacgaggcccccactgctccgaccagggagttccaagatgcccttgagacgggggacttcgaccgcgcgcgcgtgcaccccaagttcctccacaccaacgccacctcccacaagtgggctttcggagctatagctgaacttcttgacaatgcagtggatgagataagcaatggtgccacgttcataaaagttgataaaagcatcaatttgaaagacaatagctcaatgctagttttccaagatgatggaggcggcatggatcctgaaggtgtccgtcgatgcatgagtttaggattctcaaccaagaaatctaagaccactattggccagtatggaaatggctttaagacaagcacaatgagacttggtgcagatgcaattgtttttactcgtgctatccgaggaggtaatgttacattgagtataggtttgctctcctacacttttttgagaaagacattgaaggatgacatagttgttccaatgcttgattttaagatccaagatggggacattgtaccgttggtgtatggttcacagggtgattgggatagtagtctgaagatagtacttgattggtcccctttttcttcgaaggaagaacttctgcagcagtttcaggatgttggtagtcatggaactaaagtggtagtgtacaatttatggatgaatgatgatggccttttggaacttgactttgaggatgatgatgaggacatattacttagagatcaaggtagcgcaagtggggggttctcaaagagtcagaaagaaattgttaagcaacacatatcccacaggctcagattttcattgcgagcttatacctccatcctttacctcaggaagtttgataatttccaaattatattaagaggaaaacctgttgagcagatatttatcactgatgaactaaaatttaagaaagtcgttacttacagacctcaagcagcacatgattcccaagtggcctcggtaaaaattgatattggttttgcaaaggaggcccctattttgggcatttttgggatgaatgtctaccacaaagatcgacttataatgcctttctggaaggtccttcaagaaggatctagcagagggagaagtgtggttggtgtacttgaagcaaattttattgaaccagcacatgacaaacaagattttgagaggacaccattgtttattcggctagaaacaagacttagacaaattattattgatttctggaaagaaaggtgccatttgattggttaccagccaatggatccacatttaagatcccagtataaggccaccctcaaagaatcggttggtcctgctccagttcaccataaagcttccagtgtccgaagaactggagggctttcgtcaaatttactaccagagacatatgacgacataacaactgttgggttagcaaataatggttctcatttgcaatcgtctgatcaagcacaagagaacaatatggactcagaagttttggatgaggatctggtggagattggctcctctggtgtcctagatcctagttttattgagaagctgagtgaagaaaacatcgctctgttttcaaggcgtgaagagcttcgacaacgagatacacaactgaagcagacgattggagacctggagcttgagctggaggaaacaaaaaagaagtgcggtcagcttgctgctcagctcaaggcatggaagaaccagcagcatctaccctaaatgtgaagggcatcattaagaccgaggacacggaggtacacgacaacgaccaatactgacagaaaaccgaaggttacaaggaagcacggatgcatataatgtctgtctagtgggctggctaactcatggttgagttgttaaaaagaagtttagcatgtaaatcttaggcgtgtgtgctacttagctactagacagaatggttgtcatgtgcaagcaaggaagatgacttgggtgattcctgctgttaatttgctatgcaaaatgtcacgtaaggcccttatgatccagccttgagcatcaaataaaactgtagaactcgaaatgaaaaaaaaaaaaaaaaaaaagagaccactagctcctcgtgccgaacaacaaccacacaaaataaaaaaaaaaaaaaaaaaaaagtcttctgggttgttacc

SEQ ID NO: 14658 - DNA, 1344 bp, Zea mays
ttcttcctcgcaggcacagccgcttctcccaaaggttgcgatggccagcacaacctctcctctcctcctgcttgccgccatggcggtggtggcggcgacgcttgccgtggcgccagtctcgtcagcggacctgccatccggtgtcgcatccatcacgtccaagatcccaaacccatggtcggccttccagaacctcacgggctgccacttgggcgagcagcagcagggcctcgccaaggtcaaggactacctctcccgcttcggctacctgccccccgagtcgtccgggtcgttcaacgacgtcttcgacgccgacctggaggaggccatcaaggtgtaccagcgcaacttcggcctgggcatcacgggcgtgatggacgcgtccacggtggcgcagatgatggctccgcggtgcggcgtcgccgacatcatcaacggcacgtccaccatgggcggcggcagcgcctcggcctcggcggcgcacgcgcgcggccggaacctcttcacctacttcccggggtccccgtcgtggccgcgctccaggaagagcctgacgtacgcggtcacgcagacctcgctgacctccatcgaccgcgcgacgctgagccaggtgttggcgcgggccttcgcgcggtggtcggcggccacgacgctcagcttcacggagacggcgtcggagcgagacgcggacatcaccatcggcttctacgcgggggaccacggcgacggcgaggcgttcgacgggccgctgggcacgctggcgcacgccttctcgccgacggacgggcgcttccacctggacgcggccgaggcgtgggacgccagcggcgacgtggcgcgcgcggcctccgacgtggccgtcgacctcgagtccgtcgccgtgcacgagatcggccacctcctcggcctgggccactcggccgagccctccgccatcatgttccccaccatcacctcgcgcaccagcaaggtggacctggcccaggacgacgtcgccggcatccagaacctgtacggcggcaaccccaacttcaagggcgtcgcgccgcccgccaccagcagccgggacatggacagcggcgcgaccacgagctcccgggggccgtggaccgccgccgttgccgtggccgctgggctcttggtagcgttgtagtcatcggcagatttttttttttaaaaaaaacttttgctttagctgattttaattcttgtgcgtacatcgatcagtagatacatttgtaatttatgtactccttgttgttatacatagatagacacatggattgtatagaatcaaatcctattgggtaaaaagaaatggtgcgtgtgtcactatttttgatg

SEQ ID NO: 14659 - DNA, 1762 bp, Zea mays
  misc_feature (925)..(925): n is a, c, g, or t
atttgtccacttattccaaacttatagacactgcgctaacaattatggtaagatcctaacagataaggcaagatcttagcagataagataagatcctagcagataagaaagacacacttgtaatcatagagtgggttccatgtacaactaggttatcgactcggtaccatcatggaccagataaccaactcgatatccaccatgtaaccgcctcctccttgctctacaaaaggagggcaggggcgcccctatgggcattagatcatcatatcataagcaatagccaccaacacactggacatagggtattatctcgccttgatagcccaaacctgtcaaaatcttcgagtcttctatgcatttacctttagttttcgatctcgtgatctaccccataaatccactatctaatattccttaacaattaataacacaattcgcatgtgtagtactacataaaattaatctcttgtatttaaagctccccctgcattgacgctccctccgcgctcgataggcatttggccttcgctcctgtcgaggcatggagaatggggtagacacaaaactagccactctttctagcattagaattgttcttgtaaaacttagtgattgatattgaaaagataagattgtcaccacatgtaggttaacacaataaaaagggaccatttggatatttttcatttgagaggaattaaaatatatttaatgcactcgattatttgactcaaaatatgatattccataaaccttcgactagctctcctagaatagaaatgcatcacataaatggtttaataatttatgactagattatagttatagaaaaataatcccaaggattcaaacttaaatgatattgtcaaaattttaaaataactagtacaactgagtcattcgggcaagcaaccaacacacnaccatgcaaactcaggaaactgggtctatcaaaggctaattttgctctcactcactcaattgaaacacaaggttcccacaaacattgcattgggaccttgcccggctgctacaatcacgctaggccgcatgcgccatggatggtccaaaggttccctgtctttaataactcgcctttgcccccatagggcgattgggctctccgacgccggccgggaccacaccacaacaagcacagagacaccaagcgttgaactcgcctaagcagctaccaaccaaccctagaaagctagacaccgtacccatggctcgcgctagcgtcgtctttgtcattgctgctctcctcttcgtcgccatggtcgtagcaccgatggccgaggcaaagtctgccgatgcccctgtggctgacgcgccggccgatggacctagcgggccggctgctgcacctggcccccagggtgtcgaaggcctgtcaggcaatgaggatgacgatgatgactccaccaactgaggccacacatgtcggcccggttaaatttggaacaagacatggaagaaaaatgagagcaatgtctttaaaaccatgaatccataataatgtgtggtcatccatggatacatccttgctctccctctttttctttctgtttgattttcaatgtgttatcatgttgttagttaactgtatcgactcatggtatcaaggtctaaaaaattatcgtcgttcttgtgttcttgagacactgagattttgagacagtgaacgattcatcaatcacaacgttggttttagtcttccctgcaaaaaaaaaaaaaaaaaatttgcggcccttggccc

SEQ ID NO: 14660 - DNA, 742 bp, Zea mays
  misc_feature (600)..(601): n is a, c, g, or t
  misc_feature (604)..(608): n is a, c, g, or t
  misc_feature (611)..(611): n is a, c, g, or t
actcctatgggcgattgggctcctcggggccggccgggaccacaccagaacaagcacagagacaccaagcgttgaactcgcctaagcagctatcaaccaaccctagaaagctagacaccgtacccatggctcgcgctagcgtcgtctttgtcattgccgctctcctcttcgtcgccatggtcgtagcaccgatggccgaggcaaagtccgccgatgcccctgtggctgacgcgccagccgatggacctagcgggccggctgctgcacctggcccccagggtgtcgaaggcctgtcaggcaatgaggatgacgatgatgactccaccaattgaggccacacacgtcggcccggttaaatttggaacaagacatggaagaaaaatgagagcaatgtctttaaaaccatgataatgtgtggtcatccactcatccatggatacatccttgctctccctctttttctttctgtttgattttcaatgtgttatcatgttgttagttaactgtatcgactcatggtatcaagatctaaaaaattatcgttctaaaaaaaaaaaaaaaaaaggggcggccagaaacgggccccggccaaaaaaaaannaannnnnaanaaaaaaaaaaaggaaaaaaaaaaaaaaaaaggggccccttttttttttttttttttccccaaaaaaaaaccaaaattccattttccaaagggggccagaaaaaaatggggttggcttttttgggggaacct

SEQ ID NO: 14661 - DNA, 1521 bp, Zea mays
ggccggccgggatagtgtgcgcggccgatctatgcacctcacctttcccttgctgcagttggaggaagtgtgctgcaggtggaagaagagaggggagaagctggttcccctctccatatctctcctccccagctccctccccctctcatagatcgatcacacagcctgcaggcacagacaagagttaggctgttctacctgatcatatgaccctccagcaattctctcatccacacacaaactgaagcaagaattattgcttatctatatcctgtctgtcctttcctctatttcccccctcccctttctatttccattgtgcagcttgttattagtagatagcagtggatcgatgtgtgatggaggaaacaagctagctagctagctaccagctgaagcagcagggagaagaaggatagagagagagagagagagaaaacatcttcttcatccatagtctcggcctttcttcaccaggtcgtctgcagatctgtctcctgtgaccttccagaggccaagctaggccaggaaggaaaaatggcgtccccgtcgagcaccagcaacaactcggccttctcccctgtggcggcgtcggccgggacgacgatgcctggtgccggggcgccgtgcgcggcgtgcaagttcctgcggcgcaagtgcctgccggggtgcgtgttcgcgccctacttcccgccggaggagccgcagaagttcgccaacgtgcacaaggtgttcggcgccagcaacgtgaccaagctgctgaacgagctgctgccgcaccagcgggaggacgccgtgagctcgctcgcctacgaggccgaggcgcgcgtcaaggaccccgtctacggctgcgtcggcgccatctccgtgctgcagcgccaggtccaccgcctccagaaggagctggacgccgcgcacgccgagctcctccgctacgcctgcggcgacgtcgccgccggcatccccaccgcgctccccgtcgtcagcgccgcccccaggctctccacggcgccaatgacgacgacgagccccggccagttcgccgccggcatgtacggcagcggcaggaggcttggggtcgtcgacggactagcagcgccaccgctgcctccgtcgggcggcggcggcggctgctacttcatgcggaaccaccacaacaacgtcgtcattagtagctccccaggcgctgacgtggcgcccgtcctgccttacgcttccgtggctaattgggcggtgaatgccatcagcgcgtcgacgaccaccacctccggatcagagagcattgggttggatcacaaggaagagggagacagcagcatgtgaagtgaagggaagcgctgcgctgccgtgaatggtaaggcgctgtttgtttctctctgagtaattttaattctgcacggcggccatgcccatgcatgatgtatagctactgtatgtgctagctagtttgtgtgttttaattatatacatatatagctgttcttatcaagaaaaaaaaaaaaaaaaaaaaaaaaaaaaaaa

SEQ ID NO: 14662 - DNA, 2182 bp, Zea mays
  misc_feature (407)..(407): n is a, c, g, or t
tttcctttggatgtttgaacaaaagtaaggataaaattgtacaaattcttttgggtgttgcaaaagtaatacatctttctttagtgagtgttacaggttctatttttcttttcacttgtttgccaacttgcaaatcataccatgacactatcataacgcttacaatgacatgaacgcacgaaacaggaccagaagatgtgcagatggagatggtgagctacctcggcgagctggtccagaagcaggagatgaccatcaatatagcagggagtgcatcagagatcctcatcaaaatggtgtgcagtggtaatacggcaattcgaaaggcgaccctcgatgtcctggttcagatctcgtcccaccaccccaacgccaagacgcttgtggatgctggtgccgtccctgtnatggtagaggagctcttcatacgaaagattgatgatgagcccatgggctctaagacagaggctgccgcggtgctcgccaacatcgtcgagtctggcttggatccagaggccatcaccgtgaacaaggaaggccacgtcatcacgtccaagtactcggtatacaacttcgctcacatgctcaagtgctccatgcctgacaccctcaacctaagcattgtgcgcgtgctgctcgcgctgaccgctctccccaagcctctcgccacggtggtctcggtcatgaaggagcaagacagtggacagacggtgattgagctgatgggctcgctgacagagtcgcttgtcatcgccgcaatgaggctgcttattgcgttgtccccgcagatggggcacaccattgccgagaagctgtgcaaggccccggggcagccagggaggcttgtcaagagcattggcctgcacgggcggatcatggagcggcacgccatgtcagctactctcctggcgaagctgccgtaccagcacatcgctctgaacctggcgctgatcaaccagggcgcgatggttaccgtgctagccaagatagaggagatgcagcgcggcgagacgcgggcaagccgccatgcgaaggcgtatatggagggcctcgtgggtgtgctggtccggctaacgacgacgctgtatgacccggacgtgctcttggcggccatggatcacaacctcacgtcggtgctcacagatctcgtgcggtccgcaggcagcgacgaggtccagcgtctcgccgcgattggtctcgagaacctcagcagccagtcgcccaacctttcccagcccccaaccgaggagcggcgcccgaagaagaagaacatcctccggcgcctgcgcgaggcgcacgcggggcgggtgcacgacaaccggaggccgccggcgcacagccgggtttgcccggtgcaccgtggggtgtgttccccgtccaccacgttctgcctggtggaggctggcgcggtggagggcctcttgtgcgtcctggagagcagcgagaacgggcgcgtggtggaggccgcgctcggtgcgctgtgcacgctccatggacgacgcggtggacgtgccgagcggcgtggccgtgctcgcggagcacgacgcggcgcggcacgtgcttcgcgcgctgcggcagcaccgtgacgacgggcggagagggggcggcggcgctgccgcaggcgagacggtcactcggaggtgtttctgggcggtggagaggttcctggctcacggcagcgagcggtgcgtgagggaggtcaccagcgatcgggcgctgccgagcctgctggtgggcgccttccacaagggcgacgccgccaccaagcaggtggccgagagcgtgctccggtgcctgcaccgcatgccggattactccgcgacctacgaatccgtcgaactgtaaccaacacatgacgcgcacgactgcgcatgtcttgcctctcttttatcaagcttcgtctcttggttatgtttgtaaaattggtttttgtgtgtaacatgggttgatgtattgtttggtgtagctaaaggaaaatagaaaaggaaaaactgaagatgcagttatgtatgcaagtataaccaaagtttatagcaagggaagatactagtcttttgattcttcttactgtttttttgtgtgtgtgttcagtagttcttttttagggaccgtgttcaattcagtaggttttgacaagggtgcctcctaaaaaaaaaaaaaaaaaaaaaaaactcgaggaggg

SEQ ID NO: 14663 - DNA, 800 bp, Zea mays
  misc_feature (799)..(799): n is a, c, g, or t
gcctcgcgcaatcagcgaccccaggccaaagctccaaagcgaagcagtgtcactgaagcggaaaacgcgtcgccttcaggggtcagctgagagagtgttgatctcacctttgctggtggtctggtcggcggcgatggagcctctggaggtgccataacgatcatattcgacgcgctgctgctggtgttcatggtgaagctcttcttcgccatgttccagatgaagctcgtcgtcatcctcttctacctcgtcatcctcctcttcgccatggccttctccggccgggcgcccagcagcttctagctctcgtagcagctggcagagaactttcttctccgcctcttccgtttcttctcctttggagggtagatcggtggagtcgtgcagcagtagcactacgtcctgtgaaaagagtatcatctcgggttttttttttgttgttgttgaagagtatttttttttctctagaaaaaaaggtgcgcatgaccggaggcgcaaattgcgtaagcgtgaagagagatcgtacgctcaaaacacgtgaactagtcaatcttgagcttcgatctccagcgtttcatacttctatttccatgtaattcgtgacgtcccttgccttttttgttacacgggtcagttgttcggactgctgcagctacaattcaatctaaacaaaacacggtaaaagtagaagttgaaaaaaaaaaaaaaaaatgatggttttgtggatcacacagtagtggtgcatattaaaggagatgaacacatttgttttcttggaaaaaaaaaaaaaaaaagcggnc

SEQ ID NO: 14664 - DNA, 981 bp, Zea mays
catgttacaggaatgacccagagacatcaaagatgttagggactagaatgtggcctcctgagggtgaagtttataaaaccgacattgtagctgttgggcagggaaggcctggatcatgtaattgcctctacccaggatccttcctctgcagacagctccacacaaatgaagcaagagatcagctacgctctgaacttggtcgagtttttacaatgtggcaatttgattctatgggggaggaggtttctaagctgtggagtcgtgatgagcaactaaagttcgacgcacttgagcaattggttcccgttatggatcaaaagacatattgggctgttgtgtcgaaaaattttgcttcaaagcccaggatagatttgataaagtactatctgaatgtgttcctgatgagaagagtgttgtaccagtgcagactcggtcttctggaaattgatagtgacgaagatgacgtggaggaagaagaggatgaagatcaacctgaaggatccagctctcttcagaggactcaagatgcccaagacttgaagaaggtgccatgattctgctgacaacaatctgacatgcttttttgcatgtgccttttgttcaagtttatgctgagacattgcatcaagtgatgcaccattgctccgagtgattgcaagtctaattttttgcagattttttggttgagggttgcattcactttggttcagccatcttttgtggacagaaaactaaaccgagtgttaaatcatccccgcgcgtctatctaggcaagcaaatcaatacttcaacctcaccagatccaaatcattttctgttgtaagggggagggggttaagcaggtcatcatctcatccgcatttggttggcttgtgctcttggcatgacaaaaccttcgagtctgactagtttggttacctatgttcagcggatacatcagaatcttccagatgttatttccattaaatgtgtccagaccgg

SEQ ID NO: 14665 - DNA, 2185 bp, Zea mays
  misc_feature (2179)..(2180): n is a, c, g, or t
cggacgcgtgggcggacgcgtgggcaatcctccttattgttccacacaaacagaaacacacagggtctctgttctgttcatcctcacactgattgagttcttgtggtctctcaaccagcatctgatacccaattcctcgcacaaacctgccacacgcaatgtccaagaccgagagcaggaagctgtcggacgactatgaggttgcggaggtcctcggccgaggcggattctcgatcgtgaggcggggagtgagcaagtcagaggggaaggcggcccaacaggtcgccataaagaccctgcgaaggctgggcccggccaccacgaccggcgggagcacgccgccgcagcaaggctcaaataagggcggcggcctggttccgacgtggaagcaggtgtcgtccatctccgacgcgctgctcaccaacgagatcctcgtgatgcggcggatcgtggaggccgtggcgccgcaccccaacgtcatcgcgctgcacgacgtgtacgaggacgcgcgcggcgtgcacctggtcctggagctctgctcgggcggcgagctgttcgaccggatcgtggggcgcgaccgccactactcggagttcgacgcggcgggcgtcgtccgccagatcgcgcgcgggctgcaggcgctccacggcgcgggcgtcgtgcaccgggacctcaagcccgagaactgcctcttcgccgacaggggcgaggcctccacgctcaaggtcatggatttcggcctcagctccgtcgaggacttcagcgaccccgtcgtcaccctgttcggctcgatcgactacgtctcgccggaggccctctcgaggcaggatgtctcggctgccagcgacatgtggtctgttggggtgattctgtatatcctcttgtccggatgcccgccgttccatgcaccaactaatcgagagaagcagcagaggatactgcagggagagttcagtttccaggaccatacatggaagacaatctcttcatcagccaaagaactgatctccagtcttctctctgttgagccttacaagaggccaacagcaagtgacctgctggggcatccttgggtgataggggactgcgcgaagcaggacctcatggacgcggaggtcgtgacgaagctgcagaggttcaacgccagaaggaagctgcgggcggcggcgatcgccagcgtgctcagcagcaaggtggcgctgcggacgaagcggctgcggaacctgctgggacggcatgacctgagctccgaggagctcgacaacctgcgggctcactttgcacggatatgcgccgacggcgagaacgcgacgctggcggagttcgagcaggtgctgagggcgatgaggctggaggcgctggtcccgctggcgccgcgcgtgttcgacctgttcgacaacaaccgcgacggcacggtggacatgagggagatcctgtgcgggctgtccagtctccgcaactcccgcggcgacgacgcgctccggctctgcttccagatgtacgacgccgaccgctccgggtgcataagcaaggacgagctggcgtcgatgctgcgagcgctgcccgaggagtgccttccgggcgacatcacggagcccgggaagctagacgaggtgttcgacgagatggacgccaacggcgacggcaaggtgagcttcgaggagttcaaggcggccatgcagaaggacagcgccctccaggacgtcgtcctctcgtccctccggccgccgccgccgccatagctagaccgggagagagattccaactcgttcaacttcattcccacgagaacgcaccattgattacagtaccgttcgaatcatttaatcagtctccggcctgtgccgttgtccgatccggccggctagttgttggaaactccggtcgtgggagaacctcgatggatcctgctagatatggctgtgctgttatgtgtttctggatcctgatagattcgatggctgtgttattatgggtggcggccacagatgttttttttacatatggctagtttagaagttacaaaatcgaaaggggttcgagaggctaaaatcacttccttattagtctttgaatggaggagattttagtccctccaattcacttcggtttttgtactcctaaactagcttttaaggtagaaaaataaacgtgtcaagagtgggtaaaaaaaaaaaannaaaaa

SEQ ID NO: 14666 - DNA, 526 bp, Zea mays
agcctccgcaactccccgagcgacgacgcgctccggctttgctttccaaatgtacgaccccgaccgctccgggtgcataagcaaggacgagctggcgtcgatgctgcgagcgctgcccgaggagtgccttccgggcgacatcacggagcccgggaagctggacaaggtgttcgacgaaatggacgccaacggcgacggcaaggtgagcttcgaggagttcaaggcggccatgcaaaaggacagcgccctccaggacgtggtcctctggtccctccggccgccgccgccgccatagctagacggggagagagattccaactcgttcaacttcattcccccgagaacgccccattgattacagtcccgttcgaatcatttaatcagtctccggcatgtgccgttgtccgatccggccggctagctgttggaaactacgggtcgtgggaaagccccgatggatcctgctaaatatggctgtgctgttacctgtttctggatcctgctaccttagaaggctgtgattgtt

SEQ ID NO: 14667 - DNA, 2770 bp, Zea mays
cgacacgcttagaaagataatcttctctgtcaacttttagaaaatcagaatggaaagggatgctagtatagctaggaaagaagaaaaactcgccatagctagatgtgttttggaagataggctctgataccatatgacaatatgaaagttgtggacaacacgatgcctatattggaggtcgctagcagtttatatattgaactaaacttatacacaaatcatatgcaacaaggttacaataataaaaaattctaaacttactaattgtctatgttatacataccaaaaaatttaaacttcacatacttatctgtgctatagatataatataaatctatactattcatggatataatttttttatacaatacaatgtaatctcttcatttgatgtatttggacattactacttcccaatacaatatcaatatagagttatatgattatcatatgttttttcctgtgtggtatctagaagatgatatctgacacaaattaaccatatgatcaaggtgtttctagattaaggctctatgtttatatagaagggtctaataacattgataattatacatcatggtgtttcttatttttatttagtttcaaagagtgttttttggtatactgatattatctggattttttcacagggtttctaaatatatacaatgatgcataatggattaaattaactgcggagactacgaagaactaattaatcaagagagtattgagatttagtaataattgctaaataggacttaatcttaaaggatgtctttttattttcttaaacttataagtgtatataaatgattcgtatcttaagggatatttaatgaggtaagtgaaaaaaaagcttaagagacgcggtgaagaaacatctttaagtttaaaatacggttccatccatacaacccacgtaaatgagctgtgttgaggggttctagtgaataagataaaatatttagatacattaaattgtatgaacgtgtttattaaatatatctagtgtttagagaatcgtaatatattatttaggttgtactaaataaattatatagagaattattcgtacgagatgatgtctggtaacgttcccgtcgtgctcgtcgcccaggtatatatataaatagagaccccttttaatttatgctagtttggagatcaagataagagacccgcactgctttaccatgagaagaagaatagtcacacatgcaggtaactgtcaccatctgataacacatctaacggctcagattatgccgttgtttcactataggcaaaggatcggaatcttgaaatcgcggctcttgttcctggatcgtacggcgcagaggcgcccttcgctgggaagcttccaacgattccacgggcccacatcaactccttccaatgaagaatggtgagccggtgggatccaccttagccgatggtacaggtgggcaaacagtgggcccagttgcctacgctcacgtcagcatctacccctcttttccgccgtcctgtgccccattgggtaccccggggccggccgggatcgatccctaccgaataatattctgcagtagtttctcgagctcctgtagcaagaaagaaaccatgtcgggggtatgggtgttcgaggacgggatcgtgcggcgtgcggacagcgacccgcccagcggcgccggcgccggcgggtcccggccgaacaaggtgctggtgcacgttcccagcggggaggtggtgacgtcgtatgacgtgctggagcggcggctacgcgagctcggctgggagcgctacctctacgacccctgtctgctccagttccaccagcgctccaccgtgcacctcatcaccgtaccccgtgacttctcccgcctcaagctggtccacatgtacgacgtcgtcgtcaagacccgaaacgtcttcgaggtccgtgacgccgcccctgcctgatggtcttcgtggcgacgcaagctgctgctgtgtgcctattagcttcgtgcaagctcgtcggaccggctggtactggagccctatcgccgccgtatcaacatacgtgcgcatgtattgtatgtttgtgattggtactgatcgagtacttacgtgtgatttgcatggcgcagcgcgttcgtgtggctgcttcttgcatgctgtcctactttgtctgccgccgaataaatgtacgcgagagcgccgccgccgtcgccgtcgccgtatgcttcttatatatccggattttgagggtgtgttctttgactctttagtattcctcactttctagaataccaaatgggttgaggatttctaggaactaatatttagttcctagagtttagacacgggtgactaaagaaatcaaacgttccatattgcttctctctctatataaatacattgatttttaagcccagtcatggtttataatatctaatttttagtattcaactttgtcaaaaaaagttcaattgtataaccttgattgttacccttttttccgttatcacacacacatacacagatacccggtagtagaaatggatctctctctctctctctctatatagtgtgtagcgtgtgtgtgaattttttacttatacggtagttattttcatatttatatatctttagatttagaatgtgtatggtttgacaaactgtatgtgcatagagtatatattatcgtattatattaagtatgattatacttattttataggctactataattatatgttacaaaaatatatattatatatatatggcaaattgcagaacggta

SEQ ID NO: 14668 - DNA, 1543 bp, Zea mays
gcatggtctaatgttttcaccaattaatgctattctggcttcatcatcatggggcaaaactgttcgcctcgaggccggccggggatgtctttgagagcaagggtgcagtggaaacttttcagcactcacacgatgttcttactttagcttatcgacctgatggaaggcagatagcatgcagtactttagatggcctaattcatttctgggatccatctgatggtttgttgatgtataccattgagggacgcagggatattgctgggggtcgcctcatgacagataggagatctgcagctaatacaagtataggaaagtacttcacaacattgtgctattctgctgatggaagttctattttagctggaggaaacaccaaatatatttgcatgtatgatgttggagaacaggtgctgttgcgtaggttccagatcactcgcaatctctcattggatggagttcttgattttctgaactcaaagaagatgacagatggtggtgcactagatcttattgacgatgaagacagtgatgttgaagaaggaattgatcgacatactagaggaaacttagggcttggtttacctggatcaatggcaaatcgtggaagacccatggctcggacaaaatgtgttaagtttgctccaactggaagatcgtttgctgcagcgaccactgatggtgttttattgtactcagttgatgaatcatttatttttgatccaacggacctcgacatcgacgttacgcctgagaaagtagaggaagctcttgcagaaaaccaacaacaaagagcccttatacttagccttcggttaaatgaggatttattgattaagaagtgcatattcgcagttgatccagccgatgtgagagcaatttgttcggcaattccttacaagtatctccaaagattgattgatactttcgctagtctcttggaaagttgtccccatctggaatttatcctcctgtggtctcaggagctatgtaaggttcatggccactatattcaacagaactccagaactttgcttccttctctgaaatcattgcagaagtctataacaagactacatcaggatttggcagatacttgctcttctaatgagtacttgttgaaatatctttgcactgctggtacgaagaattaggttgtgctggaaaatatctttgcaccgatctccctgacgatttctataggaggttgttgtgcttgcaaacccagacgcatgcgagctctgagcagttctgctttggacctctagggggattggcatccgggcttaatcctctgggcagtggctgttgtgttcagaactactgagctgaagcaacaatgtaacatgatcgatcctctggagaaagttgagctgtctggttttgtcagtgaaacgagagaaaaaaaatgtcgggaacgattaaagttatgtaacttaccgtgttatcaaatgtttggaccagaactggaaattgatatttgtcatgaatcaaatagaagaaacatgttatattcaaaaaaaaaaaaaaaaactccggccct

SEQ ID NO: 14669 - DNA, 2674 bp, Zea mays
gttgatgttgaatggtttttacccaatcgaattttataaaagctgactgaaaagctgagcgtttggcagtccacaacagcttttggtggccagaagctccaaaaagctgaaacaaatagggacatcttctgcccgagggaagacggcctcaccaccaagcagaggctcagcctccagattatccagtggtgggcagattggcaggcagccactgttgctgctcacatgcacagtgagcggtgcctccatggccccatctgcgttgctcggtcccggtagctcctgtttatggagcacacgaaatcccctgtcgcggctgccggcgtcggcatcctcatttccatctgcaagcagctccaagccgaaatgactttttcggcgtcgcccaccctcgccatctcaccccctgcggccctcgtggcgatcgtatccgtccgaatatgccttgctttggcgccccaccccgcacgagacccccacccccaccttccccgccattcgatctctcgttcgacctcgtctctcttccccttctgctttgccttttccccttcctctctcccctgtcccccctccgtcccagccgagcgagaaagcgaaggggccaaaaaagccgcaccggcttccttcccccacccgaagagatggaactgttctacgaactgctcctcacggcggcggtcaccctcctcgctgccctcctgctcgccacgctcttcgcagccaatgattcccatcgccggaccgatcgcgccgcagccgcgatcgccgaggaggtggcggaggaggagaggatcatcgaggtcgacgaggtgatgcgtagcgaagggatggcggcggtggcgccgtcggaggcggatgggtgggttgaggcggagaaggcgccggcggtggtcgtcgcggaggtgaaggagccggagagcttgcccgaggaggagggggttcccgtgaaggctgttcgggaggtgcgccttgctgcggaagtggaggagggggaggacggtggtggcggcgtgaagcggcctgatttgacctccgcaactgttgtggcggcggtgggtgctgaagcgagccagctggtgtcgggcgctgaggttgtgcctaaggaggtttctggtgcggcagggttggaggaacgaaccgtgcaggatgttgtggtgaaccagtatgatctgggtgctgaggttgctcttgttcccgttgaagttctcgaagcaggaccggacaagcagggagtagaagttgttggagttgcgcaagtgcctcccttggaaacagaagctgctgaagtgaaacagcaccatctcgttgccgaagcggctcctgctgaagatgttcttgacgtgggattagtggacaagagtgtacgagctatcgaagtgaggcccaacgaattggattccgagactgttcttgaagagattcttgatgcggtattggaggaggaggagcaagtagagcatgaattgcctgctggggctgctccacaaccagttctcgatgtgccattggcagggaagggagagcttaaacatcatcagcccgttgaagaagctgccgaggtacacgaggatgtgcagtgcaagcaggaagctgagtgtgaggcccatacagttgatcaacaacaagaactggttcctgaagaggagtcggtcgcaggaaaaaatgatgatgtgaatgttatccatgaatgtagcttcagtgatgaagtggttaccgaattgcctgtgggggcagtgacatcgcaagggctgccgaaggatgaccctgaggcagacatggagtttgaggagtgggaagggatcgagaggagtgaagtggagaagaggtttggtgcggctgcagcatttgctgctagtggggctggggcggctgccctgtcaaagctcgatagtgatgtgcagctgcagcttcaaggtctcctcaaggttgccattgacggtccctgttatgactcagcgcagccacttacactgagaccctcatctcgtgcaaaatggtctgcttggcagaagttagggaatatgaaccctgagattgctatggagaaatacatgaatcttttatcagaaacaattccagggtggatgatgaatgaaaccttgtgtatgcatgttgtactctaggacacagagaacactggcagtttacctgcggagactatcttaacaacgatggcttctacaagtgatcaacggagcaatcaagggaatgaagataattctagcataggtgaaggtcatccaataacttcccctaacccagagaaaggccagagctctgatatcccaactgaatgaaggcaacactgataaaacatttcttgcatcagtggttccagcccattgctgggagcattatcgatgcgttcgtcataaaattagatttgtacagttgtggcggttgtgctgtgatgatgttggttcgtgtatgtatatgactgtatatatatgtttgtgctaatactactgctgcggcctgtatatttggccagttgacgacttgtcaccggttgtggtcagtagtaaatgatgagtggtaactgtgtttgttaccacgtagtttggaacgaagaacttgagcggttcaggtaaaagacttgtcgcattacaaattgttgaacttatccgatgtagggttgcattgcatagttggactgctatgctttcgagag

SEQ ID NO: 14670 - DNA, 1441 bp, Zea mays
cattgggtacctcgccgccggccggaaaaactagcgcttactgttttgcacggccatagtctcgatccccaccgagtccagcaaacagcaccaccccaccctcttcgcggctccggcagccgcgccaccatggcttctcctgcgggggctaacagcggggcctcctcctcgagagggacacccttgcctttgcccttccccttccccgctgcggcgcacttcccctcccgcggcgccggtcccttcctgtcgcagcactatcacccgccctccacctccgacggcgacgatgaggtcgaagaagacgagggaagcatggacgacggcagcgccgaagaggatgatgccgagctgtccgacggaggggctctcggctcgccgcggcgacgcgccttctccgctccaggtattggacgtatggagataaatgggggaaatggagtgaggtcaatccaagaggggcagcaatggcatttatgtaaccatggaatcgagattgggcgtccatcaccaggaggggatgaacctggtaccatccccagagatgtgagagtggagaatgggcatggagttgttggaagaagagacgggggtcctgcatccagctattgggacctgttgagagcacacctctctgatcctttaacaggtgttctcatggatgatgcattgattttatcatgtggccattcatatggaagtagtggaatgcaacatgtctacagaatgaaagcttgtggtaagtgtggcatgccaattactgaggccgccattcgaccaaacttggctcttcgccttgcagttcaggcattcaaacgtgaagaagactcagcaaagtcattgaaaagaagaagagagcgccttgaactgaggtaaaggtgtgcagtttcctttttctgtcttcgacagggtcataatcaagggaaacaagaggaccccggaacggtttgtgggacgtcaagcagttgtgacagcgcagtgcttaaatggatggtatgttgtgaagacttcagacaacgcagagagtgtgaagctgcaataccgttccttggcaaaggttgctgatggcaatgggccttctggtcttgtcccaagcaatgtccaaagtacaagctggctataggctacaacagtaccggtagtaggccccaagcccctcttcaacttcacgcatttgctgaggttctgcgatgacgtgagcatgccaaattcagattaggcttgctttgcctttgtcccctctttttgtatcctggggacgcggatcttgtgagtatggccaaagaaatgtttactactttagcagtgttggaaacgcgtgacatcactggttacgagtagttttagccgtctccaaaaaaaaaaaaaaaacggtagtggcagcaatctggtacacataaaagtttagtgcacatgatttatatattaaattatcactatc

SEQ ID NO: 14671 - DNA, 1095 bp, Zea mays
  misc_feature (1035)..(1035): n is a, c, g, or t
agctacctgcatgacaaacaagtagggccaatcccttctggaagactggatcggccgaactgccacagtagactgaacactggcacacagcgccctcggatctgccgctctcgtctcgctcgctcgcgtgcattggccgacagggacgacacgccggcgtggctgctcacgtgttctcagttcttaccctgcgctctcgccgcccggggcaactggcgagcgagtgtggctgccgcttcctctccgagtcaggcgccatttaataattcaattcgacccccaagcccacgcttccgaattcaccgactcctccacgccgcgtcgagatcgctcaggccttcgcttccagcaactccaccactcagcccacccgccggagcaatgagcagcacggggcgcgagccggaggttacccgcgccgacttccccgatggcttcgtcttcggcgtcgccacctccgcgtaccagattgagggagcgagaagggagggaggcaaaggagacagcatatgggatgtatttacagatgacaaagaacatgtcttagacagaagcaatggagaaattgcagttgatcactaccatcgatacaaggaagacattgagctcatggcaagtctaggttttagcgcatacagattttctatatcttgggcgcgtatatttcctgatggcttggggggaaaggtcaatgatcaaggagtcgccttctataatgacctcatcaactttatgatttcgaaaggtattgagccttacgcaactctatatcattgggatcttccaaacaatcttcagaagactctggggggctggatttctgacaagattgtggagtactttgcattgtatgcagaagcttgctttgcaaattttggagacagagtaaagcattggataacaatcaatgaacctctccaaactgcaatcaatggttatggggattggaatttttgcacctggaggatgccaaggtgaaactgctagatgttacttggctgcccatcaccaaatcttggctcatgctgctgctgntgatgtttatagaagaaaattcaggctgcacaaggtgtgaagttagggttggttgttgat

SEQ ID NO: 14672 - DNA, 1785 bp, Zea mays
atagtcattttagcttgtgcacgctttgctgctctaaggtttaccgggcaaacactggacgacaggtgaacggggatgcacagttaggagattgagggagcgagaagggagggaggcaaaggagacagcatatgggatgtatttacagatgacaaagaacatgtcttagacagaagcaatggagaaattgcagttgatcactaccatcgatacaaggaagacattgagctcatggcaagtctaggttttagcgcatacagattttctatatcttgggcgcgtatatttcctgatggcttggggggaaaggtcaatgatcaaggagtcgccttctataatgacctcatcaactttatgatttcgaaaggtattgagccttacgcaactctatatcattgggatcttccaaacaatcttcagaagactctggggggctggatttctgacaagattgtggagtactttgcattgtatgcagaagcttgctttgcaaattttggagacagagtaaagcattggataacaatcaatgaacctctccaaactgcaatcaatggttatgggattggaatttttgcacctggaggatgccaaggtgaaactgctagatgttacttggctgcccatcaccaaatcttggctcatgctgctgctgttgatgtttatagaagaaaattcaaggctgcacaaggtggtgaagtagggttggttgttgattgtgaatgggcagagccattttctgaaaatgtggaagaccaaattgctgcacagcggaggcttgactttcaacttggatggtacctagatccaatatattttggtgattacccagaaagcatgcgtcagcgactgggcagtgatcttccaaccttttcagagaaagataaagagttcatgaggaacaaaattgattttgttggagtaaatcattatacttcaagactcattgctcatctccaaaatccaaatgatgtttatttctaccaagtgcaacaaatggagcgaatagaaaaatggaatagtggtgaaaaaattggtgaaagggctgcatctgaatggcttttcatagttccttggggccttcataagtcacttaattatatagcgaagaagtacaataatccagcaatttatgttactgagaatggcatggatgaagaggacgatcaatccgcaacgcttgaccaggtcctaaacgacacgacgagggtcggttacttcaaagggtacctcaattcagttgcgcaagcgatcaaggacggagctgatgtccgcgggtactttgcgtggtcgttcctggacaacttcgagtgggcaatgggctacaccaagaggttcggcatagtctacgtggactacaagaacgggctgtccaggcacccgaaagcatcggcgctgtggttctcgcgcttgctcaagggcgaggctggcactggcacaagctgagcgaactgcacgcagcatgcaagcacagaacgtcgtcgttattacaatataaatattccacacaactagacgttttctcctgttgttgtatcgtactactgtacagtaagcgccaataagctagcctcagatgtgtgctgcctgcctatacctctagtgactgccattgatccagcactagctgaaatgtacccggcctccaagaatcagcaccagaatatatgctttgaattgaactcaaaaaaaaaaaaaaaaccgggggcggcacggcactctggttacagatagcaccaataactgttgtactattcacctgcaggtaggtaaggttgtgctgtc

SEQ ID NO: 14673 - DNA, 2333 bp, Zea mays
gagggaatataaatggacatatttacgcctccgtaaattttattgattttctaagcttattagtgcattattaatttttttttcaaaaaatcatcaaaatgcacacatgtatttgaaaaagatatccggatatctatccggatatccgagaagatatccggatattccgacatatatcagtcatcctatattcgtatctgatatccaaactatattactcgattccaaatccaaaaatacaaatatactgtggatattcaaaaagcctatacatccgaataattaacctcttcgaacgatcagatactcaaataatatcctatcggtaccgttcacggcgttcctgtggctgcaccgcgctggcggcgatgtgtaatgtatttgtgggccaggctggttatggatcaaacaataggcccactagaagataggcaggcccatccactaccaatccatgaggagtggagtctagagatagagagccccaggatcgctgctctggggtgcaggcgtggtcgcgtgtagtcagctcgccttgcccgctctaatcggtcaccactgacctccgcccatggcgaccatgtctgcagccctcgccatctccttaccgtcgctaactcgcgttgccgtcgcaagtacgccctctgcttcctcgcgcatcaagagagccacacaattcaggtgctgcgcggattcttcttcccaggagcaggagacctccggcgcccctcccgccccgccgctggacaaatctgcaagatcgcccccttcctctctgctgggcatttccacgagcacctggtctgcgggtgtcgctgggctggggttcctggagactggttacctcacttacctcaagctcacgggctccgaggcgttctgccccatcactggcgcaggctgtggcgacgtcctcgacagcgactactccgtcgtctttgggatacctcttcccatagttggtctggtggcatatggtttagttaccgcactttctctgcaaaaaaatggaaaggacttgctccaaggatcagatgacctggatgttagattgatattgcttctggttgctacttctatggcgactgcgagtgtttattttctttatattctaagcactaaatttattggggtgtcatgttcgtactgtttgctctcagcatttctctcattcactctactcttcatcagagtaaaggacatcggttttgaacgtatccagaagttcgctggcgttcagttagctgtagctgtcattatagctcttgctttgacaaactcatatagttctgctactactcaattgaaaggcacagatgatttcgtattagagccgtatgaaacagagatatcaaccgaatcatccccatttgccattgcattggctaaacatttgcactctataggtgctaagatgtatggagcattctggtgttctcattgcaatgaacaaaaacaggtacacactctttcaccttatcctaaccgaatacagaacgatttcacagttgtagaacattattctgttgcgagggattgtagtcttgtagatgccgaacttgcttggagaactctattatagtgctagtgatataacaataatacggtatgaacttatttgttgatgctgcactggccaaaattccaaaatgaaagagtataaatatgaccaaaaagtctttccaatccaaccaaatgttcatgcagatgtttggtcatgaagctacaaaaattctggattatgtggaatgtttcccaaatggagctggtaagggaaagaaaatgaccgctgaatgtgctgctgctggtcttgaaggttttccaacatggttcatcaacggaaagattctgagcggtgaccaagagcttgaagttctggctgaagcatcaggcttcgttggtgagggcacagaacaacccaagggaatatcgcagaattgatattaaatcattctgaactgaagctggcaggttcctgaaccaataatctggatgcagtctttagatagcaataccccaaaatgttcactagcacagttgcatccgaaggttgcttaccctacttacaactaaccactataatttgtagcgactgtacatgctctacgagaagagagaacaaaccccaaggcagcgtgttgtataaccatttgtagatctagtttgtactgtaaatgtgtaatcctacgaaaacgctcttgttcataggctcgtatactatgtattgctgtttaatgatataaaaaaactctggtgggtccctatacccgcttatgtcaaaaaaaaaaaaaaaaaaccggccaaaaaaaaaacctcgagggggggcccggtac

SEQ ID NO: 14674 - DNA, 907 bp, Zea mays
  misc_feature (895)..(895): n is a, c, g, or t
  misc_feature (900)..(900): n is a, c, g, or t
ttttttttttttttttttttttagttgcactctgtttgaatgtcttaatctaattttagcaatcagctctagtacatttaaacaactcttaattacttctttttgcgccatagagttgtcttttacgccgcggatgcctctccctgctctgttctagtgttcttccttttgtccgaatagtcaaagctcaaaccaagcaatagcagtccttgctcctccaacttccctcctggcttctgcccctttgtctgcgctcctcacgccgccccccgccccagcctcacacccgcattccccagatctccatggactcgacccctcccacggacccggcggcctcctgcttggcctccgcctctgcggcggtggcatcgggggacgtcgccgcgatgctgccggactcgccgccgcggcgtggggcgggccaccgccgcgcacagtcggagatcctcctcggcggcgccgcgctccccgacgacctcaccttcgacgcggacctcggcgttgtcggggaggcctgcgtggccggcgacgaggatgaggaggatgacgacgacgacgaggaaggggtcggcggcgctggcggcagccggatgttcgagatgttcctcgagaacggtggcaagctcccaggaccgccggagccgtcggcgcatccgcattcgacgccgccgcggccacggcaccatcacagcatgtctatggatgggtccacgtctttgtttggttccgccgccgccgggacgcctgggaggtcgggcgctgatgccaagaaggctatttccgacgctaagctcgccgagctcgcgcttgttgaccccaaacgtgccaagaggtgagaatttaacaacctgtggaggagagcttacccttgttgtatttgccccgggggatnccggnaccggta

SEQ ID NO: 14675 - DNA, 5244 bp, Zea mays
  misc_feature (1522)..(1522): n is a, c, g, or t
cacagaatctggatgcctccttccaagtatgccctctgatgcatctttcgacagcacttctgggattagcttcacatgcgatctgaatgacaacatcgcagccccatggccatcttccatgcaagcaccatcttcatcgtgcaacaagtgtatgctctctacttgctgtgctgaacatactttactatttaacaattctgtttacatgtgcatcgacttcttcaggttttatcttaaacgccactattttggtacataaatctgtacacttaaaaaccatgaagttaaaatttaagccttctgttgtattccactagattatttcccccatcatttatgctgaaactgtttctgatgatgcctgaatgtatgattctgttgcagaagcaggtttagtgattcaatatgcacctttctttctgcttgtggtggttatacttataccccatgtttgtttcactgtttgctgaatttcttgtcttctctcttgtcttaagggcagtttttaatgtacctcaactagtcgttagataactagtctaatgaatttcactgattgcaaaaatttcttgtatcctccaactcttccatcttgaatttaaagcactgttgttgtgtagcctagctgcgcaggcaagtacttgtgatatattaattgcttaaatataaggctttccagctatatatcgtgtcatggatctcttggatgtgtgatgtgtctgctgtttttttccccatgttatgttgtctgatgtaacttttggttcttgtgtatgcagctgtcaatatcccagagcgacctgctgcgacatcggcacaaagtggtgagaagatataggagtatatgtctaatgctttgatctgtggtgtatatttctaatgctcaaggacaagatgaaacttccctgtttgcaagttacaagaagatctgagagttcctttttgcaggtgtgaaccacaagaacctaaagctaagactgcttgcctctttggtctcccttcttctggtgctcttggtacaagtttagcaaggtccagttgccctattatcgcgatgattcgttcaggagagctaactggaagtcagtgaagcgctgagttttttgcgatctcgcggtcgcatcgaagtgtagtaggtttcacgtgtattttattttattttattttttgaatctcctggtagcaattagtgtagtttgttgtaaggaatatatgtataatataatgatagtagtaacttatattcatttgtatagcgagaaagaacgtctggtggacggattccagcattgtttaacacaatgtttattgtttactaattgatgtgtttgatgtcggatagacggatcatttggtgctgttcaacattacataccgtctagttttctttagcttggtgtctgctgctcatggcacaagatggttatgcttgattcctgtactgaacggtgctacgttgctctgaataattggttacttaatttttttcaggctggtctatctgacacgtcttatcatatanaaaagcagtaaattaatggaactaagtggtgtttggaagcaaatatcagatatttgaatggactattaaatattaaatataatcgtgcttgctgttgatattcagacgtacacaaacttgtttaaaataccatgtactatttgtggtttcagatactagtagtactattagtttagtttaatcagcatcgacatttccatgtgatgtgacgcgatgcgatgttatgtagccctcaaggccaacatcaaactcatttggatccgtctagttgtgtctatctattcccacttgatcctactgcactagagtaaattttattttctaactcattgcagaaatgccatccgtattttctttttcagatcactttggttgacagtactagagcctgattggattttgttcgtgcgaatatctggcgggctggctggctggctacataagcagtgcaggacagaagaatgcgtccgacgttggtggtttggtacgtctgtcatcctttttcttttgccttttttttttaaaaaaaaatgctgtttcaaggtttttcagctacacattccacctttctctggtttatgtattgtagaaaatatttaaaacactctgtataagcttaaacaacaaaaaacttgaattgcatattcagtgcatcccaatgcaaagtcactcctttacggcccctcacatccatcgtctagagacccacgaaaacagatcgaaatttgtaatttggagtgcgtttgcatccgggcagattttttttccaatttggagagaggtgaatggacaagcatagcattgcatagaagagaaaggggcagtagtgctgctgaccgtgaccaccggagcggagaatgaacgaatctatctgctcctatcaagtacacaacacaagtagacagactatagaataggatgaatagttcttctcccctgcgcgatggcgatggcttcctcgtgatgcggcgctcggtctcacgccacacatgacaagtcacatgcgcatgcaaaccaaccacatcacctccctctcctctccacgagagggatgagatgagaacatgatcattccatgaccccctcctccgccaccgctcgccgccggacctcccagaggaggcgtccctgcaatgccgcctctgcctccgccagggccctcgccgccggcctctggaggctgcgccacgccgagcggatgatggcggccggggcctcgccgccgcccgccgcccaaacgaaaccggtaatgaatgtgctgcgatcctgccttccttccttgtgcttcaccccgccattcccattctccctgatttgatctgtgttcttgccctctgtttcttttgggtggaaaaacaaattcacaagaggccacggattggattgttttgttaccgcaactttgaaactaatattgacgtattctgatttctggtcaaaagccgattatttttttttactgaacaatcatcccatcccaaagatgttttttttcttctctctttcttatataactcctaactcctaagtgattctggggattggatcattaggtatgcatccaggattcgagatctgataaatgggaagaagaaaaaaagattgctgcagatgactgactccatttcaagaagagcactctgtatccatgataattgataacccaacatgtatacataatgggacgaacggagatgacatctttatgtggatcgatctgtttctgtagatgaagactgatctattttgtctgtcccgcagcaaaagctcatgggacggagccggacgaggccaagccaccacctctgccgttgccgatgtactagcagcagcactaggaatggcatcctagacaaggtaaaatcgacacctcccagtctgggcagccgtcctcattccctttctcaacaattccgcatggactgcagatcgacgcgtgcttggacggctcctcgtccatggagaaggccaccaaatgggatgccaaccactcgcatctgaggggaagaagagcacggggactccgattggacaacatcttcttcgcctcgccatcagcaatgtcttcccctctgctgctgctcatggaggcggagctggagaaggcgcgaggcgaagccagggagctggaggaggagcggcgccttatgaccaagcgcctggaccgcttcctgcggaggctggccgaggagaaggcggcgtggaagtcccgggtccgggacaaggcccgccacgccgtggccgccctccaggacgagctaggcgcagagcggaggcaccggaggcagctggagcaggccaacgccaggcttctgcgcgacctggcggaggcgcgggcggcggccaagcagcaggcgcagagctacgagatggagcgcaaggcgcgggagctgatggaggacgcctgctccgagctcacgcgggaggtggaggaggaccaggccgaggtggagctgctccgcggggagtgcctgcgcatgcgggaggagatggaggaggagcgccgcatgctgcagatggccgaggtgtggcgggaggagcgcgtgcagatgaagctgtccgacgccaagctcgcgctcgagaacaagtacacgcacctcaaccgcttgcaggcggagatggaggccttcctccgcaacaagggcgacgagtcagcctcccactccgccgtgctgcgggaggcgcgcctcataagcgacgccgctgcagccacaagctcggaccacttccgccgcaaggaaagcgaaaggcaacatgctgccgctgcggaaagggaaagggacggcgacgggcgcaggaacagcaggcccgcgagccccgcgtcgtccaaatccagcgacatgctgcagtccgtcagccccgcgaccgacctcttcttggccaaggccgacggcggcgacggcgacgacgacgacgacgacgacatgttcgccgacggtggcagctcggccgacctggaaatggcttcctgcagcggggtcggcaccaccgaccgctcagcttcggtggccaacggcaacggcggggtgacgacggaggctcgttcgtcaggcgcgagccggcgttcaaccaagaacaccgcgctcatacgcaggctctggaggtccgccatcaccgagagcaggaagaagaccgggaggacagctgccgactggtcgccgtcttattcggacaggaggatgtcgagcgtgaccgcggaagggccgccgccgccgcttcctcctccagccgtcgcaggcgagcagtgcagctcgtcaggcggctctggattgccacagcgggtagggggagggggaggcaggctgaagcagagcctcaaggagaagctgatggaggcgaggatggacgatcagaagcccctcccctccgtgtgcaaaaaccttgatgacgagcaacactaccaaaattcatcagatcacaaattctgaatatatggtattgatagattaataggcatatataaataccaccataacatccatgtactactccctgtattatattatattatattgtattatattgcactcctacataacatactagtcttgatgtccaatgtacattgttcacatcagatatacagatcatgacgctaacagtgccagaggcctctaactcatttaacatttggttttctgccttaacgacctaaaccaatgccatctacttattcgttcaaaaaatgtatcgaaagtctagccgttttctttttatttagc

SEQ ID NO: 14676 - DNA, 1890 bp, Zea mays
cattgggtaaaaacgatttcgcggtgctcgtgcttcgctgcccactttctccacttcctcctcctcgcgagctcagctcgcgcaccgccgcagacagcgccgccgccctctcctcctccccttccgctttgccgccacccactgctgccggccgccgcaggcaccccatggccccgaccgggcggctcctcgcggtagccgccctctccttcctatgtctgcaggggccgtggggagattcaggcagcgcatttgctcagagccagccgccgcttcaccggaccgttggcgcagaggcaaatgacggcggcggcctcatgccggagctcccgcccagcggcctcatgcccatgccggagctctcacccagcggctctcccacgccatttgtccccttcctggcgcccgctccgctcgcgccattctttaacaacagcacgccaaagctctcaggaaaatgcacgctgaactttaccgctgtcgacaaactcatgaccaccacggctgtcgactgcttcacctcgtttgctcctttcctggccaatgtcatctgctgcccgcagcttcaggcaacactgaccatcctcatagggcagtctagcaagcagacagggtctctcgcattggatcccacggtggccaactactgcctgtccgatgtccaggagctgttgctgagccaaggcgccagcgacaacctccacagcctctgctcggttcacctctctaatgtaaccgagggatcctgccctgttagcactgtcgatgcgtttgagagcgccgttgattcgtccaagcttcttgaagcctgtcgcaagattgactctgttaatgagtgctgcagccagacatgtcagaatgcgataaatgaagctgcccagaaaatctcgtccaaggatgcaggtttgacgagctacaccgggagtcccaagactgacagctgtaggaatgttgttctgagatggttgtcaagcaggcttgacccacggtccgcgaaggaaatgctgaggcagatttccaactgcaatgtcaatggagtttgtcctctaagctttccagacacaagtaaggtggcaaaagagtgtggtggaacaatgacgaacagtactgcatgttgcaaggcaatgttaacttatgtagcccatttgcaaaagcaaagcttcataacaaacttgcaagctttaaattgtgcctctttccttggggcaaagttgcaaaagatgaatgtcagcatgaatgtctatagctcttgtcaaataacattaaaagatttttcactgcaagttggatctcaagaatctggatgcctccttccaagtatgccctctgatgcatctttcgacagcacttctgggattagcttcacatgcgatctgaatgacaacatcgcagccccatggccatcttccatgcaagcaccatcttcatcgtgcaacaagtctgtcaatatcccagagcgacctgctgcgacatcggcacaaagtggtgtgaaccacaagaacctaaagctaagactgcttgcctctttggtctcccttcttctggtgctcttggtacaagtttagcaaggtccagttgccctattatcgcgatgattcgttcaggagagctaactggaagtcagtgaagcgctgagttttttgcgatctcgcggtcgcatcgaagtgtagtaggtttcacgtgtattttattttattttattttttgaatctcctggtagcaattagtgtagtttgttgtaaggaatatatgtataatataatgatagtagtaacttatattcatttgtatagcgagaaagaacgtcggtgtttctaaatgtgcatgagggaatgctgttgtctggtggacggattccagcattgtttaacgcaaaaaaaaaaaaaaaaa

SEQ ID NO: 14677 - DNA, 4371 bp, Zea mays
ggcagacgttaaatatttgagaacggaagtaataacaaatgactatttattatttaattatcatatatatacatatattctatttattcacattataattatagttgtatatgtgttagccctctctaaagtaaaatcctggctatgtcactgcacataaataatgagagatacgaattgatgacttggacacttggtgcagcagagaggtacattgacctgtagtctggtgcagtacgtgtgtgaatatgctctccgtcctatttttcgtactcctaggtatcgtttccttgagatctggatggttttcagctgttgatgcgtgctggcctgccgcatgctgcatgcttctctaggttcacatgtagtacggactgtacactcgtgtgctgtctcagcgtctgcagcattgtgcctgtacatcactgttttgcttagggacactgcactatatgagacgaacattggcgagaggcttttactccctttgggtgattctatcccaattgttgcacacaagaaccactatgggagggtcagcttcccaggttaggggagcttaaagcttaaaaaaacggaaggaaagacatgtaactgaacaaacgatcgatcatttatagaactatctattgagaatataatttctactacagagattaaataatataaaaactaactgtaatttatagcattgagacagactttagaacctatataaataaacatgaataattcggagcaaaaataaggttctctttttcaagaagaaaatttttttattaagatcgctggaaacaggtcacaaaaggaagagccagtgtgcgcgccgactcttggggcctgattctcggcgcaaaatttcagaggtggctcaaagcacacatcggaaatgccgcgagcggccggcgagccccgcccgatccgaggctgattttgagatcgccgcaccactggcactcgattcgtctcgtgcgaggagctcaaaaaaaagtctcgcggatccagttccagtctctccctcccctccctcgcacgcagaagatgctgcggcattgcttgccgcgcgcgcgcagtacagagtgcaaagtcagtagtactagtagtgtacagcctgtgcccggtgctccacgctcgcgatcgcatctcaggcgtgcgcggagcaccgacatcgaggcagctgccgggggaccgggcctgggccccatctggcgacatgctgccacgcgtcacgtcctccagagggcccacaagtccagtgggaccccgacacgaatcatcaatcagcagaatactactagtcatcttgcgttctcgcaatctcgctcaccgacaactatttgttttttaaaaaatcctgctctacacggtgacagagttagagagcttgtagttgtagacggcggaataaaatcctgcgagcaatttcagccaagtgggcgtcacatgcatgccgtcattgtgcttccgaaaatcgggcggtggccggcggcggcgtatttattcaaaatactccgatcacgaacctagtagtagtcgggttaagacactggcagctcaggggacaccaccacaggctaaaactagtactagtactagcagcaacagcagctcaaaataaaaataaaaatgagggtcgtggtgcactgtggtcacaagacgaggggccacacgaattttaatggacgcatacacatcatggaccctccactgactatgttaatcccaatctgttttgagcttttgctttaagatgatttcgatagccaatgcagcactaaatcaccaaaaaagaacgcagcggtagttctttcaaatccctcccgtatccgtccacatatatggagtgaattttgccaacgcaccatcgtcgattactttcacgcggtggcatgggattttacaggtcgcctaaacctctcgccgtcacaaagtagtacgtagctgtgaactttggaaagattacacggatattttaactcacttcggtcacttttgctgttctgtttgacgcgttcagatgagctcccaacacacgctttgctcagtcagccgtagccccgcaagcctcgcctctgacccacctttgacaccgaacgcgttctggcttctcagtctatcactccacccgtatatataacagacacggtacacccacgcgtccgccgacccaaccacgcgaacaagaacaaccaagatgacgcgctctcctctggctctcgccctactgctcctctgcgccgccggcgccgcggcggccgtgccgcggtaccgcgaggcgccgcacttcaccaactcggcggcggcgcagtgcccgccgccgctgcagccgtcggacgcggacgcggcgtgctcgccgcacgcggcggtgcacgtcgccatgacgctggacgcgtcgtacctgcgcggcaccatggcggccgtgctctccgtgctgcgccacgcgtcgtgcccggagtccatccacttccacttcatcgcctccgcctcctccgggtccagtgcgacggcggaggcgctcagggccacggtgcgcgcgtcgttcccgtcgctggcgttccgggtgtacccgttcgccgacgaggcccgcgtggcggggctcatctccacctccatccggggcgcgctggaccgcccgctcaactacgcgcgctcctacctcgcgtccacgctgcccgcctgcgtgcgccgcgtcgtgtacctcgactccgacgtcgtgctcaccgacgacatcgccgccctcgccgccaccccgctcccgggggaggagggcacggccgtggcggcgccccagtactgcggcgccaacttcaccgcctacttcacgccgggcttctgggcgtcccccgcgctctcctccgccttcgccggccgccgcgcctgctacttcaacacgggcgtcatggtgctcgacctcgcgcgctggcgccgcgcgggatacacggcgcagatcgaggagtggatggagctgcagaagcgggtgcgcatctacgagctgggctcgctgccgcccttcctgctcgtcttcgccggcaggatcgcgtccgtcgaccaccgatggaaccagcacggcctcggcggggacaactaccgcggcctctgccgcggcctgcacgccggcgccgtcagcctgctgcactggagcggcaaggggaagccctgggaccgcctggacgccggaaggccgtgcccgctcgacgccgtctgggccaagtacgacctgctccggccggccgccgacatcgagacctcgtgaacacaacgacggcgttcgatcgaccgctcgtttcactttttgttcggtttagaagcacgtgctcttcgttgttttgttgatctaggctagatattggtagatcgatcatcagggtgttcatgtgaactgtacatattgttgctaactttctcggaaaagtttagaccgcttgcacaaattctagattcagaaaaaaaatagtactactcaaaagttggccaaatggtattgctccaagaaatctagatataacaaattggtggatctaaggtcagaatcaaggtgaagctctcaagtggcgcttcgctagcacaaaattagtggacttggtgaaaattgtacgaagaaaaaagatggtcaagaatagaagagactattagcaccaaaattgtcctccactagatctaaacaaaaaacatagtcattgcctcattggtagaagggactattagccaaaaagttttttttcccattgaatcttagatccggtagtgcatctgttctaaacaagctcttgagttttcagtttcgctctattaccttcgataagaaattcagaagcatcgtttaaaaaaaaaaaaaaaatactttgcctacttgtcagtttgtcattaagggtgcttgatttgaaaaatcaatccatccaaaataaaagttgtaacataggccaattcctcaaatttggtagaataatcacattccttatattagtactaactaattatgaaaaaatgagttggtgatgtatcaactcatttcattatacaaaccaaacaagaaagtaaaacaataaaaagatgatgaactacctcgttgctccaaccaaacaatcattattattaccagcagttattccgtatatacattgtagaccattgagctgctttagagctcgttcggttgtacaagaataaaccagaatttattctagctaatcaaaatctatataaattaaagaagtaatccgtctagaaatcaatctggggctctaatccctaaaaatcgaacaggaccttaacggattcctcgtatagaaaaagtcccccgatccccgcatcatcagcaatataacaaacgaaagaaaattccgggcggcctctctctctttttttttgggg

SEQ ID NO: 14678 - DNA, 2956 bp, Zea mays
catggtgtgattgatctgttccttttctttcttaacttagcacgtcattgattttatattcagctttcgaaagtagtgttactttctccctataatgatttatatggatgaatacctggtctcataattgtaggtatttattttaagatctgcataagcttttttttaccctggaacacaatagatgtgaatgcatacatgttgtcaaatgttaggattgagtaattgagctgattgtctctcttgaacaagagaagtagcttcctgcctcttgcacaagaggcctgcatctgttttgcaatattcatctatagaatgtttagaagtaatccaattcaatatttctagttcaaagtataggtgatatcatattcttggaagtcaaatatctgaccaatagttattgtttcttatcatgcagacatgattccggcggctcggcccaacttctgactcgtgattccagtctgtagcctaccttcagcaaatctggtggtttgaggtggttggtgaagtcgatttctgcttccctgttggaacatatagcttgtacttcagggtccatcttgggaagttctacagacgatttggccgccgccagtgcacctcagagcatgttcatggttgggacaagaagcctgttcgcttccagctatcgacctctgacgggcagcaggcattgtctcagtgctacctggaggagcccgggagctgggtcctgtaccatgctggcgattttgtggcctcaaagcctgaccagctgatgaagctgaagttctccatggcacagatcgactgcacgcacacaaaaggcgggctgtgcatcgactcggttcttatctatccaaaagggaaggggtttcaccaggagagggtggtcaggtctcagaaatgagggttgtagatgttgtggaggtattcacattaggatgttagagcaaatgcagcttgcagcctgatcttatttttactttgggctctagttcgcagcagaggtgaagtgtatgtggttgtagaactcaggtattgtgtggtcaggtgaccaccagagtgctctgtcagtcctttggcaaggtcgttttcgccccccttcagctgaatttggacagcgagatagccatgaaactgtactgaaatgagttcgaaggtgtcattcccagtttctaatttgctttctactgcttagtttcggatgctccctttttcctatttgtcatgatccggtcttgacttggtcttaacttaatattaagaatcattattatgattataagtatcgtgtgcatttaaagtttaatttagaaactaagaggcggagaaacttaataaacctgaagcattattatcatgagcatcaggcatctgaaatttaatgtagaataaattcaatttagaagcatcgcatctggaattcaatttagaagtctcatgtgcatgtgaaatttaatttagaaactaaaaaatcatttagaataaattcaatttagcccctgaaattcaaactagaagtgtcatatgcatttgaaatttaatttagaaactaaaaggtagaggataaatttgaaatttaatttaaaagctaagatggagagaacctaaacaattttcaatttagaaactcagagaaactaaaaggtgcagcaactgagcacagagtattgagctagacgtttgattttaatccgtaccgactatttctatagtgttttgtttatatagatttttatatagaggtttgattttaatcagtattggtttttactgtttctataatgttttgttttctatagattgtagcagtctgaacaactaagttttatctgaagcgaacagtaagcaaacaacataagagaaactgaataattaagtacttagtgttttgatagaacaaatcatccaaactgaataattctgagtacttagtattttacggaacaggtcatctctccttaccatagaacatttctttggagttttgatggaaccgatcatcgtcatccgtttttatcatgaaatattccgttgaaacattaacatagatttacagtagctgtcagtacttccgtactgacataccgtatcatacaatatgctctggcggatatctgacgtgatgatccatccttaccatgaaagctttggcaggtcatactttcatggtcttgcaaatcatttgacgtgatgaaccatccttaccacaaaacattccattagaacgttacaatagatttacacttgtccttatcacagaacattttgttggaacaataacatagatttacagctgtgtgatactttcatggtatgacatactccatccatttcaaattataatctgtttgacttttttagttcaagtttggttgactgttttaatgtgggataagttgggttgtaaagtgtatctttctagctttccaacgttacttagaacatcgaaaccggagtccgtatgtggcctgagcgttccttttcatgagacccacctctggagtctgaacctgattcgtgaataaactagacttcaactctcttattaaaatcttttcataattattattaatctttatcatttagaatatagtatactttaactatggctttgaatttgttatttttcgcaaaatattcgaataagacgaaccgatcaaacttgataaaaaagacaaatgaattataaattggatcagaggaatatcattctttcatgctctggtggatcatctggcgtgatccataaatctttttatcaacacatatcatgtgtgctccagcggatcatccggtgtgatcgacgaatgtcaatgcacataatcaatatgtcacttgtggagcttcatcgcttgtcagcccacctatcctatccacttcatggagaggcaaattcaggccaccaggaagctctcccactcacaccctcactttttcgttcctcccactcagtctctctagactc

SEQ ID NO: 14679 - DNA, 1933 bp, Zea mays
tgcagatatatgccgcggactttccagtctgtcatgagctgctcccatacgactcctgcgtcctaccagcccccgtcgcgtaccctacgagtcgcggcccatggacccagccgctgacgcgtggcctcgtaggcgccagacagccgcgcggtgcatggaccgcgttcacggatacggttgttcccgacggcggcccaccgatggttaagcccaatctgttatcgttaatgacatgatcactgtacaacattaccttttgcagaaaaaaccctccgcactggtccgtgtcagtgcacatagtcacagagaggtccctggaaaagagccttcctgtgatttactaggagtactaatagtgtctggctaagataatgcaatatccattgcaatcaaccacccccactcgtctatttcggcctcccaccttcctctttaagttgcccctcccacgcccccgccgcgaagctagaggctctctggcgccgacggccgacccacacgcgcgtccagcgatttcgccggggggagatcttgccattccgtggagcaccatccgcggtagcctagccgcgactggggatcggggcttgcgggccgtggagccacccaagaaggtagccgcgaaaagcttgatccggccggggacggggccttcggaggttcgtccctcgatcgggtgtcgtctgcgaaagccgggtcgaacaaatcgtcgcgactggaggcggcgcggggtcatgggggcgtgggtctcggtcctgctcgggatggacggagccgcggcggccgggcctgctgctgtgggcctgggcgacctgccggagctctgcgccgcccaggtgctgctccggctcgacccgccggagatctgcaggctcgcgcaggtcaaccacgcgttccgcggcgccgcgggggctgacttcgtgtgggaagccaagctgccggagaactacaactatctgatggagttcgtggggagcggcgacgaggggaagcggaggcggcggcgggccgggaagaaggagatctacgcgaggctcgccaggcctgtgccttttggcgacggcaagaaggaattctggttggacaagaacaaaggcatgatctgtatggcactgtcgtccaaagcactggtgattactgggattgatgacagaagatactggcaacacatgccaacttcagaatcgagattccagtctgtagcctaccttcagcaaatctggtggtttgaggtggttggtgaagtcgatttctgcttccctgttggaacatatagcttgtacttcagggtccatcttgggaagttctacagacgatttggccgccgccagtgcacctcagagcatgttcatggttgggacaagaagcctgttcgcttccagctatcgacctctgacgggcagcaggcattgtctcagtgctacctggaggagcccgggagctgggtcctgtaccatgctggcgattttgtggcctcaaagcctgaccagctgatgaagctgaagttctccatggcacagatcgactgcacgcacacaaaaggcgggctgtgcatcgactcggttcttatctatccaaaagggaaggggtttcaccaggagagggtggtcaggtctcagaaatgagggttgtagatgttgtggaggtattcacattaggatgttagagcaaatgcagcttgcagcctgatcttatttttactttgggctctagttcgcagcagaggtgaagtgtatgtggttgtagaactcaggtattgtgtggtcaggtgaccaccagagtgctctgtcagtcctttggcaaggtcgttttcgccccccttcagctgaatttggacagcgagatagccatgaaactgtactgaaatgagttcgaaggtgtcattcccagtttctaatttgctttctactgcttagtttcggatgctcccttt

SEQ ID NO: 14680 - DNA, 983 bp, Zea mays
gtgcggcgctcgaggcggccgggttcgaatacaagcgcacagaattgcatcattatcgttagctgccacagatggagatcttccaagtgacgacgatgatcctgcagcatccgttactcacatacttcttctctgcactcctgctcacacagctgctgacggcgcctattgcggcggcggagacaacggtgaaagtgagcaccacccctatcttccccgagatcccacaaggccaggcgagaaaggacttccaagtgctggtgcgcgtcgaggcgccggcgcgtccagaggcgcgcatccccatcgacgtcgtcgccgtcctcgatgtcagcggcagcatgaacaacccggcggcagcgccgacggagagaacgagaacgacgtcgagttcctgacgccggcgatgcggctcctgttggaggaggcgcgaaagctgccgcgctggcagcaggctgcaacgacgacggcggcgcccacgaacgtccagtacgcgggctgcgtcggcggcggcggcttcgagatggtggaccggaggctggagctgtggtccaagatgaagcgcgacgtgcagctcctcgtgtcggtccaggagcaggcggcggcggacgaagaggagcagcacctcgccgccgtcttccaggaggcgtcgctggcggccatcgaccgcgcgatgcaccgcgacatttacctggccgcggtttatgcgagcaagcagacgcgatgccactcggtcgggtggcaacaagtgaaggactgagaactcgatcggcaccagtagattaagtgggcatgacgtcaataactaaatgattacctacctagccgcttgtactagtcatgctctactttatattactttaaaagatacatttcgttgtgtaatcatcttatggttcatcatcgtcatgtgctccactatatactgtctcagatctatattcatcactggcagatctcaagctagctagcaccactcgtttatc

SEQ ID NO: 14681 - DNA, 2738 bp, Zea mays
attttttcacttaggccttaaaaatcctcaagaaacccctcatttaatattgtcggatggaaactctgttcttcactagtggctcaagacggtttatggcacgtacaactcacataaatgatttgtatgttaagaggcatataagggaataagtgtaaaaaatcacaaaaacatattttggtgaatgaacatatctagaaggttcttcatatctaagatacaattacacatatataaaccacataaatgagctatattttaacggtttctactgaataagataggcttagatatattagattgtacaaataagtttcttaagtgtatgtactgtttagagaacaacaacacaatatctaggttatacgtgcccttatgtaggtggtaaattaaatgtgtcggacgaagtcgagtttctcctaaaaatcaatttcttagtagagtatgaacaaattaaataccgctacaaataatgatttttgtgtgttgccaagctgacttcaatggagcatgtgattccactctcaccatccggtctataaatgaagccagatcaaggctacgactcccatccaaccgcacaagaattgcatcatcatcgttagctgccacagatggagatcttccaagtgacgccggcgtgcctgcagcatccgttactcacatacttcttctctgcactcctgctcacacagctggtaccattaatttgttgaaacttgctcatgtaatctcagcattattgataaatcccattacttctagtctcatgtcttagtgattcgatggcgcttgtacgcagctgacggcgcctactgcggcggcggagacaacggtgaaagtgagcaccacccctatcttccccgagatcccacaaggccaggcgagaaaggacttccaagtgctggtgcgcgtcgaggcgccggcgcgtccagaggcgcgcatccccatcgacgtcgtcgccgtcctcgatgtcagcggcagcatgaacgacccggcggcagcgccgacggagagaacgagaacgacgtcgaggctggacctgctgaagacggccgccaagttcatggtcgcgaaactcgaggacggagaccgcctctccatcgtcgcgttcagcgatcggccagtcagagaactgagctccggcttgctgtacatgactgctgacggccggaggaacgccattaggagcttggaccagctggaggcccgcggcggcactgcgctcgtgccggccttcgaggaggcggtgaaggtcctggacgggcggcagggagacggcggggaccgcctgggcttcatcgtcctcctcacggacggcgccgaggacgcgagcgggtcgttcacgctgagcgagcgccgccgcgaggtgatccgaggcgccctcggcaggtaccccgtccacgcgttcggcctcggcacggcgcacggccccgaggtcctgctgtacctggcccaagagtcccgcggcacctactccttcgtcgacggcgacaacgtcggcgaggtggccggcgccctcgccgtgtgcctcggcgggctgaccaccgtggccgccgtggacacgcgcgtggtcctcagggccgacgagctgaacggggtgcgcgtagaccgcgtcgactccggcggccacgacagcagcgtcagctgcggcgggacctcatgcgaggtctccgtgggcgtcctgtacgccggcgaggccaagcatttcgtggtccacctccacgtgccagctattactgcgacggcctcggcgtcaacggagggcggttactactgcgacggcctcggcgtgtgtgaccactaccgccaccaccgccaccaccgccacgggcagcacctgctcgccgtcggctactcgtaccgcagccatccgagcgcccgggcgatcacggtagaagcgcacggcgtgttcgtgcagcggtcaccggcggtgttagacttagacggcgggcggcacgctcctgttattccctccccctcccccgtggtcctgcagcacatcgtccggttcgagctgctggaagtggtggcaaacagcctcgtccgcggcgagctgatcagcaacgacgacagagcgcgtgccgcggacgtgctgcaggtcaagtgggaggagttcagggcgtgccaccagttctggggcggcgggctcctcgacctgatgagcggcctggagaaggaggtggacggcatggtgggcagcctcagggcgggggtggcggcgtacgtctacgcctgggtatcgagccaccagatgcagcgggccaccagcatcggctcgccggacaaggcggccgtcgagttcctgacgccggcgatgcggctcctgttggaggaggcgcgaaagctgccgcgctggcagcaggctgcaacgacgacggcggcgcccacgaacgtccagtacgcgggctgcgtcggcggcggcggcttcgagatggtggaccggaggctggagctgtggtccaagatgaagcgcgacgtgcagctcctcgtgtcggtccaggagcaggcggcggcggacgaagaggagcagcacctcgccgccgtcttccaggaggcgtcgctggcggccatcgaccgcgcgatgcaccgcgacatttacctggtacgcattgttacaactactcttctaggcttattttcttctatcaaaagcaagctttatcagcatgtatttaatatagttaattgtatgcaaacataatacaggccgcggtttatgcgagcaagcagacgcg

SEQ ID NO: 14682 - DNA, 747 bp, Zea mays
cttcttggggtactcctccccgcctgccgggatccaaccgcacaagaattgcatcatcatcgttagctgccacagatggagatcttccaagtgacgacgatgatcctgcagcatccgttactcacatacttcttctctgcactcctgctcacacagctgctgacggcgcctactgcggcggcggagacaacggtgaaagtgagcaccacccctatcttccccgagatcccacaaggccaggcgagaaaagacttccaagtgctggtgcgcgtcgaggcgccggcgcgtccagaggcgcgtatccccatcgacgtcgtcgccgtcctcgatgtcagcggcagcatgaacgacccggcggcagcgccgacggagagaacgagaacgacgtcgaggctggacctgctgaagacggccgccaagttcatggtcgcgaaactcgaggacggagaccgcctctccatcgtcgcgttcagcgatcggccagtcagagaactgagctccggcttgctgtacatgactgccgacggccggaggaacgccattaggagcttggaccagctggaggcccgcggcggcactgcgctcgtgccggccttcgaggaggcggtgaaggtcctggacgggcggcagggagacggcggggaccgcctgggcttcatcgtcctcctcacggacggcgccgaggacgcgagcgggtcgttcacgctgagcgagcgccgccgcgaggggatccgaggcgccctcggc

SEQ ID NO: 14683 - DNA, 2012 bp, Zea mays
acttcaaggaaatgtatggtttcaccattcagcatcctcgcacgagaccattacctagaacatcctaatcgaaaacgaactatttaccaatggaggcctgcaagatcgttgaaggccagagatacacgaagaggttgaatgaaaaacagatcacatcgttgctaaaggttacatgccaaaggcctcgagaacaagagatggatattctacagacagttcatcaaaatggatatgagcaagatccatatgcgaaggaatttgggatcaacattagtgagaagctaacctatgttgaagcccgagtccttcctgcaccttggctgaagtatcatgacactggaaaagagaaagagtgcttaccacaggttggtcagtggaacatggtaaacaagaaagtgataaacggatgcaaggtgagccactgggcatgtataaacttctcaaggagtgttccagaagccacagctcggggattttgccaggaattggcacaaatgtgtcaaatttcgggcatggaatttaacagtgagcccgtgatgccaatatattcagctagaccagatcaagtagtgaaggcacttaaaagtgtgtataatattgcactgaacaaactcaagggtaaagaacttgaacttcttctggctatactccccgacaacaatggtccgttatatggtgacatcaaacgtatttgtgaaactgatttgggattgatatcacaatgttgcttaaccaagcatgtttttaagatcagcaaacagtacttggcaaatgtctcactgaaaattaatgttaagatgggaggaagaaacactgtgctcctggacgcaataagttggagcattcctttggtcagtgacatcccaactattatatttggtgcagatgtaacacaccctgaaaccggggaggactcaagtccatcaatcgctgccgttgttgcttctcaagattggccagaagttacaaagtatgctggattggtttgtgctcaggcacaccggcaagagctcattcaggacctttacaaaacatggcacgatcctcagagaggcactgtaacaggcggcatgatcagggagctgttaatatccttcaggaaggccactgggcagaagccattgagaataatattctacagggacggtgttagtgaaggccagttctatcaagttctcctttacgagttagatgccatccgtaaggcatgcgcatccctagaaccaaattaccagcctcctgtaacatttgtggtggttcaaaaacgtcatcatacgagactatttacaaacaatcacaaagacagaagtagcatggacaagagtggaaatattttgccaggaactgttgttgattctaagatatgccacccaacagagtttgatttctacctctgtagtcatgctggaatccagggaacaagtaggcccgctcactaccatgtcctctgggatgagaacaatttcacagcagacgaaatgcaaacactgacaaacaacctttgctacacttatgcccggtgcacacgctcggtttctgttgtccctcctgcatactacgcacacctggcagcattccgggcgcggttctacatggaaccagagatgtcggagaaccagacgtcgaagagctccaatggcacgaacggaggcttggtgaagcccctgcctgctgtgaaggagaaggtgaaaagggtgatgttctactgctgacgaggtgaccgctttaacaaccattcacatgctgtagctaacttggtagggttcagtaggggattagattagctttctccaggaacgaagaggaaacgggatgcgtatttggatcatgaacaatcaatctgttagcgatcgctgtaaaatactcggaaatgcctgtataatagttcttgttggttcagatgcatgcatccaatgttccagtgtactatgaaaagggggtgtagaagaaaccttctggtgttttctaggttgaattcaatcaattcattaacagcaaaaaaaaaaaaaaaa

SEQ ID NO: 14684 - DNA, 1409 bp, Zea mays
  misc_feature (14)..(14): n is a, c, g, or t
  misc_feature (22)..(22): n is a, c, g, or t
  misc_feature (30)..(30): n is a, c, g, or t
  misc_feature (33)..(33): n is a, c, g, or t
  misc_feature (39)..(39): n is a, c, g, or t
ttttgggctggcancattcttngatccacnacntaaacnaccaatgtcgagccgagtggtcacgctatggtaccgtccaccagaattgttacttggtgccactgagtatagtgtaggtgttgatttgtggagtgctggatgcattcttgcagagctcctgtatggaaagcccataatgcctgggcgcactgaggtggaacagttgcacaagattttcaagctatgtggttccccttctgaggagtactggaagaagtctaaattgccacacgcaacaatattcaaacctcaacaaccctataaacgttgcatcagggagacatttaaagattttcctacatcggctctgccattggttgaaactctgcttgcaattgatccagctgagcgacaaactgcctcagctgcattacacagtgattttttttcaaccgagccttatgcttgtaacccttcaagtctgccaacatatccaccaagcaaggagatggatgccaagttaagagacgaggaggctagaagactacgagcggctgcaaaggccaagggagaacagaaaaggactcgaccacgtgatcgatctcggagggctggaccagcaccagaagctaatgcagagattcaagcaaacttagaccagaggcgacgaatgataactcatgcaaatgcaaagagtaaaagtgagaagtttcctcctccgcatcaggatggaggtacgggtaatccgcttggatcctatcatcatatggagcctatgttcgagcaccaggatgcttccttcagtacagtagtccccatagagaaggggacctcacaaacatggtccgggccgttgtttgatccagcagctctcgggcagtcgaggcggaagaagcaaactaccctagatgctaaggctgctgcttactcaaagcagctccaaaaggaaaagggagggatacgagcccgataacaaaatgtcgttttcctggtgagcatgtggagggaccgtgggaaaggttcatcgcctacggatgaattttcttgttttgttcctctggtggttggaaacaggcaacaatgcgctgctgtagggtgaagtcttccggattgtgtacatgtcatgtggtagcgtttccaagtactgtttagatgcttctgaacaagctgccgtcacccggacgggactttaggggtttgagactcgtatttgtgctctttatggcaattcagttgcccatgtgtatatatggagcaattctttcttgtgtatgtacagagacggcggtagctttgatttcttaataatgaatcaagtgtgatggcgaccttcctcacgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14685 - DNA, 5006 bp, Zea mays
ggcaccaaggaccagactactccagtgccttctcaaccagccttgccgtctagcattgcaaggccattcagcagcgcaaaacatgttgatcctgtctctaattcacagttagctgctacagctattatggctccgacacaagctttgagtagcgtaaataaggtggatccaagactagcagttgaacagaatggacaaaatgctgatgcaacaacaaatggtgcttctgcaacaacacttgaagctacacagcctgttagtccatggggtgatgttgatcatctccttgatggatatgatgaccagcaaaaggctctgatacagaaggaaagggcaagacgaataacagaacaacacaaaatgttctcagcacggaagctatgcttggtgcttgatttggatcacacccttcttaattctgcaaagtttatagaagtggaaccaattcatgaagagatgttacggaagaaagaggagcaagacaggactttgcctgaacgtcatctctaccgttttcatcatatgaatatgtggacgaagctgaggccaggaatatggaactttcttcagaaggctagtaacctgtttgagttgcatttatacactatgggaaacaaactgtatgctactgagatggccaaggttcttgatcctactgggaccttgttcgctggacgagtcatatcaagaggtgatgatggtgatccttttgacagtgatgaacgagtgccaaaaagtaaagatctggatggggtactgggtatggaatctgcagttgtgatcatagatgactctgtaagagtctggcctcataacaggcacaatttgatagttgtagagagatacacctatttcccctgcagcaggcgtcaatttggccttcctggaccatcacttctagagattgacagagatgagaggcctgaggatggtacccttgcttcttcacttgcggtcattgagagaatccaccacaattttttttcacatcctaacctcaatgaggctgacgtgcggagcatactagcatctgagcagcgaaggatacttactggttgccgtattgtctttagccgggttttcccggttggagacgccagccctcacttgcatcctctgtggcagactgcagaacagtttggtgcagtctgcacaaacctggttgatgatcgggtcactcatattgttgccaactcccctgggacagacaaggtgaattgggcattatccaaaggcaaattcgtagtgcatccaggatgggtagaagcttcagctctgttgtaccggcgcgccaacgaacatgactttgcagtcaaataacaccctccctgagcccgaattcatcatataggcttcggggaagaattcttctcagggatggaatgtgttcatggtaacctaacatgattaaaaaaaaaccataacaacatatctaaaatgggaccatggtaagaaggaaaaccaccacccaaagaatttcaggccttaaaatgaaatggtaacgaagaaaacgctttatgatagcctggaagaggagactgggtctgtggtggatgtcattacctaggtggtgagtggtcaagatgcctttttagaaagccagcaaagatgcgcgaaaaagtgatgatgagcagatgctcaccgcctcatcctttgtaacatgtagtagtaaaagtggtgcagttttggtaagggtcctaggttcagaaatgttgcttctggccaagggaacttggggggttttgccgttttggtagctgccgctggtcgcctgtcgaaagtgtggcctcagctgaacggcgtcatgaatcattggtgcagcgcatttaataggatgggtttgctatgtcagtgtttgtgttaggagtagcttgagtataaagctggttcaaaggcacgggacacctggtgctttgcctgctgctgctcgaaacgtactcgtcccccttccgaaactttaaggcagaaaaacgttttgttcagttgggtcaggtaaaggggttgagttgatggcatcagagtcagagaagaaccagctgattcaggttaacgggttgaagatttcatgccgtcagtgaacgcgttggttgctatatggaaggttggtattccaaaaaagaaacgcgtgacatgtcttctaactgaaaaggaaaaaaaccgttataatttaactgttttcgcgagaattggttcttttgggatgatgcggccggtttttttagtgtttgttttccgaacaagcttttgtttgcggccttactgacaaggatgttttggccattttggttgtttcaactttcgatgggatttggagaatgatgatccgtggtcaaactttccttgcagcttgcaacttccaagttaatacgtcaaaaataccatgtatcttatgaacgacataaagacgtttttcttgttgagtacaataaaaatgctattttcagaaaaaaaatcattgactctaggatcaccatttttgcatcatgacttgaccatgtaatgtctattggactagtcagatatacttggtcagatatacttgataaccatttttttaaaacagttatgttactctacatactaaaaaactaaccattttatagaacatatcgtatggtggtatttcaaaaacattaaagcttattgcttcaaatattagcaagtatccacaagaaaacattagcataaaattagcatgaaacatttatggcatgtaaatcatttagtgatccatgcaaatgaatgttgctcttgtggagggggttttagaagagccatttttaggatctgtttgaaagcaccacaatttctaagaaactgatttctatgcctagtttctagataaaacccaagtgtgtatttggattccagtttcttgaaaactaatttctagctttttttaatacacgaagatatgtctattcttactatattttaaaagtaattgattcaattatccccttcatttttaatttgatttaattatatcccctttatttttctttgttgctaatttcaaatgtaacttgaactcatatttttaaattcaaaacttttaaataataactgaacattcaaattgggcaaaataggcatcaatgggatcacatgcatatgtttgggagccatggcaataaccataattttcaccaaaccaactaatggcagtatataatttgtcgggcaaaacctagttttagttaaggaagaccaccttatcggtttcttagaaattgggaatctagtttctagaaactgaagcataaactgtcgtatttgaaagcaccctagtttttataaattggtttcttaaaaactcagtggttctaaacaagcccttagtagaaaatagaggagccaaagttatttttgaggagccataagttatgcttgtggctccaaaatagctctagcttctatggagggtccctctcaaacacaccccgcgagcatatctaagagtcgaacttgtataagaatatatttttatatttgttcacactcaatagttttttttctatttttggctagcatgaaatccaaaatagatgtgggtaatatttgacatctgattaaagaagttgcatgatatttgttaatcaagatctctattcctattaattaggaagtatataaataggctcttatgctctaaggacatataatgtataaggtagaatcaccctaaaggcatgcaaagtgtataacatagaatcatactttaaggtacaatgatgtggctaaggccaaagtgttgtgcataagtgtcatggttttgacccgacgttagtgaatttgtaggttaggatggggttagcgtgcttttgtcctaatggctttgcacttggtgattctaaggaagaaagtttagatgggttcggagagagccctacatttagtatggagctaaagtttttgttgcttggttttgtgtgttacaaggcgaagcgcttggctttcgtgctcgtgtgaggaatgttaccaacttagtttgcctgcctccacaacgaggcacccaatccattatatagcggagggagcgagtaatcattgttatatgatgtttttgatggggtacgtcatctctacctttagtcgtgtagttgctctagtgtgtctgctttgtcatccttgagatgacttggctataggggtggttgagtcctaaacgtgttcgaagccatgttgctaggtatgcttttctgagaggcatgtggtgattttcctcatatttctcttgctttcctcacatctggctttattgacttctatacccttggagcgtgactgaccatgacctgtgaggccctattcgtacctttgatggtgaaatagttggttggaggagtcattagtctcatgtatcgtacatgtttctgccctttgcacgcctcagttaggagtccgcgccgagtgatcaaaatatcataaatgcacttccccctagccatgttgtgtggcttctaggtcatggggtctatcggtaccctaaatataaggtacccactcctgttgggtcaaggcgagacccatgtggttgcccataaccacaggattaccgggtggctagctcgactcagagcttaggccccaccatatgaagctgcgggctagcgtggctcatttcctaagctggaccgccaacaccacgcgtcccataaagggagtaaccatcaactttgaccgaaggtctgggttaccccaagtggagcccgaagacccacatgggcccatcagatcctagagggggtccgaaggggctccacgacccgggaataaaggcgctctctaactagaagatcagttccagacctctgagagtgatcccgaaccccgtgtgtgccatccaaacctcaagccacgagaggtctggtgcagccacgtgtctataccattatggctagggcccaaaccccctcgggcaagttccggattcccagatagggagagtccgggggtgccgcatcaccacgcgttcccgggcctccttccttcctaggcagagg

SEQ ID NO: 14686 - DNA, 1055 bp, Zea mays
ggatcatcatggaatgaaggcaacaaaaacggtgaatcaggtgggggaaggtctggggaaccatggaacagaagggattttgatggcggcagaggaagaggtcgctttgggcgaggtgaccgcaatcaaggcaacaacttggggtcaggagatggtggcagctggggctctggcaggggaaatggtggtggccgtggtggttacaggaactggaacgataacaacgaaagaaggcccttcggtcaaggtggtggctggtctcagtcctccgactggaatggcaacaaaggaagtggaagtggcgaaggaaatcaagctttctcgaaaagcaagcccagctgggaatcgcaaaacacctctggtggagatgaccaggcaggaaagaagagtgacacagacaactcctggagccagaaccgatcatctccatctatcctgggtcagccaagcggtgatgctaataacaagtctagcgcttgggacggcgctcccagcggaggagctggcaggggaggttcaggttcttggggaaagagcgacgaggatggctggaactcctcccaggaaggttcaggttcttggggtggtggggcagaagctcctcccaggaaggagggcgacggcgcatggggcaaaggtggcgaggggagccggagcctaggaggaggagggggtggtagcagcagttcctcggataaaccggcagatggtccatggagcggcaacaacaagggtggcagtggcagtggtgggtggtaactggtaagcttgcgccttattggcgctgactgcatgtaaatattgtgcccgcgctgtgtgaactgttctggtgcgtgtctagttcgtatcagttacttggccatgcgtactctaaactaaaataaaacatggcttgtgactgtgactagttatatgtagcctgttgctgacagtaattaggcgccttaactttcagaaactcatttattagcatcctcgattcctagaccaaaaaaaaaaaaagataaaaaaaaacaaaaaaaaaaaaaaaaaaaaaaaaaaaaaaactcgagccg

SEQ ID NO: 14687 - DNA, 2125 bp, Zea mays
  misc_feature (2112)..(2112): n is a, c, g, or t
  misc_feature (2114)..(2115): n is a, c, g, or t
  misc_feature (2117)..(2117): n is a, c, g, or t
  misc_feature (2119)..(2119): n is a, c, g, or t
  misc_feature (2121)..(2121): n is a, c, g, or t
  misc_feature (2123)..(2123): n is a, c, g, or t
  misc_feature (2125)..(2125): n is a, c, g, or t
tagcaattctatgataaaaactggatgttgttgcgttaaaaaaaattaaatgtgagatgagaatatatgtatatatattagccaaaccctaaatatctgatgatccgatatttgtgtgctcctttattctaatgaaaggaagaaaaatctattttgcttctatccttccacgtactcagcttttggtagtttccatctcctatatttctttggacgccggctctctaggtatttacacgtacaaaattttctctcctcgtatctcttccaatgcatctattccagccaacgttgatttttaggatccttgctagtacttacgttcgtctcacttatcttctcattgttcccctctccacgtcatgtctaggcatcaaatttctacacgccacttctctctagaaggcgccaattcctggggaaaatcctcgcgccagctccttgatattttccaaaagcaatcttatccctggggaagaaatcacgtacatctccatctctcagccatctcatttcttctccgttcctgatgacactagagggattagtccgcacatcagtgcttggatcttgctagcagccgagctacttctccagcatcaatgtttgaaaccgtcatatctgcaatttccggtcgtcgacctcgccctgctgcttatcccgtcgccagctgtacttgtcttcctcaccggtgtgccctctcggctcgctcggcttcaatctccatcgcgcagcggcaacttcccttttctctggtgccgcgcacgctgctggtccttgcgagtccaccttgctccggccagtgacaccggtgccggctcgctaatgcttgcgcgcgtctgtccacgtcgccagcagctcggtctctacgtgtctccctcagcatctcggcatcggaactccatcatgtctgtatgtgtgtggaagaacgagatcgagggatcggagaagaaagcgaagcccatgtggtttgtgcgttcgtttggcttggaattggaactgtggatattggagaagaaattccgagaaattagtggacggtgatggtaatgttcgtgcgatactcatctgatgctcgacaaaaagcccgaatcgggagtggctgcttcgtcttcttcgtcgaatgagaatcgtcgtgctggccacgcgtcaccagctcgataaaataaatcctatgggtatctgggtaaggatagaaattgtgtgcatcgctcgccagacgtgtgtggtcatgggcgtcaagcgaaaaccatcttcgtttttccgactatcgtgtcggattggtcagggtacgctagctgagaatcgtgcaaagcaaagttcatagctcaaaacaacccacaagacgatgtcgtcagtcggatcaacccgaagaagggcagactgaacaagtatcggaacaaaaggttgatcgccaagcggacgtcgtctaacaaacactaacatagtgtttattccaggtgaagtgtgttgctgtggaggaaggactctgctacttttgtgcaaaggtggttctcaagcaggaggaagaaccaaaaatagaagtgtgctgctgtggatggatggtgctaagtgccggtgggctcggccgtcttataggttaaagtagctcttctatacttcttattgaggattgtcattgagctagcatatatttcaaacttaaaaataatttataacatttcaaagtttattgctttgaaccacttttgtaaccactccgataaatataatgtaaatttgctgtaacttgtaactttttgtaataaagaaattccgctgcaaaatgttggtgtgtgatttgtgtttacttaatcttgcgatccctgttgtaagtggtttatccggggtccttgggacactcgaacggatcctgttaagttatctggtgcacatgcatagccgtctgaggtctttgagacaaggtcaagtgcatgtgggcccaataacttgggaggtcctgccataccatccatcatcatactaagcctacccaaaaagttttaccatttttggagctattaatttatttctaaaattctaaagggcttggtttgaacacctttaagggctatataattctatgttttggggggggggggggatataggnanntntntntntn

SEQ ID NO: 14688 - DNA, 560 bp, Zea mays
tcggcacgagcggagtgcgtggtcgccgacccgacagccgccattccctgctcggtcatggcaactggccgtcgcgcccctactctcagtcctccctgtgctcgacgcccagctcgccatggacgcgcgcagctccctcgaggtacgataattaatcatgtgatgcggaagacgagccaagtcgacccaagatgacataatgagtggactaattcgcaaggtgatgcggatggacgaacctgaggaagggcagactgaacgagtgttgggataaaagttgatcgccaagtggacgtcatctaacaaacactaacgtagtgtttattccaggttacgagtcactttgattgtgattgatgataagtgccggtgggcttggccttcttataagtctaagtacttcttctatacttcttattgaggattgtcactaagctatcatatatttaaaaattataaataagtttataatatttcaaagttattcttggaaccacttttgtaccactccaataaatataatgtaaatttgttgtaacgtgtaaaaaaaaaaaaaaaaa

SEQ ID NO: 14689 - DNA, 506 bp, Zea mays
cttatgggctccccacgggtccaggctttcgatgagtctatgcaggaacaactacgatgtgaggacgtggacttcatcgacgagcacagatgacaagcaacaatccgaaatgcacggtacaaccaagcgctcaggcgctaccaccagcggttcgtgcatagtagggagctccgggtcggggacctagtcctaaggcgagtactgaaccgagaagggctccacaaactctcccccagttgggaaggacccttcaaggtgacgggaatatgccgacccgggtgtgtccgccttgccacaactgaaggagtgcctcttcccaatccctggaacatagagcatctccataagttctacccatagaagcaaaactgggggattgagtttttcttcctttgtaactgggttgcgcatatgtgtatgtcaatccggtgaggtccgccctcgtaaacctggcctcttggtctacacccatgtatatcaagttataaggaagagatgtccccctc

SEQ ID NO: 14690 - DNA, 2249 bp, Zea mays
  misc_feature (1971)..(1971): n is a, c, g, or t
cctcgaggccggccgggccgggacgcgaagcggaaggaaccaaacaggcaaacggaacggaacatctcctcggctccttcctcctctggccagctgctgtcgcccctcgcccgccacggcacctcctccacttccagatcttcccgccgtcccaaaaatagtgcccgccaaaaccctaccctccccgcccgcttcctcccctccctcgcggcctccgaccccgcccttccgccgcctgactaataaaccctagcacccacctccgccgctgccatggcgggcccgtccggcgcatcctcctcctcgcgcggcgtcggcggcggcggcgttgaccgcttctacagcccgccccacgtgcgccgccagcagcaggaggagcagctgcagcggctcaagggcctggcccaggggcagcgcacgtcgtccccggcggcggggacgctcacgcccagggccgccaggcagaagacgccaccggctgagacgcccgccccggccaacgagtccgagaggccggtcgacgcgtcctccaagccgcccgtgtccgcgacggcctccaccgccaaggcggctgcgacggctgatgcggtcacgacctcgccgccggcgcctgcggtgctggatgaggtcgggaatctcgacaggttccttatctccaccacgccatctgtgcccgtgcactacctgccccagaccagcatgaggggatggaggattggtggatgttacgaattctcgaccatatttctgccttggagatctctgggaggctttccatgagtggagcttttacggggctggtgttccccttgttataagtggaagtgaatctgtgattcagtattatgtgccatacctttctgctatacagctgtatgcagaccctttgaagcttccatcgaggatcaggcatccttgggaggaaagtgatggggaatctatggatactagcagcgaaggtagcagtgaaactgatgatatccgattaagaagcttaactgtggaagctacacatcgattggatggtggctttcaaagggatggcgatgaaatgcactcaccatcgactcgtccaatttttgaatatcttgagacagatccaccatttggtagagagcctttaacagacaaggtatcagttcttgcaagtagatttccagatttgaagaaattcagaagttgtgacctgctgccaaccagttggatgtctgttgcatggtaccctatctatagaatccctactggaccaacactcaaggatttggatgcatgtttcttgacatttcattacttatcaacaccttccaaggatactgatcccagtacaccaccatgccccaatttggggggccttaattgcaacatgaacgccgctggcaaactaacattgcccgtctttggactggcatcatacaaattgaagagctctatttggtcgtcaaataggcctgaggagcagcagcttgcagcttcactgacgcagacagcagatgactggcttcgccatcgccaagtgtaccatccagacttccgattctttctcacccacttcaacacagcattgagatgacatgagatggtcgcatctctcgctgtaaattgtcttcattagtacaacctccgttctcgaatatttgtcgtccactatatttttgaactaaaacgcgacaaataaaaaaaaaagaacggaggaagtatgttatatgttgttggctgagccaggctacctgtaacactatgtggttgaccgcgtaactagcgcttctctgaacttttttcgtatggttcagtagttcaagccagacagctaatttgtaacttctccaataattcttttgttgtaggtaaacttttgagagtaaacattatggagatctgtaaaacagaaactgatggttataaactttttaaacttatagacttgagaacacattgcttataatttagtttaaccttgtattatatgttctnatctaagatccagaatatttgggggctattagagcgatgtttaatttctgtctttctgttcctcaaaatctaatgattcgtgcggtggatgcaaatgtcattttactttgaatactttttcagaacttgtattttggaaacccatttctgtcccaccgacgcttagatactgtccaaaattgctgccgactatcaaatccatttggttatgatgtcctatttggttatgatgtcgtttaaggctttgactctggaacggttactttggttacagctgg

SEQ ID NO: 14691 - DNA, 1804 bp, Zea mays
aaaaaattagaaaattctgcgttaattactccaggcttaaggttaagcacctcccaaacacgccctatgagggccctcgtccggatccacctgcccgcggccatctccaccggatccttcctccacacctcctcaaccgccgcctccaagaccctagtaccgaaccccaacctcgtcccgctccggctcgtccgccacttcccggccatggccgccaccgccgcagacgagttcgtgaagggccgcgtcttccccaacggcgtcgccgtcataacgctcgaccgacccaaggccctcaacgccatgaacctcgaaatggatgttagatacaaggcacttcttgatgaatgggaaacaaatccaagtgtcaagtgtattcttgtggaaagcagctcttctcgtgccttctcagcaggtggggatgtgaagagacttgctaatgattgcaccatgccagaaataatagaggtattcacagtagagtactctttaatttgtaagatacatgagtatgcaaaaccttatatatgcttgatggatggagtgacaatgggatttggaattgggctatcagggcatggccgctaccgcattattacagagagaacactcctagccatgcctgaaaatggtattggcctgttcccagacgttggctttgcttacattggtgcaaaagcaccaggagggggtgcagttggagtttaccttgggattactggaaaaaggatatcatcacctgctgatgctatgttcataggccttggtactcactatgtaccttctgcaaatttgggttcactcaaggagtccctgctgagtgctaacttcaccaatgatcctcatagagacgttgagtcagttctgacaggatacaagaaagaaccagagtctgaaccacaactaaaaaagcttttgccatatatcatttcttctttcagtcctgataaatcagtggctgaatctgtggaagagctaaagaaatgtagccgaagtggtgatgctgcagtggcagaatgggccaatgaagctttagcaggaattgagaaaggcgctccattttctctttgtttaacacagaagcatttctctcaagttgcatcagcatatgggactagtgaacactatttatctaagctggctggtgttatgaaattggaatatcgcattgccttgaggtcgtcgattagaaacgattttgttgaaggtgtgcgtgctgttttagttgacaaggaccagaatccgaagtggaatccagccactctggaagaagtaaacatggccgaggtcgaatcagttttcgagccattaggggccgaggctgagttgagtgtgtgaaatatggcctgccacactcagttttcttatttgtgctgcaataataatgtatacaaaacagaaatgcgatgcccacagaaacaataaatgctgtgtcttcatgaactaactggagtggttccattttctcgaaaggggcgcgtgggaatctaaggtctgttgcttgctttcctgcctctgcctgcaatattccagccatggtaccaggtggatggccaaatactctagaagcgtttgccctgggcacttgcatgtagcttgatgtgagtagtgtaagaacaaccgggtacggaaaccgttgtctggccagcagatttcaaggcgtgtttagacaagtgtacaactgacgcgcacagatgtacggagtatatattatatgaaatatggcactaaaactctttgcccaggggctttgacgcaggcccggccgcggaaaaagtaataaaaaaaaaacaaaaactcgtgc

SEQ ID NO: 14692 - DNA, 1796 bp, Zea mays
  misc_feature (1649)..(1649): n is a, c, g, or t
  misc_feature (1661)..(1661): n is a, c, g, or t
  misc_feature (1702)..(1703): n is a, c, g, or t
  misc_feature (1726)..(1726): n is a, c, g, or t
aaaaaattagaaaattctgcgttaattactccaggcttaaggttaagcacctcccaaacacgccctatgagggccctcgtccggatccacctgcccacggccatctccaccggatccttcctccacacctcctcaaccgccgcctccaagaccctagtaccgaaccccaacctcgtcccgctccggctcgtccgccacttcccggccatggccgccaccgccgcagacgagttcgtgaagggccgcgtcttccccaacggcgtcgccgtcatcacgctcgaccgacccaaggccctcaacgccatgaacctcgaaatggatgttagatacaaggcacttcttgatgaatgggaaacaaatccaagtgtcaagtgtattcttgtggaaagcagctcttctcgtgccttctcagcagggatggatattaagggggttgccgtggaaatacaaaaagacaaaaaaacaccacttgtgcaaaaggtattcacagcagagtactctttaatttgtaagatacatgagtatgcaaaaccttatatatgcttgatggatggagtgacaatgggatttggaattgggctatcagggcatggccgctaccgcattattacagagagaacactcctagccatgcctgaaaatggtattggcctgttcccagatgttggctttgcttacattggtgcaaaagcaccaggagggggtgcagttggagtttaccttgggattactggaaaaaggatatcatcacctgctgatgctatgttcataggccttggtactcactatgtaccttctgcaaatttgggttcactcaaggagtccctgctgagtgctaacttcaccaatgatcctcatagagacgttgagtcagttctgacaggatacaagaaagaaccagagtctgaaccacaactaaaaaagcttttgccatatatcatttcttctttcagtcctgataaatcagtggctgaatctgtggaagagctaaagaaatgtagccgaagtggtgatgctgcagtggcagaatgggccattgaagctttagcaggaattgagaaaggcgctccattttctctttgtttaacacagaagcatttctctcaagttgcatcagcatatgggactagtgaacactatttatctaagctggctggtgttatgaaattggaatatcgcattgccttgaggtcgtcgattagaaacgattttgttgaaggtgtgcgtgctgttttagttgacaaggaccagaatccgaagtggaatccagccactctggaagaagtaaacatggccgaggtcgaatcagttttcgagccattaggggccgaggctgagttgagtgtgtgaaatatggcctgccacactcagttttcttatttgtgctgcaataataatgtatacaaaacagaaatgcgatgcccacagaaacaataaatgctgtgtcttcatgaactaactggagtggttccattttctcgaaaggggcgcgtgggaatctaaggtctgttgcttgctttcctgcctctgcctgcaatattccagccatggtaccaggtggatggccaaatactctagaagcgtttgccctgggcacttgcatgtagcttgatgtgagtagtgtaagaacaaccggggtacgaaaccgnttgtctggccangcagatttcaaggcgtgtttaaaatgtacaactgacgcgcnnacagagtgtacggagtatatatntatatgaaatatggcactaaaactctttgcaaggcctagcaaagccaaaaaaaaaaaaaaaaaagcggcc

SEQ ID NO: 14693 - DNA, 2203 bp, Zea mays
  misc_feature (848)..(848): n is a, c, g, or t
taatgtattactcacatgcaactgttgacttttaaaaaactcccctactttctttgtgctatgtaagaatttaatgcaatagtggcttaagaagggataactgcatttacacacttaactgttcctctggtggctgcagtggcagaatgggccaatgaagctttagcaggaattgagaaaggcgctccattttctctttgtttaacacagaagcatttctctcaagttgcatcagcatatgggactagtgaacactatttatctaaggtgtgaatctagtatcctctaggactgaacaatttcaattgttcatgaaccacttatctatgtattgctaattctggtgtttggtgtgtttcagctggctggtgttatgaaattggaatatcgcattgccttgaggtcgtcgattagaaacgattttgttgaaggtgtgcgtgctgttttagttgacaaggaccaggcaagttatccatatgattttctggctagtttgagaactccattttcctaagggattcctatttttccaagggaaaatgaactaatttcccttgggaaaatgtaaatcccttgggaaaatggggttcccaaactagctctaaattgtttcatccaagaaggataaatctcatcctgtcacattacgtttctacatttatctcacccttttccttatttgcggaaaaatacggaaacaggatgtgtagctggacggtgtgtttcctgtctgtttttgcaggatcctgttttttggcaggataggccttactaaatccaggataagcttttagcagttattgtagcaactttaaacactaggtctttacgataaatattagttcganaatgtagaaagtcctcatgtcaagaagcctgcgactgcgagacactttaacaagtctcctaacatgttgagtaggcacactaagccacgtcatgatcttagtaacccgttctcttcctgagtctaggtttctccattgcatcctcttagatgtctcttcctagttcttcctggatcttcctcttcctggccactcgtgaagtcttcctgagttccgacaagtttgagatctttccagcacccttaatccacccatggcagccacacatgcttgatctctcctgatcagataaccagatgcttcaacggagatggagcgtgtgctgccatatgtgcccctaggctacagcttcactcgacccttgccaaacacctcttggcaagatccacggcattgtctgtgttgctgacatctatggcgcagaccgagtggaaggaacgggtacttcctcagcgtcactctgtccagggcagtggtgtcccgaaacctatcaggaacctgttgaaactactaggactggctcaacccagcgactaatcaaatctgctctgaaactggtggagaccaatccagcctgtcctccgtgctagttgcaaaatgcaaactaagctataacctggggaacctggtccatgtcttgcaaactgggcgcaattggtggcaaaacggttaagggcttgttgggttatctctcaatccacgtggattgagtgggattggatgagtttgaatcccaaacaagtcaaacttctttttaatttttttcaatcccactcaattcatgtgtattgggaataaccgaacaaggcctaactagattatactttggtgcaactcggtttggggtttgctttatctccatagctaacttgatactacctccgttctcgaatatttgtcgtccgttagtttatttttgaactaaaccgtgacaaataaaaaagaatagagtgagtagttattatgttatggaagtatagggtggtcggctgcatttaatttattatccaagaagattaagtaaaaaggaattggcttctcattgaatttccctatcactttgcagaatccgaagtggaatccagccactctggaagaagtaaacatggccgaggtcgaatcagttttcgagccattaggggccgaggctgagttgagtgtgtgaaatatggcctgccacactcagttttcttatttgtgctgcaataataatgtatacaaaacagaaatgcgatgcccacagaaacaataaatgctggtcttcaggaaaaaaaaaaaaaaaaaaaaaaaaaaaaaaaaaaaaaaacaaaaaaaaaagaaaacaagacaaaagaaaaagaacgataaaggcaacg

SEQ ID NO: 14694 - DNA, 1714 bp, Zea mays
ccattggggaccccgccggccggtagcccttcgacccttccgccgagctcggcctcgggcggcgtcccggtctcaccgcgaccgggcggtgagaggtagaacggccaccagacatcaaccgtgaaggggtggcgtcaaggcagcgctgaagcggcggcgacgtcgaggctcgagctcccgtgccgcgctccgagctaacctagatgaacatactcgaaaggatacgtggaggtggcgacagggcggctgccacggagcgccccccgcggccggagtgctgggtggagatttcggagtccgtctcacggctctgcagcttcgacgccgccggcagcggtagccgcagcatctctgtaaaagttattcaggattctagacctatacatgacaaacttgttgattctttcttgaacaaatttttcccatcaggttatccatacagtgtgaatgaaggttacttaacttataccaaattccgtgtgctacagcatttctcgagtgctatgctacatgtgctatcaacacagtccttgctgtttgctgcaggtttgcgacctaccccggcgcaagcaactgctgtaagttggattctaaaagatggaatgcagcacgcaggaaagctcatttgtagcagcatgggtgcaagaatggattctgaaccaaagagttggaggatacttgctgatgttctctacgatcttggtactgcattggaagttgtttcgccgctgtgtccacaacttttccttgaagtagcaggcttgggaaattttgcgaagggaatggccgttgttgcagcaagagcaacgaggcttccaatttactcttctttcgccaaagaaggcaatcttagtgatttatttgctaaaggggaagccatatcaacacttttcaatgtcatgggaattggagctggaattggattggcatctactgtttgttcaacaactcaaggcaagttaattgcaggcccgttactttccgcagtgcatatatatggggtcatccaagagatgagagcaactcctgtaaacacactcaacccacaaagaacagcaatgatcgtggctgattttatcaagagtggaaaggtttctagccccgccgagctaaggtacaaggaagacctcctgtttcccaaccgagttatagaagaagccggcagtgtgaaaatcggtcagccacttcgcaaagtgttcagtccccggcttgttgagcagctgagggcgactttcccaggcgagaaatttctgctcagccagaaaagcaacaggacgtacatggttctggagcgaagcgcgagcggagaggacgcgctgagggggtggctggtcgccgcgttcgcttcggagatggagaggtcaggcgccggctcacgcgatgacgcggttctgagcgaggcctacgagaagatggagcgggtcttccccaccttcgtgtcagaagttaggagcagggggtggtacaccgatcagtttttggacgggaactgtagtcgagtctcgtttgccaagtttcggtagtcgcagagactgtatatggtctatgttttttggaggggagatgcggaaccatgaactcatgcatgcagggcagtgtagtcgaactcttaggctatccgcactcatactactttaaatttgtactctaaaaggaatattctatcctcgtcagcaagattatctactctataccacaatcctcccccgtcccc

SEQ ID NO: 14695 - DNA, 1766 bp, Zea mays
tagttgagtgtctgaaatgcaccgtttctcatccgattttttgtgatcttttgagtatgatccttggagtttggatttgctgtccctatagcaaagaaataaaatatagtttggagagcagtttatgttaaggtcggttccctgttaccatttggaatattgtgatgaaaatgggacaaggatggggattcacttgagcggcgagttcatttcgggtggctgaaattttgattcaagccctgtttcaatcccactagataaactttagcagcttttttagctacttttagccatttggtgatctaaacaggagagctaatggtggtgtgataaaatttagcacctattatctcataagctgatcaagaggtgctaaaagtagctaaacgtgggccagggaacctcattttccacccatgccctccaacctcactccctctctctccgcattaggggcatagatgtcttttttattctaatgtgctaaactttattagagtagtccaaacacccaagaagctaaactttagcacttcaacttatatggctaaagttcagcggtaatagtcttttctgttttttcattttttatagcttgtatttctagtaggaaaaaacggcagacattgcttccctccggacaaaatgagatcagcggcaccaccgtgccaacttcccagcccaaaccccgacgcgtccccacctccgtcgccgatgacaccgcgtgccccgcagcttcggcatcacccgccgcacctcctcctcgccgaggctgtcgcctcctggcaccccttccacaagaagccctgtctcacggaccgctccacggctcccccctcctcggcccgcctccctgatgcggagactccgacgcctgccctctcggggggcggtagcggcggatccttccggtggttcgggctccgcaagcggcgccgccgcggtccgggctcgcggtccgtgtccggccgcagcagcgaccgccggagatccggcacgtgctccgacttccatttcacgtgcggcgccggtggtggtggcggcggcggcgccactgactccagcggggagatgtgggcgtcggatgtcggggaggtgcggatgagggacgtgccgatggcgacggagttcggcccgtcgcctgttggtggggttggtgtctggagtggtggggtcggcgctgcagcggaggcagcagtcaccgattctgaatatgggagcgaacctgggtaccgtggcgacgtggagctgggatatggagatgaaatcgacgaagaggaggaggatgggaggcagcagctgttctggggcggggtgattggagatatgaacaaaatgaaaatcgatggcgacaataactttggggagcagaagagccatcaccgatgcaggcgcaagaagcatgatgtgaggattttggattccttgagttgaagagcttcataggcctaaaagtggtgaagcgtccatgtgttggttgtagtgttccgtcactagcagcagctatttatcgatagcatgtctttgttgcagcatccactgatagagcagacaactagttactagtgtttcgacattttgtatggcacagatgtttcataatagttccctagtatctgggcgagaatttccatgagtttatctatgacggcttcagagtgtagctaatgtgctaagaacatgtgtcttcttggttgtttttggtacacttgttagcatcgctgctggtctgacgttctccatttttattgaagtgcgtgattgat

SEQ ID NO: 14696 - DNA, 4248 bp, Zea mays
  misc_feature (3880)..(3880): n is a, c, g, or t
aaccgcaggcccgatccctttccgcgtatcgtttgcgtgcgagcgaacctggcagagtggcagtctggcactggtctggtaggtggtagccaccgcgcccgcgcgccgctcgcgtgcacgtgaaccgcaccggcgccaccacccgccgccgcccgcccgtccgatggcacatccagcccccaccgcccagaaaaaacctaaccgcccaccacccatacccagcccccgccttatcctcctccaccgccgccgcccccgccccccaactactcgtcctcacctccacccttatcgccgcccgcccccagatctagatctgagcctcccgtgaccgaggccgcgggtagacaggcatacgatggccgatgagcctccaccgccgccgctagcgaggaagagcgcgccggcgcagccctggtcgcacgtcgagaccacgcacctcatcgacgcgtacgaggagcgctggacggcgctgcgccgcggccagctcaaggctcaccagtgggaggaggtggcggccgaggttgccgcccgctgcgccgccacccctggggtcgtcgcccagcgcaagacgggcacccagtgccgccacaagctcgagaagctccgcaagcgctaccgcaccgagggcgcccgccccgtcacctcgctctggccctacttccgccgcatggatcgcctcgaacgggggccactcgccgtcgcgtcttccgcctacccggccgcgactggttctccgcctgccgccgacggcgacgaagaaggagaggaggaagaagaggaggtggaggaagaggaagaggaagaagacgtgcaggaggaaaacgaggaggaggaagaactcgccccacgcaacaacaacacccggagcatcaacggcatcatccgggaattcggcaccggccttgccccgcgccacccgcagctgcagctccacccgccgccgccttccatcacgccgtccatcgcgcccccgcgcaagagggtggcctacgaggcgttccaggccaaagccgccgccgcggcggtcaaggccaaggacgacgaagaggaggccatggagatggcccgccgccgcggctcctctgggcggcccgtcgcacagctgtcggctgtgctgagggatttcggcgagggtgtcatgcggctggagaggcggcgcatggaggtgcagtgggagatcgagcgagggtggcaggaggcggacgcccgccacgccaggatgctgcaggacgctcagcgccagctccgtgacacggtcgccggcgcctgtgccttgccgcccaagaaggccaggagggaccatggagactcctagcagcaattggcaccttggattgttagttatgccttttctgatgctgttgctagcagggaaggcatcccatcccaattggattgtactcctagtagggctagtcagttcagttggtatatggtggtaggactgatttgcagtagcatcttctcctaacctatgttttatgactttatttatgtcgtgtgaatggtggcggtgcagcaggctaatgcagtgaagttgctgggttttggtagtgcgggtgtctgcattgtgttcacttgttaattccaattttattttttgtgattagcatatgctcatgagtgctaaaaaaacttagtgcatttgattgtcactgaatttgattgccttcatagccgatatcattgtgatataattttaggccagacgatagtttttttagggcagctgtgggtgcctaggggctacattcgcgggggactgttcgggcatcgctactttgcgagtgaaaagctctcgagactcttcgagtctgccccgggctttgaggtggacaacagcaccttcacggaggtcctaatcagggccacattctaccccaagttcgaaaacgataaatccaatcaggtgagaatttggcagcaccaaaaatgttgtttagttttgccggttaatattgtactgtagctgcttagctcttgttaacttcaattgggtcataattacttctgctaatgaagaaatgtttaatgaacccactgtgcagtaaatccttggggtcttagattgttctagcttctttggctttctgttattgcagtttagtaagtggaataaaaaaagtttaattaagctttacccttgattttagtgatgacagacaaggaccagaatgatttagatggtgtcccattcccatgtgcttgcaaactttggggtatgtatcacatattggtttttctttaaaataaaaaatgggtgtttatttgtgtgaggtaatcagtgattatgatgatcacttccctcatgttagactcaagcattctggttccctcttcatgtatgttggtcaccatggtggttcatatgcgaagaacagcttcgggaatgtgtatgttgcattaatctctgctgattattgtatgataagtatttgctatgcctgaagcttcatgttttcttatgatgctctttgttctaggcagtctacaggctgtcgttgagaaaattctatgctagatatatgtttttaggagtagaaaggctaggtcagttgcttcaaacatgagttagttgcaactattgaccacttacagttatggtgaccatgttttttttatcggatttctttgatgacaatctgatgtgattcaaaagctataacctcttttctcccaggtggttcttttcatcgacttgtaactttgtaagtaatattggtccatgaagtgtagttcgtgcacagcgcatcctgcttctggttgcgtagtaatacactgcagtgctacttttggttgcgtagtgtgagactgagctctagcttattagcttgtgacttccttgattttctatttctgcagctgcttgggttcagttatctctctcccccgtatgccaatgaattgacttaaatcaggctcaagtgtcagtttaaattaacccttggtgtgcgagcgactctttaatatatgttctatttatctatcaatagctgcagaaaaccctggttattttttgttctagcatataacccatttcatttctcaatgaaaatagatcttgagtgcagtgcaaattacataatacatatgttctatccatctgccatcaaagctgcagaagacgtaatataaaaagaagctgtagaaaaccttttatcttcgttttttggcacataacccattcctactctgcgctatggcatgtgctaccatttagaatttggtctgtgctatggtctgtgttattcctactctgcactaatctctgcttcacatgtttatctggactaggctacgcctacatttatttggctgcaagttttggccttcaaattgttttcataaatcgtttagcttcgtttgctatttaatttatccaactattgcattataatttatttattataagccttggtcggaaacatttcctactgttagttcttttttaccgagaaactctatgatcactaaatgctctattgttgttttcttcttcttttgcttgtacagaagatggcaaaggcttttggtatgtttgttggatacttggatccatgctgtttatgagcacctgtggtggtatgatggtcgtctagggagccttccgtaggctgactgcaatggatatcagcggagctgggttcctttgttgttttctccccctctttttgttagcagtggatttgttcttacttcagtttgagacaattgaagtgcatctagattctagactctagagacaggtgtctgcttgctcttgtgaaatatgggttgcctctttcttgatcttttttatgggcagaactactgaaggtgccttcaagattattgcaaacagtcaaatcaaccaagcgcatgagccgcagtttttttnaaaccatttgaattctggtccgtggaatggtactcccttcttggctcgcttaaattcatgcaatctgtgttagaagagaaatatggtcggtgtactgtcgcaatgtaaggcaacgcaagggcatcctaacatattaggagaaggccgcaagggcatcctaacatatttggagaaggctgcgtcaactttaaggtcaactgctacccactcagattttgtttgttttaggctgtgtttggttctagagtctatttagatggaagatggagtggctctgttctaaattctaagtatagaatgattccgttttgtgtttggcagttagaatggagccactctgttttccatttgattctaaagtgaagcag

SEQ ID NO: 14697 - DNA, 2345 bp, Zea mays
gcagagcagcgcaggcgccctgcacctccactctgcagctctgctccccctccctctctcccgctcctcctccttttccttctccagctcggccgcctcagcccgcgccgcgatgtcagaggaggacgaggaccagccgccggccaagcgacccagcccgtcgccgcccgcggaccaggtgctcgacaacgtgctcgagacggtgctccagttcctggacgccccgcgggacaggagcgccgcctccctcgtctgccgctcctggcacagcgccgagtccgccacccgcgagtccgtcgccgtccgcaacctcctcgccgtgtcggccacccgcaccgcgcgccgcttccccaacgcgcggagcctcctcctcaagggccgcccgcgcttcgccgacttcaacctcctcccgcacggatgggacgcctccgccttccgcccctgggccgccgccgtcgccgccggggccttccccgcgctcacctcgctctacctcaagcgcatccccgtcaccgacgccgacctggacctcctctcccgctccctcccggcgtcattccgtgacctcaccctgcacctttgcgacggcttcacctcgcgcgggctcgcgtccatcgcctcccattgcaggggcctgcgagtgctcgacgtggtggagtgcgacatggccgaggagcaggaggttgtggactgggtggccgcgtttccgcaggagccctctaacctcgagtcgctctccttcgagtgttacgagccgcctgtggccttcgcggcgctcgaggcgctcgtggagcggtccccgcgcctcagacgcctgggggtcaatctgcacgtctcgctcggccagctgtgccgcctcatggcgcacgcgccgcgcttgtcgcacctgggcaccgggtcgttccggccggcggatggcggcgaggaggggacaggattcggggaggttgtctctgcattcgtggccgctgggcgagcgcgcacgcttgtttccctctccggcttccgtgacctcgcgcaagagtacctgccgaccatcgccgtggtgtgcgcccacttgaagagccttgacttaagctactccgcggtcaccccgaatcagattctgatgttcattgggcaatgctacaaccttgagacactatgggtacttgactcggtgcgcgacgaagggctcgacgccgtgggaatttcctgcaagaagctccagtctcttcgtgtgctcccgttgaatgcacatgaggacgccgacgagttggtgtcagaggttggccttactgccatctcacggggctgccctgctctccgttcgatattatacttttgccagaccatgaccaacgctgctgttgtcgacatgtcgcggaactgcccggagctgaaggtattccggttatgtataatgggacggcaccagccggaccatgcgactggggagcctatggatgaaggattcggtgccatcgttcagaactgcagcaagcttaccaggctatccacgtccgggcaacttactgatcgggcatttgagtacattggcaggcatggcaagtccctgcggacgctctccgtagcatttgctggaaacagtgatgtggcgctgcaatacatcctccagggctgtccaaagctagagaagcttgagataagggactgccctttcggtgacgctggcctcttcgccgggatgcaccatttctacaacatgcggttcgtctggatgtcaggctgcaacctgaccctgcaagggtgcaaggaggtggctcaggtgctgccacggatggtggtggagttgataaatggccagtctgatgagaacgaaaggaatgaaagcgtggacatcttatacatgtatcggtcactcgatggtccaagggaggatgttccaccgttcgtgaagatcctgtgaagctgcgcttctgcggagatggctgggtatcgctatcagtgtagtattcaggctgctgcacttgatatgctggctgagtgcagatcatttaacggaatatatatgtaagttgttgagctgcagatgtggtacatttttatctcttagaaagatttcgaagcactgtactggagcggggcgggcgggggtatcatgtagtaggagttcatcagatgtggtacatttttatctagtaggagttcatcagtgtatccaaagcgttcacggcaggaggactaagtgcagcagagcaggcttcttcgagggggcctcatggctgcctcagttttgtttgctgctctggagggggctctggtttgaggaccatattttctgtgccggtgcaaccaccatgttttccttcaaattttcgaaatgaaacctgtcatatcagact

SEQ ID NO: 14698 - DNA, 4387 bp, Zea mays
ccattgggtgttttattcgggtgctccattagagttagccttagtgacttgtctcctctacatttctccttatcttctacctccctaaatagcatgatgataccgtaataaatctaaagtacgaggagaagaaacaaccactttcttttttgcgctattttctcgggtgtatactcaatcatatgcacaattagctggttttaggttgacagttgaaatacacctaacagtaatgcatgggataagtgacatgctgctacatgtcaatgtcttagcattagggatctctctaggctgttggttcgagcctgtaaacagatagtacaaagtacagtctcccggtcagcactatataataaagatgaacatgggacaggtcaaagtgtattcccaccatgaaataaaatagtttatcgtcgcaaaaccctcgaggaaattaatatcctttcacgtacagaggttgatatgcatggagtcacatggcaccgtccagtgcgatatacagatatatatacattcttcttttgaaaaagtgtttgcaagttcgctggacaaatcaatcagctgagagagcagtaaaaagcatggaataaaaatcgagatttgacatcaatggtttcttcttcttttttccgttttgttttgcaagggcggaaaagatactcctgcctcgcaataccacgagaggcaaggtagggtgcagggaagtggccagtctgagctatttaccgcatctttcagcaaggtcgtaacttgctttgaatccagaggttcagttcagataacaaaatcagaatacctctgctggtcatcagtcgacacatcaaaagatgaagaaatcagaacacttgaattcactgtcagaacgatgcatgggtgattcagacagaaaaccatacccagctcagctgtgccctgcgaacgcgtggcaccttcgatgcgctcgagtcgcaaatgataagctgctgaggcagaatatgccgtgcaggaggaagtccggtccactgagaaaggcggcgacctttggcgccagttcccgttccgccgtgcgtgcaactgcaattgcaatattcgggtccgcgctgctctgctctcgcgacaccgtcgccgatcctgcccttttgaatctcgtgctaataaacaaggagcaggagcagccgccgccgctctcactggacagaaaggaagacggggccttgagacgatctgagatagcgagagatgactgcaggcaccgaatgctcattcaggtcattctgcacagctctagtctagtgtcagtatataggagggcggccagtgttgatcggaacatatcttcgagctgctgctgcagcatcgagtacttatgccttgttctcctatagagcttccttgccatgtcactcgaacttgtaaaaaggaaaacactgtggtttatggagtcaagccatgaagaggtcccaatgctgctgctctgacgaacatgggtttagccactcagcgttctgatgaggttaaacaattgcgtggcgctaagaatcccaatgcctttgactgacagccatccctgccccgaaaggccgaccaagcgcaataaaagatgtgggaagaaaccaaaaccaaaaacaaatgacctgtccgatctctcctactgaactggtttatcttcagcacctcgctttcacagtgtcgtttgcaaagttcggacataattaagcgatcttgatcaggctttagtattagtaacagacccgttttggtttatggattcatcagaaacaaatgccaggtagatgtttgtatacggagcactgtcaaattccgagcaggatagatacaccaaaataaaaaaagatgtctccttcaagcaaagcctacggctccagtgctaaactaggcggcaattcccgacaacgtgaggggcctcgtcagcataacgcaagtgggcggctgtcaggctgtggcccaatgaggccaccatcaccactactactcctcgagtcctcgtcgtcagtgaaaatgcgatcacgtgaaaaataaataaacccgggaaaagggagctggattgttacggtcgatttttttttttacctaacacttggaagttggaaagggtgagattaccagatctaccgcctccctgccactgccacagcacaaatgcacaagcggctgcgtcgactgactgactcaggcgaacacaagtacacctcacacccacgccccgcgcccccgcgtccccgcccccgtgggcagcccgccgcgcagagcagcgcagcgcagcgcaggcgccctccaactccgggctccgcaaccgctgctccccctccctccctccctccagctcggcctgcctcagcccgcgccgcgcgatgtcagaggaggacgaggaccagccgccgcccaagcggccgtgcgcgtcgccgcccgcggaccaggtgctcgacaacgtgctcgagacggtgctccagttcctggacgccccgcgggaccggagcgccgcctcgctggtctgccgctcctggcaccgcgccgagtccgccacccgcgactccgtcgccgtccgcaacctcctggccgcctcggccacccgcgccgcgcgccgcttccccaacgcgcggagcctcctcctcaagggccccccgcgcttcgccgacttcaacctcctcccgcacggctgggacgcctccgccttccgcccctgggccgccgccgtcgccgccgggtccttccccgcgctcacctcgctctacctcaagcgcatccccgtcaccgacgctgacctcgacctcctctcccgcccgctcccggcgtcattccgcgacctcacactgcacctctgcgacggcttcacctcgcgcgggctcgcctccatcgcctcccattgcaggtatatcttcctcttcctcctcggcgccatctcgatgtttggacttgactttcaacctgatgggttctcactctcaggggcctgcgagtgctcgacgtggtggagtgcgacatggccgaggagcaggaggtcgtggactgggtggccgcgttcccgccggagcccaccaacctggagtcgctctcgttcgagtgctacgagccgcccgtggccttcgccacgctcgaggcgctcgtggcgcggtccccgcgcctcagccgcctgggggtcaacctgcacgtctcgctcggccagctgcgccgcctcatggcgcacgccccgcgcttgtcgcacctgggcaccgggtcgttccgcccggcggaaggcggcgagggggaggcagagttcggggaggttgtctctgcattcgtgtccgctgggcgagcgcgcacgcttgtttctctctccggcttccgtgacctcgcgcaagagtacctgccaatcatcgacgtggtgtgctcccacttgaagagccttgacttaagctacgccgcggtcaccccgaatcagatcctgatgttcatcgggcaatgctacaaccttgagacgctatgggtactgaacctaccgtagactgcttcatcgacttgttttacctggttctgtgcgtgcgctccgttttgctgaagacttctttgctaccaggtacttgactcggtgcgcgacgaagggctcgacgccgtggggatttactgcaagaagctccagactcttcgcgtgctcccattggatgcgcatgaggatgccgacgagttggtatcggaggttggccttactgccatcgcacggggctgccctgctctccgttcaatactatattttttgccagacaatgaccaacgctgctgttgtcgacatgtcgcgccactgcccggagctcaaggtattccggttatgtataatgggacgacaccagccggaccatgcgactgaggagcccatggatgaaggattcggtgccattgttaagaactgtaggaagcttaccaggctatccacgtcggggcaacttactgaccgggcgtttgagtacattggcaggcatggcaagtccctgcggacgctctctgtagcgtttgctggaaacagcgacgtggcgctgcaatacatcctccggggctgctcaaagctcgagaagctggagataagggactgccctttcggtgatgccggcctcctctctgggatgcaccagttctataacatgcggttcgtctggatgtcaggctgcaacctgaccctgcgggggtgcaaggaggtggctcgggggctaccacgaatggtggtggagttgataaatggccagcctgatgagagcgagaggaaggaaagtgtggacatcttatacatgtatcggtcactcgatggtccaagggaagatgtaccaccatttgtgaagatcctgtgaagctgctgctggtagtatcatgctgctgcccttgatatgctagttgagtgcagatcattaacggaata

SEQ ID NO: 14699 - DNA, 1193 bp, Zea mays
ccactcaatctcatccctcaaaatcccccaccaaatctgaaccaattttattttggccatgtcgtcgtcttcgccttccctcctctcatcgcggctactctccccagccatcctcttcacaaagaagccggcttccctgcgctccatttcctctgcgacagcgagacacggggttcgggtggtggtagccgcggcgtcagcggccgcagcgacaccagtgtccgtggcgcgggtgcgaccgtcggcggcggaggtagcgcggacggtcgtggagcttgccgcgtccgggactctctccatggtgggcccagacggctggcctctcggcgtcggcgcgcacttcgtcgcggattctgccggtgcacccgcgctctgcctgtctgccgctcgggtcgccgcgcccgatgcgccggccagcttccacgtcgagtttcgacagagtggggctaggacaccacagtgcactatgcttggtgccttaactaagcctagtgatgaatctgtgttgaagaagctttctactaggtggcaaaagaaatttggggaagagattgatcaagatcttttgtatttaatatctgttgaccggatcttgcacatggaagatttcaatgaggatggcatgtgggtagttccatcagactacaccagtgcagaacctgatcctctacgcaattttgctgaaaacatcgtggaggaatttaacaacaaaaatgctgaagacgtccgtaggatatacaacatatatgtcgaatcagatttacaggtggcagacgtgaagatgatatgggttgacaggctaggtttcgatctccacgctcattctgcggaaggcgttttcgctgttcgggtcccttttcctagggaggtctccgacgagaagggggtgaaatcgtcgttcaacatgatgtctcatcatgcgtgggaggtggagaagagctacgcgagcccagagtttgagaaggtgcagttcttgaagaaggtcagatagcattgcgaattctgtttccgtggtggacgatctttcgttattgagaggagtgtagtttgaagttttgtttcctttatcatgaactgtttgtcttgtatattggtcatatttttttgtgcctaatacattggatgcaattggcatcttgaattatctgctagtaatttatttgagaagggcagtgagttttgaccgtaaggat

SEQ ID NO: 14700 - DNA, 2215 bp, Zea mays
agttttgcctgtggtcaatggtcgtcgcttcattggtcaaaccttgagagccccggttcagcaatcgcagttccacaaggcggcgatggacggcggcggggtcgatacggccacgacggcggcctggatggagaagcaccggcacatgtacgagcgggccacccggcacccgttcaccgtctccatccgcgacggtaccgtcgacatgtctgccttcaagcgctggctgagccaggactatctgtttgtaagggaatttgttgcattcatagcaagtgtactgctcaaatgctgcaagcaagaagacagctcggacatggaaatcatcctgggtggagtagcgtctatcagcgacgagatctcttggttcaagaacgaagctactgtatggggcgtcgatctagcaagtgtttcccccttaaaagccaatctagagtaccacaggtttctccggagctttactgagccagagattagctatgctgttgctgtaactaccttctggacgatcgaaaccgtgtaccaggacagctttggtttctgcatacaagacggcaacaagacgccgccggagctcctgggcacctgccagagatggggcagcgccgggttcagacagtactgccagtctctgcagagcatcgtggatcgttgcttggctaacgcaccggctgatgctgtccagagtgctgaagaggccttcgtccgggtactcgagctggaaattggtttctgggatatgagctcttctcggtcctaattaccagcgtgttctctgagtccaaacatctacgcaaataatcgaacgaaataaatggtgcttcgggctcagacccaggttttcccctcaaaaaaaaaaaaaaaactttggttttcgcgtgacagtactttccgctaggcctgggcaaaaagaaccggaaccgaggaaccgaaccgaaataaccgagaaccggaaccgaactaaccgaaccgaaggaaccgttatgaatttcggttctggttttttgagaaccgaaataaatgagatattttcggttctgcactccaaagaaccgaaagaaccgaaagaaccgaaaaacccaaaagtattagattcaatttgttacatgtgtttgtaacttcggatgttgtgttatcgacttatgttgaacctctaaccatccatgtattatctatgaaattatagtcattgtgcacttgttgttgtttgtggagagatgttgctgaaatttctcacaaaagttgtcgttattcataattttagagtggctgttacagttcggttagaaccgaggaaccgaaccgaagaaccgagaaccgaactagtcggttctaatttctttatcttgctatttcggttctagtttttgaagaaccgaatttctacaagaaccgaggaaccgaaccgaaccgaaccgaaccgaagaaccgaatgcccaggcctaaccccggctttggacgacggcgcaggcgggaggatctctgcctcgaaggtggtcgccagcactgcgctcgggcccgcggcgaccgcgtcgagcctctggacttcagccagggcggcttcatcttcgtcaggaaggcaatacccctcgctaacccgctctagatccacgacgtagtgggaagcaagcacggcgaaggcccgcctaacgccgtggtgtagcgcctcgcggagtctgccgcgcacgtgatcgtccaaggcctgcaagcgactttgaggggagcttcctgaggggacgtcaccgaagccaaagacccggcagaagtccgagatggcctcggacatggccgtgtggtcggcctccctctgctcggccgccccagcaagcgccctggtggactcatcaagggcggactcgagctctgcgaacggccagagcgcaaggcctcaaacacaagcggaggaaacaagctgaaacgaaaactgaaaatggccaggacatacctcctgctcgggcacgctgctccgaggctgcggcctgggctacggctaggtctgctgcaagggctccagcccggctttcagcctcggcagcctggccccgagattggtctcgctcatcggcgacctggtcgaactccgactgccgtcgttgcacctctgcgtgtgccgctgccgcctctgcgagtgccgctgccgcctctgctctcagatcggcgcagagcaaccgaaggtccaccacctcgacgccctgctgagagaggcgcgcaggac

SEQ ID NO: 14701 - DNA, 706 bp, Zea mays
caaaatccaaaaattaaataaaacaaaacaaaaactcttctcgcaatcttctcattctcaccactaatttcatttcatctacgaaagacacgcgcgcctaatcgcaaacaatggagagcgccattaatcgcaaactcgcccccgcgagtgagtgatcactcagacgccgatggcgatggccagcaacgccatggccagtgccgcgatggcgccgctggtggtgcctggcgcggcgctgccgccggttggggccggcgggctgggaggcgccggcgggggcgcgccctggccggcgaccctgacgaccatccgctggccgcgctcgcagtggccggtctcgccgctgatgaagtagacggggcccgggcggtccagcgtcacctccgtgtctccgttgttggagaagaagacggggtgcgacgcgcggcagctgtcgtagtcggcctccgtcaccaccagcaccgagtcctcgctgtacttgaagtggacgacgtcgccgacgaggaagcggttcttggatgcccactggttgtacctgccgccgtcgctggccggcggcacgacccacccgtcgtcgccgccgacctcgaacgcggtggcatcggcgcggggacacagcgcgcagccgaggacggccaggaggagcgcgagcggacggaggaggttgttggccatcgcgcgctagctcttcggatcagcagcgaat

SEQ ID NO: 14702 - DNA, 3386 bp, Zea mays
gaacagaagcaccgcgcggccggagacgccaaaaatacatcttcccggtccaggcaagaaatcagaattctccgctgaacaatccgtcgcatttgcgccccctttacggcgaatccgacatggggagggcgggatttctcttccttccccctcctgctcctcctcgccttcgccggccccggccccgcctccgcggcgacggccatgaccccggacgcgggcgtcatcttggacctcgccaagtcgctgaccaacccgccgccgtcctggaccggcaccgacgtctgcggcggcgtctccttcagcggcgtcacctgcaacggcgccgcccgcgtcaccggcatcaacctcgccaagctgcatttatccggcaccctttcctcgtccctcgccaatctcaccgcgctccaatcgctgcagctccaaggcaacgcgctggagggcgacctgccctccctggcccagatgggctccctcgagaccctcgttctcgacggcaacgccttctccaccctgccgccggacttcctcgagggtctcccctcgctgctcaagctcagtatggacgacctccctctcgagccatggagcatccccgacgctatcgcggggtgcgcgatgcttcagaccttctcggcctccaatgcctctgtctctggccccttcccggcggttcttgccaacctgacgtcgctacagacgctgcggctgtcgtacaataaccttaccggggtcctgccggtggggttagaggcgttgggctcgctggagacgctgcagctcaacagccagaggtcgaacggcatgctgtcagggccaattgacgttgtggcgaagttgccgagcttgaagacactgtggcttcagtccaactcgttcaccggcccgatcccggagtttgatcccaacacgcagctggagactttcaatgtcagagacaacagcctcaccggaccggtgccaccctctcttgtagggatcacaagccttcaggatgtggcgctgtccaataactttcttcaagggccaaaaccaaaattcgcagctaagactgtggatattgattctgggaacgggttctgtcacgaagaccctgggccatgcgatccactggtgaccactctgcttggggtggcttcagggtttggatacccattgcagctcaagaagtgggcaggcaacaacccatgcgatccatggcctggtctttcctgcatcaaaatggatgtaactcaaatcaaattgcctcgccggaacttgtcagggcttatttcaccggcttttgcgaacttgactagacttcagcggctggatctgtctaacaatcgacttactggggtaataccagatgctttgacgacactgaaaagtctcaattatcttgatgtctcaaataatcgccttactggacaagtgcctgagttcaagcagcatataaagctgatgactgcaggcaactcgtttggggaatcaggtggtgatagtggagggggtggctccaatgttcggtcctcatcttcaaatcctacaggttcacataactcaaagtcaaatgcgggaatgatcgttggaattcttctagttgtcattcttcttgtcatttgtgttgggcttttcctacatcatcgaaggaacaagaatgtggacaagttcagtcctatctcaacaaagagcccttctggtgaatctgaggtgatgaagattcaggtagttgggacaaatggccatagcaacataagtggttctgtaggctcaactgagctttacagtcattcaagtgctgacaacacaagcattgctgacctcttcgagtcccatgggatgcaattaccgatgagtgtgctactaaaggccacaaacaactttgatgaggactacatcttaggtacagggggctttggggtggtttttaaggggactctcaatgacaagctggttgctgtgaagaggtgcgacagtggcactatgggaactaaagggctgcaagaattcatggctgagattgacgttcttaggaaggtgagacatcggcacttggttgcattgcttggatactgcacccatggcaatgagaggctcttggtctatgaatatatgtcaggaggaacactgcgccagcacttgtgtgatcttcagcagagtggttatactcctcttacatggacacagaggatgacaatagctttggatgttgcccgggggatagaatatttgcatggtttggcgcaggagactttcattcatagggatctgaagccttcccactgggtgcctcgtcgccggccgggggccaaggtttcggactttggattggtcaagcttgcgaaagatacagataagtccatgatgacaagagtagcagggacatttggataccttgcgcctgaatatgccactacaggaaaggtcactacaaaagtagatgtgtatgcatacggtgtgatactgatggagatgattacgggaaggaaagtacttgatgactcattacccgatggcgaaacgcatctcgtaacgagcttccgaaaaaacatgctcgacaaagagaagttcaggaagtttttggaccccaccctggagctcagcgctgaatcttggaacagcctgctggaggtggccgatcttgctcgccattgcacggcgcgggaaccgtaccagcggccagacatgggtcactgcgtgaacaggctttccagcctagtggaccagtggaagccaaccaacattgttgatgatgacgatgaggagggtgggacaagcgagatgggtcttcaccagcacctagaaatatggagatgcgatgatttcactatatcggattcggattcattcagcgcacacaacacatcaaggaagtaccattgacaattagcgaggcttttttttgtcatacatacatataaatgaggaaccatggtgtggcacatcaagaggctccccagtccccacacgtctggatcacgaacagctttgaaggtcaatgtgccagccagtcaggttgtagttagcgcattgaaaacaaggttacttgataatcagcatcttcattcattgaatgtctgctaaccaggctcaaacttgagagggaagtcatgataccagaaaacttgtgctgtatctagcttagcctgtttatacaatttggtcactttggacactgagaaacattttgttcttgaatggtgaagagggaaaagagatgaaagaaaccatagcttcgccgaaggcgagttctggtggttagttttttaggatgtagagggttgccttttgtgtacaaccaaccatgatttcattattatttatctagtatctgtatttgctctgtacaaccaaccgtcaggattgttttcttcaaatacctgaacgtgcgaaacgatgcctcc

SEQ ID NO: 14703 - DNA, 2633 bp, Zea mays
  misc_feature (1990)..(1990): n is a, c, g, or t
ggagccctatcctcattttgtacactatttctaacattttatttactaaataacatgatataagacttaattgttggggctatagatgtttttatggccataaacattttaaatcaggtcttattttaatttttaggactcaaatgtaagacttcttgttgaagatgctcttaataactgctttatatgatccccagttccccacccctttttcagatgggttctgttgcaaccacttcatgagttttgtcttgccattttttactgtacaggatgttttatgcatccaaacatttgtttgatagtaataataatatgggggcgatacttcattcagtcataagcttgtgaggatgaacattgccaagcaaccaataccaacagttattcagttttctgctggtgatggctgatgtcaaaacatgactagtagtatatctggttagttttattccttgtaaacagtgacgaagttttgcaccatttagtacattggaatacactcaggacaccttactgaaataaaattagactggaactgatttcatgtatccatttatggatcgaccaagatgaaaaagacaggctgtcaaaaatcaattcttgaggtcttttcagccattgcccagagagttttttttaattggggctcaaattttatcctttttctatgggttttctacaaattcgttatttcagcattaattcttttggaaagaaatgccgagaattgtatgtgaacagttgttcccccccatgtttttgcattgtcatgtttttgatttgttccattttgtggcgtagtattgacaaacgtgccattgatatgtatacagctacaggaaaggtcactacaaaagtagatgtgtatgcatacggtgtgatactaatggagatgattacgggaaggaaagtactcgatgactcattacccgaggatgaaacacatcttgtaacgatcttccggaaaaatatgcttgacagagagaagttcaggaagtttttggaccccgccctggagctcagtgctgaatcttggttcagcttgctggaggtggctgatcttgctcgccattgcacggcgcccgaaccacaccagcggccagacatgtgccactgtgtgaacaggctttctagcctagtggatcagtggaagccaacgaatgttattgatgacgacgaggagggtgggacaagcgagatgggtcttcaccaacagctagagagatggagatgcggtgatttcactatatcagattcggagtcattcagcacatacaacacatcaaggaagtaccattgacaattagtgagtcctttcctttgtcatatataaatgaggaaccatgatctggggcatcaagaggctctctacagctatgtagatcacgaacagctttgaagggcaacgtgccagcctgtcaggtattgtagttaccccactgaaaacaaggttggttacttgaaaatcagcatatacattaatggctgctaacctggtttaaacttgagggaagtcgtgatacttgaaacttgtgctgtatctagcttatccagtttgtatcactgcctcactgggggcattgagaaacagtttgttaagagggaaaagacacgaaagaaaccatacttccgaaagtgcattctggtggttagttttttaggccgcagagggttgctttttgtgtacaatcaaccttgatttattattacttactccctccgtaccaaaataaaattcgttttggctaaaaaatgtgttcatataatacttgatgtatgtattatatatatatatgtctatatttattattatctagttgaatatagatataaagatcaagagctaaaacgaatactattttgaaacagagtatttgtatttgtatttgctctgtataaccaatcgtgagggttgctttcttcgaatacctgaacatgtaaaatgatgctacccaacgttcaagttgtgcgttaggttttttcgaantaaattaaggggttgccaacccgtacattcctataagagaacatatctggtgcacatggtgtacatattaaatcatcaccacttattttagatctaacgtctctagttatttggtatattttgctgaggacaccctccaatgtggtggtgtctagtggtggaaggtgttatttgtaaattaaatgatcaactagagacgttaatctaaaatgagtggtgatgatttaatgtgtgcaccatgtgcaccgatgcttcatgtgcaccagatatgtccccttcctataaaccaatctgtagaatattataccattaaacaattcgtagctcaatccttaaaacattgacatgagcacatgtacaagtgcaggaattgacatcattttttttctcgaacacgcaggagaactacatgtcattatattaagaggaaagaaaggtcccaagtggaccaagaaaacaaagtgcccgagaaggcagcaaacgagaagagggggaaaagaaaagaaaaaagagaagaacaaaaatgataaaaataaaagaaactagaaacaagagggaaaagggaggggggacaacccccaccacaccatctaaattaaggccacaaatatctaatatcttttgctcctgccattccccaaag

SEQ ID NO: 14704 - DNA, 1906 bp, Zea mays
gccttcctctctcctcccaatctcccattaccccagcggcccagcgtgcggagacgggagacgcgctccccagtccccacccccctctcgtgtcgtggcgacgactggggggctgtcgctgccgccctacgtcaggtggccaggtcgtattagggcacttcgccggcgacgagtaccacaaggcagtggacactttctctggtatcagaggatcaatgtccaattattatgatgactacgatgacattgacgggatggaggatgattatgatatggatgatcccattgatgacatggtagacgagcagcaagggattagggattctgatgtggaagataatgattatggacaaccaaatgataagatcccagatacttcatcagcagatgcaagaaaaggaagggacattcaaggaataccctgggagcagataaacataacccgtaaaaaatacagacagtccagattagaacagtacaaaaattatgagaatgtacctaactctggagaagaagctatgaaggattgcaaaccaacagagaaaggtgggatatactatgagtttagacgaaatactagatcggttaaatcaactattctacattttcagcttagaaatttggtatgggcaacgtccaagcacgacatctacctagtatctcattactcaattcgtcactggtcagcattgagtggtgtggatactgaacttatcaacgtccaaggacatgtggcaccaagggagaagcatgcaggaagtttattagaggggttttatcagactcaagttagtaccttgacagtcaaggacaatttactggtagctggtgggtttcaaggagagctgatctgtaaacaccttgatcaggaaggtattagtttttgctgtcgaacaacttatgatgataatgctattacaaatgcggttgagatatttaatacctctagtggcgccgttcacttcatggcatcaaataacgactctggtgtgagatactatgacatggagagattccagctattcaagcattttcagtttgaatggccagtgaatcatgcttcgttgagtcctgacagaaaggtggttgttattgtgggtgatgatcctgatggtctacttattgatgcaaactctggaaagacagttcattccataaaaggacatcgggactactcatttgcatcggcttggagccctgatgggcgaacatttgctaccggcaaccaagacaagacatgccgaatctgggacgtgaggaacctctcaaaatccgtccatgtgttgaggggtaaccttggagccatccggtccatccgcttcacctcggatggccagttcatgtccatggctgaacctgctgactttgtgcacatctacgacgtgaagagtgactacaacaaaaggcaggagctggacttctttggcgagatatccggcacatcgttcagcccagacactgacacgcttttcgttggtgtgtgggataggatgtatggcagcctgctacaatttggccgcctgtacaactactcgtatcttgactccctgttttgatgtggatccaaacgggtgttgaactgttgggttttggtgtacctcagtgctctgaatgttgtcagcataaattaggtggttatccctaatcaggatattaagttgcaaagataattgaattaataaatgttgtaccgtgcccgatgtgtatatgtaaaaagaaatgtatacatgtgcctattgagagaccgagttgagatgtgacttaggggttgtttgtttgggattataatctattcagattatataatctaatttatttgttttaggggttgtttgtttgggattataaatataatctaacttatttgtttgtttgtaaaccaaaataaaaaaaaaaaaaaaaaaaa

SEQ ID NO: 14705 - DNA, 1287 bp, Zea mays
gtaaaatatggatatggggagggtgtcaatgggtaatacccattacacccatacccactctaaacatgagagatggtgatggtgaaggagatatgcgggttcagtgaggcggagacggcaaggagaaaaggatggtgcagacaattgctgagtaggcatcagctagtcagccgaggccgggtgatgcacatcggcggcacggaagaatgccagcatcactgcccagcagttccctggcaacaacttatatctcagttctctgtgtgctctccatattgatcttttgttcaattgaatatcttctgttgatgtcaaatgcagcaccttgatcaggaaggtattgggttccgcgggcccgccccgtatgatgataatgctattacaaatgcggttgagatatttaatacctctagtggcgccgttcacttcatggcatcaaataacgactctggtgtgagatactatgacatggagagattccagctattcaagcattttcagtttgaatggccagtgaatcatgcttcgttgagtcctgacagaaaggtggttgttattgtgggtgatgatcctgatggtctacttattgatgcaaactctggaaagacagttcattccataaaaggacatcgggactactcatttgcatcggcttggagccctgatgggcgaacatttgctaccggcaaccaagacaagacatgccgaatctgggacgtgaggaacctttcaaaatccgtccatgtgttgaggggtaaccttggagccatccggtccatccgcttcacctcggatggccagttcatgtccatggctgaacctgctgactttgtgcacatctacgacgtgaagagtgactacaacaaaaggcaggagctggacttctttggcgagatatccggcacatcgttcagcccagacactgacacgcttttcgttggtgtgtgggataggatgtatggcagcctgctacaatttggccgcctgtacaactactcgtatcttgactccctgttttgatgtggatccaaacgggtgttgaactgttgggttttggtgtacctcagtgctctgaatgttgtcagcataaattaggtggttatccctaatcaggatattaagttgcaaagataattgaattaataaatgttgtaccgtgcccgatgtgtatatgtaaaaagaaatgtatacatgtgcctattgagagaccgagttgagatgtgacttaggggttgtttgtttgggattataatctattcagattatataatctaatttatttgtttt

SEQ ID NO: 14706 - DNA, 1821 bp, Zea mays
ttgggtccctcgaggccggccgggggcggccgtcgctcgctcaacgattcaggagtcaggacccttgtttgcctatacgctgccagcctgccttttctaagttcttcttccatcgctccacccccacccccttctctctcgtagcaacgtttggggcgccgtcgctgccgctctactcgggtgcccaggtcttgttcgggcccttcgccggcgagccaggggacactttctttggtatgagaggatcaatgtccaattattatgatgattacgacgacattgatgagattgaggatgactatgatatggatgatcctgctgatgacatggtagacgagcagcgaggggttagggattctgatgcggaggataatgattatggacaaccaaatgacaagatcccagatacttcatcagcagatgcaagaaatggaagggacattcaaggaataccctgggagcagctaaacataacccgtaaaaaatatagacagtccagattagaacagtacaaaaattatgagaatgtacctaactctggagaagaagctatgaaggattgcaagccaacagagaaaggtggaatgtactatgagttcagacgaaatactcgatcgattaagtcaactattctacattttcagcttcgaaatttggtatgggctacgtccaagcatgacatctacctagtatcacattactcaattcgtcattggtcagcattgagtggtgtcgatactgaacttatcaacgtccaaggacacgtggcaccaagggagaagcatgcaggaagtttatcagagggtttttatcagactcaagttagtaccttggcagtcaaggacaatttactggtagctggtgggtttcaaggagagctgatctgtaaacaccttgatcgggaaggtattagtttttgctgtcgaacaacttatgatgataatgctattacaaatgcggttgagatatttaatacctctagtggcgctgttcacttcatcgcatcaaataacgattctggtgtgagatactatgacatggagagattccagctattcaagcatttgcagtttgaatggccagtgaatcatgcttctttgagtcctgacagaaaggtcgttgttattgtcggtgatgatcctgatggtctacttattgatgccaactctggaaagacactccattccataaaaggacatcgggactactcatttgcatcggcttggagccctgatgggcgaacatttgctactggcaaccaagacaagacatgccgaatctgggacgcgaggaatctctcaaaatccgtccatgtgttgaggggtaaccttggagccatccggtccatccgcttcacctcggatggccagttcatgtccatggctgaacctgctgactttgtgcacgtctacgacgtgaagagtgactacaacaaaaggcaggagctggacttctttggcgagatatccggcacatcgttcagcccagacactgacgcgcttttcgttggcgtgtgggataggatgtatggcagcctgcttcagtttggccgcctgtacaactactcgtatcttgactccgtgttttgatgtggaaccaaacggatgttggactgttgggtttggtgtgccgcggttctctgaatgttgtcagcatgattaggcggttatccttatatcaggattttaagttgacaaagataattgaattaataaatgttgtaccgtgcccgatgtgtatatataaaagaaatgtatacatatgcctattcagataccgagttgagatgtgacttggtctactcgaaaaaaaaaaaaaaaa

SEQ ID NO: 14707 - DNA, 1759 bp, Zea mays
catttatccgagttgagccggattctggcttcgcgcatatttgcacatatttgcaaggaacatgtggtatttacatatagaggacaaaatatagaggacactgcgggatataaaaggagatataaatgagaatcttttaaaagagaaagaaccgatatagataattaatatagatggtgctgctgaagatagcttaatgcacactgcggaatctcacatctccttcacactagcagtagcacactttaaacaatgtaacttaaacttatgtatgtcgagtattgtagtggtagtattagactatctccatcatcttacccattcttatttccatatttaactctactatgtgaatagtgcaatatatacaatgtaaaacatagttttgagtgacaatatgagtgaacttggacatgcctgaatgaaaaataattaaagataaaattgtgcgtagtggaacactctacgcagcacggtaccgagatagcgtaaaacgtttgctgcagtggatcactgcatatagtaggctattttagcgtagtggtccatgaacggtgaatttggcgcagtacaaaaacaaccctatgtactacatataccaacgcatgtgtatgaaagagaaatgaaaaatataacaccaacttttcgaatattttttgtatgctagtttatttttaaactaaaatatgacaaataaaaaatagaaaaatataatagagttaaaatatgaagtaaacatgactattgagaattataatatatggtaaagaagtttgctgataagaatagaatattacttttacgcatgattactgagaattataatatatagttgtctgcacgcaaataacttcagttcaactcagctccgccgcgcgtgtcagccgatggaagagctgcgggccgccgtgacggcgcacttggaccaggtagcgggcctcgtgcaggcgctctcctccgagctccgccgcggcataggtcccgccgccgacaacctgcgcgccttcatccgcgccgttgactggacggagccatggctcatgtgcttgatggcattccatgtggttctgctgctcactgctgtagggttcaggaggaatgccaatttccagctattcttgttatttcttgcttattcaggagtgtatctagctgaaaagatgaacagatacctgggagagaactggaagagctttaccagtaggaattattttgatcgttctggagtttttatctctgtcgtctggtctgggccccttattgtcatatcgattgtcagtgtgattagcagcctcattgcattatgtcgattgatggtgaaatggaaaagagcagaacttaggcaccgggctcgacttgctcatgacaagaaggattgagagaagagaaaaaaatccttattatgggagaatcgaatgatttagtgattttgaacttttctaagtttgtatgccgcttgtcaacagggcactcaagaattaagtgttggaaatcctggataagcgaggagtgtctacagctattgttcctgctggtcactgtaggacagtagcagctagacatacttcataaaaaaatagatatggtacctgtctctatcttgttttagattgtagatgtaaacatggatgtaatcttgattgaaactgccaagatttgtagaacaaagcctcactgtttcgtttcccatcacaaatatgaaatatgagacgcggaagtgacacgagaaaaaaaaaaaaaaaaaaaggcccctagggcc

SEQ ID NO: 14708 - DNA, 3131 bp, Zea mays
  misc_feature (2699)..(2699): n is a, c, g, or t
aacactacctaacataacagtcaatgcattggatatatattaaattatgctgatctgtcaaaagatttttaaaagaaaaaggaatagaaaagaaaacgatgggcttttttatttgaggcccatctaaaagccattaattaaggagaaccctccaccacacccacgcgtttctttaccctaagcttttagctggtccaacgaaaggcacacagcccgacagccgccgctgtttcttcatcttcctcgcagcgccggcgctccttcttccgctccctctccgattcgcgctcggcacgcaggcgacggcggcggcgctcgtgctcgggctctcagcgacggcgggcagtcccagactcggtgtcggcgtcagcggtcccccttccgcctgtcaccaatcgcctcgcgccctcgcctccggtcctccgcacaccgaccggcgccctgcgtgcacgcctcccgctcccctcctgcctccggtggaccgtcgacggcgctcggacccggaggctgcactgcgcgccgcgtgcgaccggcgggcagcgggagccagcagccgcgccgctttggtagcgcttatacccccaaatgaatccttaccgtccgcttagctcttcagcgcgctgaagcgtgcgcttagtgccgatttttggaaccctgattgttgagtgttttgacatagtaactggtatatgtggtaaccctattgcattgatatatttttttctcgtgcatgtctggtatcctgaattaagtttcgcactatctacttttttgcaggctgtaacacattggtatttgaagaccattgcaggttgtaacacactgttatatctgaagaccagtggtgggttgacttaaaagcagggtttaaacatcacttttgtgatttgttctgcaatatctttgccatatcatggggtttcagaccataccagtcgtaccagaccttgtggtggataagagtgaggttgaaacctcacaagttgcgggctctgattcaatagtcatagaaagggtggaaacaaatctgagcaaggaaccctttctgctagttcccttggaaaataaggaagagaaagagtcccttggtataatttgttatcttgaaaataacaaggttgatgttcctgaggccttctctccaaggagagatatacttgaattgtcaatctctagcaagtctactgatgatagtctttcattgggttgtgagacaccacgtgaaagcatctttgatccatttgctccaggacctgaggaggcagcctgtgcaccaaagaagaaagtgactagaggtgctcaagttccacctcgcaggaagctaaattttgattcaggtgactacccagttaaaaggttaagtttcgattgcagtgattctgaagaggaggatcaatatatcgaagtgattcacaagatgatcctggatctattaattctagatgtccctcttggtggacaaaaagaaactggaaagaatgcgacagatttgggcctacatggaagctgcaagacacctgattcaaagcctctacttactggcattgcatccacatgcccagatgcacctttgaggccatctcttaaagcgttaaagctgagcccaggcatttgtcgaaagattgactttgacttcgatgcagtcagtggctcaggaagtctaagttcttccatggataaagaaagtaattgatcgttctgcccttcttgattgacaatgacaagtaatgaactgtgcattttgggactgaatgaagcatcgtgatgatcttccccaggaacagctttaatctgcatatttgcatctcatgtatcagtatcctatgccgttgtggcaccttagctaaccctgatgctttggggattattgctgatggtagacaagtacttaagtagcaagcagtttatgttatacatgtaatctatctctggttttcttttgtaactggccttgtgctaattacctcctagatttatatcagttgattcgagctctgaccatattattttgtaaatcttaagacgagacttattccatctgattaaagtaatgcacccgatgcagtttcttggtagctgttaaatcagctctgaccatctgacgcatgtttggccagtgaatgtttgcttggatgttcctcttgccattgcaacatcactatcctgttgcagtcttacgtccggtatttctttgtgccgtgatgcttggatgttcctcttttcattgggacattacaatccctcgttgcagtcttaaaagatggaccaactcaattcttaaaatcaaactccctatttgtgaagcattctacaaacaaaacaaagaaaaacagtgaaaacagagtagatgatagactaattcttaaaaccaaacagcctatttgtgaaacgtagcactgggctggctcgtgtcgtgttttttgttctacttctacatgtggttgagaattttgttctgattctgagacgaggaaggatcgtttggatttgatgagattcgggcgatgctttccatactattatagttcttctagattattgtattgagtatgcactaaccaatttaacacaaaaaattaaactgactagttaaaagttaaaacgcatatgtggcacgctcgtgtaaacaaaaaataaacataactgaggaggtgtttgatttctagagactagtctacattttattatctaaattatcnatatgaaaactaaaaattagtccatagaaaccaaacatcccctaaatactatctaattatttctatgatttttatttgaattttaagctatatagctagacctttagatgattgtagacgttctgtagtgagtgcaagagtgctcttgtaagaatccgtatatctatgaaaaaacattttctttagaaactataattttctacaggtggtggggctggggctccgtgtcgcgatcgggtgaatacaggagggcgcgatgcggaacgatgagactgctcacgtttttttggtcatgtggttgttgaggtgttgcaatttctgtgcaagtggacccgccccggatcatctttaggtcttgttcggttaatcccgttatctatggattgaatgtaattggaaaaaattgagaaaaaaactgacttgcttaggatt

SEQ ID NO: 14709 - DNA, 1918 bp, Zea mays
  misc_feature (447)..(447): n is a, c, g, or t
tattatcctattattctacactagatagttgtccctacattgatacgggtgctatatatcatataggtaggtcttacttaaatgacatatttattcaaacacgattatattttttattttcaaactattaatgtatatatatttacaatatctctcctttgtataatacaatatacacgatctacagtggttaagatgcgtgttttgttattttgagatcctattttttttattattttgggacgcccgcgggaggagacaacgcacgaaaatattaacgcattaaaagtgttagtgattagtgaagtgaagtgagttgcggcactagaagttgtgtgcccggaggattggaggcttaaactggagtagaaaagctgttgcaagcttttgcctaatcaacagctgctgctctcgtctcgaccctgacgaagacgacgtaggcgcatnttactagtgcgttagcagcgattcagcggttacgcagtttgtttggctttgctagcttggggtaggcaggtagtttggtcgcttcgagtttggcggaaacgtcctttccattttgcacaatgtttttagaatatatagatagatagagtaaaagtcgcttgctgaacttgtatttatctttctgtatttttggtatatacattcaaacttaccaatagcgctattccaataattaatgtcatgattccctttggtcacaggggataaagcgagatactcaaaagatcaaattaaaagagaatcaaaagtattcaacccaaaactcaatcctagcgttatatttggtcatccatccatacatatgcttcaaaatacatgcaaaatggcatcccttatacgtgcacgccggccatcggagttgacgaactgaaacctgcgacgccgaaaataatggaccgacgcgcaggtccgagtccgacggcgtctcccaacgcaacaccgtgcttgattccacgctcttgcgacctgcccctggcccgtctgcctctgcccttgcccttgccctgcccccatatatccaggccactgccaccccccccccgtaagcacaagcacaaccaaaagcaaagaagagacgaagtcgatcgatcgatctcagcaactaagcaggtaggtaggcatggcggccgagaaggagggcgcggtggtgaccaagggccacgacgaggggatgaaggcggcggcggcgctgctggaggagttcgggctcccgccggggctgctgccgctggaggacgtgacggaggtggggttcgtgcgggccaccggctacttctggctcgcgcagcgcaagaaggtggagcaccggttccgcaagatcggcaagcaggtgagctacgacgtcgagatcgccggctacgtccggcccaggggcatcaggaggctcaagggggtcaaggccaaggagctcgtgctctggccgcccgtccacgagatggccgtcgacgacgacccgcccaccggcaagatccacttcaagagcctcgccggcgtcaccaagaccttccccgttgacgccttcgccgccggccagtagccacccacgcgtaccatcttatatcactatagtaatacatcatacaccattatatatggcgcatatatatagtattaattaatctcttgtgttactaccttatatatatgttatgtgtgtacttgctttgctaatcctgatgatgatgaagcacgtaacctctagttttttgccgcccaaatataatgaaatgaaactgaacaataaaagtataatgccgtgctttttgatacactgctaccagcagcaccaggatcttgaatgcatgtagatatcgttcaggttctggaagcacaaattttgttagcccgcgaaacactagcaaactagattaaaaatgccttaaatcatctaactggtaaaccctcaatctaa

SEQ ID NO: 14710 - DNA, 1022 bp, Zea mays
cgaaaaaacctgtcatgttcacagaagaatcgtgatcagatttttagatcggggcatcttattcgtgccagcggcattcacacggaagtgcttgcatgtaggcgagacagagaaaccaagtgacgtgcgggtgaaaagactgttgcgagatgaacgacaaggagatgatgtgccaggagcagtgcgacgagctgtccgagaccgagatcagcagccaggaggcgtccaactcctccggcccggtcagcctcgacctctcgctctccgttaccgacaacagcaacggtaacaacagcaacagcggcggcgcgcaggccgacgccgcccgcgagccgtcccgcgtgttcacgtgcaactactgccagcgcaagttcttcagctcgcaggcgctgggcgggcaccagaacgcgcaccggcgggagcgcacgctggcccggcgcgcgctgcggctcgacgcagcgggcccctactacggctacggctacggctactacgccgacgtggcgtcgctgccgctgtacggctcctgcctgtaccccatcggcatccaggcgcacgcgtcggcggcagcgctcccggagcacgaggacgcgcgcgccggcgccgacgagctgaggaggcccgcgcgggggctgctgagccccatgccgttcctcgtggccgacgacgaggagatgctcttcggctggcccggtagcttcaggccagacgccgctgcgccggcggactcggccggcggcgtcgccgtgcacgcccgggaggagcccgatctgacgctcaggctgtgaactgcgaactgatccgtcgactagactggttaatccgtcaggctgtttcttttctttttttaaactgatcggtccatgtctggcgctggtcagatcgcggcggtctcttgcttgaccggattattcttattgtttcgtgggtgcgtgcaagaatttttgtacagcagttggatgtgcaagagctcgagatctctctttgttcgatgatcttgctatgctattgcacatgttcgt

SEQ ID NO: 14711 - DNA, 3884 bp, Zea mays
  misc_feature (2896)..(2896): n is a, c, g, or t
caggcctatgaaaagaatcagatgcttctcatgattgttgaacagaaaatcgaccactctggaaataggctaagattctccttcccctcgtttgctctttacgtcattatctgcatccagtttgcactggctactctttagctccagtttgcccaagattctttttctctaaaaaaaggtggtttagcttagtaattcagcaagcatatattttgtttccctactgacacatgacaaagtattactcaatggacaacctctagtgcatatggacaaacatgggccatcttgaggatcacttaagctgcaaggaattttagccaaaataatcatttgcgacaacatcctttttatcccatcttgaaataatcagtttgtcattggtttatctgaagctagtcataaactgttgatcaccaatctgcacaccagtaggcaaaccaatgttttttttttttttttaaaccactgggatcccccctccaagtttttgtgcatgaacacatctcataaagttgctttttctctacccttgaacacaaagcatgtttcatatctttcatcatggatccatgcatcggtgttcctgccttacctaacctgccatgttcacagaagagtcgtgattacatatttggatcagggcatcttattcttattagaggcattcacacacaagtgcttactagaatgagctggcgtgttgtctgcatgcaggtacggtgagacagcagagaaatcaagtgacgggtgaaaagattgttgccatcagtcagggatgaacagcaaggagatgtgccaagaaccgtgcgacgagctgtccgagatcagcagccaggaggcgtccaactcctccggcctggtaagcctcgacctcacgctcaccgtcgccgccgccgccgccgccgagtcgagcactaccgacaacagtaacagcggcggcacgccggccgacgcggcggcggtcgcccgcgagccgtcgcgcgtgttcacgtgcaactactgccagcgcaagttcttcagctcgcaggcgctgggcgggcaccagaacgcgcaccggcgggagcgcacgctggcccggcgcacgctgcggctcgacgcggcgggcccctacggctactacgccgacgtggcgtccctgccgctgtacggctccggcctgtaccccatcggcatccaggcgcacgcatcgatggcagcgcacccggagcagcagcagcggcacgaggacgccgccgagctgaggcccgcgcgggggctgctgagccccatgccattcctcgtggccgacgaggcggagatgagcttcggctggcccgggagcttcagaccagccaccgccgtcgctcctgcgccggcggggagcgccgtcctgaactcggctggcggcgtcgccgtgcatgcccgggaggagcccgatctgacgctcaggctgtgaagtgtgtgtgaactgatccgtcgactagactggttaatccgtcaggctttcattctctttaaattgatgatcggcccatggctgatgcagatcagaccgtggcggtctcttgcttgaccagattcttcctattgtttcgtgtgcgtgcaagaatttttgtacagcagttggatgtgcaagagctcgagatatctctctttattcaaaaaaaaaaaaaaaaaatccgtatgctatcgcatgttcgtacgcgttccagctgtgaaacacaatgcgccatggctgtgaaacacaaccgtcgtcggcgcgacagccgccatcgctaccgggcgttcgcgaagccgcagcggcgagcgagaggttagtgcttgtccgcggccaacacagaaatcggcggcctttctgcttggcctcaacgggcagcaacagaagctgcgactgcaacttgggagctggactcgcaacttgtgctggctgtcgactgtcccggactcccggtggtcaccccggcgatgctttcgacagcttgccccgtgaccccaccgtggccccgtgaacaaaagatatgcaagtggggaagcgaaccgtctgaagaggcaaatcttcgagggattccaatccgctagtggcgactgacaggcttctttgtccgttctttatacgcgctccaggctctgctgcctgcagtgcaggctgcagtggagtagtctgtctatcacgggaacattaaggcattaatatataaaaacaatgtttatatttatattttaaatagatattaatattttttttatatagagtaaaatacactgacggtccttaaatttgtagtgttgtatcatcccggtccataaactctcaaatacacatctaaagttcctaaacttgtgaagttgtatcatcttgatcccgaaactcttaacatgcacattacggttcttatacttgtatagttgtgtgtcatctatttctacctgtgatgacaccaaaaacaagagatgacacgaccatcgaagtatagagactaaaaatgtgcaggtagagagtttagggaccaaaacgatataacttcagaagtttatgatcttagatatacactttgggactttaaggaccacgactatacaacactataagtttaaggattgccagtgcattttactcttttatatatattgttgtgtaacaaccttagtgtagctaaagtaccaagagtggaacatagatcgacggtcatgatgaatctatgcacaaataaaagtcaacacacagttaattagaaagatttaggcaacactgtgtgtagtatcatacgacctattgctacttatcgattgataaatacaaaggtaaagaagatcacaagctcataaacaatcgagcatcaagtcttagctcgccctcacctcctaggtggtggaacttctagcttaatggtcctaatccatctttatatttggnctatatataaagtctataaccgtgaaacagatttggctagttttgaatcagtcccctttgggcttaactaaaatagtttggtgccccttaaatgttactatgtctctcccttttatagtgaaagaaagaagagaggttacataaaccttggattcccccgattaagctcaactatcatgttcttatcatgatctataaactgtaccaggggccatgacctcgacaatggcataatatcgaagatgtccttcaccaggcaattgtcatacctgccatatgagcacgtatgatatgtctcatctacgggtgttgagacccatgtcgtatagtatgatataggtggtagtcagtgtagacttatgtacttgataatattgttggaatatgtctgtaattatttttacatatttggaatatgccttggaatatgttttcatgtacgcctataaatatagatcctccttataacttatactctgcggttgatagtgaatatgtttcctcgtggttgtttgctctccatattggaggggacttttccacgtaaattgttgtgtctattttatttccctaacaagcagcggcggacctagaatttttatttagggtgtgccaaaacaaattttttatatacacttctatctaatgtatatctctgcttcttcatatttcatccattaaaaatagtgaatcgacaattaacaaaacaaaatttagcaataaaatatagattgcattatagattaaccaatgtatatttacactcaaagctaacagttaagccgctaggctttacaaatcacaataaaaaccttgggaatggggcattcggtatcgttgtgctggagaggtgctgctcgtcgcgtgctactctcctgttcccaacattcccttaaccgccccacaagatgaggcgtcaggcgtgtggccggctgaccgctggaagctccgacgcagctgcataaagatggccggctgggcacggtga

SEQ ID NO: 14712 - DNA, 1004 bp, Zea mays
agctacctctctctctctctctaggcatgctggcttcgaccacaaggtgagacagcagagaaatcaagtgacgggtgaaaagattgttgccatcagtcagggatgaacagcaaggagatgtgccaagaaccgtgcgacgagctgtccgagatcagcagccaggaggcgtccaactcctccggcctggtaagcctcgacctcacgctcaccgtcgccgccgccgccgccgagtcgagcactaccgacaacagtaacagcggcggcgcgccggccgacgcggcggcggtcgcccgcgagccgtcgcgcgtgttcacgtgcaactactgccagcgcaagttcttcagctcgcaggcgctgggcgggcaccagaacgcgcaccggcgggagcgcacgctggcccggcgcacgctgcggatcgacgcggcgggtccctacggctactacgccgacgtggcgtccctgccgctgtacggctccggcctgtaccccatcggcatccaggcgcacgcgtcgacggcagcgcacccagagcagcagcggcacgaggacgctgccgagctgaggcccgcgcgggggctgctgagccccatgccattcctcgtggccgacgaggcggagatgagcttcggctggcccgggagcttcagaccagccaccgccgtcgctcctgcgccggcggggagcgccgtcctgaactcggctggcggcgtcgccgtgcatgcccgggaggagcccgatctgacgctcaggctgtgaagtgtgtgtgaactgatccgtcgactagactggttaatccgtcaggctgtcaccttgtttctctttaatttgatgatcggcccatggctgatgcagatcagaccgtggcggtctcttgcttgaccagattcttcctattgtttcgtgtgcgtgcaagaatttttgtacagcagttggatgtgcaagagctcgaggtatctctctttattcaatgatcttggtatgctatcgcggggggcccggtacaa

SEQ ID NO: 14713 - DNA, 1866 bp, Zea mays
ggcagcgaggcagtagctgcagccggccgcgcccccatctcatctcgggggtcgcgccggccggccgggaatccgtttcctcaccaaatacgccacggcggcgcggcgcgctggctacccacaatggcgctcaccaccgcctccacggtctcctctccctcccgaatcatccgccgcttctcttcttctcaagactctcgccccccttcctcgctcctacatctcgccccgcgccgaggacccgggaattccccgcgcgcctgtagctggcaccggctcgttgtgcgccggatgggctgggcggcgcgagcgctcctcggcggattatcggacgccggcgccagtgagagcgacgaggaggaggagcacgtcctacgagtggggcagcgggagggcgagatcgacgacgccgtggagctctccgcggcggccgttgggccagagagatgggacgtgctgggcctcggccaggcgatggttgacttctcagggatggtggatgacgagttccttgacagattgggcatagagaagggcacgagaaaggtcataaaccatgaggagaggggacgggtcttgcgtgccatggatggatgcagctacaaggctgcagctggaggctccctgtccaactcgctcgttgcgctggcaaggcttggtagtagccagtctgctggctaccctgagcttaatattgtgatgggcggcagtgtgggcagtgacccactaggtagtttctacagggcaaagttgcgccgtgctaatgtgcacttcctgtctaagccggtcaaagatggaacaactggaactgtcattgttctaacaacgccggatgcacagcgtactatgcttgcgtatcagggtacttcgtcaactctgagttacgattcagacttggccagtttagtgtctaaatcaaatgtactaattgtggaaggttatctatttgagctgcctcacacaattgaagctatcaagcaagcgtgtgaagatgctcacaagaatggtgcaatcattgctgttactgcatcagatgtatcttgcatcaagcgttgctacaatgactttcgggacattgtaagaaactatgcagatatactgttcgccaacgccaatgaagcaagggcgttgtgcgagctaccctcaacagacagtcccatgtcagccacaagatacttaagccactccgttcccctagtatctgtgactgatggcatgcatggctcctacattggggtgaaaggtgaagcaatatacatccctccaccacaatgcgtggctgtggacacttgtggcgctggcgacgcatacgcttctgggattctgtacggcgtcctccggggtgcttccgacctgaaaggcataggacttttggcgtcacgggtagctgctgtcgtcgtcgggcagcaaggcacgcgactgcgggtccaggacgcggacagactggctggatcgtttgagcaccatctggatagcttggagttctgctcagatgtttgaatagatcactctgcaaacgtctggtctgattgtatctgttttttttcccaagccttagaaatctatatgtacatacatcacttccctaggtctagtacatttcatcagggcatttagccgagctgggtaaatcttgtgcgcccatttgatattactttccatctttgagcattgccatgattggaattacgtagatttcattgggcatggaaaatacaacggtatagttcatttcctgttcccattgaaaatggatggatgctatgttggtctggcctttctttatgtgtagtatgtaaaaggaactttgcggtccactgaaaccgcagtgagactgaaattacggtaatgcaatccggctttgtt

SEQ ID NO: 14714 - DNA, 1923 bp, Zea mays
  misc_feature (1901)..(1916): n is a, c, g, or t
agggagcgaggcagcgaggcagcagctgcagccggccgcgcccccatctcatctcgggggtcgggacctgattaccccaatccgtttcctcaccaaatacgccacggcggcgcggcgcgctggctacccacaatggcgctcaccaccgcctccacggtctcctctccctcccgaatcatccgccgcttctcttcttctcaagactctcgccccccttcctcgctcctacatctcgccccgcgccgaggacccgggaattccccgcgcgcctgtagctggcaccggctcgttgtgcgccggatgggctgggcggcgcgagcgctcctcggcggattatcggacgccggcgccagtgagagcgacgaggaggaggagcacgtcctacgagtggggcagcgggagggcgagatcgacgacgccgtggagctctccgcggcggccgttgggccagagagatgggacgtgctgggcctcggccaggcgatggttgacttctcagggatggtggatgacgagttccttgacagattgggcatagagaagggcacgagaaaggtcataaaccatgaggagaggggacgggtcttgcgtgccatggatggatgcagctacaaggctgcagctggaggctccctgtccaactcgctcgttgcgctggcaaggcttggtagtagccagtctgctggctaccctgagcttaatattgtgatgggcggcagtgtgggcagtgacccactaggtagtttctacagggcaaagttgcgccgtgctaatgtgcacttcctgtctaagccggtcaaagatggaacaactggaactgtcattgttctaacaacgccggatgcacagcgtactatgcttgcgtatcagggtacttcgtcaactctgagttacgattcagacttggccagtttagtgtctaaatcaaatgtactaattgtggaaggttatctatttgagctgcctcacacaattgaagctatcaagcaagcgtgtgaagatgctcacaagaatggtgcaatcattgctgttactgcatcagatgtatcttgcatcaagcgttgctacaatgactttcgggacattgtaagaaactatgcagatatactgttcgccaacgccaatgaagcaagggcgttgtgcgagctaccctcaacagacagtcccatgtcagccacaagatacttaagccactctgttcccctagtatctgtgactgacggcatgcatggctcctacattggggtgaaaggtgaagcaatatacatccctccaccacaatgcgtggctgtggacacttgtggcgctggcgacgcatacgcttctgggattctgtacggcgtcctccggggtgcttctgacctgaaaggcataggactcctggcgtcgcgggtagctgctgtcgtcgtcgggcagcaaggcacgcgactgcgggtccaggacgcggacagactggctggatcgtttgagcaccatctggatagcttggagttctgctcggatgtttgaatagatcactctgcaaacgtctggtctgattgtatctgtttttttcccaagccttagaaatctatatgtacatgtacatacatcactaaccttggttagtaggtctagtacatttcctcagggcatttagccgagctgggtaaatcttgtgcgcccatttgatattactttccatctttgagtattgccatgattggaattacgtagatttcattgggcatggaaaatacaacggtatagttcacaaaaaaaaaaaaaaaaaaccgccctttccattgaaaatggatggatgctatgttggtctggcctttctttatgtgtagtatgtaaaaggaactttgcggtccactgaaaccgcagtgagactgaaattacggtaatgcaatccggcnnnnnnnnnnnnnnnnaaaaaaa

SEQ ID NO: 14715 - DNA, 1058 bp, Zea mays
ttggtgaaatgatatttgtacatggttttgttcacggtgatccacatcctggaaatatattagtttctcctgaaggccatgggaaattttcactagttctgttggatcatggaatttatagagaattggaccaaaagttcagattggactattgtcggctatggaaagcactgatattgttggattcaaacaaaattctggaattaggcgaacagtttggcgttggcaaatatgcgaagtactttcctgtaatattcacagggagaactatagaaagcaagtcagctcttggcacacaaatgtctggtgaagagcagaggcgtctgaaggaggacttaaactctcttgggatggatgatatatcttcatttatggaatccttgccaccggacttctatgtcatactacgaacagacggactattgaggtccattttagggaatcttggggcaccacgccatgttcggcttctcacttatgcaagatgtgctatacacggtcttgagaagcagcacaaaatggagtctgatgttcaattgtgttcaggtgcaatcagacgtatgttcttgaatgtcaaaacaaatgtcagctatctccgtctgagagtgattattgaaatagcggtattattagctaaagcaaatggtgccaagcagaaagtcgtgaacaaactcagacagatgttacaggagaccagtcaaggttttcaccgccttatgtgatgcccagaagtcagcgacgtggtgaaattaaggctacgagaaaggtgggggaagttggaagtacgtcaggactccggagtagaatcataactgtgattgttctgtttcaacttgtaaattggaggttgtattgtgtcaaggagtccaatcataactgtgagtgctctgttgtaacttgtaaattctacttctacgtcgagtctgcgctcgagagtccaggtgtttttttttgttggaccaagtacgcatcccaaaataagtctacatctcagaattcgaggagtcaaacaacccttcccctgaagtttgcctaaatttataaaaatgaaaataaaa

SEQ ID NO: 14716 - DNA, 1992 bp, Zea mays
ccgccgccgccgggcaccgctcctcctggccgccgccggcgccggcgccgcgctggctgccacctctccctccggcgaaaatggtcgaagcgtcgcctccgcgctccaccaaggcatcgctcgctcctcccgttccgtctacacggttcgccctcccgtatctgttgctattactcctgagtttcggatgctgcttttgctcgattttctagccgttggctgtcgcagattggttttgtgatggcagattacaagtattcgctgaggggtctggatgctggatcggcggattaccgtgttaagctctccaaggttcatctgcggtcagcaaaaaaactacttaaactatgtgaagtgaatggagggttttatgtcaaagctggtcaatatgtatcttcactaagacaagtgccaaaggagtactcatcaactctctcctgcctgcaagaccaggcaactccatccaagtttcaagatattaaagcagtaatagagcagaactttggcaaggaattgtatgacatgttcatcgaggtcgattgcataacaatcaagatgtagctgtcaaggttcaatatcctggattggagcagcgaatgaagatagacattatgacaatgtcattctcgtcaaaaatggtctcttgggtttttcctgattataaatttgacagaatactaattgaatttgagaaatccatgacaatggagcttgattttacgcgggaggctaagaattctgagagaacagccagctgcttcaggaaaaatagtgttgttaaagtgccttatgtgttctggcaacttacaaccagggaggttttgacgatggagttttgttatggacacaaggttaacgacttggacttcctgcggaaaacagatattagccctacaaaggtagctaaggctttgattgaactctttggtgaaatgatatttgtacatggttttgttcacggtgatccacatcctggaaatatattagtttctcctgaaggccatgggaaattttcactagttctgttggatcatggaatttatagagaattggaccaaaagttcagattggactattgtcggctatggaaagcactgatattgttggattcaaacaaaattctggaattaggcgaacagtttggcgttggcaaatatgcgaagtactttcctgtaatattcacagggagaactatagaaagcaagtcagctcttggcacacaaatgtctggtgaagagcagaggcgtctgaaggaggacttaaactctcttgggatggatgatatatcttcatttatggaatccttgccaccggacttctatgtcatactacgaacagacggactattgaggtccattttagggaatcttggggcaccacgccatgttcggcttctcacttatgcaagatgtgctatacacggtcttgagaagcagcacaaaatggagtctggtcttggagatgttcaattgtgttcaggtgcaatcagacgtatgttcttgaatgtcaaaacaaatgtcatctatctccgtctgagagtgattattgaaatagcggtattattagctaaagcaaatggtgccaagcagaaagtcctgaacacactcagacagatgttactggagatcagtcaaggttttcaccgccttatttgatgcccagaagtcagcgacgtggtgaaattaaggctacgagaaaggtgggggaagttggaagtacgtcaggactccggagtagaatcataactgtgattgttctgtttcaacttgtaaattggaggttgtattgtgtcaaggagtccaatcataactgtgattgctctgttgtaacttgtaaattgtacttctacgtcgagtctgcgctcgagagtccaggtgttttttttgttggaccaagtacgcatcccaaaataagtctacatctcaaaattcgaggagtcaaacaaatcttaatttgaagtttggctaaatttataaaattggtattaacatt

SEQ ID NO: 14717 - DNA, 1205 bp, Zea mays
cggtccggaattcccgggtcgacccacgcgtccgcgcaccctcccgggccgccttctcttctccagcgtccgatctcccactcccctccctcaccgcagctctcccacctccgccctccccccgcacgcgctcgccacctcgccctcccctccacgttgctcgcacccgcgcttatataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaatggaggtatggaccttttctgcgacagctgctcttacctgaggcgattttttttgtcttagttatttactaagacaccttgcggtgaccattaaagagtaaccaatcgccctcaataggtccgtttttatctgccagaactgatgaggtcgctcactaggagtaagtcgcttccctgggaacggttgtcggctagcaccgctcttgtatgtatattaagagtaacttaatgattggtcttttggctgcgatttgattacatgtatttgtatcgggaggcataaatattgtgtaatttgtgttaaagactggtgtaattgaactatgggaagagctgctttggttgtaaccatattttgatgcccgtatattaggcaaaaatagaaggctgtgggcgtgcacaacaaaaaaaaaaaaaaaaaaaaaaaaagggcggccgctctagaggatcca

SEQ ID NO: 14718 - DNA, 1162 bp, Zea mays
cagccccgcatcgcaccctccctggccgccttctcttctccagcgtccgatctctcccactcgccttcctcaccgcagctctcccggctcggtcgcttcgccacctccgtcctccccccgcgctcggtcgctcgccacctgctctcccctccctccacgttgctcgcgcccgcgcttatataagtgcaggaggagctcatggcggacgctccggcgagccctgggggcggaggcgggagccacgagagcgggagccccaggggcggcggaggtggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctcggagttcatctccttcatcactagcgaggcgagtgacaagtgccagagggagaagcggaagaccatcaatggcgacgacctgctgtgggccatggccacgctggggtttgaggactatattgaacccctcaaggtgtacctgcagaagtacagagagatggagggtgatagtaagttaacttcaaaatccagcgatggctccattaaaaaggatgcccttggtcatgtgggagcaagtagctcagctgtacaagggatgggtcagcaaggaacatacaaccaaggaatgggttatatgcaacctcagtaccataacggagatatctcgaactaatgaagacatggaccttttctgcaacagctgctcttccccgaggcgggtttttggtcgcagttatttactaagtaagacaccttgcggtgaccattaaagagtaaccaatcaccctgggtaggtcaatttttatctgcaagaactgatgaggccgcttggtaggagtaaatcgcttttcctgggaacgattgttggttagcgccgctactgtatgtatattgagataccttaacgattggtcttttggctgccatttggttacatgtatttgtatttggaggcataagtatcgtgtaatttgtgttatgactagtgtattgactattgaattatgagaagagctgctttagttgtaagatcaaaaaaaaaaaaaaaaaaaaaaaactcgagactagttctctctctctctctctcctcgtgc

SEQ ID NO: 14719 - DNA, 1221 bp, Zea mays
caccctcccgggccgccttctcttctccagcgtccgatctcccactcccctccctcaccgcagctctcccacctccgccctccccccgcacgcgctcgccacctcgccctcccctccacgttgctcgcacccgcgcttataagcgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgctaaatctagcgatggctcgattaaaaaggatgcccttggtcatgtgggagcaagtagctcagctgcacaagggatgggccaacagggagcatacaaccaaggaatgggttatatgcaaccccagtaccataacggggatatctcaaactaatggaggtatggaccttttctgcgacagctgctcttacctgaggcgattttttttgtcttagttatttactaagacaccttgcggtgaccattaaagagtaaccaatcgccctcaataggtccgtttttatctgccagaactgatgaggtcgctcactaggagtaagtcgcttccctgggaacggttgtcggctagcaccgctcttgtatgtatattaagagtaacttaatgattggtcttttggctgcgatttgatttgactatatgtatttgtatcgggaggcataaatattgtgtaatttgtgttaaagactggtgtaattgaactatgggaagagctgctttggttgtaaccatattttgatgcccgtatattaggcaaaaatagaaggctgtgggcgtgcacaacatatttactgttcaccgaaatacttgtattgatgtatttccgcatcaattatagtcatcgtcagcttaactacggcaatgaataaataaaaattcactgagtaaaaaaaaaaaaaaaa

SEQ ID NO: 14720 - DNA, 1183 bp, Zea mays
gtcgacccacgcgtccgcgcaccctcccgggccgccttctcttctccagcgtccgatctcccactcccctccctcaccgcagctctcccacctccgccctccccccgcacgcgctcgccacctcgccctcccctccacgttgctcgcacccgcgcttatataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctcggagttcatctccttcatcactagcgaggcgagtgacaagtgccagagggagaagcggaagaccatcaatggcgacgacctgctgtgggccatggccacgctggggtttgaggactatattgaacccctcaaggtgtacctgcagaagtacagagagatggagggtgatagtaagttaacttcaaaatccagcgatggctccattaaaaaggatgcccttggtcatgtgggagcaagtagctcagctgtacaagggatgggtcaacaaggaacatacaaccaaggaatgggttatatgcaacctcagtaccataacggagatatctcgaactaatgaagacatggaccttttctgcaacagctgctcttccccgaggcgggtttttggtcgcagttatttactaagtaagacaccttgcggtgaccattaaagagtaaccaatcaccctgggtaggtcaatttttatctgcaagaactgatgaggccgcttggtaggagtaaatcgcttttcctgggaacgattgttggttagcgccgctactgtatgtatattgagataccttaacgattggtcttttggctgccatttggttacatgtatttgtatttggaggcataagtatcgtgtaatttgtgttatgactagtgtattgactattgaattatgagaagagctgctttagttgtaagatcaaatggagccccctatattaggcaaaaatagaaggctgtgggcgtgcacaacaaaaaaaaaaaggaggaaaaaaaaagggcggccgc

SEQ ID NO: 14721 - DNA, 2253 bp, Zea mays
ccacgcgtccgggggattccacatcgtaaccactgaagacgaggcggcggacgagacggagagcagaaccgcgcagcgaagcagcagcggcgacaagccctcgcgtcggtagaggcgccgtccgccgtccgccccctcaactccggtagccgctggccgctgcaggtcgagtcccgtcgagccgactcgcgcttcccgatctgggtggccgcggcgccggcatggcgcggttcgaggtgaacggcaagtcggtgcaaggcgtggacttgctgcggcggcgccactggccgtcgcgcctcgacttctggcccttccttgcactctatgcgctctggctgctgcttgctgtcccggcgctcgacttcactgacgctctcatcatccttgccgcgctctccgctgctcacattctcaccttcctcttcaccgcctggttcgtcgatttccgtgccttcgtcgggtactctaaggtcaaggatatccatgccgctaacacgtgtaaggtgactcctgctaagttctcggggtcaaaggagattgtacctctgcacaaacagaaaaatgtggcctcaacttcagctgcaggtgagacagaggagatttactttgattttcggaagcagaggttcatctactcggctgagaaagataactttttaaaactccggtacccaacgaaggagttgatcggtcattatgccaagggcactggttatggaactgaggccaagattagcaccgctgtggacaagtggggcagaaatgtattcgagtatccacagcccacatttcagaaattaatgaaggagcaaatcatggaaccattttttgttttccaggttttttgtgttgctctttggtgcctggatgcgtattggtactacagtttgtttacacttttcatgcttttcctgtttgagtctactatggcaaagaataggctgaagacattgactgagctaagacgtgtgaaagttgatagccagattgtgttgacctatagatgtgggaaatgggttaaagtccctgggactgaactactaccaggagatattgtgtcaataggccgctcaactagtggtgaagatagatctgtaccagcagatatgctattgttagctgggtctgcaatagtaaatgaagctattcttacaggagaatctactccacagtggaaggtttcaattgctggacgtggtcctgatgatatgctatctataaggcgagataagaaccatatcctatttggtggcactaaagtattgcaacacactgcagataagtctgtaaatcttcgatcacctgatggtggctgtctagcttttgtattgaggactggatttgagactagccaagggaaattgatgaggactatcttattttcaactgagagggttactgcaaataacaaagaaagtggcctgtttatactctttttgcttttctttgcaatcattgcgtccggttatgtgcttgtgaagggattagaggacccaacaaggagcagatataaacttttattgagctgttcgttgattattacttctgtgataccaccggaattgccaatggagctctccatagcagtcaatacatctttaattgcattggctcggcatggtattttctgcacagagccattcagaataccatttgctgggaaggttgacatatgctgctttgataagacagggactctgacatcagatgatatggaatttcaaggtattgttacatcggaaggtgatgacttaatatctgatgcaaataagctgcctctccgaactcaagaagtgctttccagttgccatgcactggtatttgttgacaacaagctggttggcgatcccctagaaaaggctgctataaagggcatagactggatctacacatctgatgagaaggccatgtccaaaaagcctggtggtcaacctgttcaaattgtgcacagataccattttgcttctcacttgaagagaatgtctgttatcgtccgtattcagcagaaattttacgctttcattaagggtgcaccagagaccatccaagagaaattagttgatttacctgctgcatatgtggagacatataagaaatacacacggcaaggttctcgggtcttggctcttgcatataaattgcttcctgagatgcctgtaagtttctgttgatattaatcatgtttgcctatagcctttcttatctagtattctgttattcttttgtcaaaaaaaaaaaaaaaaaaaaaaaaag

SEQ ID NO: 14722 - DNA, 1447 bp, Zea mays
agaagctggaaaaagcccaaacaaaaaggtcattgtctttgtccgcgtggacgcggctgacttgcgaacccaccggaccaaccaggacttggagcgtgcggcgtcggagttcgccggcggtgaggagcagaagaggaagggaaccaaacaaagatgggctgctccatctcggggctcaacgcgctctacgacgcggccacgggcggcggcgacgtctggatcaacgagcgccgcttccgcgtccttcgccagatcggcgagggcgggttcgccttcgtctacctcgtcagagagcaccagcccgcctccgatgcggcgttcgctaggcgtgaccccgcccacgtctcagaggatggaacgtatgccatgaagaaggtgctgatacagagcaaggagcagttggatctggtgagggaggagatccgtgtgtcgtccttattcaatcaccccaaccttctgccgcttcttgatcatgccataatagccgtgaagggagattggagccatgaagcatacctacttttccctgttcatctggatggtactttgtttgacaacgctaacatcatgctgtccagaagggaattctattccacagctgatgttctgcaaatattccagcagatgtgtgaagggctgaaacacatgcacagctttgatcctccatacgctcataatgatgttaagcctggtaatgttcttataacctggcgtaaaggacaagcacctgttgcaactttaatggattttggaagtgcaaggcctgcaagaaaggaaatccgttctcgttctgaggcactacagttgcaggaatgggccgctgagcattgctctgctccttaccgggcccctgaattatgggactgcccaagccatgccgatattgatgagaggacagacatctggtctctaggatgcactctttttgctatcatgtacaatgtttcaccatttgagtatgctcttggtgaatctggaggaagtctgcaacttgccattgtaaacgggcagttgaaatggccagcaggacccaaacctccttatcctgatgagcttcgccattttgttatctggatgcttcaacctgaagctgtaatgcgccctcacatttctgatgtggttcttcatgttgacaagctcattgcaaaatacttgccctagatcaccctggagttcctctcatttctttgttatacagtacagagccaatatgatgtaaaattggcccatgcttgacgtcattcagtccttggataggctcaatattgattcttttgtagaactttcaggatattacatcagtctaatgtctgtggatctttgatactcatggagtcacggtgtcatgtaaaaatgtcaaactgaacatcaaagcagctatatgatatccttgcacttgggctcaaaaaaaaaaaaaacgcccgcccggcggcgcgaaccggtaccc

SEQ ID NO: 14723 - DNA, 3168 bp, Zea mays
tcctctcgtctcctcgtgcgttgggcgccccggcgctcggctggatccactttcgcgtggcgcgcgcggtcgacgggaggtcccagccagccagcgagagagggagccggggccgggcggggcggcacctcgcgagatggcggcggaagcggacgacccgtcgctggcggcgaccctggagaagttccgcctctacgagacgcgcgcgaggttctacgtgatcgggagctcgcgggagaagcgctggttccgggtgctcaagatcgaccgctccgagccctccgagctcaacgtaagcgaggaccccgtctggtactcgctgcaggaggtcaagagcctcctccagcggatcgacgagggcaaccgatccaccgggggcctcgccttcgtcaccaaggcatacggcatcgcaggttgcatcaagttcctggagtcatactacctgattttagtcaccaaacgccgtcaaatcggttgcatttgcgggcatgctatatattgtatagatgagagccagatgatcaccatcccacactcatcagtgcaaacagatgttgcgacctctaagaatgagctgaggtacaagaagcttttggctagtgttgatctcaccaaggatttcttctatagctacacatatccaattatgcagagcctgcaacagagtgttacttctgcagggatgaaagaaatgccttatgaaaatttgtttgtctggaacacttttctgacagagccagtacgttcaaggtgccacaatactctctggacagtagctcttgtccatgggcacttcaagcaggtcaagctatcaatttttggcagagagataaatgttgttctcagctctagaagatcccgacacttcgccgggacacggtatttgaaaagaggtgtgaatgaccatggaaaagttgctaatgatgttgaaacagagcagatagtctttgaagaagaggctggttcctggaagggaagaatgagtgccgtagtacagatgcgaggatcaatccctctcttttggtcacaagaggcatctcgacttagtcctaagcctgatatttttgtgcagagatatgatcccacatatgaagcaacaaaattacattttgatgatctcgcccggcgatatggacatcctatcataatacttaatttgataaagactgttgaaaaaaggccacgtgaaatgatgctcaggcgtgaatattgtagagctgttgaatatcttaatcaaaatgtcccagaggagaagaagttgagattcatccactgggattttcataaatttgctaaaagcaaatctgcaaatgtactgggtgttttaggaaaagttgcgggtgaagcactggacctcactgggttttactacagcggaaagccaaaagtccagaaaaaaaggttaattcagcttagtcgaactagcactgcaagggatggctcccttgatataagggccagttctggagatctttcaaggctcagggatggctcccttgatataagggccagttctggagatctttcaaggctctctagtaatgctgaggcacttagttctacaggctttcaagatatgagaaatcaggctaacaaacaagagtttcttggtgatactccctgttaccaaactggagtgctccgtacaaattgcatagattgcctggatcgcacaaatgttgctcagtatgcatatggccttgctgctttggggaggcaacttcatgcaatgggactgacagatgttttaaaaatccaccctgatagcagcattgcttctgctttgatggaaatgtaccagagcatgggtgatgcacttgctcatcagtatggaggatctgcggcacataacacggttttccctgagaggcaagggaaatggaaggctactactcagtctcgggagttcctgaaatcaattaaacggtattacagtaatgcctacactgatggtgagaagcaggatgctataaatctatttctggggtattttcaaccacaagaaggaaaaccagctctttgggagctggatactgattactatcttcatgtgacgacagctggggatgatcttatgtctgatagctaccacttgagttctgcacctggaaataatgtgttcatggggtctggagctgcaatgaaccctgggaccatattgagccctgtcccagcatgcaaagaggatttctcacggaagaagcttacttcgttcgacaaacttatagaaagaacatgtagttctataaggaatgtaaggcttcattgtgacgctgatctaaagccaagtggaggtgttggaacttctggaatggcaccagatgcagctgagatacagcttaaaagccccaactggttgtttggtcaaaggaagcatacggagacaatttcaaccgcaagagttgccccggttgaaaacgtgaacgaggggaacagagacgagtcaaatgtgtctctttgtggggaactaatttggctatcctcctcagttgaatcatgcgaggaggacattttcagaaggtaccttgcattcacgacagcggatgtagagaatggctggtatggcggaacactgctatatgaccgagatgaaaacagcggggcttacaggcactattctgagctctgccagggagctgtcatggatccctttgagcatgaccctgagaaagagcggcactacgcggaggcccttagcgtggatctcggcgatgcacgggtggaggccgaaatgcaggccgcgctggatgactaccaggtcatagggtcggacctgagcatcatcccttcgtgcggagcactcgcagaggacccgagccagctgacgaggtggatcattggagatgagaggctgcttgtgggtgctgctgcgcagtagaccggtggggttctgtcttctactcttctgtggaaggttgtacagagcaacagattgccattcaccgacccagcctttgtgttttatagatacttccctgaaacaattactccatgtatttagcagcaggtgttttatagacacttccctgaaacaattactccaacacgtgcatgcaatttattgttgtgcagcaggtggtattgctgctgggattagctttggcaataatagttgattgttgtgcagcaggtgtttgatgtcataaaaaaaaaaaaaaaaaacgcctg

SEQ ID NO: 14724 - DNA, 796 bp, Zea mays
aggaagcatacggagacaatttcaaccgcaagagttgcgccggttgaaaacgtgaacgaggggaacagagacgagtcaaatgtgtctctttgtggggaactaatttggctatcctcctcagttgaatcatgcgaggaggacattttcagaaggtaccttgcattcacgacagcggatgtagagaatggctggtatggcggaacactactatatgaccgagatgaaaacagcggggcttacaggcactattctgagctctgccagggagctgtcatggatccctttgagcatgaccctgagaaagagcggcactacgcggaggcccttagcgtggatctcggcgatgcacgggtggaggccgaaatgcaggccgcgctggatgactaccaggtcatagggtcggacctgagcatcatcccttcgtgcggagcactcgcagaggaccagagccagctgacgaggtggatcattggagatgagaggctgcttgtgggtgctgctgcgcagtagaccggtggggttctttcttctgtggaaggttgtacagagcaacagattgccattcaccgacccagcctttgtgttttatagatacttccctgaaacaattactccatgtatttagcagcaggtgttttatagacacttccctgaaacaattactctaacacgtgcatgcaatttattgttgtgcagcaggtgggtattgctgctgggattagctttggcaataatagttgattgttgtgcagcaaaaaaaaagaaaaaaaaaaacacgagggggggccgggtaccc

SEQ ID NO: 14725 - DNA, 1483 bp, Zea mays
gactcataaatccttgaccaaaacccgacttcaagaccacttcactactagagttgacctcatcgcttacatatcccactcatgcatggcagtgcgcatgatcactcacgcaactatcagattcagactgcacgccatggcaagcaacacagctgctctcctcctcctgctgctgctatctttccagctcatcgccatgtcgctgtctcaaactcagctgtccactcaggacctcccggctcttatcaagatcaggcagcagctccccgccccggacgcgctcgcgggatggcggcccgactcgctctgctgggggtggtggcccgcggcctgcaacgagcagggccgcgtcaccaagctcttcctcgagcgactcaacatcacgtccacgctcccgccggccatcggcgagctcgaccagctggagacgctcagcatcatcgagatgccgggcctgggcgggcgcatcccggactccttctgcaacctccggcacctctcactattcaacctcatggtcacctccgtgtcgggccccatcccggcgtgcctctcccgcaccaacctcacctccgccagcttcttccgcagcaagctcaacggcatcatccccgggtcgctctggaagctcccgtacttcacctacttcaacgccgcctacaacaacctcgtcgggcccatcccgccgctgctggtgcacggcggcacgcccgaccggccgctgggcctgatgctggacggcaaccggctcagcgggcctatcccctggacgttcgcgctcgagaggcacctgctgcagttcagggtggccaacaacaagctcaccggcgacccgtcgttcctcttcgggcggcgcaagacggtgaccggcaccatcgacctgtccgggaacaatttccggttcaacctcaccggcgtggagatgcccatgcagctgtctttcctgaacctgagccacaaccggatctacggcggcgtgcccgtgtcgctccgggacaccagggtggcggtgctggacctcagctacaacgacctctgcgggaagatacctaccggcgggcatatggtgcagttcaaggcggcggcgtacgagcacaacaagtgcctctgtgggacaccgctgccaccctgcgcgaacggccgctgagatgaagatgtcccttagatcctctgggctgtgggattaacatgcattagaggctaagataactaggtaatgttggtcccctcggtaaaaatagtaccactgccgccggttagcttccagtcctatctgtgtctgggcaaatccaataggtttggcccaattaatcttcgtaatggtgtacgtctgaagcaaataatggaaaagcggtggcgtggttatttttattttatcctaaaaacataagtatattaaaaaagatatcctaaactaaattattcgaaactatagcatatttaaatcatgcaacacctcgtgcgactgttaaccttgatcatc

SEQ ID NO: 14726 - DNA, 1029 bp, Zea mays
ccttgcccgggaaatgatgcctcccagccgaagaagaaaaacatctcacgccacgcctgctgcagcacctcgctctccgctccgttggccccatggagtccgtcgcgtccgccgcgatcgccaccacctcccgctctctcccgctccccttctcttctaccccggtccaccgccggcgccgtgccgccttcctccccgttgccgcctccaagcgtcacgacgacgacaaggaggccgcgaaagggtccggctcggaaccacggcgcgagcctaccagcctcgcgccgtacggactctccatctcgccactctccaaggacgcggccatggggctggtggtgagcgctgccacggggagcggctggacgacgggatcggggatggagggcccgccgacggcgagcaaagccggtggggctggcaggccggaggtgtcgacgctgccttggtccctcttcacgaaatcaccgcggcggcgcatgcgggtggccttcacctgcaacgtgtgcgggcagcgtacgaccagggccatcaatcctcatgcctacaccgatggaactgtgtttgttcagtgctgcggttgcaacgtgttccataagttggtcgacaacctgaacctgtttcatgagatgaagtgctatgttggcccagatttccgctacgaaggggatgctccattcaactaccttgacagaaacgaggatggcgacagtatcttccctcgctaaagcctaaagcctcccttatgttgcagacttgcagtacccaaaaaaatgatcggtcctgttctaatttgttcgtgtagctgtacttaataagcagatgtaccttcatgaacctgtaagactagtttatcatacgcatagatgaccagtcactagaatctacactggagttgtaatgtcggtgaccagttagtgtaattttctattgcctgtctgcttttgggcatataataaaaaatttgacctgcatttcgtcaacaaaaaaaaaaaaaaaaaaaaaactcgaggaagggccgcggtaccc

SEQ ID NO: 14727 - DNA, 1021 bp, Zea mays
gtcccgccgccggcccgggaagaagaaaaatctcacgccatctgcacctccctcctatcggtcgccctctcgccgacgccacccatggaggccgccgcgatcgccaccacctcccggtctctcccgctccccttctcatctacccagctccagcgccggcgccgtgccaccttcatacccatcgccgcctccaagcgtcacgaagacgacaaggagaccgctaaaggttccggctcggaaccccggcgcgagcccactagcctggcgccgtatggcatctccatctcgccgctctccaaggacgcggctatggggctggtggtgagcgccgccacggggagcggctggaccacgggatcgggaatggagggcccgccgacggcgagcaaagctggtggggcgggcagaccggaggtgtcgacgctgccttggtccctcttcacgaaatcaccacggcggcgcatgcgggtggccttcacctgcaacgtgtgcgggcagcgtacgaccagggccatcaatcctcatgcctacactgatggaactgtgtttgttcagtgctgcggttgcaatgtgttccataagttggtcgacaacctgaacctgtttcatgagatgaagtgctacgtcggtccagacttccgctaccaaggggatgctccattcaactaccttgacccaaacgaggataacgacactaccttccctctctgaagcctaaagcctcctttatgttgccagtacaaaattggtcggtgtcgttctaatttgctcgtatagatgtacttaataagcaggtgtacgtaccttcatgaacctgtaagattgttcagatgtatataattctacttagtgcacacaggtagtggataataatggatagacgaggaagtttatgcattcggctttgtgctccaggagcctgtagtgtgtgaacatgatatgtatgaatgtattatatatctcaagtgtgtttatggagtataaaaaaaaaaaaaatacatacatatttgaaaaaaaaaaa

SEQ ID NO: 14728 - DNA, 1040 bp, Zea mays
aggaagaaaaaaaatctcacgccatctgcacctccctcctatcggtcgccctctcgccgacgccacccatggaggccgccgcgatcgccaccacctcccggtctctcccgctccccttctcatctacccagctccagctccagcgccggcgccgtgccgccttcctacacatcgccgcctccaagcgtcacgaagacgacaaggagaccgctaaaggttccggctcggaaccccggcgcgagcccactagcctggcgccgtacggcatctccatctcgccgctctccaaggacgcggctatggggctggtggtgagcgccgccacggggagcggctggaccacgggatcgggaatggagggcccgccgacggcgagcaaagccggtggggcgggcaggccggaggtgtcgacgctgccttggtccctcttcacgaaatcaccacggcggcgcatgcgggtggccttcacctgcaacgtgtgcgggcagcgtacgaccagggccatcaatcctcatgcctacactgatggaactgtgtttgttcagtgctgcggttgcaatgtgttccataagttggtcgacaacctgaacctgtttcatgagatgaagtgctacgtcggtccagacttccgctaccaaggggatgctccattcaactaccttgacccaaacgaggataacgacactaccttccctctctgaagcctaaagcctcctttatgttgccagtacaaaattggtcggtgtcgttctaatttgctcgtatagatgtacttaataagcaggtgtacgtaccttcatgaacctgtaagattgttcagatgtatataattctacttagtgcacacaggtagtggataataatggatagacgaggaagtttatgcattcggctttgtgctccaggagcctgtagtgtgtgaacatgatatgtatgaatgtattatatatctcaagtgtgtttatggagtatatttgtgtaaaatagagtaaagaagatttctggagtagatttgtaaaaaaaaaaaccttagactctct

SEQ ID NO: 14729 - DNA, 1763 bp, Zea mays
agtttaatatatatggagagacaaataaagagtcaaaaataaagagtctcttgaatgtgataagattttttttatgttttagcttttacatgcaagtttagctgtttttgctccgtttatcctgcatggttcgaatgttgctcatttaactctcctggctgagagagcagcctatggagatactactaattaagcaaatcaaacgtacaaattcataactttgcttctcaatcgatcatgcactttgtataaattaagctactacgacatgccatgcatatataccttggcagcataatataattaatgacatatatatatatatatatatatatatatatatatatatatagtatatatattatggtatctgaaatgtgtcacatcatccataatgacagacatatggtatcatcaactggaccattgacacacacactagctagcagctagggtaacaaaacaacaaaaaaacccagcctagcagctgctagctattgctactacctcccttctccatccgctccaagttgccatgcgcgctggctacggatgatgactactacaacaagtcgatcccagcagtagaagctagctagcatcgagatctgctggctccggcatatcatcgatccccggccggcccgctgtagagcaagcaaatggccaagtactactggggtatgctgggcgccgcaaccaccacgacccgcgctggtactggtagcagcctcatcaggtccacctggccacctccggcagcgcatggcggcggccgcagcggcgagccgtcgtgggaggagctggccttcgcccaggacgcggcggggcaactcggcggctgcgtctggccgccgcgctcctacacgtgcaccttctgccgccgagagttccggtccgcgcaggcgctgggcggccatatgaacgtgcaccgccgcgaccgggctcgcctccggcagtgcgccccgccggatcatgaccaggagccgatcgccgcgcctcttccagcgccggaattggcggatcaccagcagcagcttctgcaactgcatggatctcccatgaccaaggcggcagtattattctctggccgccctgctgctgcttgctgtactcatcagcaaacttattgcaataacaacagggagggggagggggaggattctcctgctcggtacatatcaacgacgacgaccatcatcaaggagagcaagagcaaggtactcatctccatacctgcagcaacgacagcagcggggagcaaaaaagccgctactactatagcaatcatcggtgaggaggaggaggaggaagaagaagaggaagagatcatggtgacggggcggaggacgaaacgaaggcggctagtccatcagccgttctacgacctgcggcggcttccgccggcatcatcatcacccaataaaggaggagttgaagatgatgatgcaaaggtacccaaattaagcagccctagtagcctcagtcatcatcttgcaggccggcaagaagaagtggatctggagctcaggcttggcactagctgctagctagtcgcgatcggccgtccgatccctaaattaagttgcgtgaatggatccatatatctctcttttcacttcaccataactaagatcgagtgtgtgcgtgcacaactgaatcatatatatcatctgctgctgcttgcttcattcatatatcatatatatatagtatgctcctcgtgataccaaaaaaaaaaaaaaaaccccagggcctctctg

SEQ ID NO: 14730 - DNA, 2416 bp, Zea mays
gccgggtgcggtgtgtgtgtgtgtgtgtgtgtgtgtgtcaccgagggtccgaggcggtcctactccctctgtcttggtgtcttcttgcgccccccgcccggccgggccggccctcacggttccatctccgggtccttgggtctggatggaactggagacacggtagaggagcccgcggtttcccttttcccctcccaacaaggtattcctgggttcttgcttgcctttcgagctctgcgggattgacaattctgacaggaccggcgtggaggaagggttgatagggaggattttttggattgatctataagccttttggtggctaacggttgggagctttggaggagaactcgagtccttgggctctaggttggtctggacgaggccggaggaagttgccaatggagccgccgactgggttctgggcctcgcttctgagcttcctcaagttcctcccctacttctgcggcctcctcgtccttggactcatcaaaggtgttttgttgtgcccttgggcatgtctgattatggcgattggaatatctgccctggtcctgggcttatggcctatgcatctgatttggacatactactgcattgtcagaaccaagctggttggacctgtggtaaagcttctgcttcttattgctgcgactgcagtcttgatcatatggttgataattggcatcccgggaagcatatttgctggattggtatatggttttctagcacccataatggctacatttgatgctgtaggagaaggcaaagaaaagccatttgttcattgctttgtggatggaacatggagtactatcactggaagctgtacagtagtcagggacgtgaaagatttgcttttccactcctatttttcacttatggatgaccttcgtcttcagaaacctcctgacggggagccatatgagataagattgcttgatattcctggtgcactaatagcggctgcatttgggcttctacttgatggaataatgttcacattaattgccttctataagtgccccgtgatgcttttcaaaggatggaaacgactgatccaggacatgattgggagagaagggccctttctggagactgcttgtgtgccatttgctggtcttgctattcttctttggccatttgctgtagtaggagccgttctggcatccatactctccagtgcccctttaggtgcttatgctgcagttgtagcttatcaggaatcctcccttatcctgggaattgcctatgtgttctcgtcggtgtctatatttgatgaatacacaaatgatgttcttgacatggcgcctggttcttgttttccaagatttaaatatcggaagggcaaagatgagtcttcacacgggcacagtgttccattatccagaccagcctcattcaatagggagaagcaagaagggaaaaggcctccgtctcgtgttacttcatttaagaacagcattgatgatttcaatccattcaagctgctggaccacctatttgccgaatgcaggaaccagggggaggatttggttaacagaggagtgataacaatgaaggacattgaagaaacgaagtctggcaaagttggcagcggtgttcttaatgttggtctaccagcgtatgttattcttaatgcactccttcggtctgcgaaagctgattctgtcgggctaatcttaagtgacggctctgagattacatctgacaatagacctaaaaacaccatctttgattggttctttgaccctcttatggttataaaggaacagatcaaagctgagaatctcactgacgaagaggaagagtatctgaaaatgcgagtgctattggctggtgatcccagtcgcctgaaaggctctctgcctcatgttccatccttgactgaacgtaaaaaggcagatatagacgcattcgctcgcaggttgcaaggaatcacaaagtcgatatctagatatcctacatcaaagcgccgcttcgacgtccttgtgaaggcgctcttgtcagagctggagaggacgatgggccaatctggcaatggatcccagtcccaggcgcagaggctgcgaaactcggtagcccggatgttgagccagaaatctatgggcaagactgccaacattagggatgaagacccagaagcgcagatgacgagactgtctcgcaccccgtgatcgtctgtttgttagtttgacgatgccgtatcacatgctattccagccttgtacaaatgatgagtagatagaatgctgcggcttgaactgatgctcttacatctcatgtatgatctgtatattttaggcactatatgtatcgtgtatgcaatgtttttttgctcccgaaaagagtatgcacagaggagcacaataaataccaatctcaaacaacaaaaaaaaaaaaaaaaaggccccta

SEQ ID NO: 14731 - DNA, 2190 bp, Zea mays
ttttttttttttttttgttcccgaaaagagtatgcacagaggatcacaataaatcaaaatctcaaacaacagcaaatacgcaatcctcaacggataacaccgacgagcatgtgttttagacaagttgtgggaggttaagctacaacaattgcaaagcacacctgctttggggctcgcatgaaacttgcaccgtaccaggtggataattgcaaaaggttgacgcatgttcaaccccgaagaccatccgtgggctggctatcaggcacaatggtgtcatcatcgtctaacagctcctccagcttctttcttgccttcttatagctacgggaaccacggaggatggagctaatatgcagaccacctttgagactcttctgagatagtgatatggcaccatcatcatcggaagcctcgctttcatcataggctgtagatgaaatacctgagtcagcagaggtagatgaactatcagatgatccttccatgacagtcgtggtgtccaattcatcaccacaaccctccctgatagagtcattggatattgcaccagagcctattttcctactagcttttttggagtttccactggtctcttgatacattttacttgggactttctggactgaaactttatatcggttagcactttgtggcataccctctgtgctgtcacttgacgctcctgggctcgtggaaaaatccttcataaggttgcttacagtcttaggatttggagccacctttcccttgatagtaaactcatcaggctttctaatcttagcatggggctttggctgagaagtgaatttccccacttctttacttatatgtgcatgatccttttcagtgagcaacttgttttgatcatcatcaacactctggtggagattcttctcaggagtatgattccaagtgggatcttctcgtccatgttgcattatactggcattctgagtaactttactgttgctctcttttccattttcctgacccatcctttcattttgtacaaaagaaataagtgattcttgggtactaatatcaattccttgattatcacaattagaattgtccttttcagcagtaggtacttccatattagctttgccctttctcttcttctccttgccgtcattcacattctcattttctatgttcatgctttcttttgcaacagatggcacaatagctttgctggtaccaaaatgaccagttaagctagctttctctgagggaaaagattctagaatgtcatttggttcaatgctactagtaccttgcttccatttcttctttttattcttcatttcccttaaaggttcatcttcattgttttgcttactttctgcagcaattgatggatcatgattcatattgctgcagctaaaatgatcgaggaaattgattccatcattagcacgatgaaacacggtgcggtaatcaggtttaatagcactagcagaacttgtagtgctaacttccctttcagtcctgctgttcaccaaatctgcagtgaaaccatgttccagggcacaatcctgactttgaagttcagaattcgaagatgttttcctttgcttttgagaattagggttggcagatttgagaaccattgcatatttctgaacttcatgcaaggttggagttcctgcagcattttcattatcatgggtttcaatgatgtcagttacatacacaccctggttgtccttagttgtgtgactatccagcccatgagtagaacaattagtttttcgtattttaggagtcagtatctgagaagacttgcctttctgctctacttccccaacagtgcttaaaggagtgtcaactacataacctccctgaaccaaattttcttctgcatcatttgtttccttcaatgccaatgtatcacatacctgcttaacagaacccttcttcctttgacgcttagtggttttgcgcttatcatcagcttgtgcaaccacatttccagttactatatcctcaggatcacttgttttatcagcaaacctcaaagaatcagattctgttaattctctattagcatcttcttcggatacaccacttgattgatgagaagagtcagtcatggttgatagcactttcgattttttccccttagacttcttttgtctaggtgagctaacaggagaagcaaagtgaaccgctgcaggcatgcaagct

SEQ ID NO: 14732 - DNA, 1464 bp, Zea mays
tcgtccacgcgtcagcccacgcgtcctcattaagattagcaaaattgtgggccagcagcaggagcgcccccgtctccctccaccctcctctgtcagggtcctccgagtcggacttcctcacggccgccgcgccaaatcccgtctcgttgctccggtccgctgcgcatcctcaggaatggaacttggcgccaccactgccctctaccctctgcaccgctgcaaaaccatttacctggtcaggcatgcccagggcattcacaatgtcgcgggggagaaggactttggcgcgtacatgtcacatgaactgttcgatgctcagctcactcctttgggttggaaccaagtcgatggtctgcgggagcatgtgaagaaaagtgggcttgcagaaaagattgaattagttatttcttcccctttactgaggactatgcaaactgcagttggtgtctttggtggtgaaaagtatactgatggtgtaaatgcacctccactaatggtcgaaaatgccggacacagtggccgtccggcagtttcaagtttgaactgccccccatttattgcagtcgaaacctgcagagagcacttgggtgtccatccctgtgacaagaggaggagcataacagaataccggcctctctttcctgcgattgatttttcattgatagagaatgatgaagatgttctttgggaaccagatgtgagagaaccaaatgaggctgtcgcattgaggggtatgaagttcatggactggttgtggacaagagaagagaaagagatagctattgtcagtcacagtggtttcttgtttcacaccttaagcatgtacagcaaggagtgccatccaaccataagagacgaagttagcaagcactttgcaaactgcgagctacggtcgatggtgttggttgacagaagcatgcttggatcatattcctcaagattcaactatgctggcaagaatccaaccggactagatgtgcctagtgatattgcagataagaagcaggttgacgaagctcagaagaactgaggcaacctcgaaagcataccatatatgacttggattatcaagaaattctgacctttgcgaagcttgtttgctttgaagaggacaagctaagagggcatctacagatagagtttacgcataccattttgttagtcaagttgaactacgcagcaatgtattagcatgtctgctcttttgtctcagcctacattgagattcagggccttggactacgattatctatttatgataataataaccggatcacctacattcaccaggtgatgcatggccaaagttctcttggtttccgagctgttctagtctaaggataaaacctaggggtggctgtacaacgtccacggctccacgcaattccgtctcatggattgtgacaaaaccgatcgatgtatggttttggtttgtgcagattacatttgatggctgggttcgct

SEQ ID NO: 14733 - DNA, 824 bp, Zea mays
gtggatataccgctgcttgaggctgcttccgctatgttttgtactgattattttgtgctagtttccatgtactgatgatctctcacagagttgaatacttttttcctagaaagggtctaatgcaggaaacagcagaacctcttgcatgtaggtcggggcctgtaaaggcagtttagcttggtctatgagtggactagttactcactctatcattatatctggatttctgcccattgtttgaacatactttcaggttgtggacaagagaagagaaagagacggctattgtcagtcacagtggtttcttgtttcacaccttaagcatgtacagcaaggagtgccatccaaccataagagacgaagttagcaagcactttgcaaactgcgagctacggtcgatggtgttggttgacagaagcatgcttgggtcatattcgtcaagattcaactatgctggcaagaatccaaccgggctagatgtgcctagtgatattgcagataagaagcaggttgatgaagctcagaagaactgaggcaaccttgaaagcataccgtagatgacttggattatcaaaaagccactctgacctttgcgaagcttgcttgcttgctttgaagagggcatctactacagatagagtttacacataccattgcgttagtcgagatgaactacgcagcaatgtataagcatgtctgctcttttgtctcagcctacatttgagattcagggcattggactaagatcgcctatttatgataataataataataataaccggatcaccccacattcaccaggtgatgcacgtcaaaattctatt

SEQ ID NO: 14734 - DNA, 2168 bp, Zea mays
gagtgttgaatttatgggagtggatataccgctacttgaggctgcttccgctatgctttgtagtaattattttgtggtagttttcatgtgctacctctgttctcgaatattagtcgccggctaattcattttgaactaaaacgcgacaaataaaaatgaacggagggagtactgatgaactctcacagagttgaatactttgtactaggaaggctctaatgcagaaaaagcatgtaggccggggcctgtaaaggcattttagcttggtcgatgagtggactagttactctatcattatagctagattaatttgcccattgtttgaacatactttcaggttgtggacaagagaagagaaagagatagctattgtcagtcacagtggtttcttgtttcacaccttaagcatgtacagcaaggagtgccatccaaccataagcgacgaagttagcaagcagtaagtgtcttgacgttgacttattttttccctcagtaactgttaactagctatcacacattcacaacagtggcaatgttcaaagtgacagaggtacagtgatacacatacacatcatattagtatatccacagattctgttgtttgttcattctattatgtcgaataggttaacctttcagttctttgtttttctgtccctcactgtactgatccttgcactacaacttaaaatgtttagccatgtttattagatgtagtacaaggatgtgtcgttaactttcagttggtattctgcagctttgcaaactgcgagctacggtcgatggtgttggttgacagaaggtcagttttggcacctcatttgtggatatggcatgcactgcttttgttttgcgcttatatttcaaatatatgtgtcttagccttattttgttatcatttttccacgatgcagcatgcttgggtcatattcctcaagattcaactatgctggcaagaatccaaccggactagatgtgccaagtgatattgcagataagaagcaggttgacgaagctcagaagaactaaagcaacctcgaaagcataccatatatgacttggattatcaagaaattctgacctttgcgaagcttgtttgctttgaagaggacaagctaagagggcatctacagatagagtttacgcataccattttgttagtcgagttgaactacgcagcaatgtattagcatgtctgctcttttgtctcagcctacattgaggttcagggcattggactaggatcatctatttatgataataataaccggatcacctacattcaccaggtgatgcatggcaaagttctcttggtttccgagctgttctagtctaggggtggctgtacaacgtccacggctccacgcaattccgtctcatggatggtgataaaaccaatcgatttatggttttggtttgtgcagattacatatgatggttgggttcgctggattatggccttgcttatttttattatttttgtcaacttgcttgtttttattaattttctgtttttacactagtacttgaacgcagtggaggtgagcctggcgtgaggtatcaaaatgcatcatttcatatggttgtatttataaatgtgtgattggattcgtgagtatacattagaagatattatcattataagttggtactataatgtcataaattattatttgaaagtattgaataaaaaaattgtgtgaaaaacgacactacaaattacagcttattagatgggccgttttttttgtttgggacatacactagcctgtactgcgcatgtaatgtttttttatggaaaaaggaagttaagttaggccttatttggttacaagagatgaaatcccacattggatttaatctgaatctagattaggtgaattcatggctcacacttaatcccatggtgaaattaaattcatcatttatatccatgtatctctcaaaactagttattattttgatctatagattttaatataaatttgtgcaatatctttatgtatttgtttcatatctaatgagctatggatcgaatccatgccttctatagtttaaaaattttacaaacccttagattataatcaacgatgagttcaaccgaataaaaaaatttgagtaggcttgtattattttggagcatggattgtgatatggatttaatttca

SEQ ID NO: 14735 - DNA, 1608 bp, Zea mays
gagttagaagaggagctccgggccctcggcccggcccggcccacttttattttttatttcacagtcccattctgatcctgtggacagtgggttaataatagtaataaaaatgataatccacctcctctgcttcccaggcccagcagcaggagctcccccgtctccgtcctcctccgcctctgtcagggtcccggtcggacttcctcacgaccgccgcgccaaatcccgtctcgttcctccgttccgctgcgcatcctcaggaatggaacttggcgccaccactgccctgtaccctctgcaccgctgcaaaaccatttacctggtcaggcatgcccagggcattcacaacgtcgcaggcgagaaggacttcggcgcctacatgtcacatgaactgttcgatgctcagctcacccctttgggttggaaccaagtcgatggtctgcgggagcatgtgaagaaaagtgggcttgcagagaagattgaattggttattacttcccctttactgaggactatgcaaactgcagttggggtctttggtggtgaaaagtatactgatggtgtaaatgcacctccactaatggttgaaaatgctggacacagtggacgtccagctgtttcaagtttgaactgccccccatttattgcagttgaaacctgcagagagcacttgggtgtccatccatgtgacaagaggaggagcataacagaataccggcctctcttccctgccattgatttttcattgatagagaatgatggagatgttctttgggaaccagatgtgagagaaacaaatgaggctgtcgcattgaggggtatgaagtttatggactggttgtggacaagagaagagaaagagatagctattgtcagtcacagtggtttcttgtttcacaccttaagcatgtacagcaaggagtgccatccaaccataagagacgaagttagcaagcactttgcaaactgcgagctacggtcgatggtgttggttgacagaagcatgcttgggtcatattcgtcaagattcaactatgctggcaagaatccaaccgggctagatgtgcctagtgatattgcagataagaagcaggttgatgaagctcagaagaactgaggcaaccttgaaagcataccgtagatgacttggattatcaaaaagccactctgacctttgcgaagcttgcttgcttgctttgaagagggcatctactacagatagagtttacacataccattgcgttagtcgagatgaactacgcagcaatgtataagcatgtctgctcttttgtctcagcctacatttgagattcagggcattggactaagatcgcctatttatgataataataataataataataaccggatcaccccacattcaccaggtgatgcacgtcaaaattctattggtttcctacctgttttaaaacctaggggtggtttctgatgaatggcaacaaagccgagcgatgtcatggttttgggttgtgcgctgtatttctgatttctggttcagagataatgcaggccggcccattaaccagtgttactaaaaaaaaaaaaaaggacggcgcggcggccattccggtaccggtacgtgcaggc

SEQ ID NO: 14736 - DNA, 1488 bp, Zea mays
ctcgaggccggccgggaatgccggccgggaccagtggtgtgatgtcactgattctgatgataggattcatcgtcgtctcatccgtccgccccttgggatgatctctagcagtgcatccctttctctgctctccggttattaaccttccataccactcctgcttcgcccgcacactcctctcatgccccaatccacgcgcaggaatggaacttggcgccaccactgccctctaccctctgcaccgctgcaaaaccatttacctggtcaggcatgcccagggcattcacaatgtcgcgggggagaaggacttcggcgcgtacatgtcacatgaactgttcgatgctcagctcactcctttgggttggaaccaagtcgatggtctgcgtgagcatgtgaagaaaagtgggcttgcagaaaagattgaattagttatttcttcccctttactgaggactatgcaaactgcagttagtgtctttggtggtgaaaagtatactgatggtgtaaatgcacctccactaatggtcgaaaatgccagacacagtggccgtccggcagtttcaagtttgaactgccccccatttattgcagtcgaaacctgcagagagcacttgggtgtccatccctgtgacaagaggaggagcataacagaataccggcctctctttcctgcgattgatttttcattgatagagaatgatgaagatgttctttgggaaccagatgtgagagaaccaaatgaggctgtcgcattgaggggtatgaagttcatggactggttgtggacaagagaagagaaagagatagctattgtcagtcacagtggtttcttgtttcacaccttaagcatgtacagcaaggagtgccatccaaccataagagacgaagttagcaagcactttgcaaactgcgagctacggtcgatggtgttggttgacagaagcatgcttgggtcatattcctcaagattcaactatgctggcaagaatccaaccggactagatgtgcctagtgatattgcagataagaagcaggttgacgaagctcagaagaactgaggcaacctcgaaagcataccatatatgacttggattatcaagccattctgacctttgcgaagcttgtttgctttgaagaggacaagctaagagggcatctacagatagagtttacgcataccattttgttagtcaagttgaactacgcagcaatgtattagcatgtctgctcttttgtctcagcctacattgagattcagggcattggactaggatcatctatttatgataataataaccggatcacctacattcaccaggtgatgcatggcaaagttctcttggtttccgagctgttctagtctaggggtggctgtacaacgtccacggctccacgcaattccgtctcatggatggtgataaaaccaatcgatgtatggttttggtttgtgcagattacatttgatggttgggttcgctgtattaaaaa

SEQ ID NO: 14737 - DNA, 1295 bp, Zea mays
  misc_feature (231)..(231): n is a, c, g, or t
ccacgcgtccgcggccttgcaaacctttcaatccattgcttggggaaacctatgaagctgattaccctgaaaaggggatccgtgttttctctgaaaagggcagtcatcatcctatgggcatggcatgtcactgtgaggggaaaggggggaaattttggggagacagcaatctgaagagcaaattctggggacaatccattcaattggatcctaatggggtgctaactttanaggttgatgatggagaaattttccaatggagcaaggggacaacaacaattaacaaccttatccttgggcgagtatattgccatcaccatgggacaatgaacataagggggaatagacgatattcatgcgagctgacttttaaggagcagtctttccttgatcggaatcctcgccaggttcaaggagtcgtcaaggatgctggtggaagcaaggttgcaacattgacggggaagtgggatgaaagtgtgcattgtgtcatcaacaatgatgcctctaaggtgaactctcatggtccacatcagagttctggttccactttgctatgggagaaaaatgagcctccagtcaatcctacccgctacaacttgtccgcatttgcaataacactaaatgagttaacaccagagctcgaggagaagctgccaccgacggattcaaggctgagaccagatcaacggcacctggagaatggggagtacgagaaggccaatgctgaaaaactgcgcctcgagacacagcaacggatggcaaggaagatgcaggagagtggctggaaaccaagatggttccaaagggacagcgaggatggaacgtaccgctacgtcggaggttactgggaggcaagggagcagagaacatgggtcggctgcaatgacatatttggtaacttgtctagcagccagaagctcccaccatccgctctctacacgagctgaagtatataggggtgggtaaggccggaagggcatgttcagtagttgttgacatcgcattaaccagagggtttttctctcgtttctgttgtgttaagctgtgagctaacatgtttttcttgtcaattgtcacattgaagccaaggacatccaagcataacccaaccttttgtcgatactaggatacttatgagagatcttgtggacattattgcgaaaagaaatgtcgatgatactattttcttctttgcattccgcaaggacgtgtctgcatgtggcccttatgttgtcgtgcttttgtgtgtttatctcgcattggtgatgctgttcaaggttgccgtatggtggcta

SEQ ID NO: 14738 - DNA, 706 bp, Zea mays
ccagtgaattccgttgctgtcgccgttgctgtcgcacagatgaaagcaacgttgtgaagagtatttaagctttattggcactcttccacaggatgttgaggtagttaattcagtagattcaactgtccctgagaagccacggctagagctgttcaagcatgactgctccagctctggaaaatgtagtgaatatagcaacacagaatcttctgatgatgttggcaagcaagagattagtgaactatcagacggagatgaatttcatttctatgacacaaggcaaagtttcagtgaatttgcttctagtcctgctgacccgagaaagggatgtttaaacaacggaaatgaagatgataaatctgttgaatcattgacggttgacaaggctgagaaatatatgctgtcacattcaaaaaggcgcttacagttgcctgaaccagacagaaaggagaaaggagttagcctttggtcaatgatcaaagacaatgttggaaaggatctaacaagagtctgtcttcctgtttactttaatgagcctttgtcttctctccagaagtgctttgaagagttggagtattcttatttgttggatcgtgcatatgaatgtggtttaagggggaatggtctgatgagaattctttatgttgctgcatttgcggtctctggatatgcgtccacagattcccggccttgcaaacctttcaat

SEQ ID NO: 14739 - DNA, 2113 bp, Zea mays
cgggcccccccgccggaggccgccccggcttctgaagggttcggcagaggggacaaggggcccaggttcgccgacctcggcgggatggaggcggtgatcgaggaactcatgatggaggtggtcgtgcccatgtgccatccggagataccgcatcgccttggcgttaggcctgtcgcggggctgctgctgcacgggccgcctggctgccgcgcgtccgcccttgcccatgccattgctaatgagactggcgtgccgttctataagatctccgcaccggaagtcgtatctggggtgtctggagcatctgaggaaaacatcaggggcttgtttcagaaggcctatcggactgccccctcgattgtatttattgatgagatagatgcgattgcatccaagagggagaatctacaacgagagatggaacggcggatagttactcaattaatgacatgcatggatcaattccaccagaatattggatcgggcagtggcaatttggaagctgaatcatctgaaaagaaacctggttatgttattgtcattggagccacaaataggcctgatgctgtggaccaagctctgcgaaggccaggcaggtttgaccgagagatatcacttggtgttccagatgagaatgcacggaaacaaatactgaagatgcttactcagcatctccgacttgaaggcgaatttgacttgttcaagatagctagggcaacaccagggtttgttggtgctgacttgaaagcattagtggataaagcaggaaatctagcaatgaagagaataattgatgaaagaagggctcggtgttgcattgagcaggacggtagtagcaagcatgactggtggagacaaccttgggatgaaagtgaggtggacgaactacatattaccatgaatgactttgaggaagcagcaaaaatggttcagccatctttgagaagagaagggttttcttctgtccctggtgtcacatgggatgatgttggaggtcttgattcattaagaaaagagttcgaccgctgcattatccgttgtatcaagcaccccgaagactatgaggtatttggagtgaatatgcaagctggcttcctgctgtttggacctcctggttgcgggaaaacactaatagcaaaagcagtggcacatgaggcaggggctaactttattcacatcaaggggcctgagctactgaacaagtatgttggggagagtgaatcggaagttaggaaaatattcactcgtgcgcggactaactccccatgcatcctgttttttgatgaggttgatgctttgacaacaaaaagagggaaagagggaggatgggttgttgaacgtctcttaaatcagttacttatagaacttgatggtgctgatcaaagacaaggtgtctatgtgataggagctacaaacaggattgatgtgatagatgatgctgttttacgtcccggtagatttggaaagaaacattatgtacctttacctggtgcagacgagagagtttcaatattaaaggcacatgctcgtagcaagcccatctcgactgatgttgatttggatgcacttggtcgtcgtgctgagtgcaacaatctcactggtgccgacctagcatcactggtcaatgaagcagccatggcagcactggaagagagactggaattccgtgacaaggggacatcctcactgagttcgtctagcttgattgagatgccgcacttcgaacgtgctctatcgaagatcaagccatcagtatctgaacagcaaatcaagaattatgaggcgttgtcaatgagatactcgtcaaactgatccatcaccagttgtccacatgttagtgtgtatacgagggcaaccttgtgaaaaaaatgtggtgttctgtaccgtgtttgcaaggagtgtgcaccgtcaccagcttttacccatttctgaagcacattataaatctcatgtcagagcctgtggtagagtagtttagatacaaatagaaatctgcatgttatcgcgatcagttttgtttccattttcatttgtctgtaacagactggcctaccggcaattttgtatgcatctcatcaaggacatcatacatacacgaatgagttgttattgc

SEQ ID NO: 14740 - DNA, 631 bp, Zea mays
agtctgcacggcgccttatcatcacacacggaaccagattgcgggcagccatagacgaagagagaaagaaaggtcaacagggcactgcttgcctgctgcgtagtgactagcgtgtctcaaccaaaaggatccatggctcccggagacgactctaaccccgcctcctatatccacacggtgcagcacctgatagagaggtgcatgacgttcgggatgagcatggaggagtgcatggaggcgctggctaagcgcgccgacgtcctgcccgtcgtcacctccacagtgtggaaggagctggagaaggagaacaaggaattcttcgacaagtaccgggagtggatatccgagaagcgaagggcaggcacctcctagcgcggtggcactgaactagctgctggctttgcttaaattagccatgatgtgtattgtttggttattcttggattcgttacttaggcattgtttagttattcttggattcgttacttaggctttctctagtgctaaaatttagtacctaataaaatttaacatatgctaaactttagcacttgctgtccttgctgtccaggaggagcatgcaactaatggtaagaaagagataaagtggtaaataaaaaaaaaaaaaaaa

SEQ ID NO: 14741 - DNA, 861 bp, Zea mays
ggccgtaccgtacggcgccgggcggcacagcggtgtcctcatccgtggcgcaagtgtatgtaagatcgtccccgggccggccggcagtctgcacggcgccttatcatcacacacggaaccagattgcgggcagccatagacgaagagagaaagaaaggtcaacagggcactgcttgcctgctgcgtagtgactagtgtgcctcaaccaaaaggatccatggctcccggagacgactctaaccccgccgcctcctatatccacacggtgcagcacctgatagagaggtgcatgacgttcgggatgagcatggaggagtgcatggaggcgctggctaagcgcgccgacgtcctgcccgtcgtcacctccacagtgtggaaggagctggagaaggagaacaaggagttcttcgacaagtaccaggagtggatatcggagaagcgaagcgcaggcacctcctagcgcggtggcactgaactagctgctggctttgcttagattagccatgatgtgtattgtttggttattcttggattcgttacttaggcattgtttagttattcttggattcgttacttaggctttctctagtgctaaaatctagggagtgtttggtttatagggactaatgtttagtcctttcattttattctattttagtctataaattgccaaatatagaaactaaaatagagttctaatttctatatttggtaattttggaactaaaatagaataaaatgtagggactaaaaattagtcactagaaaccaaacacccccttagtatctaataaaatttagcatatgctaaactttagcgcttgctgtcccttggtgtccacgaggagcatgcaactaatg

SEQ ID NO: 14742 - DNA, 1195 bp, Zea mays
gagtagaaataaaatcacttgaaaaaatattgttcctaaactagtcttaataaagtaaatactcatcggattaggatacctgttgccatctctatctagaacaattagcagggcatgcgccataccacacaggcccacagacatgtaactccgcctcagtcctcgccccttggtatactccgtataatgaccggctcgcacgcagcaccctccatcctccaatcgcgtgattcaagcacgagccgccgacgcggccgcacaactcatttccagagctttacagatcagcccccgagttcgcgaccactccgcaccgcgcttcctttatatgtagtggtctcctcgttgccacccgttcgctgcgatccaaacgcgcgacgcgacttattcagcaccaccgccgcctttcattttttccttcgcatcttgagagagagagagagagagagcggaggaggagagcaaggagatgggcggcttcgaccagcaggtgaaggagcggaccaaggagctgaagcacctcaagaccgcggcgatgaagggcatcaaggcggccggcgagtcgtgcaagaaggcgtggagcaaggtcaggagcagcatcaagcgctaaaaggccctaggcgttgttgctctgctgctgcgtggttttctgagttgtggactgtggtagatttgcgcttgtggtttctgtttgttggatctacttatttattttggatatacatcatgtgtgaagatctgcatgtgtgtgttcctagtgttttttgcttctgttcgttcgctgtgtgatcctcttcgagttgttgtagccacagaaagaaatcttccgtgccaacaaactctctagtctggaatggatattcaccgcacaccgaattttttttacaaacaatttccacatcttggcccctgcggcctagggcccgcatcactttatcatcgttgagcctactttggttcctgatccctcaccttatctaggcggctaggctctgaaatcaggatgttcatctataacaccgactaccgctaaattttagttgttagcctgcttcctaaccggcagcgctgaaacaatcgacactaggaaaaattcagaaaaaggtacttattaaggtttggtaatcctattttttcaaggaatttttattttccttataaaatcattttcccccttggtaaaatggaaatgggg

SEQ ID NO: 14743 - DNA, 1760 bp, Zea mays
catgcctgcagtagtgcaacccttaggctccaagaggagcacgactgtctgccgtctccttagccatggacgcccccggagcctccaccaccacgctcctcctctacggcgcgctcctcctggtgggtttcctcttcatcgcggtcgcccgccggcgcggccgcgggagcaacggaggccttccgccgggtcccacgggcctgccgctcttgggcagcctgccgtctctagacccgcagctgcacgtctacttcgcgcgcctcgcggccaggtacggccccatcttctccatccgcctgggctccaagctgggcgtcgtggtgacctccccggagctggcgcgcgaggtgctgcgggagcaggacctcgtcttctccggccgcgacgtccccgacgcggcccgctccatctcctacggcggcgggcagaacatcgtgtggaaccccgtgggccccacgtggcggctgctgcggcgggtgtgcgtgcgggagatgctcggccccgcggggctggacaacgtgcagggcctccgggcgcgggagttcggggccacgctggcccacctccacgcccaggcccgcgccgccgcccccgtcgacgtcggcgcgcagatgttcctcaccgtcatgaacgtcatcacggggacgctgtggggcggcaacgtcggcagcgagggcgagcgcgtcgcgctgggcagggagttcaggcacctcgtcgccgagatcaccgacatgctcggcgcccccaacgtgtccgacttcttcccggcgctcgcgcgcttcgacctgcagggcatccggaagaagtccgacgcgctcaaggaacggttcaaccagatgttcgccaggatcatagagcagagggtccacgccgagcgggccggcggcgagcccccggcgcccgacttcttggagtacatgctcaagctcgagaaggaaggcggcgacgggaaggcgtccttcaccatgaccaacgtcaaggcactgctaatggacatggtggtcgggggcacggagacgacgtcgaacaccgtggagtgggcgatggcggagctgatgcagaagccggagctgctggccaaggtgcggcaggagctggacgcggtggtgggcagggacgccgtggtggaggagtcgcacctgccgcagcttccctacctgcacgcggtggtcaaggagacgctgcggctgcacccggcgctgccgctgatggtgccgcactgccccagcgccgacgccacggtgggcggctaccgcgtcccggcggggtgccgcgtgttcgtcaacgtgtgggcgatcatgagggaccccgccgtgtggaaggacccgcgggacttcgtcccggagcggttcctggacggcgccggcgaagggcgcaggtgggacttcacgggcagcgagatggagtacctcccgttcgggtccgggcgcaggatctgcgctggcgtcgccatggcccaacggatgacggcctactcgctggccatgctgctgcaggcgttcgactgggagctgcctgccggcgcgcggctggagctggacgagaagttcgcgatcgtcatgaagaaggccacgccgctcgtggccgtgccgacgccgaggctgtccaagcctgagctctactactcggcctagtccaccactggcaccacatccatccactggactgggccattcggcagaggaggaaatgtaacatatttggcccacctgccctccctcgtgaatacgttacatactgaacagtgatgttttaatcgg

SEQ ID NO: 14744 - DNA, 1980 bp, Zea mays
cattgggtacctcgaggccggccgggaaagcgtcctcctccctctccactcccagccccagcccccggggactacaagggcactgggctaggtccgttggcaacagccgccacactgctccgctctgctctctggaggcattgcctgcctcgagttggcatggcggcagcggggacgcagctgggtcggctccttgttggcggcctctggctcctggccgcgttgctgcagcggggcgctgcggcggcagtggccgccgtggatgggcggcgcgccatcgcagcgactggggagaacttcgtgtgcgcgacattggactggtggccgccggacaagtgcgactatggcacctgcccctggggccgcgccggcctgctcaacctggatctctccaacaaggtcctcctcaacgccgtcagagccttctcgccgccgctgatgctccgcctgggagggtcgctgcaggacaaggtggtgtacggcaccgcggacctcgggcggccgtgcgcgccgttcgccaagaacgcgtcggagatgcacggcttcacgcagggctgcctgaccctgcgcaggtgggacgagctcaacgccttcttccagaaatctggtgccaggatcgtgttcgggatcaacgcgctaaatggccgtgttccgttgccggatggatccatgggagggccatgggattacaccaatgcggcgtcactgattcggtacaccgcaaacaagggctaccgaatccatgggatgggagcttggtaatgaactcagtggcactggagtccgagctcgagttggtgcggaacattacgggtgcagatgtgatcgccctaaaaacactagtcgacgacatatacgcaagccatccatcgaaaccattggtgcttgctcctggaggattctttgaccaagcctggtttgcccaacttattgtcaggaccaggccgaatctactggatgtgatcactcaccacatttacaatttagggccaggaagggacacacatctgattgacaagatcctcaatccatcagtcctcgacgggatgagaagcacattcagcagtcttcaggggctactgaaatccgcaggaacttcgactgtcgcatgggttggcgaagctggaggcgcttacaacagcggccggcacctagtcactgatgcatttgtgttcagcttctggtttttagatcagcttgggatgtcagcaaagtatgacacgaagagctactgcagacagagtttgattggtggcaactacggcctgctaaataccacaacgttccaaccaaaccctgactattacagtgctttactgtggcatcgcctcatgggaaccaaagttctagcaacaacgttcagcggcacgaacaagatccgcgcatacgcacactgcgcaagagattcaccaggaatcactctactgctgatcaatctcagcggcaacaccacgacgcaggtctcggtgagtgtgacgacccaaggggccgtggcggcgcacaagcatggcgcaaggaagcacgtcggcggcaggaagttccggcacgtccacgtccccagcttcgacgaggccgccggcggcgtgagagacgagtaccatctcacccccaaggacggcaacctgaggagccagatcatgctgctgaacggcagggcgttggccaccgacacagcggggaacatccccgcactggaggcggtgaagatggatgcggcacaacccatcgctgtggcgccctactccatcgtgttcgctcgcatttcacatttcaatgcaccggcatgtagttagagtagttagtgggtacagatcataatggcaagggagagtttgttttccttttactccttagaattatgtaaggttgaagaaattatgatgatcaacgatgggaaggggaaaaacttagagttgtaaaaggttgaaagaaattatgatggtcaacgatgggaagagggaaagttagaaatgacagtgg

SEQ ID NO: 14745 - DNA, 1558 bp, Zea mays
  misc_feature (1521)..(1538): n is a, c, g, or t
tccggaattcccgggtcgacccacgcgtacgcccacgcgttcgcccacgcgtccgtccacgcgttcgaccacgcgttctcttacgaaagggctgttgcacaggaaaaaaccgagcaagaaacaggtgcacgggtctcaatcagtgatggtacagtcactattgttgctaaaactcaagaaattatggataaagctattgagaaggttgagttcctcgtggggccgtgaaattgaagttggtcgtacatacaaaggaattgtttcttcgattaaggagtatggcgcttttgtggagttcaatggtggacaacaaggcttacttcatatttcggagttgtcacatcaaccggttacgaaagtctcggatgttgtaactcttgcgcaatctctctctctgagatgcattggacaggacatgcggggtaacattaaactttcacttaaagcaaccttaccccaaccacgtatcaagaaggatttgaaaaataaggatcctttgccaagtgaagttactggttgggctgctgtggagaacatgagtagtgtggatgttgatgctcagctatcaagtaccgaacatgtaaatggctctactgaggcggcagctgcattttcgactccttcagttataattcgaagtgctgctgactgtgatgctcaagatgatgcaaatggttctaagaagcgggcgaaggttgcaaagtcatctcctagaccaaataaaccagccagcgaatgccatgatgttaggaaagctaccgctaagaaagctacaggtgccactaccaagaaaactaagaaagtaaagattgaggaatctgtgagtaatggactagaaaccagtggttctgatgttccagaacagagtgctgacaacacttctgaccagaatcagagtcccacgaaattccaatctggggcaatgaagttgggtgatgtagttacagcaaaggtctaccagattcgagcctatggactagtacttgagttgagtgatggtgtgcgtggaatgcataaatttgaggcaaatggcctaaaggaatttgaagttggacaggaactagtagtgaaatgttctagtttcaatgcgaaggggattccgttattctcattgctggactagcaatgccaccatttgggaaccggatacaaatgacaccttagcagctaaccaatcaacttgtggaacacatggctagcgaagttttgttctttcgctgttgttgaagcgttggtcaagttctttattcgtgcaaccatgaatagaatggaggtcaatcacatgaagtgtagagcgtacggactgagtacgaaccatcggaacctgctgtagccattatatataactaggattacgttacttatctatctattggttaaaataatagggacgatgaattctttgtaagacgtactgaagcagagtgtcccacttacaggaatccagttccagtttgtagtttctttacctaagattgttcagctgtacctttattttatttttagcagggctgtttacannnnnnnnnnnnnnnnnnaaaaaaaaaaaaaaaaaaaa

SEQ ID NO: 14746 - DNA, 556 bp, Zea mays
gaggagatgcgcgcgtaccactcctcttcatttcaccatgtcgttcagcaagcgagtagctgtggccggcgccctcgccttggccctgcagcttatcctggcttcacatcttgcagcagctggagccaaagacgaaacaatagcaccgttacagacgtgcgagaccatgatcaaggtcccctgctggggcaaaaacgcgatctgcatccccatctgcatcgcgatgcgctacaccggcggtttctgcgacgtcgccacctgcatgtgcaccaagcaatgcctcgccgccgccgaggctgaggcagacggggcatcgcagcaggccgtggcgacaccgcggctgaactgatggattgtttggtgggcgggcggctggggcatgcatgccgagaataaactcgatgttacacaatgcgaccgagagtagacccaggttgcttgtcatatgtagcagattattgatgaagttatttgatgattgatcgtctcgatctttaacacatctgtaatttttactttcatcttcggcagtgttatccatctcacctcttttcct

SEQ ID NO: 14747 - DNA, 1536 bp, Zea mays
gcacgagaccattacctagaacatcctaacgaaaaagagcttgttacgaggcaatggcgccgacagtggaggtgctgacgtcggagatggtcgtcccagctgaagaggccccggcgggcaccatttggctgtccaacctggacctcgccgcacgccgcgggtacacgcccacggtctacttcttccggcccaacggtgacccggggttcttcgccccggacgtcgtcaagggcagcctcgccaggacgctagtcacgttctacccgctcgcggggcggctcgcgctcgacggcgccgggcgccgtccaggtcgactgcaccggcgagggtgcggtgttcgtgaccgcgcggtcggactacgcgctcgacgacctgatgcgcgagttcgtgccgtgccgcgagatgcgggacctgctggtgcccccggcgcccgcgccggacccgccgtgcgcgctgctgttcgtgcaggtcacgcgcctgcgctgcggcggcgccgtgctcgccctgtccatgcaccactccgtgtgcgacgcgcggagcgccgcgcacttcttcgatacgtgggcgagcatcgcgcgcggggacgccgccgccgccgccgcgaacgctcctgtgccaccgtgcttcgactacgcgctgctcgccgcgcgcccggcgctcgcggtgctgtacgaccaccccgagtacaagcccgagccggagcctgtggacgccgcgtccgactacgcgagcgccatcgtcgtcatgaccaaagcgcaggtgggcgcgctcaaggcgcggtgttccggggcgtccacgttccgcgccgtggtggcgctggtgtggcagtgcgtgtgccgcgcgcgggcgctgccccccgaggcggagacgcggctctactccatgatcgacatgcgctcgcgcctggatccgccgctccctacgggatacttcggcaacgcggttgtccgcacctcggtctccgccacggtcggcgaggtgacgtccaaccccgtaggccacgccgcgcgccgcgcgctcgcggtaacgagccagggcgacgactacgcgcggtcgctggtggactacctagagggcgtggacgccatgaacctgcccagaagcggcatctcgcgtgcgcacctccgcgccatcagctggatgggcatgtcgctgtacaaggccgacttcgggtggggcgcgccggtgttcatggggccggcgatcatgtactacagtggcttcgtgtacgtcatgaacgcggcggggaaggagggtgccctcgcgctcgtgctgtcgctggagccggagagcatgccggagttcaggaaggtgttcgccgaggagctcgccagcctggacgtgatctagtgcatacatatagctcgaagtatgtaccggccggctaagccgccaggcgccagtggacagttgcatgcgtggaacgtactacgtgttaggctatccacactcatatcaccctatttctctaaatatctaccatataactgtgggttatgataattagagatacccagacaaaaaaaaaaaaaaaaa

SEQ ID NO: 14748 - DNA, 1898 bp, Zea mays
acagcccgacccccccgggccccccggaccccttgttcatttcctttcctccagttcctcgtcttctacgcagaccccccgttgaagcctagggtttggcggctacacctctcttctagctagttggcgaccaccatttacgctaaaccacccgcgcggccgatggacgtcgactcggacccggccgcctcgagcaagcccacgcagatggacctcgaggaccagacgaacacaaaggggaagggaaaggcggaggaggggaacgggaagggcgaggagctcgcggactccatcggtagcctctctatcggcccggggcgcaccaatttcaagaagaagcctgtgattatcatcgtcatcggcatggccgggacggggaagacgaccttgatgcaccggctggtatgcgatacgcaagcatcaaataagaggggctacgtcgtcaacctggaccctgcagtgatgaccctgccattcggtgccaacattgatattcgtgacactgtgcggtataaggatgtgatgaaggagtacagccttggtcccaatggcggcatcctcacctcgcttaacttgtttgccaccaagttcgatgaggttgtatctgtcattgaaagacgtgcagaacaattggattatgtactggtggacactcctggtcagattgagatcttcacttggtcagcttcaggagctatcattacggaagcttttgcatcgacgtttccaacagttgtagcatatgttgttgacactccgagatcaacaaaccctgttacttttatgagcaacatgctttatgcctgtagtattctctacaaaacccgccttcctctagtcctgacattcaacaaggttgatgttgccaagcatgagtttgccattgaatggatgcaagactttgaggcatttcagacagctgtggaatctgacaaatcatactccgctacatatacccgaagcctctctctggttcttgacgaattctacaataatttgcgctctgttggagtatctgcgatttctggttctggagtcaatacattttttgaagctatagaagccagcgccaaggaatacatggaaacctacagggctgatcttgacaagaggattgctgaaaaggaaagattggaggaagagcgcaggaaggagaatatggaaaaattgcagaaagatatgatgaaatccaaaggacaaactgtggtgctcaccactggtttgaaggaaaaaaaatctgtttcagacatgatggatggtgctgatgaggaggaagaagaggaagcattggaagattttgggttttctgaggatgatgaagatgaagacgaaggagaagatgaggaggtggctcattttggcttttgaggggatccaatagttacttgttggtgtgtcttacagagagtccatatggggggctacttgctgaagtggaatgaagaactgtcaatatcagtaggttgttgactttgctattagtctactcttttaaattctggtgccccactgctggctatttatgctatatatttgggacctcatgtcaaagtttatctcgtcgctgagctgtactaatcatattaattgtacgtgcgagtaagaagttgatgggtcaagttgtgtgtgtaatcggttgtgccacaacctgtacctaatccttcgcttcgcttaccacttaccaacatcccaccagtctttttgctgatgaactcggaaggaaagagtcacgaggatacgagtatggtagaaattctagagtacgaataatactatgtttaaggggaagcgaatatgtttggtataatgtaatctacaaccgaactggctatcactcgactttttatgtggtggcggcatcactgtcacttcaatgaaatgcatgagttaacacatcc

SEQ ID NO: 14749 - DNA, 1135 bp, Zea mays
gcacgagaccattacctagaacatcctaatcgaaaagaacgagcagaagccgccgtgcacattctgacctggacaaggacaagcaagcgcagaggcagagcagctcgataacctcgatccgatccatctcgtctcttccgcgttgcttgcttgcttgctttagatgtgctgactgctgactgctgttggggtagggcagggagagaggagaggaggaggaggaggagctcgtagcggaatcagatcagatggtgcgtcgccagagcagagaaggccggggcctgggctggcctgcgtgctgcctcggcttcctgctcaagctgctcgcgttcctccaggccttcgccgccgtctccgccctcatctacgccgcttggatcctctcccgctgggcgcgccaccaccagctccacctccgcgaccttctaagcccggacctatggttcccgtcgctcgtcatggcggcggggatcttctactgcctcctgctcctcgcgggttacttggcagctgagatcaacaccggatgctgcctctgcttctacaccatcccagccatggctatgatgctgctggaagctgctctcgccgcccatctggcgctcaaccagcactggatccaggaactgccagaggaccgcaccggcgagctccacaacttactctccttcatccacaataatctcgacctatgcaaatgggttgctcttgccatcttcgccatgcaggcactctcacttctcctggctatgactttacgggccatgctatctgcccggaccatggactacgacagtgatgaagactttgtggttatacggaggccactactggttgcccagcctcctgcaccttagtccaactcgagcaaagctccgtatcccaccccgaatccgtaaaatacgcgcccgtggacactgtttaggcttcgaccaacttctgcaagggcgccctccgtctctgtatcctagggaggagtccttgcgtttgcggagccggttcctggagccggttcactactttgcaacatgtagcaacgaatttgaggactcccaatgtaatgggttatcctatcaggtcaaatttgaagaatggatatatgatacaccacctcatctaaatgaagtagttcctt

SEQ ID NO: 14750 - DNA, 1096 bp, Zea mays
gccggccggtcgggaccctcgaggccggccggagacttggtaaagaaccgtctttctgttgaattcaactctgctctagctagcaccgcggtgcagctccatcttctatattatactcaaggcaaggaattaggagcagaccggagacttgggggcttcacctgctgtatctcattaccatctgcatctggttgcccgttgattgagaaggaggagctgagggccatggcgaccgagaagcccatcctgtacaacgcctggatcagctcctgctcccaccgtgttcgcatcgcactcaacctcaaaggtgtggattacgagtacaagtcggtaaaccctaggacagatccagattatgaaaaaatcaatccaatcaaatatattccagcattagtagatggggacatagtcgtttctgattctcttgccatctcattgtatttggaagataagtatcctgagcatccactcctgcctaaagatctcaagaggaaagctcttaatcttcagattgcaaacattgtttgttcaagcattcaacctcttcaaggctatgctgttattggtctgcacgagggtaggatgagcccagatgagggccttcatattgttcaaagttatattgacaagggattcagagcgatcgaaaagctgttggaaggatgtgagagtaaatatgctactggagatgatgtccaattggcagatgtgttccttgaaccacagatacatgccggcataaatcgcttccaaatcgatatgtcgatgtacccaatcttggagaggctccatgatgcatacatgcaaattcccgcattccaagccgcgcttcctaaaaatcaaccagacgcaccttcatcataatcatcaagattatctcaataatttgcatgtcattttgtaataatttggatagggagccactgcttcctccatcccgttgtggatcaaaagggtgaacgattggcacttacctgcatggtccaatacctattatatttcttaaacagatactatttacggctattgtaatttaagcccaatacctgcatggtccgttttctaccaaaaaaaaaatatatcagttgtagggaac

SEQ ID NO: 14751 - DNA, 1626 bp, Zea mays
ccggccgggaaaaaaaaactcccgctccctgtccgcgtccgcgtgcaaccaacacctcgcccaccgggtcccgcgccggcagcgtcaccgtccgtcgtcgcaaacgagcccagtggcgattcgctttcgaaccgcactcgccctcctccgttctcttctctccctcctatagttggcttctcgccaccctctgctttcgatcagctttctccgctccccatttccctctccaactccaatccatggcctccacggatcgctccacgccggcggaggacgagcaacagcagaagcgcccgtctctcttctcgccgtaccagatgccccgcttccgcctcgcccaccgggtggtgctggcgccgatgaccaggtgcagggcgcccgacgcggtcccaggccccgcgctcgcggagtactacgcgcagcggtccacggacggcggcttgctcatctccgagggcaccatcatctcgccgtccggccctgggttccctcgtgtccctgggatatacaatcaagaacagactgatgcatggagaaaggtggttgatgctgttcatgccaagggagctatctttttctgccaactatggcatgtaggccgagcttctcaccaagtatatcagccgggtgctgctgctccgatatcctcaactgataagccaatatcatcaagatggaggatactgatgcccgatggatcctatggcaagtatccaactccgaggcgcctagccacatccgagataccagaaattgttgagcaataccgtcaagcagccataaacgccatcaaagcaggtttcgatggcatcgagatccatggcgcccatggctacctcatcgatcagttcctcaagggcggtatcaacgaccggactgacgagtacggtggctcactctccaaccgttgccggttcctcctggaggtgacccgagccgtggtctctgcgataggagcagaccgcgtcgcggtccgagtgtccccggccatcgaccatctcgacgcctacgactccaaccccctgcagctcggcctggccgtggtggagcgtctcaacgctctccagcaggaggccgggcggctggcctacctccacgtgacgcagccacggtacacggcgtacgggcagacagagtctggccagcacgggagtgccgaggaggagagccggctgatgcgtgccgtgcgaggtgcctaccgtggcacgttcatgtgcagcggtgggtacacgcgggagctcggggtcgaggccatcgagtccggggacgctgacctggtgtcctacgggcggctgttcatcgctaatcccgacctggtggagcggtttcggcgcgacgccccgctgaacaaatacgtgcgcaagacgttctacacgccggaccctgtcgtcggttacacggactacacattcctcggccagcctaaggcgcgcatgtgattattagtaggttgccgtaattataagaggcggagtgttgtttgtgtgttgtgacttgagaaaacaagcaaacatctgggtaatgccgcgattgttacgtgttcctactgtatacgtgttaccaatattcgggcctacagattgtatcttgataatcagtggcagatctagaattttactattt

SEQ ID NO: 14752 - DNA, 1737 bp, Zea mays
  misc_feature (1710)..(1711): n is a, c, g, or t
  misc_feature (1713)..(1717): n is a, c, g, or t
  misc_feature (1722)..(1722): n is a, c, g, or t
  misc_feature (1730)..(1731): n is a, c, g, or t
cattgggtacctcgaggccggccgggactcactgtccagtgtccttgttgtccaccactccctcgagtccgtgacgcgtcagcgtcaccgtccgtcgtcgcagacgagcccagtggcgactggcgattcgctttcgaaccgcagtcgtccctgctgtgttcccggttccctcccttcctcctcctatagttggcttctcgccaccctctgccttcgaccaactttctcccttctcccctccccgttcccctctccaactccaatccatggcctccacggatcgctccgcgccggcggaggaccagcaacagccgcagcgcccgtccctcttctcgccgtaccagatgccccacttccgcctcgcgcaccgggtggtgctggcgccgatgaccaggtgccgggcgcccgatgcgctcccgggccccgcgctcgcggagtactacgcgcagcggtccacggaaggcggcttgctcatctccgagggcaccatcatctcgcccgccggccctgggttccctcgtgtccctgggatatacaatcaagagcagactgatgcatggaaaaaggtggttgatgctgttcatgccaagggagccatctttttctgccaactatggcatgtaggtcgagcttctcaccaagtatatcagccgggtggttctgctccaatatcctctactgataaaccaatatcatcaagatggaggatactgatgcccgatggatcctatggcaagtatccaactccgaggcgcctagccacatccgagataccagaaattgtcgagcaataccgacaggctgccataaacgccatcaaagcaggtttcgatggcatcgagatccacggtgcccatggctacctaatcgaccagttcctcaaggacggtatcaacgacagggctgacgagtacggtggctcactctccaaccgctgccggttcctcctggaggtgacgcgcgccgtggtctccgcgataggggcagaccgggtggcggtccgggtgtccccggccatcgaccacctcgacgcgtacgactccaacccgctgcagctcggcctggccgtagtggaccgcctcaacgctctccaggaggagaccgggcggctggcctacctgcacgtgacgcagccacggtacacggcgtacgggcagacggagtccggccagcacgggagcgccgaggaggagagccggctgatgcgcgccctgcggggcgcctaccgcggcacgttcatgtgcagcggtgggtacacgcgcgagctcggcgtggaggccgtcgagtcgtgggacgccgacctggtgtcctacgggcggctgttcatcgctaacccggacctggtggagcggttccggcgcgacgccccgctgaacagatacgtgcgcaagacgttctacaccccggatcccgtcgttggttacacggactacccgttcctcggccagcctaaggcgcgcatgtgattattagttaggttggtaactataagaggcggactattgttcgtgtattgtggcttgagaaaataagcaaacacatggtggtagtgctgtgcaataagccttaggtgcaaacatgagcctcctgggcctttagataatgatctaattatagatgtaattatagttttgtcaagaagttaatgtttatttgcacagcaatcagcagtcatctctcaaatggcaaaactaaaaataggtaacaaannannnnnaattnaaaaaaannaaaaaa

SEQ ID NO: 14753 - DNA, 1580 bp, Zea mays
gtgctttgttcatccaaccactgatgacttgattagtttctttaccttgggcatgaacagcatagtatttttgtttgaacttaccgatatcaacatagtgtgtcacatcaggggttgactaatatttttttcaccaattactgtatcaaccaatcattttaattttctttaccctgagtgaatctgggtgcctgccaaaccaactgatactaactcatggccactaacgttttttcccccatcaactagtatatcagccgggtggttctgctccaatatcctctactgataaaccaatatcatccaagatggagggatactgatgcccgatggatcctatggcaagtatccaactcccgaggcgcctagccacatccgagataccagaaattgtcgagcaataccgacaggctgccataaacgccatcaaagcaggtaatactgaatgattacaccatcaaagcccgatgaacatgcatcaattcggaatgattacacgttggaccccaaatcatagtcagagtctcgtagatgataagaaaatccttctgtctactatatgctcatctggagatgaaatgcgctgctggcaggtttcgatggcatcgagatccacggtgcccatggctacctaatcgaccagttcctcaaggacggtatcaacgacagggctgacgagtacggtggctcactctccaaccgcgtgccggttcctcctggaggtgacgcgcgccgtggtctccgcgataggggcagaccgggtggcggtccgggtgtccccggccatcgaccacctcgacgcgtacgactccaacccgctgcagctcggcctggccgtagtggaccgcctcaacgctctccaggaggagaccgggcggctggcctacctgcacgtgacgcagccacggtacacggcgtacgggcagacggagtccggccagcacgggagcgccgaggaggagagccggctgatgcgcgccctgcggggcgcctaccgcggcatagcgtggtcgcggccgaggtacacgcgcgagctcggcgtggaggccgtcgagtcgtgggacgccgacctggtatcctacgggcggctgttcatcgctaacccggacctggtggagcggttccggcgcgacgccccgctgaacagatacgtgcgcaagacgttctacaccccggatcccgtcgtcggttacacggactacccgttcctcggccagcctaaggcgcgcatgtgattattagttaggttggtaactataagaggcggactatttattgttcgtgtattgtggcttgagaaaataagcaaacacatggtggtagtgctgtgcaataagccttaggtgcaaacatgagcctcctgggcctttagataatgacctaattatagatgtaactatagttttgtcaagaagttaatgtttatttgcacagcaatcagcatacatctctcatatggcaatactgtgaatagttacttacagtagctagcatatagtccgtgttaacgctacgatactgtgaagatgagaggaggggtcgacagtgcttgtggtggcgtgaggggtgaggttgaatgt

SEQ ID NO: 14754 - DNA, 1827 bp, Zea mays
cccacgcgtccgcccacgcgtccgcccacgcgtccggctccccgtttccctctccaactccaatccatggcctccacggatcgctccacgccggcggaggacgagcaacagcagaagcgcccgtctctcttctcgccgtaccagatgccccgcttccgcctcacccaccggtgagcctccatcgcggtggtgctggcgccgatgaccaggtgcagggcgcccgacgcgatcccaggccccgcgctcgcggagtactacgcgcagcggtccacggagggcggcttgctcatctccgagggcaccatcatctcgccgtccggccctgggttccctcgtgtccctgggatatacaatcaagaacagactgatgcatggagaaaggtggttgatgctgttcatgccaagggagctatctttttctgccaactatggcatgtaggccgagcttctcaccaagtatatcagccgggtgctgctgctccgatatcctcaactgataagccaatatcatcaagatggaggatactgatgcccgatggatcctatggcaagtatccaactccgaggcgcctagccacatccgagataccagaaattgttgagcaataccgtcaagcagccgtaaacgccatcaaagcaggtttcgatggcatcgagatccatggcgcccatggctacctcatcgatcagttcctcaagggcggtatcaacgaccggactgacgagtacggtggctcactctccaaccgttgccggttcctcctggaggtgacccgagccgtggtctctgcgataggggcagaccgcgtcgcggtccgagtgtccccggccatcgaccatctcgacgcctacgactccaaccccctgcagctcggcctggccgtggtggagcgtctcaacgctctccagcaggaggccgggcggctggcctacctccacgtgacgcagccacggtacacggcgtacgggcagacagagtctggccagcacgggagtgccgaggaggagagccggctgatgcgtgccgtgcgaggtgcctaccgtggcacgttcatgtgcagcggtgggtacacgcgggagctcggggtcgaggccatcgagtccggggacgctgacctggtgtcctacgggcggctgttcatcgctaatcccgacctggtggagcggtttcggcgcgacgccccgctgaacaaatacgtgcgcaagacgttctacacgccggaccccgtcgtcggttacacggactacacattcctcggccagcctaaggcacgcatgtgatttgattattagtgcgttgccgtaattataagaggcggagtattgtttgtatgttgtgacttgagaaaacaagcaaacatctgggtaatgccgcgattgttacgtttgttacgtattcctactgtatatgtgttcccaatattcgggcctacatatgtatcttgataaccagtggcagatctagaaaaaaaaaaaaaaaaaaaaaaaaaaaaacttgccgccagccagcccattaaccctcgttcctgtcgcgcagccacgacctccacttccgcatcttccccggcggcggcgcggtcagttgaaccatggcggactccaaggccacctcggcggtcaccctccgcacccgcaagttcatgaccaaccgcctcctggcccgcaagcaattcgtgcttgaggtgatccaccccggccgcgccaacgtctccaaggcggagttgaaggagaggcttgccaaggcgtacgaggtgaaggaccccaacaccatctttgtcttcaagttccgcacccacttcggaggaggaaagtccactggtttcggcc

SEQ ID NO: 14755 - DNA, 1745 bp, Zea mays
  misc_feature (22)..(22): n is a, c, g, or t
cacctttgccggagacatgtgnaaccgtacggaatcgccggcctgagatggcggccacctccgcgttcgggttggcccccggagatggagcggttcctctgcgagaggctgcttgatgcggagcaccccatcgcggagcgcatccgggcgttcttctccctcggtccctccgcaacctccacggggatgcgccgcgccctcatctaagctgcaaaggatccttccaacttgcttgctcatggggctgcatttgcacttggacaaatgcaggatgctgaggctattcctgatctggtggcagttctcaaagatttttctctacatccaattgtcttccatgaggttgcttatgtgctaggtcagctgcaaaataaaaccgcttcagatgcacattctacggtcgtgaagaatgtctgtgagcatccaatggccaggcatgaagccgctgaagcccttggctcaatgcggaccaagagagcattgtgcttttggaggagtttgcaaaggatcctgagcccatagtacgagagaatcggggaagtcatttgagtttctcttccttgagactcctcgtgtgcagccctatgatcacccaaatgcgaagtggctgaaggctccttggttaatgtgactgcaccaaccatgtatccactggtggcttgcctggtaggaaagattttgcttaccatctcagtggcaacagcggatgatgaaaaatggtgaagctgcagctcttgctgctgcaagcaaaaactgacacagtgaccgacagcaaaacagatcgtagctgcctcggagctaggagaagaatcctctgatcctttcggtttggatggttttgttgagcacaagcccaagaagcctgagagagcccgagaaagggccgatggcagctctgtccgctgcgtgcgccccccccccaaagatatttctcaagtcgcagcgggaggccccttgtgaaacgcctggatatagctgctcggcgctacagagttccatgggcgcagactgccattgacatccttgcgaagcgcgcatactcccacgagacgaagatcagcagtggttgctcggctaaggtggtcagtcggcagatccgttggtgtctgtctgatccccgcttctcccccttggcaggcgggcgtagcatgatgatctggttgggttcaacaaggacggcgctcgcctgatccatccattgcctatgcctggcctgggactcccatggtccatggatttcggtgcgtgtgatgaatgcggacgacgccagggtttcttctttgggcttcggcgagcgacacgggcgtgggagctgctgtttttgtgcttggatttccgtagaggagagttgacatggccatcaccatccccatgcatgacctcatacatcagctgactgactggatgtgttggatgcatctgcatcccttacagttgcgttgcgatgccaagctaagcttgcaggtaccgtgcgcggtgtgcctgtacactgtgtggtgggtgggtgggtggtgcctgtactgtacaccgtatggtgtgatatagagaagggggttgacttgaagaaagtgcagtagagaaagagagcaaatgtttttggctttgtttgatgttttcttttccctcctcttctataagagcaactccattagttttctaaaggactctctaaatcaacaagttaggtagttggtcttaaaaaaaaaaaaaaaaaccaaaacaccacaacaacacaaacccacccc

SEQ ID NO: 14756 - DNA, 2272 bp, Zea mays
  misc_feature (10)..(10): n is a, c, g, or t
cgggccgggntataagtccctcctccgcgcccgccggccccctcaaatcccagacgccacgccacccaacacatacaaacacacgcacgcgcgcgcgcgcgcctcccgctgttccgcaaaacaaaggaaacgaaggagaggaggccatggcgccgagaacgtcagagaaaaccatggcaccggcggcggccgctgccacggggctcgcgctcagcgtcggcggcggcggcggggccggcggcccgcactacagaggcgtgaggaagcggccgtggggccggtacgcggcggagatccgcgacccggcgaagaagagccgggtgtggctcggcacctacgacacggccgaggacgccgcgcgggcctacgacgccgccgcgcgcgagtaccgcggcgccaaggccaagaccaacttcccttacccctcgtgcgtgcccctctccgcagccggttgccggagcagcaacagcagcaccgtcgagtccttcagcagcgacgcgcaggcgcccatgcaggccatgccgctcccgccgtcgctcgagctggacctgttccaccgcgcggcggccgcggccacgggcacgggcgctgccgccgtacgcttccctttcggcagcatccccgttacgcacccgtactacttcttcgggcaggccgcagccgcagccgcggaagcagggtgccgtgtgctcaagctggcgccggcggtcaccgtggcgcagagcgactccgactgttcgtcggtagtggatctgtcgccgtcgccaccggccgctgtgtcggcgaggaagcccgccgcgttcgatctcgacctgaactgctcaccgccgacggaggcggaagcctagtcgtcgaagcttttaatgactgtctgtcttcttagttctttcttctcctttttctcgaggaaaattcggtactactaagctgagagacgctctcctccgacagacgacgtcgacgacgggcatttttgtaaatagtttttgcgccgggacctttttagtttatgatgaaagctgtattgtcaccgaagacaggtcctgccggcgttgttatggaccggattactatattatattatgcactactagtattttgatagccaaaataaaaaacccgacgagaaaaccctcgacgcgtgcctctacttatttatcgttctcagaaactgaagcgagattttcttaaaatgaacggcgagcatcgtagtttcatttaaggcttgcttgcaatccatgcaacgtcgcctttattggtcggttaaagacgcatcaaagcgagtcgaccggtcgtctcgtccggcgtagacactcaccgtgtccgtttcagaacgacgagagcaccgcagatccagccgctaaaacaatgtgcagtgcaccgctcaagttctgaaaacttgtgggtagttggcacgaccagtggcgcaggagacggaggcggcatcgctgtcggtttcacctcccacgccacgctacagccgctgcgccgacggagagaatataattttgcgtgctacgtgccttctcgagtcgttttcccggccaggctgtttgttaattacgtggagaaggatcagacatgtgctttgctggtgctggcgtcgccgctgatccaaggtgacgcatgcggataacgagcgagtaaacacaggcgatcgaccagcctgtttgtattctcaggttttaacattctggtttttggaaactggataagattcaaacaggccagttttttgttgtcagctcttactaccaaaatttttaaaacaggaaggccagcttcttaaaaagccaagcggccgcagccggcagggcagcaggggcggatggatctttcgccgccccgtccgtcggtgtgcgcgtacggcgcgatcgtcctgcctgtgtgctgtgctgtgctgtgcgtgcgctgggctggcagtggcagtggcaggtcgtggttgccctttccgctcgtgatctcgggagtaacgtgagcgtgcggtcgacgcccccacggcccacgggtgcgcggcgctgccggccacagcctgccgtccaggggcgggagccgggagcgggatccgccctgcgcgcctcggcccacgcaagcacgcacgcaccagccccgcggcgcgcggggatacgaaatcgtacctgcccgtcccgcgtgggaggcggtcgcccattggctggcgtccgtggtgcgtgcacgcgggcgcgggcgggtaaagcggtgggaggagggggggaggacctgtctgtcctggcgtgcgtggtccgcgccggac

SEQ ID NO: 14757 - DNA, 542 bp, Zea mays
gtagctaccagtagtttgttaggacacaaagaagctccataattaattattgccctttcagttcgccatcggcagccgagcaccatgagctccacaggcggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaaccgcgtccgcatcttcgtcgacaccgtcgcggaggcaccccacatcggctgaggtttaaatctacaaaatgaatgactcggacatgccatgcgtacctgtccgtcgccgaataatggatgtgtgtgtgcttcgttccaataaattgctagtaaaaataatggcatcgtcggtatgcatgaataaaatgtatcagaatgttcatcctttcacgattggatatatgaaaattggatatatgaaaaaaaaaaaaaaaaaacgcgagcccggcccggaaaaaaaaaactcgagcccgg

SEQ ID NO: 14758 - DNA, 516 bp, Zea mays
  misc_feature (509)..(510): n is a, c, g, or t
acccgggattcggccttatggccggggacacaaagaagctccataattaattgttgccctttcagttcgccatcggcagccgaccagcatgagctccacaggcggcgacgatggcgccaagaagtcttggccggaagtggttgggctcagcctggaagaagccaagagggtgatcctttgcgacaaacccgacgccgacatcgtcgtgctgcccgtcggcacgccggtgaccatggatttccgccccaaccgcgtccgcatcttcgtcgacaccgtcgcggaggcaccccacatcggctgaggtttaaatctacaaaatgaataactcgatcggacatgccatgcgtacctgtatccgtcgccgaataatggatgtgtgtgtgcttcgttccaataaattgctagtaaaaataatggcatcgtcggtatgcatgaataaaatgtatcagaatgttcatcctttcacgattggatatatgaacatgtgctcagttgtttggtttccaaannaaaaaa

SEQ ID NO: 14759 - DNA, 2889 bp, Zea mays
cgcctttcttcgcatctcttaggtcatattcgattgcaggtggattaattggaggggtttaggggattaaatttcttcgtgcttaaaattaaatagacagaaatttaatctctccattatattctggcctcctcaattcgctcctaacggaactaagcttttagggttagtttggaaacctaatttttctaatgaatttatattttgctaagaaaaattagttcattttccaataaaaaaatagagtttcgaaactaactcttagtgggttgagaagttcacccatctcacattgtctagtgtcaagtgtttttgccagtagtgttcagatgctcgtacaaccatatggatggatatacatgttcctgcatcgtttttatcctttcatttttctttttttttttgcattattactggctgtatgcagaccagggccacctcgtgtgcctcgtgcgtgtatatataattacatatacgcatgcattattgttgagcggtggagcatgcagcctgtgttatcctgatgagcgatgacacacacacatgctgccttgttggctgcagcagcagcagcagctctataaatacctcaccaccgcgcatactcgcttcacacaaagaagctccataattaattattgcccgtaagtactgtgcctctctctcttaatatatattatcacgctttggattttttgcaataacatagtaggagcccccgggccggccggccgggacacaaagaagctccataattaattattgccctttcagttcgccatcggcagccgagcaccatgagctccacaggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaaccgcgttcgcatcttcgtcgacaccgtcgcggaggcaccccacatcggctgagaatcaaatctataaaatgaataactcggacatgtcatgcgtgcatgtccgtcgccgaataatggatgtgtgtgcttcgttccaataaattgctagtaaaaataatggcatcgtcggtatgcatgaataaaatgtatcagaatgttcatcctttcacgattggatatatgaaaatgtgctcagttgtttggtttccaaaaaaaaaaaaaaaaaaggccccaactggaacgcaggctcaaataatgatggaatctgcacaatatagataggttaacgacttagagcatgtacatcttattaattaaatatattttggtttgaggttaaagtaggatgagtcgggtatgtaccccttatcaattaacgacctagggatgtacaacttttcacatgacgactcgaaaaattagcctccacgccatcactcactgcaggagcgatgagatctttaagatcatacaacataagcctacgtcacacaatgtagaaaaatcatgctcttgtagtcttgttcatgccgcaacgattgtgtaccaacaatgggccagctgacatgacttcaaaaaaaaccaatggatcagacataataaacactttctttatagagagatgcagcacatcaacgacatgtccatatgcaaaataaaaaaaaaacaactgaatgatctctctaggatacatcttgtgataatttagcaggagcagctaaagatgagctgatcaattcgtgaatagatattatcactgagagaagaatatcatatataaccaacaagttcgacttttttacaatcctcaaggagggggcaaagggcaacagagctaaacagactctgacttggtgtacatcctaacggcaacagccaaggccaggattgccaggggaactaaaaactggaggatcttgatgacaaactcggggggtattgtcctggttgtagtgcggttgcttggggggcacatacttggtcctagaagggatcgtcgacttcacccaccaggtactcgtccatcatcgcgcgggcagtattgctgtgcccgccgacgtcctcgaaatcgtcggtcgcatccttgcctgtgtaaggttcaaacggattgggttgtgtgttatttacagcatgtcgtcgttcggaaccttagctgaggaggaaatacaagaaggcataccagttgaggacagcagaacatcgtcgcctcctgggtggtcttccagaaacttggtcacatcgtacacctatattccacagcaaaacatttgcgctggtgaggttctttatggagaaaaaggacaacagtgctgatcattattagaccaaagtagcaatgaaagaattgtagcaaatgcctccagcaaaatggggccaccataataaaaaaacaggtgatcaaataatgcaaaacaaaaaacggtttcgaaggaaggcagaacagaatatgaaggataagaagacacgagtttcaccaaggttatctagcatgtctaatcttacctaaagactaaaaaaacatcaatctttgggaaaacgcaatagaacgaaaacatctatatgttatatgtgatagggtcggcaaacgaggtaggaaacttccaaaaacttttatactccatcagtttacatgcctatcagcgtgaaggtaaaaaaaaagaatgtggacttgttattagaagatcatgtttaagagcttgctttccctaccagaacaaagatatggcacttactgagctgaaacaaatctactactgtatgagcttgtggagggggccaaagaacatggctttgtttggataatcacgtatttaactcaatccacatgtattaacgtggagtgagatgtaatttaaactaatttgcacctcaatccacctcaatatatgtgg

SEQ ID NO: 14760 - DNA, 550 bp, Zea mays
ccccccccccccccccgtccacacccaaaaatcctgtgcggcgctcgagccggcctttcaaaaacacaagagctccataatgaattattgccctttcagttcgccatcggcagccgagcaccatgagctccacaggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaaccgcgttcgcatcttcgtcgacaccgtcgcggaggcaccccacatcggctgagaatcaaatctataaaatgaataactcggacatgtcatgcgtgcatgtccgtcgccgaataatggatgtgtgtgcttcgttccaataaattgctagtaaaaataatggcatcgtcggtatgcatgaataaaatgtatcagaatgttcatcctttcaaaaaaaaaaaaaaaaaaaaaaaaaaaaaaaaacgagagcggggggcccggcggtacccc

SEQ ID NO: 14761 - DNA, 2619 bp, Zea mays
gttacgtaaaacagggggtcagttgaatacaaccagaatgcagttgaaggctcgaagtgcatagacgcaattttgacccatagttcacttggcatagcgaaaacttcaaaacatgattcacacttagctttccacatcttaggatggtgaccatcaatcgggggaaaacataatttaggcaatgacgccaccagatgtgaagcataaggcgataacaaaggatctatgtgttgaatatggtgatcccagatacaggagagaatgtgtacctgtgaccggaggcggaatcagggtggtcatcaccccaaatccatcattccggtaagaaggtgtagtgcaattgttaataggtcctggtgtcaagtgtcaacgactgaataggagtagcaacgtgtactctagaggctcccaatcggacaccttcaaggctacgtgaaatttctctcggaatggcaccaactcgttaattttgcccatgagaattcccaattccttacgaagatgaccaccatcaatctcgatctgcggcttccaagtcgagctgtgttctcttctagctcctgcttgatggtgccggcctgcagttgcatggattgaagaagctcctgcttgatgacgtcaatgtgcttctaccccctcatcttgtactgcaaatattcaagagattctgctaggaccgcgaccagaatccgataccaattgtaatatagatcgaaggcatgagacgacgagcaccactctcggcactctcttcttcccaagaagttaactggtttataaaaaatttagagaactagaaacaaagaactctcgtggatccctcacacgcccaggtctgatcgcagccggccaacaacttacttcccaagtatgatttcggtgacgatctgtagattaatgcatgtcactctgctatacacagattaagttgagtgctgttactattgctgtaacatagtaaatatgtcatgtgcatgagcagtaatcaagagtgaatatatacgtagtaagagtatcatcaacgcatgttcattaaagcttcatctgtgtatataatatactactacgttggaaaagcagttcgttcgctgtcgccatatagatgcataatgcaactcctgagaattgtgtggccgtaacaatcacacgtatgtattaaagcttaaactaatcttcagcgtctcttaggtcatactcggttgcagctggattaattggagggggtttaggggattaaatttcttcctgcctaaaaattgaatagacaggaatttaatctctccattatattccagccttttcaattcgctcctaaccgaactaagcttttagggctagtttgggaacctaattttctcaatgaatttccattttttcaagagaatagttcatttggaaaaatggagttctcaaactagcccttagtgggttgagaagttgacccatctcacagtctagtgtcaagtgtttctgccagtagtgttcattcagatgctcgtacaaccatatggatggatatgcatgttcctgcagcgtttttatcctttcatttttcttgtttttttttcattattactggctgtatgcagaccagggccacctcgtgtgcctcgtgcatgtatatataattacatatacgtatgcattattgttgagcggtggagcatgcagcctgtgtaatcctgatgagcgatgacacacacacatgctgccctgttggctgcagcagcagcagctctataaatacctcaccaccgcgcatactcgcttcacacaaagaagctccataattaattattgcccgtaagtactgtgcctctctctcttagtatatattatcacgctcttggattttttgcaataacatagtagtagctaccagtagtttgttagtgaacaaagaagctccataattaattattgccctttcagttcgccatcggcagccgagcaccatgagctccacaggcggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaaccgcgtccgcatcttcgtcgacaccgtcgcggaggcaccccacatcggctgaggtttaaatctacaaaatgaatgactcggacatgccatgcgtacctgtccgtcgccgaataatggatgtgtgtgtgcttcgatcgttcctataagttgctagtaaaaataatggcatcgtcgttatgcatgaataaaaagtatcagaataatgttcaccctttcacgattggatatatgaaaatgtgctcgatcagttgtttggtttgttgtttggtttccaacttcttttctataagatcgatgaactggaacgcaggctcaaataatgatggaatctgcacaatatagataggttaacgacttagagcatgtacatcttattaattaaatatattttggtttaaggttaaaataggatgagacggtcatgtacgccttatcaataattaacgacttagggatgtataacttttcacatgacgacttgaaaaattagcatccacgcc

SEQ ID NO: 14762 - DNA, 668 bp, Zea mays
ggccgctttcgaggccggcccggggcagctcgagaagctccatcattaattattgccctttcagttcgccatcggcagccgagcaccatgagctccacaggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaaccgcgttcgcatcttcgtcgacaccgtcgcggaggcaccccacatcggctgagaatcaaatctataaaatgaataactcggacatgtcatgcgtgcatgtccgtcgccgaataatggatgtgtgtgcttcgttccaataaattgctagtaaaaataatggcatcgtcggtatgcatgaataaaatgtatcagaatgttcatcctttcacgattggatatatgaaaatgtgctcagttgtttggtttccaaaaaaaaaaaaaaaaaaaaaaaaaaaaaaaaaaaaaaaaaaaaaaaaaaaaaaaaaaaaaaaaaaaaaaaaaaaaaacccccgggggggggccccggcccccatttcgccttatagggggtcgatttacccgcgctcattggccgtggttttacaacgtggggatgggaaa

SEQ ID NO: 14763 - DNA, 635 bp, Zea mays
ctgtgcggcgctcgaggcggccgtttcgaggacaaagaagctccataattaattattgccctttcagttcgccatcggcagccgagcaccatgagctccacaggcggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaaccgcgtccgcatcttcgtcgacaccgtcgcggaggcaccccacatcggctgaggtttaaatctacaaaatgaatgactcggacatgccatgcgtacctgtccgtcgccgaataatggatgtgtgtgtgcttcgatcgttcctataagttgctagtaaaaataatggcatcgtcgttatgcatgaataaaaagtatcagaataatgttcaccctttcacgattggatatatgaaaatgtgctcgatcagttgtttggtttccaaaaaaaaaaaaaaaaaaggcccctaaggccaataaaaaaaaaaaaaaaaaaaaaaaaaaaaaaaaaaaaaaaaaaaaactttgggggggggccaaaaaaaaaaaaaaaaaaaacttggg

SEQ ID NO: 14764 - DNA, 2181 bp, Zea mays
cctgatttcatttcgttcggcgtccccacacggccacaccggaaaaaagaccccggcaagaacctcgctctccggcgtctccggccaatacccatggaggccaccgcagtgccgagggctctgttcctattcgggacatcgccggcgccgtatcgtatgcgtatgaactgcttgcgcgtagctattggaggagatgtgaggcggcagggggccgtggcagtgtgggcgaagaagaagagggggagggggcgggatagcgagacggaggaacgggtggacacgcacagcttcacccccaagccgggcgaggctgccgggctgttccccgaggccgtcctgcttagaaagaaaatggtgagagaggatggtcaagtgtcaccagaatttgctgatgcagacgaagaaaagctgtatgattttcttaatattgagctagaaagtgatttaaatctgaaaagaatgcggcactatgaagtagtttatctaattcatgaggaccgtgttgaagaagttgaaaatgttgtatcaaaagtacaagattttatcagggagaagaaaggaaggatatggaggcttaacaattgggggctgcgcaggcttgcttacaaaataaagaaagcaacacatgccaattacattttaatgaactttgagatagagtcaagatacatcaatgacttcaagaccctgctagacaaggatgagaggatcatcagacatctggttatgaaacgggatgaggcaattactgaagattgccctcccccaccagtatttcacactctgcgagctcaacaatattttgatgatgaatatgaagatgagggggaagaggaagaggatgaggatgctaggagtgagccaaagtctgccaattatgatgaggatgatgttgaagctgatgatgagcctgaaattatttatgtcgatgaagctgatgaggataattacgaagacactagaagaaggaacacaaagctaaaggtgaagaagtatacatcagagaaggtattgaggcagcattagtgtatggttttccacttagtttaagtctttttagctcttatagaaaggactatctgtgtctgtatgatgaggaagtttcacttaggtgtttttttctgatgccaaggaccactgcatgataatgagataggtatatgtgctatggttggtacagcccttgtaaatgctttctttagtgcacctttgtttttgtgcaactttattttccaaggaaaccaaaagcttaaatactatattattagtttgaatacccccttctcggactgcaaataaggtatgagtacacgcaaagaccccaaagatgcttgcctcagccattcagcaggagcgggggttgtgtgaatcttgtagcattcccaggggtaacttgttggaagcaaccctttggtttctgctttaaatttgtgcatgcatcaagtatttggagcataaaagctcctccaattttgttgatctgcaagttgttggcaggcttctctttttttgttcatttctctttattttagaaggctaacttcatgtgtgtgcaagttttgtatttggttggagagtccgtgtttcttttgttgacgaccgaacatgctagattcattttattacaccaaatatatcagcacctcatcactagttcagcgggtttgttgacgtgtacttgactagtttttgaagccagagagcaggggctagtattccaaacattttttgaaggaatggaattgacccagttttaaggaaaaccgggtccaaagcctacatagagcacacggtagaaaaaccagcgaacgccgtaacaaacaacctagacaacgacaacccccgcacacaaacatctagagtcatcgttgccaagctcaaacacaagagatgagcagcttcgacttcccaagacgagccacacactgccaaagaagcaactcgacaacgcttacatccagacaccgacgcaaggaataagaccgtggcacgccatcgtttccaaacattatttattggaggaacttgtactattatgtactgacaaaacatgaccgcgttgccaacttgattcaggtcatgtgatgacaaggaatgatggttgcgaggggaccttgcacaaacttcatcaatgatcaagcactaaggaatgttcaggactgtttttattaatgcctcaaa

SEQ ID NO: 14765 - DNA, 1789 bp, Zea mays
aggctcgtgcaccattgccccccgcgccccccgccccgaatagggccgtcaccggcccccatcggctgcctttcctcatcccacgcggcgcccatgccagccacacctgttcgaccacctgacccgcgcgcgccctgatggctcccgcgctcacctccaacccgccctccttccgtcccctaacgtccccactccgccgtcgtgccgccaccgtcccatgccgcgtcggtaagcccggcaaggactcctccgctgcggatgacgctaccggccccaacaagaggcccaacctcttcgcggacttcgggaatgccaagtcgctcatacaggcgttcccgtcgcagtcgctgttcgcgggcggtggcaggggcaggaaggacccgcagacggtgttcgtcgcaggcgccacagggcaggccggggtccgcatcgcgcagaccctgctgcggcaggggtttgccgtgcgcgctggcgtcccggacctagcgtcggcgcaggagctagcgcggctggcggcggcataccggctcatctcccccgcggaagcgcggcggctaaacgcggtagaggcgggcttcggtgaccccgacgcgatagccaagtccatcggccccgccgcgaaggtggtggtcaccgtcggctcggccgagaaagggccagaaggcggaggcgtcaccaccgacgacgcgctccgagtggtgcgggccgcagatctcgccagcgtggcgcacgtcgttgtcgtgtatgacgagggggcggccagcggcggccttggcggcgggggctccacttacaatgtgctcgacggcttcacgtccttcttctccaacctcttctcgcgagagcaggcgctgacgctgagccagttcttggccaaggtggcggagaccgatgtcaggtatacactggtgaaggcttcactcaccgacgactatacccctgagagctactacgcccagctggtactcacgaaggagggagtatcgcctagcgacacaggcaaagtgtcaaggtcacagattgcagcccttgtagctgatgtcttctccaatgtggcagtcgctgagaacaaagtcgtcgaagtttcaacttcctcgtcagcgacagcaaagaacatagcggaggctttcacagctatccctgaagacagaagaagaacagagtacctagaagctgctgcgaaagcacaagccgaagaggaaacgttggcctcagaacgagctaataaaaaagccgaagcggctgccagtaaatctgaagccgacacgaagacgacaccttcagaggaggcagctgctactcctagcgcggtgaacggggctcaggcctctctagagaacctcttgagtagagccaaagtgatcagtgcggatttctcgtgggagaagttcagcacacagtttgccgacgtgacgacccctctaacctcatcactagagaaggaacccaacaaggcacagatagccactgtgcgaggccaggaaaaagcgaagaagctggcaccgcggattgctgttgtgaagccagcagcgcagaaggcgaagcagccggatcccaaaccagaagtgagagcactgtttggtggcctcttcaaacaagaaacggtgtatgtggatgatgactaaaacgaggagcgccaatttatcctctacgtgattttctttcttttgtttttttttgtttgtccagtgccttggtgtactcttgaaataggaacgcttaaagttgtacaaaaattggctatatataagaaccaatgatcatgtgttacaaaaaaaaaaaaaaaaaa

SEQ ID NO: 14766 - DNA, 855 bp, Zea mays
atcatcattcatcacatcgatggcatagccagcgaacggcagacggaatcgcgcctcccatcctctgctttccccaaaggccagctccaccgcggcggcgccgctcctataaaccgtcagttccctctaggcgcgctttccccgcggcagcctgagcagccagccatgccggggcggcgggcgatcgaggtccggcagctgctgccggccggcggtgacgccgcgacgccgaggtggcgcatgtcgctgctggagaacacgttcagcgggttcgtgcagggcgccggcgccgaagccgtgttcgcggatgggtccctgttcagcccgttcctgttcggcaagttctttgacccagccgacccgttcccgctgtgggagttcgagccggacgtgctgctcgccgcgctgcgccgcggcaacgccaggaccgccgtcgactgggctgagaccgactccgattactacctcacagccgacgtgccaggtggaagtggaaggagatgcgacgtggaggtgagcggggacgcgatgaaggtggtcgacatcagcggcctctggcgggcgccgccggcggacggccgggactggcgcgcgggccggtggtgggagcacggcttcgtccggcgggtggagctgccggaggacgcggagtggaggaaagtggaggcatgcttcgacgacagcgaggggtccctggagatcagggttcccaagaccgccgatgcccgccaggccacggcctgacgccgccgagaatcggaaccttgcaatgcgtgcgtgtcgctgaaaaacgatgtatgtgatatgttcttcagtgccagctgttgaattggctagctaaaaaaaaaaaaaaaa

SEQ ID NO: 14767 - DNA, 3694 bp, Zea mays
gttgatagttgcagcttacatgttgaggtttcccttgcttgttttattttattttggcctgcacaaagctggactcgatgatctcccactaattttgttggcaatttatttacaggagtcttgatgatgttagaatgaaccttgaagttctcaaatactgtgctacagttctgttcctggtatgtttttgttaacatattttcccatgcctgactaatttcatcaactaagcagtcccagccacataaatctgtgttttttttttgcattaaagcactgatgatactttctcgcttactggcttcccatgtattggggcatctgaagtgggaaagctcagttcctcaatcgattacttaagtttagctattggaatgtagtcatatgttaatgatttttattattgatacgatacatgctgtggctcagttatggttgttgcagttgtcagttttccgcaaaagaatttacataactgataccataattcacattccatcgcaccttgaattattgtagaaacagtatgccttacaatgagtgagccataatgctgctgtggtaataatttgaaactcctgcttcatatggaaatttgtacatcagttctgattcttgcagttgtcagttttccagaagtaatctgagttcaactagaaatttaccaactcatgttcaattttgcaacttgaattactgcagaaataataccccctacaaagaaatggaatcagcatgttgctgcggtatatttgtagagttaattgtttgttaactgttgaagttaatatactagctgaacccccggctcctgctgcctggaggcaagtcttccagaggtgcttactgttgagaatctggttgaacgtgcaatgacaaggagccgagctaatggaactgcatcccctgatttgccaaaacctgaagcgaactctccaccggattcctcaaaaaaggcaacggacagtctctccagttgactgtgtgatgcctgcggaaggtaatcaaggaacaagtgatccttctaccaacagggaatctgttgagttggtatcccacattgaagaaatgaagctaaataccaccacacatgtggatgcaagttctagtggttatcctggatttcttgagccagacgatgtttccattgagtgtattaaaatttcagttgctccattacaccaatttggcagaaggtcatctatccagcacagagattgtccactgcagctttgttgtgcaggcttgaaagtacagtttggtgtcagcacgaagtttctagataatgcagggcggccaaagatgagcatagtggttgagatccctgagaacctctgtaaaggtttggaattctgcgatgttcttgctagaaagctgtcccaggaatctggtagcaggtctgaatggagacccctgattaagaagtatggatacattaatcgtccaactatccgtctgaagtgagttctactctttttctttttgaaaaatattcttttcttccattttctaccttggtgtggtcatgatgttttcctgagttctaaggatgccctttccttgcagcatccctcctatttccaacagcgatgcggtggccttctcaactgatatatgccagagagagcctagtggtaacattcagaaacttgctttcggcaatgtgggcaccacggaattggactctctgttcgttaaagggagcaaggtggacgcattcttttcactggagttatacgattaccagcaaaatgctggcattcggctggttgcaaagaggctggttatacactcgaattagcaccaggctcatttattaaaatactagtactagaaactaacccttgcactgattcaggggcctttagaccaccatatgtatttaaccaattgtagtttgtagattatgccgagtgcgtaagatctcgccacaaggaggtattgagctgttgatggtaaattaaaattcaaatgttgcaaaaatgttttaacaatctgtgctatttatttgtgaatagaatgcacatttgttgctactacagtctacagattgtgttttcacttggaacttccattgctggtgtcgtgagaaccggcggtgatgatttgtaccttcggttcgaaggcacgcgcggagaagtggagcgacaaactggcggcgaaaagaggccaaattggtggtgaaatcatttaacgctgccggtttgtcaccttgtgccgttgtgcgccacgcaaataccagccggcagcacgaggttcagaaggacacaatgtctgttagaacaatgctataatatagcgctgcggaccgtaagaatcgttgctggaagaaaagcctacaggatatagaacaactagttttcgtactccctcctttttttaatatatatgacgttttctattttaaaaataaattattgaacatcaaatatttagaaaatagaggttaatttagccgactgttaaccgtaaaaatcgttgttggaaggaacactgatgtctaagaggagagataaattagaacaacttttttttactaatttagacctttaatatttattaaacaaaatatatatgggtaattaagtaagctagtgcaactaagattttatcttaagtgttgttatctctaccataataaggagtttaaaatttatgttcaatcctgcctgatagatttgtatgatcttctagtgtctcacttagtaatctaattactaattaataacaaagaactagtctaattcaagcagtaagcacataattagaagggaaaacttaagcatacaatcttgctcttgattgaggaggtaggagaattgaggtgcgtcccggttgtcctggtgagatgggatcaagtcgccaccaccaccttggtggttgtcgtcgttcccttgcagtggagggttagagctcatcggcggtgggtcgtcgttgttctccaacgccattggttagagctcttccggttacgtcgagcacctaggcgatgagagcctctgtcgtgtgtaggattagcgttggcttaacctgccagccctaatcctctatttattgtgatgctaggtgaatcaggggctgcaaccatggttagggtgcccccatcaagggtgcaaaattagggagtcgattaagattaactcgacccagtttctgttaaacgtatgtagacgacatttcaacattctcccctctgttctctacttttcttgttcttaacttttctgggttctatcatttgacaaatttacacatcaagcccaaagggtaacgatggtcgattaagtgtcgtcgcactcattgactacaacatgctcctctgactcagaatcaaatatcttttctaggttgcaacgatagcccatttgatttaagatcataggttctcccttaaccccatgtcgactacgtgctatctaaacacgttaggtggaaagccttttgtgagaggatctgctagcatctgccggattctaatatgctcaactttaatagtgtgatcatgtatcttctccttaacaacataattaatgtcaatgaacttggcagcaccacttaacttattataggagtagaatattgctattttactcgctcattatcgaagtaaattctcagtggtttttctatgctatcaaccactctaaatctaggtataaatttattcatccaacatcgtcagcctaattcctca

SEQ ID NO: 14768 - DNA, 2976 bp, Zea mays
  misc_feature (808)..(808): n is a, c, g, or t
gaacaccattatgaaatcgttatatcaaaaacacaaactcatagaaactcaaagctactagaactagtgctaatctctcaaggaaaaagaaaaagggttaagacaactagcaaaataggtcacgatatccaaaaactgtctcaactccccttgaacaagtgcactctcctaaatgaatccacactttcaatatataccaactctttgtgtaacttttctctccattgttggtagatgcacacatcaactaaccaaaactgtaagcctcaaaaactgctagaaacactttgggatgtaggacatgggagcttcaggagtaggtcatctagaatgaaaagatactctatgtgatactaccatgtgagtatatctttaaatttgtgttctagctaatgctcaaactaatcatatgatacaagctatgattagcatagcattttgagcaaatgttaggcattagaaagggttcactattgaaatagcaattaacatatggaggtaggaagtcaagcatgtgctaacaagcctatacaagatgaactaccttaaacaggggtcaaccaacatgctacagaagaatagaaatgttgtgcgtaaagaatgttttagacatatcataaaaatgtttcagacaccccataaataatttgtagttacagtagtccataaagactttcgatacatagctgatcataaagaatgttttagacatctcgtgcataattttagaaaaaaataccaaggagatgtgttgaagtacatgtggccttgtgcttggacatgtaatactatgaggcatcaacgacanagatccgtctagaagaaatccttacttgcaagagaatcacaagcatgtttggtcatgagcaaagttttcgagggagtgcagagtggattatgtcaataacgagatattagaatgcttcaataattggatcaaggtttcaaaggactgcccgtagacaatcttgtgtacattattagagttaataccatggagaatatagcaatgatgcgccttataagttagaatcttgaagggccaatccttcttactgttagaaacttgagctatacaatcaaggtgagtggtggactaaagagtgaaatctctcgattgactagggactttacttgaaggcacacaatggacctagaagggaaaactttgctcatatgcgatcaatggtagatctcttggaatttttgcacccatgatatagcctttttaggttcattgagtaaaataaagctcgaattgatgatgactctactcaattgagcatttgaaggctacatgcatattaataccgtaggacccacctgacggctgttacgaccgttaactttaataaataccgacggccatttacgcccgtcgaacataagttaattttgactagaagcataaaaaattgactttttgcgtagtacgaatcggtttgttctgtacacgccggccgggctccgccggatgaaaccgtgtcagatagacaggcacatcaagtatttaatacagagaatgcaactgctctcccgttgtaaattattgaacagatcactaagccaaaacaaatttctagtagcacgagccacgtgccacacagtggcaggttaacgaacccactgcacctgcacgggtggtcgttttcacctgacagcgccgccgggccgtcctcatcccttgcttggctgccacggggcgagagagttcctcgctccctcgtttatttccgccccccgtccaaagcacgcgcgttgccggtcaattcgactggctgctcagcctcagcgtacgtctacctgccgagtcaaagcgagggagtagaagaagaaaccttggcaaccaaggcagcttcagacgtcagcatcacattcacatccgcgcgcgaagctgctggagcaaaagccaacagactcgtgcgttcacctcaccccggccggacacgaagcttcaagcttatcctcctccgtgcgactccctcccccatactcccctgcaatccagcatcacgcaactcgcatcgcagcagcgcgcggtctcctataaatacaactgcccctcgggcccggcccggatactactcgcacacagcaacagcaggaacacagttacacagaggtcctcggccgtggcagcacgttcacgttgaccaccagagctcaaacgcaacagccgcccatcatcagccagccgagccatcatcaggagagttcaggtcgtgcaagagctgcgggtgaaacaaaacgcatcgatccatccgtcggtcgcccaatcatgattctgggcttgggaggatgctgcggagctgccgccgccgccgccgccgtgtcgccggctgccgtcggcaagcaattgggaggccatctagaggccagtgagcggcagcagaagaagcggggggcaagtgatgagcagaagatgaacaagggaggcgagcagggagcggcggcagcagctgggggtaaggagaggagcaagacgaaggatcgtcacaaggctcccccgatcgttgtgcatcagttccccttccactctcgccccggcttgctctgaattcctctactcatcttggcgtcatgtgcgtgtttgtgatcctgtaattattcgcgatctcgtgtgttatccattgagatatagtattacagtataagaaacaatcattttctcaaaaaaactaccaaaaacaggcccctagccaaaatgcgttcttcactacttgtgttaccggatcaaaaacgaacgtgatcggacgggactgataacctcactctctttcgttttcattttcacgttttattacataaagacatgactagcgggatgaaaaaacaaaccaaaatgagcagattaaatcgataacagatcaaaatgacggaatcggaagtatgaaagcagaaacatcgccgccgcataaaatacaaaaaataaagtagcgttgcgatccataaaacatgagtaaattacatttttgg

SEQ ID NO: 14769 - DNA, 3342 bp, Zea mays
gtcgctacgcttggaagggtcccgcggggcgcaagatcgttttttccccttcttgctggtgttgtttgttggtggcggaatgcttcggcgccgccgttgaggttgcgcctcggcgtcggcattggaggtggtggcaaagttggattgattacctcattcaagatttgactggtgcaacaagtaatggttctcatcatcatgagtttggttcaaaaactcctagaaggccaggagctattgacaataccgatttaattgatgatgtgccacttgaagtctccaacatggagattgagatacatgataacttggttgagggtcgggattacatactgcttcctcagcaagtttgggaaaagttgcatggttggtatggtggaggaccaacattaccaagaaaggcaatcaatactggcttttctcaaactgatttggcgatagaagtttatcctctacgactgcagttaattctaatgtcaagaggagagcgaacctttataaggataagcaagaagggtacagttggccaactccataaaatggcctgtaaggtttttgacttggcaccagatgaggtatgcatttgggactattatggtcgaacaaagcattcattgatggatagcttggacaaaacccttgatgatgccaacattcagatggatcaaaacattctagttgaggtaaccactgatgcaagtggtagtcgggatggtttggttaagcgaaacaatttttttgagagtgatgctccgaaatcaggattgccagatgagaattttgcagccaacaactatgcttccagaagctatagctctagtctgacaccaagcatctacctgcgatcacccaatggtgatctggataatgtgcatggttctagtggcatgatcacgaggggatcgcccttaggtcttacagggctacttaatcttggaaatacatgctatatgaacagtgccatacagtgtctggtgcacacaccacagtttacgaaagacttctgtgaagattatcatcgcgaaataaatcggcaaaatccactgggtaatgtgggtgaacttgcattagcttttggtgagctattgagaaaactctgggctcctggaggacgtgcccctgtttcacctagaccattcaaaatgaagctttctcggtttgcatctcagttcagtggatacaaccagcatgattcacaggagctgttggcgttcctattggatggactccatgaagatttgaatcgtgtgaagcatagaccttacataaattcaggggatgctgatggaagatcagatgaagaagttgcagatgaatattgggcaaatcatattgccagaaataattcaatcattgttgatgtatgccaggggcagtacaagtccactttggtttgcccagtctgtgggaaggtttcagtgacttttgacccgttcatgtatctttccttgcccttacaatttgcctcaacccggagcgtgactgccgtggtgttttcttgtgatggtagtgttccaccaacaccattcactgtgaatgtaccaaaacaaggtttgacgattgtgtgtccttaaacattttggttgaatttatctacagatacggaatcataagatctaccgttttattgatgatccagtgcttcagctgtctacaataagtgatgatgatcatctggcagtttataagctcccaaagttggaaaagagggtgaattacattcagtttgtgcatcgtcatgaagatctggaccatggaaacaataacagcttgacatcttggaaaccgtacggtgttcctcttcttgcacaaatttcttgcaatgaaattgtcacgggttttgatatccatgagttggtccataaaatgcttgtgcccgtgctaaggaatccggactctctgcatttggctgttcaaagttctgtttccacaagaactcatagttatcataccgacagcagcaaatgtcagcttctgttggttgatgatagcaacacagtcattgaaaaatcaaatgatgctatcaggatcccacaatcttcacttgcaactgtattttttatcaactggcccaaggcagatctgaaaaagatagacactcatcatttagagtaccttccagaggtgtttatgtatgctccgcctgcgaagagaacccgtggtgaagctctgtcactctatgcatgcttggatgctttcttgagagaagaacctcttgtacctgaagacatgtggtactgtccaaggtgcaaggagcaaagacaagctagcaaaaagttggatttgtggagacttcctgaagtactagtcatacatctaaagagattttcatttagtaggtcaacaaaacaaaaactagaaacttttgttaattttccaatacatgacttggatttgacaaattacattgccaataagaagacttcagagcgccagatctatgagctgtatgctgtgagcaatcattatggcaacatggcaagtggacattatactgcacacattaagcttgtggatgagaatcggtggtacaacttcgatgatagccatgttgcttccattgatgaagatgaggtgaagactgctgcagcttatgtgctattctatagaagggtcagagaacaagacatagcaaggggaactagtaatggatctcagttatatgcaaaaagaagtcacggatatagccataggtaggctgatgattactgtggttcggtgcaagggggattctggaaatgacacccgcacgcctttagtcattgccaggagtatatggcttgctggaaaaaatgctcatcacgtgcagtcaatgcaccgttgtccagttgtcacagaagatatttcgtgcagtgctggtacaagatgggaattttgtatgaggtgagttgaaggagtaattgactctttatgataactgggtagcttcaacaggaacgccggggcttggtggcattttgttcgtctgttttcttctagaagagaaacaaggggaggcaagaaaacatttaggaaacaccttttcgttaatttgattttttatttccatttttagatttagctagtctgtacactgttgttggaaatgggtccgctgttgttggtcgatgcttgtggtggccaataatactacacccaactataccaggctctgcaatggcgaatcatggtgcacattatggtgctctgttgcgggaagaattgtagctgatgttgtacttatatactggcaaaaaggccccagaaatgtaaaaatgtatcgatatgctgacatcttaaaccctattttggattcgtgctctttcctatggatgaaggtgtgcgccatttaggggttgtcca

SEQ ID NO: 14770 - DNA, 2146 bp, Zea mays
ccggccgggcagccccccaaataaaactgaaatagcgaggaagggacgggttcggcctctctgcccgaattcccgattgcgcctcctccgactccgagatcccgtcagccatggacgggctcctgtcgaagctccgcagcctggacgcgtaccccaaggtgaacgaggacttctacagccgcaccctctccggcggcatcatcacgctcgtctcctctgctgtcatgctcctcctcttcgtctccgagctccgattatatctccatgcagttactgagacaacactaagggttgatacttcaaggggagaaacacttcgcataaattttgatgtcacctttccagcccttcaatgttctataattagcctggatgcaatggacatcagtggacaggagcacctagatgtgaaacatgatgtattcaagcagcgaattgatgcccatggcaatgttattgcgactaggcaagatgtagttggtgggatgaagatggaggcacctctacaacatcatggtggaaggcttgaacacaatgaaacctattgtggctcttgttatggtgcacaagaatctgatgatcaatgttgtaacacatgtgaagatgttcgtgaagcctacaggaaaaaagggtggggtgtatcgaatccagatttgcttgaccagtgcaaaagggagggctttcttcaaagtataaaggacgaagaaggcgaaggatgcaatatttatggttttattgaagttaataaggttgctgggaatttccattttgctccagggaaaagtttccagcagtcaaatgtgcacgttcatgacttgctcccgttccagaaggacagcttcaatgtcagtcataagataaacagactaagttttggagaatactttccaggtgttgttaatccacttgatggggcaaattgggtgcagcattcatcatatggaatgtatcaatacttcatcaaggttgttcctacagtctacacggacataaatgaacacattattctctctaatcagttctctgtaacggaacattttagaagtggtgagagtggtcggatgcaggctcttcctggtgtgttcttcttttatgacctttctccaatcaaggtcacattcacggaacaacatgtgtcatttttacactttttaactaatgtttgcgctattgttggaggtgtgttcaccgtttctggaatcatagattcgtttgtataccatagtcaaagagcaatcaagaagaagatggaaatcggcaaattcaactgatgttgccttactattgctgcaattaagtagctcctgttgcagctccaagatccagaaatgcaatgtggcttttcctcgaactcttggcacagttgcgtagttgacaaacaattgctcatcagataactcttgatgtgcttgccaacttgcttccggcaaagataccagcgagcaagatggtcatcttgtatacttcgatgttacatttttgtacgcttagtctgacaagaaaacattttacttcctcgagctgcaggtgttcgtgtactgttgtaaatttgtggtagagggagcctatctgtagttttttttacaattatgtgtttgtaccagttttttctgagacatttgtagcttagacaggtaaagattgtttgaaatacatataaaccatttttgaaggaaagcaagcttatcgttgtaacccgagggggggcccggattctcatcctgaattcataccgagttaagccaagacaaccaggtccacgagcattgtgctccttccaattcaaaatatcaggctttatttggcttggtatgacaaatcgcaaatataagaggctgctttcaaatacggatccaagatattactttggcacaaaaaggtttgcatagtctgacgaactctgaatccaaaaatgcgtgtgctccttataaaaaaatggaggggttgttatagagcacccatttggcaccttttcagtttttatagaaatattcctgaagagactgattttgatatcgtcaagttagtcttttgccagtctgtaggagaaccttttttgtgtgtatgtgtgttggtggtggttagcgccggggggggggggggggagccggaggttctgaactactgattctgaatcccagaaaac

SEQ ID NO: 14771 - DNA, 2714 bp, Zea mays
aattcggtacctcgaggccggggcggcgtctcggggactcgcttcctagcagcaccactccttcctccattcctccaagccacgccacacctcggcgcgtcccgccaaaaccccatcgatacccaaaccctagccagcccctctcccacgcgccatgtccgtcgcgtctgcggcggcggcggcctccctcatcgcctctacctcgctctccgtcccagaccgcatccgcctccatccccgccccgcgcttcctccactaccgtgcttccgccggcgatcgcgggtctgcctcgtacgcgccatcctcgaggaccgcccgtccccgcctgccgaggaggacgctaagcgctacgggctcaacgggaacgggagcgggctcggatacgacgatgccgccgtccaagcgtacctcggaagcaacggtaacgggagcgccagcggtaacggcggggcggtgaagcagaaccccgaggttgccgggagcagcgcggccatagtcccggccccggtcccgccggcggagggtgagaggagaaggaaggagagagtggaggagatcgggagggaggatgcctggttcaagcagagcagcgcagaggtttctgttgctcctggtggtcgctggaatcggtttaaaacctattcaacaattcaaagaacactggaaatatggggattcgtttttacatttatattcaaggcttggctcaacaatcaaaagttcacatacagaggcgtacggcggggggatgactgaggagaaaaagataatgaggaggaaagttcttgccaagtggctaaaggagagtcttttgagattaggccccacattcatcaaaatagggcaacaattctcaaccagggtggatattctcccacaggaatatgtggatcaactatcagagttacaggatcaagttcctccatttccttctgagacagctgtaaaaattgtcgaagaagagctgggggcatctgtaaatgagatatttgatcgatttgattttgaaccaatagctgctgctagcctcggccaggttcatcgggcacgtctgaatggccaagaggttgtgatcaaagtgcaacggcctggtctgaaggagctgttcgatattgatctgaagaatttaagggtaatagctgaataccttcagaaagtggacccaaaatcagatggcgccaagagagactgggttgctatttatgatgagtgtgcgtctgttttatatcaggaaatagactatatgaaggaagcatttaacgctgaaaaatttgctgaaaacttcaaaaaattggattatgtgaaggttcctgaaatttactgggcacacactactcctcaggttttaacaatggaatatgtcccaggaattaaaattaacagaataaagcagttagataagttaggagtcgatagaaaaagattaggtcgttatgctgttgagtcctaccttgagcagatcttatcccatgggtttttccatgctgacccgcatccaggaaacattgctgttgatgatgtcaatggagggagacttatcttctatgacttcgggatgatgggaagtatcagtcaaaatatccgggaaggattgcttgaagtattctatggagtttatgaaaaggatcctgacaaagtgcttcaagcaatggttcaaatgggtgtccttgttcctactggagatatgactgctgtcagaagaaccgctcaatttttccttaatagctttcaagagcgcctagcagcacaaaggaaggagagagaaatggcaaccgcagagcttggattcaaaaagcaattaactaaggaggagaagtttgaaaagaggaagcagagacttgctgcaatcggagaggatcttttggcgattgctgctgatcaaccatttcgcttccctgccacatttacatttgtggtcagagcattctcagttctagatggtattgggaaaggccttgatcctaggtttgatattacagagattgctaagccatatgccaaggaattgctaagatttaatgacgctggtgttgaaatagttgtgaaggatgcaaagaagagatgggaaaggcagtcccgtgccttttacaatttgttccgccaacccgatagagttgaaaagctcgcacaaattattgaacgtttggagcaaggtgaactcaagcttcgtgtcagaacgctggaatcagaaagagcatttcaaagagttgccgctgtacagaaaacaattggatatggagttgctgcaggtagtttgatgaaccttgcaacaatgttgtacttcaattcaatccggggaccagcaaccattgcatactccctctgcgcatttttcgggctgcaagttctgatcgggcttgtcaaggttaagaagttggatcggcaggagagactgataaccggtactgcatgagctatgagttattcatgatcaatcggtgagaactgaaccgccacttttcagcgttgtgcgtcgtcgcgacaccttttttttgcttttgcccaaattttacccccaccacgatttagcataggcatgccggttacccctccccccccggttgtatgatagttgtatgtaaatgtgatgataacatataaagatgtacatagtgtataatagacattctccatgtattgtttcgttttcatgatgtagcagtacgtacaggattttctttcacatgctacctgattggtttgctggctgcac

SEQ ID NO: 14772 - DNA, 4802 bp, Zea mays
  misc_feature (3938)..(3938): n is a, c, g, or t
ccactagatccccgtgacgctagtaacgaagattagcatgcagtgcagcagcatcaaagagatggccccaggccgtgcacacccccacagacaagagcacgctcaggctacaaacgaatgatcggctctccagtcacggaggcgtagaggtacggctgggccgggggtgccaccgcccaggcgccggcgtcgtcgctgtactgtacgcatgcagcttgcgcggctgcaccgaacataaatgcgtcacgtacatgcgtgtagccctactgctgcatcgggtgccactgacacgatccatcccgatcccggggcggcgtaaatgagatcaatgccaggacgggcagcggcctgcgcacgcaacggacgccggcgttctgcgccaggcgcccaggccttcggatgcccattctctcggcctcggacggacagacggccagagcggcgctgcagcgccgtcgcgtactacaagggccaaaagaaccggatccttgtctgatgagtttctactttcctggcacgacgacgcgccgcccggcgggtccctgcgccgcgcacgtacgctaccgtgtggcgtgtgtccggccgctgctctcgtccatttggccgggcaccgcgtcatgtcgtatgttttcgcttcgttttaggcggcggcagcagaaggagaggcacgttcgctcgctcgccaccggggcaaatgacatgcatgtcaacctgtccacagccggcagtagttaaccgcgcgccgacgccaccgcgcaagcattggcatcacccgtctcctcggctggtcctcctggcccacgcacgcccaagtctgcgcgcgccggcccgcccccagccgtcccagccccggagactccgaggcagcaggcaacccgcgccgcgcgtgcgccccacgacgccaccacagaaatacgacctcgctgtcccggaggccctcaccaccacaaagtcaaaaaggaaaaaacccggacgcgagacgttccgggcgcgcacatacgtcccattttatcttccttcccgtcccacgcgtgcgccgcgcggcgcgacgcgcaggaggtggccggccgatcgacgggacgggacaaaccggagcccgcctggctatacggcgtacggtacgacggcgggttgaccgaccatgccgtgcggctcgggccccggcgcggctgacctctgggcgatggccgccgagctggagcgccagttcgcggggtacaagcagcgcctggcggagcggacgaccaccggggccaccgccaccgcacgcgagcgccacgacgccggggacggcgcggaggaggcgggtgatgatgacgaggcgggaggcggcggcggcgacgtgcggggcaggaagtacgaggcgtacgcgcggcggagggacgagcggctgcgcgacgggtggcgcgcgcgcatggagcgcaaggaggccgaggtcaaggcgctctgggcgcagctcgagctcgccgccggccgcgccggacccggtgacccgacgacgaccgcgacggaggacggagacgacggggtcggtaaattccgttacgcgtgccacgcggaagctactgcgaccgcgagctagctgcacgtttcttttcttcttttttttggtcaacggtttcgtctcgtttttggaagagtctgggataactgccattgccgttcgtgcgttcaaaacgtccggcaaaagcacgcttccttgcttggcagagatcggaatcggatgatgctccagttcacacctttttcttttgttttccttgtccctccttgtccttggtcactgacagtgctgcaaccacgccgcgtgcgtattgcctgcggcgagccggcgacatatacgagcataactatatgcaatcgagagggagaaggaaggaaggggaaagcaaagcatcaaacgtccaagagtttgcacctcatcacgccaaaaaaaaagttgtgttttccggcgccaaagcttgggacaccgcatccacctggcatgcagaaccgcacgggcagaaccgtcacgttctccttcgtgtaatcgtgttgttatagtgcccgcgtgtcattcccgtcgttgtccctcgcgcaggggggcctcttgatgcaaaatttaaccttcaagatcatcatcagttcatcgggtttttttttctcaaatgtcattgcccatagaaaaaactggcatttttatagccatttttggaatttgattggaggtctgctgtttctctgtttggtcgatcgatagacacgggaagcatgccactgtgcaatcgtgcagaggaagactgaacggaacgacgccgacgacgacaggaggagaagctcatcgggcgcggctcttgccccgaggagggtcaccggcaagaggcacgtgcggaccaggagcttctcgtcgtcaaccatgagcaggaaccgcaccgacgtcgggaggcggcgggcgctgtcgcacgaaccgccgccgtcggagccggacgcatcctgcggggaagccgacaggaaaagccgagcgtggccggccggccgcgcggcggcagcgactgcagacacgatgagacccaggacccaagacgtctctgcggcgcaggagcacctccgtggaagggcacgggcccgcgaagacggcggcggggcggaagctcccgcggcctctgccccgacgagatgacagctccggcggacccgaggatctcggcagggatgtggcgctggcggtggctcagccaagcgccgagacggttgcgccacctgtgccgagtcgttcggccgagtatgctgccactggcggcgggacccccggggcttctccgacgaagatgtcgctcgctggcagggacgacgacggcagcggcggcaacggtgcggcgaacacacgagctacctcgccggagccagatcgcggagcggtggacgaagccgtgtcacacggcgaacctgacgcgacgcacgacgctggtgccaacgaacacggcggagaagagaaggtcgacgccgacggggaggtcactagtgagtcggaacccgagccgagctacgtctacgtcaacaacaaggacgccgccgaggagcgagccgtggcggcgctctctgagccttggacactggccggttcggccgctgcggttggtccggacgtcaaggcaagcggagagacgccggcggcactagcaccaccagccgaagctactaccgcggccgcagcagaggtcgcgacgacgaacgccgaagaagcgccggcgagggagagctccgacgagtcctatctgtcggccaggtcgtcggtgccgagcgcgcgggcgtcgtgcagctcgcgggaccagtccgccgagcggctgctagaggcggacgccgccctcgcgcggaagaagcgcgccgagaagagcgcgccggcgccgagtacgccgccgggcagcaggtcctccggcgcggcgaggtccccgagacaggcgacggtgagggggttcaagaggttcctgagcttcgggaggaagcacagggggagggaggtcactgtcatcgactgcacgtcgccgcccgtgccctcgccggtccacgacgccagcggccggtggcagcccgctgatgggtcagtcaagcgcaggatgggctcctctgatgctgcctctgatgatacaaaacatggctatccggtgtctccacaaggtactcctttcttctaaaattcttcgtgtcatttgacattcttttttttagaccatggttcacatgcttaatacaaagaggcgcacttgtatgttttgattcttttttagagctcttcttccgtgttttcaaaatctatttacatgtttggtattcttttatacattaatctttataattttctctataattttagtcggagttgagatgctctcacttctcaaggaaattggatagcttgtaatttagaatggacagtttgtgctctttaacctatggcactngctgagcggcttcatatactttcagcagcggcgtgctctttgcaaagccttgtagctgcctctcctgcaaagtatgaacttgctaagatagtcccacaagagaaatcaccaaaaggtaatgcttcattttccaggtcatcacccttcttgccatttctcctcggttcctttttcaatgaatgtggctcagcacgcacgtgttccgttctgattttgctgttccatagcttccattcaaccaatgccttctgattttttttcttttgtctattgcagttcatcgatcgttcttctcgttccggtcactcaactgcggcaggggctgaccctgctgataccatcataccatacaatgcattgggaatgtagttgctgtaaattttagagagaagaaaactttgtgcttgatgtgttatgccgccttgtatagttgtgtctgacgatgtctgtatgtattggtgtagtcgtctgtcatctggcctggcatatacatcagtagcactgtagctgtaggtttactgtgcctgtgtactacagatccatatcatgcgtgaagtgttttccttcttcattcagttaattctagtgctcccatcgtagctcattcaattcatggattgtcgtaatcatatttgtcatatgtttgacaaacggcagcaccgtgacagagaagaaaacacttcgtatatccattcgtttcaaagtgaagataaaacacgttgttatgcaatatgttgtctttgttaaatatttagaaggtgttgagcaccaaattggctggcggacggtcctgccatgaggctggacagtctacggttcggacgatacgtcgttgtggcgcagagccatttaggattatgagtt

SEQ ID NO: 14773 - DNA, 1111 bp, Zea mays
cattgggtacctcgagggaaaaacgtagcctcgcactctcgcaggcggcggcgcatcgagaaacagggctgcggctgttgcttcttccacctctccggccatccggcggtccatcgttccgtgccggcggcctcccctcctacgcccctgccgattcttcaatcttcaccaacgtctgcgcgtagcaggctagcagtcggcacggcttcctcagatctgccggacgacttgctgttcgtcaccgactcaccagcaaccaacgtcagccatcagccggcagcaggggaagctgggcggagggtcattgcggcacggcgtccaggcgtacagaaggcaccagcaacagcccatggcaaacgccgcagatgaccctatggcagatgaagccggagtagaagatgccttcacacaggagatcaatcattcgtacgtccctagataccatgtgttgagttggatggaaactgtggaggggatggtggccggtgtggcgtcgcttccgccggtgtatttgatactgaacagagatcttcttgagacgggatggggatggaagaggctggtgccctacagacctggttatgttgagttgcatgtgttcaagaaataccttggggactatttcgaccataatcgtgaagcttttctttgtgccgagcagaagcctgatccatttggatggattgttgctgaaaagagtgccctgattgctgcagccaaatcgtgcctcaagatggagaaggcacttctcaggtactgtgctagctttctcactcctgacgacaaaaggctgatcctccggatcaaggaccaggcaaagcaaatgatccaatcagagggtgatcaatctttgattgtaactatatgcttggagtgtattgcgaaggaggccgagttaatgtacaattatttgccttgtgattttgacaccaccgaagaagtcgccgtctgcaataaggttcggcggtctgccttgaatcttatgctctacaaaggttctgaatctgctgttgctgctggtgccatgatgggtatcacaacagaggctaagtccatttttgacttgcttagtcgagaccatgacgtggtcatggaaatttttacttgtgag

SEQ ID NO: 14774 - DNA, 1975 bp, Zea mays
ccacgcgtccggctgaataccttcagaaagtggacccaaaatcagatggcgccaagagagactgggttgctatttatgatgagtgtgcatctgttttatatcaggaaatagactatatgaaggaagcatttaacgctgaaaaatttgctgaaaacttcaaaaaattggattatgtgaaggttcctgaaatttactgggcacacactactcctcaggttttaacaatggagtatgtcccagcattgggtacctccaggccggcccggttagataatgttaggagtcgataggaaaagattaggtcgttatgctgttgagtcctaccttgagcagatcttatcccatgggtttttccatgctgacccgcatccaggaaacattgctgttgatgatgtcaatggagggagacttatcttctatgacttcgggatgatgggaagtatcagtcaaaatattcgggaaggattgcttgaagtattctatggagtttatgaaaaggatcctgacaaagtgcttcaagcaatggttcaaatgggtgtccttgttcctactggagatatgactgctgtcagaagaaccgctcaatttttccttaatagctttcaagagcgcctagcagcacaaaggaaggagagagaaatggcaaccacagaactgggattcaaaaagcaattaactaaggaggagaagtttgaaaagaggaagcagagacttgctgcaatcggagaggatcttttggcgattgctgctgatcaaccatttcgcttccctgccacatttacatttgtggtcagagcattctcagttctagatggtattgggaaaggccttgatcctaggtttgatattacagagattgctaagccatatgccaaggaattgctaagatttaatgacgctggtgttgaaatagttgtgaaggatgcaaagaagagatgggaaaggcagtcccgtgccttttacaatttgttccgccaacccgatagagttgaaaagctcgcacaaattattgaacgtttggagcaaggtgaactcaagcttcgtgtcagaacgctggaatcagaaagagcatttcaaagagttgccgctgtacagaaaacaattggatatggagttgctgcaggtagtttgatgaaccttgcaacaatgttgtacttcaattcaatccggggaccagcaaccattgcatactccctctgcgcatttttcgggctgcaagttctgatcgggcttgtcaaggttaagaagttggatcggcaggagagactgataaccggtactgcatgagctatgagttattcacgatcaatcggtgaggactgaattacaccacttttcagcgttgtcgcgacacctttttttttcttttgcccaaattttacccccaccacgatttagcataggcatgccatacccccccttccgggttgtatgtaaatgtaatgataacatataaagatgtacatagtgtataatagacattctccttgtattgtttcgttttcatgatgtaccagtatgtacaggattttgtttcacatgctacctgattggtttgctggctgcgcatacccaggctatcgtcagacttgtcgccggtccgatatggacatttttggcgtaggcaaataacttcaaaaggacttattttgtatccgctcatggtactaacgtctctcgcgtgcaggcaattaaatatatgctcggccaaagtcaatgcacattggcgcataatgagatggtatggataaccaaactgatggatgatgattcaaggtgaaatgatcgatttggaaagtgatttttctatatctttctcacaactttattgctgacccgagtgtttgagattcgaacctagagcatatgatgacgtcgttactcaacatatcatcaacactactctagcctaacattgttgtgaatttaatctacaataactcttcgtcaaattgatatgttcttgaccttgttg

SEQ ID NO: 14775 - DNA, 886 bp, Zea mays
aattcggcacgagggcgtgtaacacctggcgtaccggacccgaaaattttcttcgaacgagctctgagcagtgtagccctcctgtccgctgttcggtccccgcggcccacctccctctcctccttccgacctcgccgcctccctcactaaactctaaaccctccaccagccgaagctactgccgcggccgcagcagaggtcgcgacgacgaacgctgaagaagcgccggcgagggagagtcctttactttttcctatgctgtagcaaaacaagcctataccatcttccaaatatactcgttccgtgccggcggcctcccctcctacgcccctgtcgattcttcaatcttcaccaacgtctgcgcgtagcaggctagcagtcggcacggcttcctcagatctgccggacgacttgttgttcgtcaccgactcaccagcaaccaatgtcggccatcagccggcagcaggggaagctgggcggagggtcattgcggcacggcgtccaggcgtacagcaggcaccagcaacagcccatggcaaacgccgcagatgaccctatggtagatgaagccggagtagaagatgccttcacacatgagatcaccgattatttgtacgtccctagataccatgtgttgagttggatggaaactgtggaggggatggtggccggtgtggcggcgcttccgccggtgtatttgatactgaacagaggtgcgattttcttttatatttcttccggttcatgttctccttgtgtggctggtgctggattcaaccgatctagggaagagatgttagttgatttgctgtaaaaatcaatatgttaacagagatatatgatacatgctcctgcttgctcatgatgccaaaaaaaaaaaaaaaaa

SEQ ID NO: 14776 - DNA, 3862 bp, Zea mays
cttttacggttcgactactataatcagtttggctggtctgctttttcactctgtcttacactttttttatgctgcatgtttttcatatcggacattttaacgtaccagcagatgtaaatgatcgttttaggtaactcgaacagtaattgaggtatgcgctgacgatgtgaccgcacgaattgatgcttcattcgtggcttggtgggcagggtaggaagaactgaacagtggcgtcgttcagattcatatcagcatacgagaatatgaatgaattgattggtcaccatccaggtggggacgacacaggttacctaggatttgattaaaagtggaggaataaactacagtacagacacttccacggaagcgatctagagccttccgaaccaaaagctaccaggaactaatattaggctttgcgaggagacgaagaaatggtcatctggccgtaaccatcagtgtagctcatagttatcctctcagcactaagttaacctatgaacaactaggtttttcgaagagaaatcaaagcaaaaggagacatttggcgacattcattcctttttttttcccgatcacaaaggtaacgtgtatatatatgcacacatcaacaccacacaaaactaagacgtggttccaatcgctcatacacaagtaggacatggtcctaaactattggccgagagaaacttacaaagtaaagtccagccgtctgaattctaattaaagacataacttttttgtaaacaactcaaatgataggctgatccactcccctttcggcatgtatgtcctagatagcccgaatcacgcacacactaaccctccacaacaaacaaatgtaacagtttgtctcgatgtgattgatctacgagctgcacatctgctcccttctcattggtttaaacacaggtactgtattcccagtacctgattgaataccgtcgcgagcccgcaaaagtctagtccagcacgaagcacaccgcgtgcgctaattgagaacgagaacagagtatgcgactttggcaggacgcacaagcgcagtggtcgttccattccatgggaggaccaagtatccgctcgcgatctacagcgagccgaaaggaacgtccgcgcgaagccgagcggtcaatgcgcgtggggcccgacccaccgaccacgatcccgtccgcgccacacaacacaacgggcatcctactctttttttacctcttccacggttccaccgtggaacctggaacggcccggcgagcagcaaaaaatcgccccgcctttttggcctgatcctctcgcgagcacgcgacctttataaacgcgagcctcgccatggccgcccactcccggcccgagccgcgcgccccattggctcgtgtcgtgcacgcacaccgctcgcccgccccccgcttccttggcaaagcctcgcctcccggctttccacgcgcggcatcaagctcctcatcggtgcagttcgcacttcgcagcgggcgggcgggacacgacactccacacacacacacacagagcgacacagattgcagctcggcacgttggaggcaggcagggatggagccgatgggcagggacggcggtggaggccacgggaggggctggaaggggaagggcgtgagctcgggctccgccgcggggaggcagctggcgccagttttagaagacgcgccggcggccgcattgctccggcccttgaagaagatccgcagccccgaccggcgcctcatccgctccctgtccgcgctctcgtcgtcggctcccccttcccctgactcgtcctccgtttccaaccccatgtcgccgccgtcgacgcgacacatatttccgttcgcgtacgatccggctccggcggcatcgacgtccacggctgcgtcgccaaggctcctgccgctgttgcagtacggcagcgtgttccagcagcctctgccgccgcagcagcctttgcagcaccagcagatgatttcgttcggaagcagacagcaacagttcggggcggccgcggctcctctgttcccgccgcagctcgtggcgccgccggaggtgcagcagcaaatgctgctgctgcgctactggagcgaggcgctgaacctgagcccccgggggttccgcgccggggccggggccggggccgtgccgccggcgctgtaccagcagctgctgcgcgcgcccaagctctaccgcggcgtgcggcagcgccactgggggaagtgggtggcggagatccgcctcccgcgcaaccgcacgcgcctgtggctcggcaccttcgacaccgccgaggacgccgccatggcgtacgaccgcgaggccttcaagctccgtggcgagaacgccaagctcaacttccccgacctgttccttggcaagggccgcgtcggcgggagcggccgcaccagtgccagtgcagccgtgtcctgctcctcctcttcgtcgtctgctccgccgacgccggacgagaatcacgcgaagcaagctcagcggcatgacggtgagcagccgtgcaacagcgaagcgaagcctctgttcccggaagcagagcagccaaacaacttggaacacgaaccgaattctcagctccaatcggccgatcaccatggcggtgacggcagcacggtcatgtttcagccgtcggtggcgtcgagcggcatgtggggcccggccgaggaggcgtggttcagcgcctggggcccgggcagctccgtgtgggactacgacatggacaacgcccacggcctcttcctccagtctcgcttcgccagtgaggctgccagcatggactacgtgtccagcatgccggaagccccggcgacaccggcggcagggactgccgtggcctccgctgcttccctttcttctcctccccctcttcctcttccccgcagtccaacctacagggggaaggactgaacatggcacacgatcttcacgcgcaggaagtatccaccggaatcgggatgctcacaagttgcaggttttaagagtcggcttgtggcgtctcgcagcacgatcaccattcaccgaacaggggcatcgaaggacccccattttatctggacctttccctctgactgcttttttttttctctcccgatgaaacagcataaggaatcccagctggatttttaaggctgggacaaggatggcctctgtttcaaccgccatccttgttgatattccgacatgatatttaggtatttcaagcatgtgtcccttgttgcatggtttgcagttgcacagcggcatggagtagtgttctgtctttaagggatctccctaaaggcttggaagaggagacgggttttatgctctcctctgatctttagttgaatgtttaagttttctgcaagtactgcattgtgtactagtactactgcacaaatatgagcgtcagtgtgtgcgtgtgtgttgtgtgctttgggtctggaatatatgtatgtcattggcaaaacaactttttgtcttgttcggttattgatatttcctgtagactggagtgtattgggtgagattgagataaattttgacttattataaatttaatccgactcaatttcatcctggactaacgcaaaaatgaacaagcctttatgtgatgtcaaatccatatctaaagaatttgtagctccttaagaactgttgatgtatatatttttaggatatgtctttaatggttccgctttctccactatttttaaatactattttcgacaattgtgactcttctctgatcttgcaattacgattgtatctctcgcttttcacctttgtggttttacctctctgttctgaaatgaagtcgttgtttgccgctctcctgaacagtattagtgaaactcagaattagtgattaaaaata

SEQ ID NO: 14777 - DNA, 2256 bp, Zea mays
  misc_feature (17)..(17): n is a, c, g, or t
  misc_feature (35)..(35): n is a, c, g, or t
  misc_feature (42)..(43): n is a, c, g, or t
  misc_feature (343)..(343): n is a, c, g, or t
  misc_feature (398)..(399): n is a, c, g, or t
  misc_feature (514)..(515): n is a, c, g, or t
  misc_feature (979)..(979): n is a, c, g, or t
  misc_feature (1039)..(1039): n is a, c, g, or t
  misc_feature (1087)..(1087): n is a, c, g, or t
  misc_feature (1146)..(1146): n is a, c, g, or t
tttttttttttttttcntttttttttttttttttnttttttnntttttttttttttttttttccgcaggacgcacaagcgagtcagtgcttcgttccatgcccatgggttgttccttccttgatctacagcgagccaaaagcaacgtccggggggtcaatgcgcgtggggcccgacccaccgaccacgatctcgtccccgccacacaacggcgtcgtcctcctttttattttcctcttccacccgtggaaccgaacaccccggcgacggcgagcagcaaaacatcggcccccgcctttttggcccggtgctcgcgagcacgcgaccctttataaacgcgcgangccccgccccctccgaatcagaaccgcgcgccccattggctggcgcacgcacgannggtcggtcgcccgcccgctccccgcttccttggcgaagccgctgcctcgctcccggtttttccacgcgcggcttcaagctcctcgggtgcagttcgcagcgggcggccgggcggnnacaacacgacactccacatagacacacacacacatacatagattgcagctcggcacgttggaagagggcagggatggagccggtgggcggggacggcggtggcggtcgcgtccgcggccgcgggaggagctggaaggggaagggcgtgagctcgggctccgccgcggggaggcagctggcgccagttttagaagacgcgccggcggccgcattgctccggcccctgaagaagatccgcagcccggaccgccgcctcaaccgctccctgtcctcgttctcgccggctcctccttcccctgagtcgtcctctgctttcagccccatgccgctgccgtcggcgcgacacatatttcttgatccggagagcgagtttcagcgccctatgacgccgccgccggatcagcagcagcacttgcagcaccagcagatgatctcgttcggaaagcagccagcaacccgcgccnaagagttcgttgcggcggcggcggcgactcctctgttcccgccgcagctcgtggcgccgnaggtgcatcagcaaatgctgctgcgctactggagcgaggcgctgaacntgagcccccgcgggttccgcggcggggccgtgccactgccgccagcgcggctgtaccancatctgctgctgcgcgcgtcgtcggggccgcccaagctctaccgcggcgtgcggcagcgccactgggggaaagtgggtggcggagatccgcctcccgcggaaccgcacgcgcctgtggctcggcaccttcgacacggccgaggacgcggccatggcgtacgaccgcgaggcattcaagctccgcggcgacaacgccaggctcaacttccccgacctgttcctcggcaagggccgcgtcggcgggagcggacgcaccagcgcggcggcctcgtgctcctcgtctgctccgccgacgccggacgagagccacacgaacagcgaagcgaagcctctgctcccggaaacggaaacagagcgggtagacaactcggaacccgaaccgaatcctgagctccagtcggccgatcaccaaggcgacggcaccacggccatgtttcagccttcgggcggcgtgtgggggtccgggccgacgaggcgtggttcagcgcctggggccctggcagctccgtgtgggactgggactacgacatggacaacgcccacggcctccttctccagtctcgcttcgccagtgaggcgaccagcatggactacgtgtccagcacgccggaagtcccggcagtagggaccgccgtggcctccctttctcctcctcctcctccccgcagtcctacatgaaggactgagcatcgcacacgatcttcacgagcaaggaagtatccaggatgcgcacaggttgcaggttttaagagtcagcatgtggcatctcgcattagggtcaccattcacaaagcaggagcaccttaaggagtaaggaccaccattttatctggacctttccctctgaccgctttcttctcctgataattaaaaacgccataaggaatccccagctggttttctgagtctgggacaaggatgggctctatttcaacccccatccttgctgatatttccatgacaatttcatggttccaacatgatctttaggtgtttctagcatgtttccttgccgcatggtttgtagctgcatagcggcatggcatgcatgaagtagcgttctgtctctagggatccctaaaggcttgtaagaggagacgggttttatgc

SEQ ID NO: 14778 - DNA, 641 bp, Zea mays
ctgtgccccgcccgggcccgcggcggccgaaaaaccctagctcatttgttgctctgcacgccgcacttcagccgatggtcgacggcacttggccggctcactactctcaaattcttattgtcagtctattctttagtttttgcttttctccccctcctccagtgatggccggtatgggtagccgagtcaaggacggggccctacagtgcctactgccgctgagctcatcccctagggcgggtgtgccgccgtcagtagggtccctggcggtggtccctggttggcgttctgtggtggcaaggtaagttcgaccaaagttggtcgtcttcggtgttgtaccttgtcgtgaactcatggtgaggtaagaactgcggccatcttgtcgtgtctgtgaacacttgaacccggttctaaccccaaaactcgatcccactctgtgatgtatgaatgtatgaaatggatatgatgtaaagtttggggatccagttttggatgttgtttctgcgtggatccagccatatgcgcggttctctgttatttgtttgtgtttttgaccgagatccgttccacaaatgttatggacagtgcttatgcacttcgatcccaaagaaaaaaaaaaaaaaccggcacccccgattctg

SEQ ID NO: 14779 - DNA, 939 bp, Zea mays
aaacaatcgaatggtggtgttgaacaacgaacgctgcaggcacttcccgctgacggacggcgcgctgtgcctggtggcggcgacggcgttcacggcggagttggtgctcttctacttccactccacgacgcacatggggctggaggggtactaccactacctgctggtgctgctggtgggcctgtgcgtcgccgccgccgtcctcggcgcgctcctgccggacagcttcccggccgacctggcctcgggcgtcctcgtcgcgctgcaggggctctggttctaccagacggcgctggcgctgtacgggcccatgctgcccgcgggctgcgcccgcgacgccgacgcccacgtcgagtgccgctcgcgcgccgcgcaggagcgcgccgagcagctcgccatctcccagctcttcgccctcgtgctcctcgccttcctctacgcgctcgggtgctacgccgtcgctgccgccaggtacgggcaacccccggagctggccgcggttcgtcataggcacgccgcggccgtcgagctggagtgccggcagggtgatgacgctggcgcgatggaggagtgcgcgatctagtggtgctggctgctctggatggagtctgctggactctgccttttgggtttatttggtgtagtagccgtataggaaattcagagtacgtgcatggtcagaactcagaagtagttatcttcaggctttcgatatcagggagggcaggcaggaagtgtacatgttcggattaactatcaccaaagcttttgggtttcatttcacgagttgcttaacttatgctgtaactgttactcatgtcagaggagaggagcgatacatagaatgaaaggaatatacttgttcgcaaaaaaaaaaaaaaaaaatatcgataccgtcgactgtttaaacacaataaagttggaactggaggggggaaa

SEQ ID NO: 14780 - DNA, 2587 bp, Zea mays
tcctcttcgggcctcggccttctccccctctccacacggcgtcgccccctcccatttctccagcatcgacgatgaacggcggcggcgggcggcggcggtactcctcggagcagctcctcttcgacgttccctccaatgccggtgccggccggtgggcgcagcagtccggtggagtgcggcgcggggacggtgagatcttcgtgtcggtggagccagctacgccccccccccccccccccccccacgccacggccggggactcgccgggacagaggcagcagctcagtcccgggttgctcgacctccatgcgttcgacaccgagcttattcccgattttcaagtaccagggatgtatgatggtgcccaaaagtttggctatggaggaggtctagatgaatctgatatgagattcacagcaaacaagctgatgagcaagtctgctgtttttcctgatggtaactacctgaaggccttcacagagaaagagaaggcagcacctgtcgcgaaaatcaaagtggtggtgcgcaaaagaccacttaacaagaaggaagtatcaaagaaggaagaagatatcatagacattgaacaaagatcaaactctttgactgtacatgagactaaacttaaggttgatcttactgaatatgtcgaaaagcatgagtttgtattcgatgccgtcttagatgaagatgtttcaaatgatgaggtttatcgtgaaacagtggagcctgtggttccttcaatttttaatcgaacaaaggcaacttgttttgcttatggacaaactggcagtggaaagacatataccatgcgtccccttcctcttaaggcttcccaagatatcttgaggttaatgcaccatgcatatcgaaatcaaggatttcaattgcatgttagcttctttgagatatatggtggcaaattatttgaccttctcaatgataggagcaaactttgcatgagagaggatgcaaagcaaaaggtttgtattgttggtttgcaagagtatagagtgtccgatgtagagactatcaaggagttgattgaaaaaggcagtgctaccagaagtactggcacaaccggtgcaaatgaagagtcctcaaggtctcatgccattcttcagcttgccattaaacgccgtgtggatggcaatgactccaaaccacccagacctgtcggcaagctgtcatttattgaccttgctggcagcgagcgtggtgctgatacaactgacaatgataaacaaacaagaatcgagggtgctgagatcaataaaagtttgcttgctttaaaggaatgcattagagcacttgataacgatcagactcacattcctttccgaggtagcaaattaactgaagtcctgcgtgactcattcattggagactcacgcactgtcatgatatcatgcatttctcctagttctggctcttgtgagcatactctgaacacattgagatatgctgacagagtgaagagtttgtcaaagggaagcaatgccaagaaagatgtgtctttggcagtgcctttaagagagtcgagcccttccccactgccttcagttgtaccctcattctctgcatctgaggtgatgaatgatatcaccgagagaaacaattttggttggcccaagcagcagtatgttaaagaacggcctgctccgacatttgttgaacgaatgcccaaagtgaaggatgccgtggagttcgcaacatcagacggtgcttatttgaagggacaaagaagccagggctgtatggcaccaaatatagctgaaataccggatacaatgtaccagcagagaaggcaaccagcaaggaaggctaaagataccgctttgcggaataatatgagaaattccgttgcttacccaactagaagggttgagccagacgaagatgatcatctgaataatcttctccaggaagaggaaggcttggttagtgctcatagggagcaggttgaagcgactctggacatcctcaaagaggaaatgaacatattaggcgaagcggatcagcctggcttccaacttgacgactacaacattacgagactaagcagtatactctcgcagaaggcggctgggattgtggacctacaggctcggttggagcagttccagaggcttttggatgagaacaatgtgctgctatatgctcagagcccccggttgtagttccatctgttgccttcatggcaccgtaaaaggtgggcatcggtggcttctaccagcgcctcaggtggcatcatatgcggtatcggcgtgtcgctgtggccatgacccatggtgccggtgaaacgcaaactagacggctagttcacagcctgttgccatggttctttggcattgccggccccgcaacctgttttgtactagagttgctccattcttgtcttcccgcgctccatccataatccaatgtgtatatcttatatttgtccgtgtcacatgagtgctctgttatttgtagctcaacaaatacattgttttacctttctgatgtatgaagttttccagagtgtacggtatcatccagttacaccaaaaaaaaaaaaaaaaagggcggcctcgcgatttaggac

SEQ ID NO: 14781 - DNA, 3876 bp, Zea mays
  misc_feature (2152)..(2152): n is a, c, g, or t
ctggaggctcaggattgtatcacgcagtctcttaactatctcttgtatttagaaaactgtttcaagtaattagggctgtactgaaaacgagttcacattttcatctcttccttatcaattactcatccaaaaataattgttgttctcaccgttggataagtcaaaaattttaattttaataaaaatagcaatacttacagcatataattaatattattagataaataatcggtgttttataacaaacttatttgaagatataatattgataatattatttgtaaatctaggcaatattttaaaaatgatcatataaatactgacacttattttgggagttggaatggccagacaagatttttacacgacagatattcagacaatgatacctccaataaaattgattattttttcaaaagaaaatataacgaaatgcctcttccaccaaccattgccccgtaccacggtcgagaccggcgctgcctaaaatccccaaaaagcagctgaacaacaaaaaaaacgcaccccacccttttttgtccctatacctgcagccttgaacgccactccaaattcaaacttggggggcgtcgacgcaccgtctcgcaaatcccagggtgcaacctgcaaaatcatcccctctctggctcccggaaacagaggtcttttttactctagcccactagcggccgctcctccgcctcccgttgtcccctccatcagtcccctcgtccttctcccctctccacacggcgtcgcggctcccctcattcgccggcgtcgacgatgaacggaggcagccggcggcagcggtactcctcagagcagctcctcttcgacgtccccgccaatgccggtgccggccggtgggcgcagcaggtacggcatagcgcttcatcgagatccgagcgggtccaggctttccggtttcttctaggataagctcatcgcaggttcgctttgtgtgtgcagcgtggcggggtgcgtcccggggacgggcagatcttcgtgtcggtggagccccccacgccggcgcggctgtgcgcagggcacgccgcggccggggactcgccgggacagaggcagcagctcagtcccgggttgctcgacctccatgcgttcgacaccgagcttattcccgatgtgaggccaatcatctgtattctttagtttttatcacttatcagttgccgcatctgtttcagtggcctcgcttgtttggaataaatattactgttcgagaatgctgtcgggcaaatatcgcttttattttgtttctcaattggtcatgggcttagtcacacgcatattttttgggtttcctaggcgtgctgtttttttgatgtacagaaactgggatgccaaacttatattttgttggctgaatcatggtcaggggttgatatggttaatatgttgatttatcagtctgtttgagttgttaaacttaatctagtcctttagttcagaagatgcatctacttttatttagtgatgattcttcattccttctttaatcctaacctttttcccggacaatatggttctgtagaaaaagatgctttatcatttccctagtgacagttcttaaatactggagctaaaatacatatttcatgtatacagtttcaagtaccaggaatctatgatggtgcccaaaagtttggctatggaggaggtctagatgaatctgatatgagattcacatcaaacaagatgatgagcaagtctactatttttcctgatggtaactatctgaaggccttcactgagaaagaaaaggcagcacctgtcgcgaaaatcaaagtggtggtatgttctttgattttgtcacacacttgctgataaatagatcttgttgccttagctgttatgtcataatctgtccacttctaatagttttgatgtgacatatgatatgaaatgcaggtgcgcaaaagaccacttaacaaaaaggaagtatcaaagaaggaagaagatattgtagacattgaacaaagatcaaactctttgactgtccatgaaactaaacttaaggtttgcattttcttctattgccgttcctgatgacaaaccttaagaatcttaatatctggcgcatgattcacaggttgaccttactgaatacgtcgaaaagcatgagtttgtattngatgctgtcttagatgaagatgtttcaaatgatgaggtgccgactgcaaactctttgctattagtggtagtattgtgcatctacattttcagttacctgtgattatccaacctacaggtttatcgtgaaacagtggagcctgtagttcctgcaatttttaatcgaactaaggcaacttgttttgcttatggacaaaccggtacacgctcaatcttctctagattatacatccacaaaacacttgatatcatctgaactaatattctccactcaggtagtggaaagacttataccatgcgcccccttcctcttaaggcttcccaagatgtcttgaggttaatgcaccatacctatcgaaaccaggcggttcccctgtatgtcagcttctttgagatatatggtggcaaattatttgaccttctcaacgataggaggtgagtgaccacaaaatctgtgatgttaaaggattgtgtatatctatgcgcctgctattcctcacattttgaatatgactttcttcatgtagcaaactttgcatgagagaggatggaaagcaaaaggtttgtattgttggtttgcaagagtatagagtgtccgatatagagactatcaaggagttgattgaaaaaggcagtgctaccagaagtactggcacaaccggtgcaaatgaagagtcctcaaggtctcatgccattcttcagcttgccattaaacgccgtgtggatggcaatgactcgaaaccacccagaccagtcggcaagttgtcatttattgaccttgctggcagcgagcgtggtgctgatacaactgacaatgataaacaaacaaggtgacatttcacaatttctgcccctttattcttgtttgcaataccttgtgaatgtgtcggcatgttgtttatcgaactgttctttctgaaacacaatgcagaatcgagggtgctgagatcaataaaagtttgcttgccctaaaggaatgcattagagcgcttgataatgatcagactcacatacctttccgaggtagcaaattaactgaagtgctgcgtgactcattcattggagactcacgcactgtcatgatatcctgcatttctcctagttctggctcttgcagagcatactctgaacacattgagatatgctgacaggtgattacttaactccactgttgctataactgctcatattcttataatacgcacaagacattctcatttttcagagtgaagagtttgtcaaaaggaagcaacgccaagaaagacgtgtctttggcagtgcctttaagagagtcgaactcttccccactgccttcagttgtaccctcattctctgcatctgaggtgatgaacgatatcaccgggagaagcaatttcggttggcccaagcagcagtatgttaaagaacagcctgctccaacatttgttgaacgaatgcccaaggcaaaggatgcgggtggagttcacatcatcaaatatagctgaagtaccagatataatgtaccagctgggaaggcagccatcaaggaaacatgtcactttggcgaacaatatgagaaattccgttgcttacccaactagaagggttgaaccagatgatgatgatgagcatctaaataatcttctccaggtagtgctatctctacgagattttcttgtcatgacatggctgaggtgaacatcgactttgaatgattgctgcaggaagaggaagaattggttagtg

SEQ ID NO: 14782 - DNA, 2600 bp, Zea mays
  misc_feature (723)..(723): n is a, c, g, or t
  misc_feature (742)..(742): n is a, c, g, or t
gcacgagatcagtcccctcgtccttctcccctctccacacggcgtcgcggctcccctcattcgccggcgtcgacgatgaacggaggcagccggcggcagcggtactcctcagagcagctcctcttcgacgtccccgccaatgccggtgccggccggtgggcgcagcagcgtggcggggtgcgtcgcggggacggggagatcttcgtgtcggtggagcccgcgacgccccccccccccccccccccccacgccgcggccggggactcgccgggacagaggcagcagctcagtcccgggttgctcgacctccatgcgttcgacaccgagcttattcccgattttcaagtaccaggaatctatgatggtgcccaaaagtttggctatggaggaggtctagatgaatctgatatgagattcacatcaaacaagatgatgagcaaggctactatttttcctgatggtaactatctgaaggccttcactgagaaagaaaaggcagcacctgtcgcgaaaatcaaagtggtggtgcgcaaaagaccacttaacaaaaaggaagtatcaaagaaggaagaagatattgtagacattgaacaaagatcaaactctttgactgtccatgaaactaaacttaaggttgaccttactgaatacgtcgaaaagcatgagtttggattcgatgctgtcttaaaatgaagatggttcaaatggatgagggttatccgnggaaacagggggagcctgnggttcctgcaatttttaatcgaactaaggcaacttgttttgcttatgggcaaaccggtcaggggaaagacttataccatgcgtccccttcctcttaaggcttcccaagatgtcttgaggttaatgcaccatgcatatcgaaatcaaggatttcaattgcatgttagcttctttgagatatatggtggcaaattatttgaccttctcaatgataggagcaaactttgcatgagagaggatgcaaagcaaaaggtttgtattgttggtttgcaagagtatagagtgtccgatgtagagactatcaaggagttgattgaaaaaggcagtgctaccagaagtactggcacaaccggtgcaaatgaagagtcctcaaggtctcatgccattcttcagcttgctattaaacgccgtgtggatggcaatgactccaaaccacccagacctgttggcaagctgtcatttattgaccttgctggcagcgagcgtggtgctgatacatctgacaatgataaacaaacaagaattgagggtgctgagatcaataaaagtttgcttgctttaaaggaatgcattagagcacttgataacgatcagactcacattcctttccgaggtagcaaattaactgaagtcctgcgtgactcattcattggagactcacgcactgtcatgatatcatgcatttctcctagttctggctcttgtgagcatactctgaacacattgagatatgcagacagagtgaagagtttgtcaaagggaagcaatgccaagaaagatgtgtctttggcagtgcctttaagagagtcgagcccttccccactgccttcagttgtaccctcattctctgcatctgaggtgatgaatgatatcaccgagagaaacaattttggttggcccaagcagcagtatgttaaagaacggcctgctccgacatttgttgaacgaatgcccaaagtgaaggatgccgtggagttcgcaacatcagacggtgcttatttgaagggacaaagaagccagggctgtatggcaccaaatatagctgaaataccggatacaatgtaccagcagagaaggcaaccagcaaggaaggctaaagataccgctttgcggaataatatgagaaattccgttgcttacccaactagaagtgttgagccagacgaagatgatcatctgaataatcttctccaggaagaggaaggcttggttagtgctcatagggagcaggttgaagcgactctggacatcctcaaagaggaaatgaacatattaggcgaagcggatcagcctggcttccaacttgacgactacaacattacgagactaagcagtatactctcgcagaaggcggctgggattgtggacctacaggctcggttggagcagttccagaggcttttggatgagaacaatgtgctgctatatgctcagagcccccggttgtagttccatctgttgccttcatggcaccgtaaaaggtgggcatcggtggcttctaccagcgcctcaggtggcatcatatgcggtatcggcatgtcgctgtggccatgacccatgatgctgcaatttgtttttaacccataggtgccggtgaaacgcaaactagatggctagttcacagcctgttgccatggttctttggcatggccggccccgcaacctattttgtactagagttgctccattcttgtctttccgcgctccatccttaatccaatgtgtatatcttgtatttgtccgtgtcacatgagtgctctgttatttgtagctcaacaaatacatttttttacctttctgatgtatgaagttttccagagtgtacggtatcatccagttacacacatacttttgccaag

SEQ ID NO: 14783 - DNA, 1586 bp, Zea mays
  misc_feature (1569)..(1569): n is a, c, g, or t
ctatagggccgattggggccgacgtctgattgttccgggcggcaatggggccggggattccgatccgaccggcggcccgggcaggtactggcacaaccggtgcaaatgaggattcctcaaggtctcatgccattcttcagcttgctattaaacgccgtgtggatggcaatgactccaaaccacccagacctgttggcaagctgtcatttattgaccttgctggcagcgagcgtggtgctgatacatctgacaatgataaacaaacaagaattgagggtgctgagatcaataaaagtttgcttgccctaaaggaatgcattagagcgcttgataatgatcagactcacatacctttccgaggtagcaaattaactgaagtgctgcgtgactcattcattggagactcacgcactgtcatgatatcctgcatttctcctagttctggctcttgcgagcatactctgaacacattgagatatgctgacagagtgaagagtttgtcaaaaggaagcaacgccaagaaagacgtgtctttggcagtgcctttaagagagtcgaactcttccccactgccttcagttgtaccctcattctctgcatctgagctgatgaacgatatcaccgggagaagcaatttcggttggcccaagcagcagtatgttaaagaacagcctgctccaacatttgttgaacgaatgcccaaggcaaaggatgcggtggagttcacatcatcaaatatagctgaagtaccagatataatgtaccagctgggaaggcagccatcaaggaaacatgtcactttggcgaacaatatgagaaattccgttgcttacccaactagaagggttgaaccagatgatgatgatgagcatctaaataatcttctccaggaagaggaagaattggttagtgctcataggaagcaggttgaggagactctggacatcctgaaagaggaaatgaacatattaggcgacgcggatcagcctggcttccaactcgatgactacatcacaagactaagcagtatgctctcgcagaaggcggctgtgatcgtggacctacaggctcgtctggagcagtttcagaggcttttgaacgagaacaatgtgctgctatatgctcagagcccttgaccgtagctccgtcggattcatctgttcccctgttgccaccggaaaaggtgggcactggtgatgagtctcgggcggcaacctgtgcgttgttgctgtggccatggtgctgctactgtaatccgtcggtgccagtgaaacgcggaactagatggctagttcacagcatgttgccatgcttctttggcatggccggcccggcaacctattttgtactagagttgctgcatccttgtgttcctgcgccccatccaatgtgtatatctcatatttgtccgtgtcacatgaatgctctgttatttgtagctcaacagatacgtttttctccccctttctgaattctgatgtatgaagttttccagagtgtatggtatcatcccgttatacacagcttttcttggatctttaaaaaaaaaaaaaaaaaaaaaaaaaaaangaaaaaaaaaaaaaaaa

SEQ ID NO: 14784 - DNA, 792 bp, Zea mays
catgctctacctcgaggccggccggcagagccagtctctcctcgcctctctctcgcgcaagccacagtagagcaaccaaccataccaccggcccgtgtcgatctctggcctctctcgtgcaaggaattaagcaggcaagaggccaaccttcttccagcatggccaaggcgagcagcaggctgctcttctcgctctcgctcgtcgtcctgctgctcctcgtggagaccactacttctccccatggacaggctgacgccatcgactgcggcgcgagctgctcgtaccggtgcagcaagtcgggacggcccaagatgtgcctgagggcgtgcggcacctgctgccagcgctgcggctgcgtcccgccgggcacctccggcaacgaggacgtctgcccctgctacgccaacatgaagacccacgacggccagcacaagtgcccgtgatccatccaccgtggttcccagcatcagcagctttgccaaaaagacatgatacctacatatatataagagtacctagctgctgctgctctactaccttgttggttcattatattgtgcgcgtgcatgcatgaataaataaatgaacatattagggcatgtacaacccagatacggctgcacggtactccaagtacaagatacaactaaaacacaacacaatacagtggtcatgtctaaaacatgtgtcttacgatattcattgtaccaatcagagtattcaataaattaaagtgaccaatcagaaaaaaaaaaaaaaaaaaaaaaaaaaaaaaaaaaaaaaaaaaaaaaa

SEQ ID NO: 14785 - DNA, 859 bp, Zea mays
ccttcgcacgagaccattttggggccccccgggccggcgggaacaaggccacatcagcagagagcccagcaactgaaaaaaccaaccatcgcgcgggcacggttgcggttgctacctcccgatcccgtcctcccgcaagccaagctctctctctccccctccccttcagcacgatcggagtccaagtccatcccatccagacccactcgacagtcgacccgatggcgccgtccatctccgtcggcgccgcggcgccgtcccgtgcagcgggcgcgagcacgaagaagagcgcggacgaggtggagctcctgcggcggcggaacgcggagctggagcgggaggtggcggcgctgcggctggagctgggcgcggcgcggcgccgcgccgagacggcggaagaggccgaggagcggctgtgcgtgcagctcggcgacgccgaggtggaggcgctcgagctcgcgcgcgcctaccaggcccacgtccacgagctcgccagggagctcgccgccgcgcgcgcggccccggcacgcccggccagataggttctcgtgggctggtagtaggctactagtagctatagcgtgcggttcagcgggatggctgtggttcccgcgtttggttggcgtcggacggcaccccgcgccgcggtgccatttatttgctcgccgccggcatcgtcgtctttgctttttgctgtgtcgatgatgattctttaacgaacaagagtccatgatgacgcgtcctaaaaaaaaaaaaaaaaaagggactgttgaggctaagggcatgtacaacccagatactgctgcacggttcgccgccgccgtcgtacaactaaaaacaccatatatacagtggtcat

SEQ ID NO: 14786 - DNA, 650 bp, Zea mays
cattgggtccctcgaggccggcagccagtctctcctcgcctctctctcgcgcaaggcagagtagagtaaccaaccataccaccggcccgtgtcgatctctggcctctctcgtgcaaggaattaagcaggcaagaagccaaccttccaccatggccaaggcgagcagcaggctgctcttctcgctctcgctcgtcgtcctgctgctcctcgtggagaccactacttctccccatggacaggctgaagccatcgactgcggcgcgagctgctcgtaccggtgcagcaagtcggggcggcccaagatgtgcctgagggcgtgcggcacctgctgccagcgctgcggctgcgtcccgccgggcacctccggcaacgaggacgtctgcccctgctacgccaacatgaagacccacgacggccagcacaagtgcccgtgatccatccaccgtggttcccagcatcagcagctttgccaaaaagacatgacacctacatatataggagtactacctagcttctgctgctgctgctgctctactacctgttggttcattatattgtgcgcgtgcatgcatgaataaataaatgaacatattatacaatagtatatatgtgatggcggcctggcctaaaaaaaaaaaaaaaaagcgggc

SEQ ID NO: 14787 - DNA, 1386 bp, Zea mays
  misc_feature (1366)..(1366): n is a, c, g, or t
atccaggggtcggcatcagcctctctccctcgctctctctgactcgtcgcggcataaacaaacaaaccaaacaaagcaaagcaaaggcaaaaccccacctccaccacacctcgtcgtttgcttttcctcggtgcgggcggtgcggcacaagcccccagaccggttgcctccattactgagctgtgcgtgcgtggtggctgtctgccttgtggcggcgccggtcatggtgatggtggagatggacggtggcgtgggaggaggaggaggaggagggcagacgccggcgccacggcggtggcgcctggcggacgagcggtgtgacctgcgcgccatggagacggactacgtgcggcggtttcaccggcacgagccccgcgaacaccagtgctcctccgccgtcgccaagcacatcaaggcgcccgtccacctcgtctggtctctagtgaggcggtttgatcaaccacagcttttcaagccctttgtgagccggtgtgaaatgaagggcaacattgagattggcagtgtcagggaggttaatgtaaagtctgggctgccagccacaagaagcacggagaggctggaactgttagatgacaatgagcacatactcagcgtcagatttgttggaggtgatcacaggctgcagaactactcgtccatcctcaccgtccaccccgaggtcatcgacggccgaccggggacgctcgtgatcgagtccttcgtggtggacgtccccgacggcaacaccaaggacgagacctgctacttcgtggaggccctgctcaagtgcaacctcaagtcgctcgcggaggtgtccgagcgacaggtcgtcaaggatcaaacggagccccttgaccggtgatgggggagatacatacatacatgtcgaacgatatgttcggatcactgcattgcattgcttacgatgtgcagagctaatcttcaacggagcccctaggttcctggagaaaagagctttgagggactgctactgctactgctatgccgcgtcgttcaaagttaagtttcctccttgcgattgtgtttgctgtccttttctccggcgttgtacgtcgcacaaggagaaggacaggcagaatatgatgtgctattgtagtattgaaaaatgaaaggaaaaaaagaactgtgaggctctgaacatcttcattcccatggtcaatgtgtggacttgagggtttctctgtaattagattcgctctagattgccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccaaaaaaaaaaaaaaggggcgcggccgttcgcgaattaaaaactanccaattattttaaaatcgga

SEQ ID NO: 14788 - DNA, 680 bp, Zea mays
cccacgcgtcccatccaggggtcgtcgtcgtcactctctccctctcgccctcgccatcgccctcgcggtctcgccgcggcataaacaaaacaagcaaagcaaggcaaaggcaaaggcaaaaccccacctcctcgctccgcacctcgtcgtctgcttttcctcggtgcggaacacaagcccctgccgcctccattaccgggctgtgcctgtgcgaggctgcgagcgtggtggctgtgtctggctttgcggcggcggcggtgatggtggtggagatggacggaggcgtgggagtagcagcaggaggaggaggaggagcgcagacgccggcgccggcgccgccgcggcggtggcgcttggcggacgagcggtgcgacctgcgcgccatggagacggactacgtgcggcggttccaccggcacgagccccgcgaccaccagtgctcctccgccgtcgccaagcacatcaaggcgcctgtccaccttgtctggtccctggtgaggcggttcgaccagccacagctcttcaagcccttcgtgagccggtgtgagatgaaggggaacatcgagatcggtagcgtcagggaggtcaacgtcaagtccgggctgccggccacaagaagcacggagaggctcgagctgttagacgacgacgagcgcattctcagcgtcaggttcgttggg

SEQ ID NO: 14789 - DNA, 735 bp, Zea mays
aactgaaaggatacctttttcgtaaacccttctattgtattgtgagaaattttctttccttccttgaaggcaaatggtagattcagggcttttcacattaatggatccaaaagggagtgctcggcacacttctgttttttcatgagaagaggcagggatctaaagtgccacagcccccttccactctttccggttggtaccaagagtgctagcagcgataggataaatgcactacttggaagatgggaggggcattctgtgactaagcggagtggggtgtatggagcaacacttgttgaggcagatacagctattgttctcaagatggacagtaatggccaattaattcaggatactttatcaactaaattcggaactggaacaacaacggtcaactggacaggatcagcaaatgacaacttgcttcagtttgatggaggatatgaaataacattgctacctggtgggatgtacatgggatatccgtcagacattagcaaatctgttgcccaattagattcttttcatttggagttctgttggatggaatcacctggaaagaggcagcggcttgtccgaacttacgattcagctggtttggctgtttcgtcgacctatttttctgaaaccaaagtatgagtcacagtttcctcttacaaaatgtattgcaacgaattttgtaagtgatccaataatctcactaactatttttgttgtcccgtgcaaaaaaaaaaa

SEQ ID NO: 14790 - DNA, 1521 bp, Zea mays
actcgatatttatctcaccctcactttaatcttacgtctaaacactatagaaattatgatgccccttctatccatcctcatgatcaaaccaaacacaccactatagccgtcgccaatacccgataagactcggcaaatcagctggacacatagcacatctatcccgcttccgtctcccgctccagtcgccatggcggaagccctcgtgggcctccgcgtcgctgccctcgccgtcccgcaggctaggagccaccgcagacggcttctccccgctgcgcgcctcgctgcgttccggcgcgaccggctgagcactgcccgcgcggccgtcgcagggccaccggaggtggacgaggacgattccatgagtatcgacaacttgcatcgtttcttcgacctcaacgtcggaaagtgggacggctcattctaccaattcgacgcgcacgggagggttcttcaggagattagcacgcggctgtccgtgagcacgtacggggaggacaacctcatcagcctccttcaatcgttgtacattaagcaagcatcctctgcaatatcaatcgtggacgaagaggattctgaacctgaatgggtggaatacaaaatcaaagagacgaacatattcactgtggacaaatatcagcagatagggttctttcctgaagaaaaggcatttgctctgaggtatcagactgctggaatgctggagactgttcttcgggttggcacgcttggagaagatgatactggtgaagaatctcccaaaaacctgaagataccttctcgcaagccatctattgtatgtgaaaattgtctttactcccttgaaggcaatggtcgaatgagggctttccacataatggatccaaagggagtgcttgacacacttcttatttttcatgagaagaggcagggatctgaattggcacaatcatttaaacactattcagtttgtaccaagagtgccagcagtgataggataagtacagtacttggaagatgggaggggcattctgtgactaagaggagtggggtgtatggagcaacacttgctgaagcagatacagctgttgttctcaaaatgggctctaatggccaattgattcaggatactttatcaactaaaatcggaactggtacaacaacaacggtcaactggacaggatcagcaaatgaaaacttgcttcagtttgatggaggatatgaaataacattgctacctggtgggatgtacatgggatatccatcagacattagcaaatctatttcccaattagattcttttcatttagagttttgttggatggaatcacctggaaagaggcagcggcttgtccgaacttacgatgcagctggtttggctgtttcatcgacctatttttttgaaaccaaagtttgagtcatagcttctataaaatgtattgcaacggttttgtaagtcatacagtaatctcactatttgtgtccttcggtgcatgatatttgagtatatattgtcagatctttctaaaaaaaaaaaaaaaa

SEQ ID NO: 14791 - DNA, 876 bp, Zea mays
gccggccgggttgggctccagccccgccgggctagatctcacgaaagagtagcttcgacgtagaagaaactttggagcccttcaaatcccatggccgcgctcggttcttctgtcacctccagaggcttggcgctccatacctccgtgtgtgtggtttttcttcgtcgtcgccacgggaatccagtgatcccggccgcaccgtctcgtcaccagcgaagtcttgcgactgggttaacgacgagttcttcaggcatgaacaatgccttccctattatcaaaggaactacacgaattcctgcggttggtcctggccctgcaaatccggcaggaggaaacctgccaatacccagcagcatgcctccgtgggccaagtgggtggccggggccgtcatacttgcgatacctatctacaggaggttcagaactttagaagacaagatagagaagacgacggaggtggccatcgaggtggtcgacacggtggcggaggctgcggagaaggtcgccggcgaggtcgccggcgcgttccccggcaacgacggtctcagggaagcggcctcgaagattaagacggtcgcggatgagatcgaggaagacgccgagaaagccgaggccctaatcgagaaggttgacgagatcaagaaagaggttgattcaattgtggatcctataatcgacaaggttgtcaaggacaaagaaatatagagacaggtggtgaactgaagatgtaaacatttgttgggctggtctggttaggaatggatccggatatttattcagatgttaaattactttcgattgcaaacaaatatgatatataatttgttatgtaaatttattatgggggattttagtattaagcttatcaagattcac

SEQ ID NO: 14792 - DNA, 868 bp, Zea mays
ccggccgggaagcaacaaacttggtactagataacatgaaaggggtgccccgccggcgggccgactttggcgcccttcaaatcccatggccgcactcggttcttctgtcacctccagaggcttggcactccatacctccgtgtgtgtggtttttcttcatcgtcgccacgggaatccagtgatcccggccgcaccgtctcgtccccagcgaagtcttgcgactgggttaacgacgagttcttcaggcatgaacaatgccttccctattatcaaaggaactagtacacgaattcctgcggttggtcctggccctgcaaatccgccaggaggaaacctaccgatacccagcagcatgcctccgtgggccaagtgggtggccggggccgtcatacttgcgatacctatctacaggaggttcagaactttagaagatagagaagacggcagaggtggccatcgaggtggtcgacacggtggcggaggcggcggagaaggtcgccggcgaggtcgccggcgcgtttcccggcaacgacggtctcagggaagcggcctcgaagattaagacggtcgcggatgagatcgaggaagacgccgagaaagccgaggccctaatcgagaaggttgacgagatcaagaaagaggttgattcaattgtggatcctataatcgacaaggttgtcaaggacaaagaaatatagagacaggtggtgaactgaagatgtaaacatttgttgggctggtctggttaggaatggatccggatatttattcagatgttaaattactttcgattgcaaacaaatatgatatataatttgttatgtaaatttatattggtgattttagtattaagcttatcaagattcat

SEQ ID NO: 14793 - DNA, 778 bp, Zea mays
  misc_feature (774)..(774): n is a, c, g, or t
gcacgagctctctctctctctctctcgcacgagaccactacctcgacccccgcgcggcataatcgtccgtccaatccatccattcatctacacacgcagttgcagcacatacagctagctagctcgttactgtttttgcagctgatctgatcgaccgacgcgacccaccgatcacgatcatgagctaccaagcgggctacccaccgccgggccaacaggcctacggcgcgcctccgccggcgtacgtcgcgccaccgccggcgtacccgccaacggcccaggacggcggcgcggcgtactacggccagcagcagacaaccaccaccagcagcagccgcggcggcgacggtttctggaaaggatgctgcgccgccatctgctgctgctgcgtcctcgacatgtgcttctgaggacatatcgtcgatcgatcgacgacggccagggcatgctagctagctgatgaccggccggtacgtgcgtggttgatgatcaccatcatgtgctgctctagtagctgctgtgtcattatatattacacatcgtgtatacatatatacgtatacgtacgtactcgtacgtcttcgaattcattcctgtggttattgtattatacatatgcagcacactttgtactcgtacccgtgtctgtgtcgtgtattcaattgtcgagacattcttttacgattctaatgtatgtagtattaattacatgctatatatatattccgttccgtgatactaaaaaaaaaaaaaaaaaaggcccctaaaaaaaanagaa

SEQ ID NO: 14794 - DNA, 647 bp, Zea mays
aatccccgcatccattcatctacacacgcagttgcagcacatacagctagctcgttactgtttttgcagctgatctgatcgaccgacccaccgatcatgagctaccaagcgggctacccaccgccgggccaacaggcctacggcgcgcctccgccggcgtacgtcgcgccaccgccggcgtacccgccgacggcccaggacggcggcgcggcgtactacggccagcagcagcagacaaccaccaccagccgcggcggcgacggtttctggaaaggatgctgcgccgccatctgctgctgctgcgtcctcgacatgtgcttctgaggacatatcgtcgatcgacgacggccagggcatgctagctagctgatgaccggccggtacgtacgtgcgtggttgatgatcaccatcatgtgctgctctagtagctgctgtagtgctgtgtcattatatattacgtacatcgtgtatacatatatacgtatacgtacgtactcgtacgtcttcgaattcattcctgtggttattgtattattatacatatgcagcacactttgtactcgtacccgtgtctgtgtcgtgtatttaattgttgagacattcttttacgattctaatgtatatatgtagtattaattacaaaaaca

SEQ ID NO: 14795 - DNA, 3752 bp, Zea mays
  misc_feature (3722)..(3722): n is a, c, g, or t
attctaaaaagatatgcattcaaaaatctaaattaaaatatgacaaactatgatacctggaattgattctagggctggacgaaatactcgtggctcgataactcggctcgattcggctcgttagtagctcggctcgactcggctcgttttaatttagcgagccaagctgacattctagctcggttctctaatgagccagctcgggttagctcgtgagctagatcgcgagccaaatgagtcaagccacaacacaagtttgtctagtcgtttgtgtcgtctcctctcatagtcttgtgttctcgtagttatgatctctgatatggacatgtgtggatgtgccatgtgcttaaatatttgtattattgcatggctatatacctacattgcatatttaatatttgattattggttatggttttgtgaactttgttttctagttagtgctgtgcaatgaaatgttacatatttgtgaaatagatgatgaattgctttataatgatacttgttgctaacttattttaataaaaaggtttgtaaatatgtaagttaatacatatttggttattcaatttaatattgaaaggtagaagctaggacgataatatgataataatattataaaggtcattatagtgttaaacacttaaatattattgaaagctacaagctacaagctaagctggctcgttatagtaacgagtcgagctggctcgatatccacccatactttccatgtgaatccaccatgtttccatctctagccacatgagcgtgtgctagggagaagcgaagtattatggaacttttgtaagcaagctgtcttaatgagatcaataacgaaaacaaaactaacatcattaggcactctactgttgagaccaagtggcttcataaactccttatcattttacttttacggaaatataatatcgtctatcttgatgtgagatcgagtggatttataaactccttatcattttgccgatcaagagacaactaaggtccatcacaaagctaaaaattctgtagtcggaggaaacgcgactcgatggatccccgctgtcggaccatgttgatttttttatgtttttttttatataaacgtgagtcgcgtgcctgctaaagcttcataaactccttatcacgtttcctccgactaaggttctatcttgatgtaatgaataattacatgtttaggtgttgtcttcatagaattataaaactagcatcctgtcgattatccagcaatcgacaaagtatgtatcggctaatgaatggccgacaacctacgtgtgacagatttagagtagaataccggagacttggctactgttggtgcgtccgacagcaggcacacgactcacgtttcctcggagttgagtctgtactagtgtagtgcacctatgctagtgcgcaacaggcagcagccgcccactggcacggtagcatggtgacccgcctgtatgcacaacggtatactaataacaataatctccttagcacacaagatgaccgcgtggcctaatggataaggcgctcgcctccggagcgggagattgtgggttcgagtcccatcgtggtcgatgtttttttttatcctgcatttatttttttttgggcggaaaagaagaagacaattcaagtgccaatcttttctctcagcccaccgaccctagcattgttcatgggccgccatcagatgcttttagccccgaaacagttccagtaacaaacgtggtcatccgaaggcccagcggccgcggccatgggctgcccattacgtaatcgccacgtgccaaatacgtaatagtagtacacacctttacgttacgactttacgagttaatgcaacgtattctaaatgttcgagactatggtagggaacttctcaaaaataataataatactaataaatggtcgtttttttatatcgagcatcttttaacaataccctgtaaaggatgattattccaagtttggagaaacgcagttacgtaccatggatttgcttcacttttatttaaaatcggaattgatcctctcaaatatgccagctgcttagaccattgctaaaataattagtttgtactctaaagatcacggtgatatcgacgtccgcgttttcaggggtccaaattaacatcacttttggttctacatacacgttgccaccttgttagctactgtagtacttatcatatgctttcgtatggcagaggggaaccttcggtttgaagaatcaaaatcttattctagatgtctataaatttggtagaatgaatcaatttttaatattattactaattattagattatgagcaatgaattggtgattgatcaacttattatatttcataaaccaaaataaaaaaagtgaggagtgcgaaaatgacatgtatagtttgaacacgcaccgggaataaggcgtttttcttctccctggaaatgtgtggcgtggcgtccagttgaaccaccgacccaacacagcttcggtcaggtcagcggaggcgtgccgtcctgccaactcctactggtggtggtgccgccgctccacatggcatggccttcaacacgcagcctgcctgtgtagggaaacgtgattaaaaatcgtttatctataataataataataataataataataatatagtaataaaaaaagaggtggttggatgaaatggctcgttctaatccataggcaaggcaacaaataaagcagctagcctagctagctgtaggcgagagtagtacgcgtctaagcaacctaccggtgacgatggataccgcgtggccggtttctgtctctcctgcctgtctctctctatatacatataaatagaaacgaataatgggggatttccagatcatcgtccgtccaatccatccattcatctacacacgcagttgcagcacatacagctagctagctcgttactgtttttgcagctgatctgatcgaccgacgcgacccaccgatcacgatcatgagctaccaagcgggctacccaccgccgggccaacaggcctacggcgcgcctccgccggcgtacgtcgcgccaccgccggcgtacccgccaacggcccaggacggcggcgcggcgtactacggccagcagcagacaaccaccaccagcagcagccgcggcggcgacggtttctggaaaggatggtgagggcttatataacttattaattgactccaaccacagaagctagatagatagagatgatgcgttctgatcacctgctgcatgcttggctttgctcatgcagctgcgccgccatctgctgctgctgcgtcctcgacatgtgcttctgaggacatatcgtcgatcgatcgacgacggccagggcatgctagctagctgatgaccggccggtacgtgcgtggttgatgatcaccatcatgtgctgctctagtagctgctgtgtcattatatattacacatcgtgtatacatatatacgtatacgtacgtactcgtacgtcttcgaattcattcctgtggttattgtattatacatatgcagcacactttgtactcgtacccgtgtctgtgtcgtgtattcaattgtcgagacattcttttacgattctaatgtatgtagtattaattaaatacaaaatataaattccgttccgcgatactatcaacaatacttctccggcagcggcagagctgactccatttcatccagtgtaattaactcaaaagttaacancccaccccaccccccttcttgtagtgtgtt

SEQ ID NO: 14796 - DNA, 972 bp, Zea mays
cactcctatgggcgattgggttcatcaagccggccgggcgagctctgtgctctccaaatcagctgagcaacctgcaggccagttccaccaagctaaggaggtgagaatctctgtaaaacgctgaaggaaaaaaaaaatgaaaggatccagcgagcatggcgagacctcgaagcaggcgcccctgggcagcagcaggggtgtcagcaaaggagtgtccgtgctcgatctaatacttcgcttcattgccatcatcggcaccctcgctagcgccattgcaatgggcaccaccaacgagacgctgcctttcttcacgcagttcatccggttcaaggcgcagtacagcgatctccctactctcacgttcttcgtcgtggcgaattccattgtctgcgcttatctcaccctgtcgctcccactatctatagtgcacatcattaggagcagggctaaatacagcaggctgctcttggtcgttcttgacgcggcaatgctagcactggtgactgcgggagcatctgcggcagcggccattgtgtacttagcgcacaaaggcaacgtcagagcaaactggcttgccatttgccagcagtttgactcgttctgcgagcgtatctctggatccctcattggttcgttcggagccatggtcatgctcgtactgctgctactactctccgccattgctctagccaggcgctaggcggtgcgtgttgcggttatcggactccgctatcctcgtgtaatcatacgtgtgtctattatacctctcctgctatgatcctctcatatatccccaattgttggcttgattctgcacttcttttcttctgatggtgtgcactatcatgtatatatataagctacgaaaaaaatgaatatacgtgaaccattatgtatggatcgccgtagtttctgaaagacttgttgggtattgtgttcacttatcagaacaaaaacatgaaagattatctt

SEQ ID NO: 14797 - DNA, 4203 bp, Zea mays
  misc_feature (1056)..(1056): n is a, c, g, or t
gtttggttcactcctgaccagagctgcgtgggtctggccgtctggtcatctgccttcggttgtcagggtcttaaccaaacatgtccatagtactatagtcatcctaatattccgtcggagttcgaatttataatttgtttaactcttttattccaattttaatcgattcgtcttattttaaaatatatacaattactgttaatttttacagtaatatcgtaagtgtggttttgatatttttttattttttcacaattttttttgaataaggcgtgtccctcaaagttgggtaaaacattgaaacgaactataaattagaacgaaagggtaataaggggatgtttagattaaaagatgaaattttagtctctatcacatcaaatatttaatgctagttaaaagcattaaatatagtttaattataaaactaattacacatacgaggactacacggcaagacaaacttaatcatgcgatgttatagtaaacatttgctaatagtagattaattaagcttaaagctttttctcacgagcttattcagcttattcgtttggctttaatccgtaccaatttctaccgtttttacaatgtcttgattaactttagtcacatgaaacagagacatccttaaataatgtactgctctcgcgtactctagcatctgatttctgatcggtctcccttgtaaagtcatctttcgaaatttattgtttaaaatgacatatattaatatttatcataagtaattgtctgattttctaatagtttgcatatctaaaacacttgaaatttctatgaattatgaacaacactaatacataatatgtccatactaacaatagaaaacagatataaaataatggttgttttttagagcatctctaagagactagctaaatgactcgccaaactaaaatttggctattcaacagtaaaataactttccaacaaattagctatttgactcgccaagctatctgactctctaaactagctctctcactagctaaatttggctagtcatatgactagcaaaactaaatagatagtctnttggagtgaaatgctacatatagagtgtaaccattatgaaaaattaattagagagttaaatagagagccaaaaataaagtgtctcttggagatgctcttaaccactgtcaaaggtcaatcaaaataaagaattttcacgtgtcagttctaaaaccgccattgatattggcattaccttataacgcccgtcaatgcaaatgattgtgcgaactgaacagcactagggaggaacatgggaaaaatcaacagaagagagatcatgagcacaaacaagtcaccgaacacaagaacctccggggcgaatcgaggcccaagtgtgccttgggtgcaatagggccgcactgcttgctgcgccgaggcccgcgctttcccattgctacgtcgggcctgtgtcgcttgtcacaccactcgtgccccgccaaggcccacgtttggcatggcctcgtcgagaatagctcctacattttctcagactatttactaaaaaacccctatacttttatagaataggacacaccgttctcaggtgaaattgcaaccatccgtagacgataattctaatggacaaatttaatattaacttagcactataatcaattttacactaaggctttgttcggttattgatattacatgtgtattggagtgtattgagtgagattaggatgaattttgacttattatggatttaaaccggctcaatctaacccagtacatgtggattatcaccaaaacgaacaagccctaaatatgtatttatccactacgatgcgtgtgggccatgggtgtacacaatttaattcagaggtatttaattgaaaacccaatatttttgtttaaaaaattaatatatatagtgtataatacatatgtacatataaatacataaataaattagcattaaggctaaaatacaaaacaagcctggttgtctggtgggctagtgattcaactgcattcggtgactaaacaactcatgcctacgcataatctttctagacgtgtcgtacgcttgcacccatcatccgctcaccctcttgcccaatcgtactaaacgtacagcgtagacaagagctgaccgtcgcctgtcatggtgtcgcatgacgctcgtccgatggttccattggcctgcagcgccgcccgtcacccactcgcctagtggcttagcactcggttcggcccagagcttcactctggtgtctgatctctgatggattcctttctccgccggcggccaaggagccgctgttcccgtcgccacccatcccgatttggcaagttgtcggaagccaagcgtttggtcggcatagaacgaaaaccgagggaacacaacccgacacgcgggttccgcccgggggccccctcacgtccgtgcccaccaccatcgctcgtcggcgtcgtccccctctttctctctcctgtgccccggccaagaaggcaaggctgcctgcctactggttggacctggacgaaggaggacgagaggctcgctcgtcgctggcgcctggcggttggtacgtgcgcgcgcgatggacaggggaaccgtggaggacctcatacggcggttgctggacgggaagaagcacaaggcgacggggaagaaggtgcagctgaccgagaccgagatccggcacctctgcgtcaccgccaaggtgttcttcctctcccagcccaacctcctcgagctggtggcccccatcaacgtctgcggtgagcatgcgttgaccgctcgccggctggtcagtcgtcgatggatgccaatgccattgctgacatgataagatgtgcgtgcgttgatctgcgcgcatgcaggtgacatccacgggcagttctcggacctgctgcggctcttcgagtacggcggcctgccgccgacggccaactatctcttcctcggcgactacgtggaccgcggcaagcagagcatcgagaccatctgcctgctgctggcgtacaagatccggtacccggacaacttcttcctgctccggggcaaccacgagtgcgcctccatcaaccgcatctacggcttctacgacgagtgcaagcgccgcttcagcgtccgcctctggaagatcttcaccgactgcttcaactgcctgcccgtcgccgccgtcatcgatgacaagatactatgcatgcacggcgggctctccccggacctggacaacctcaaccggatcagggagatccagcgccccgtcgacgtccccgaccagggcctcctctgcgacctcctgtggtccgacccggaccgcgacagctccggatggggcgacaacgaccgcggcgtctccttcaccttcggcgccgacaaggtcaccgagttcttaaacaagcacgacctcgacctcgtctgccgcgcccaccaggcaagcctccctgctcctgtgtcctgcactcctgcttgcccatgtgcttccacaaccagcctgacagatcgactcacagttcatttcttgccatggcaaattggcaatgccattgtgccaacgacaggtcgtggaggtcggcttcgagttcttcgccgaccggcagctggtgaccatattctcggcgcccaactactgcggcgagttcaacaacgccggcgcgctgatgaacgtcgacgccagcctgctctgctcgttccagatcctcaagccgtacaggggcaaagcacaaacggagtgacgacgacaggctgcgaccgagacacaggaaggagacgtcgattagaggcttcgtttaggttgcaaggagagtatgcctgcgcgtcttgcattcctctcgcaattttttttttgctccccctccgagagctgtcgatcaagtccgcagttcttctgaatcttttgcatgtatgtaactgattcaatacgtgagtgtctgtatatataaaagactatagtttctaaactgatctatgatcttgcttgcaacaaggagcaaaaagtcacatcgaagttctaattcagaagcagttatattatatggagacaaccaacgtaacaatcttttagaagaggagtattgtacaaaaatcttttagcaaatcagtggaatactacaaatggcatcaacagaaacagaaagtttaacgttcatctcgctcttgtcccatctttttacagataatggagagaagtatcagaccaggggtaccga

SEQ ID NO: 14798 - DNA, 1362 bp, Zea mays
  misc_feature (6)..(6): n is a, c, g, or t
aattcntaggccgacccgacccgtcacgccccctcacgtccgtgcccaccaccctcgctcgtcggcgtcgtccccctctttctctctcctgtgccccggccaagaaggcaaggctgcctgcctactggttggacctggacgaaggaggacgagaggctcgctcgtcgctggcggttggtacgtgcgcgcgcgatggacaggggaacggtggaggacctcatacggcggttgctggacgggaagaagcacaaggcgacggggaagaaggtgcagctgaccgagaccgagatccggcacctctgcgtcaccgccaaggagatcttcctctcccagcccaacctcctcgagctggtggcccccatcaacgtctgcggtgacatccacgggcagttctcggacctgctgcggctcttcgagtacggcggcctgccgccgacggccaactatctcttcctcggcgactacgtggaccgcggcaagcagagcatcgagaccatctgcctgctgctggcgtacaagatccggtacccggacaacttcttcctgctccggggcaaccacgagtgcgcctccatcaaccgcatctacggcttctacgacgagtgcaagcgccgcttcagcgtccgcctctggaagatcttcaccgactgcttcaactgcctgcccgtcgccgccgtcatcgatgacaagatactatgcatgcacggcgggctctccccggacctggacaacctcaaccggatcagggagatccagcggccccgtcgacgtccccgaccagggcctcctctgcgacctcctgtggtccgacccggaccgcgacagctccggatggggcgacaacgaccgcggcgtctccttcaccttcggcgccgacaaggtcaccgagttcttaaacaagcacgacctcgacctcgtctgccgcgcccaccaggtcgtggaggacggctacgagttcttcgccgaccggcagctggtgaccatattctcggcgcccaactactgcggcgagttcaacaacgccggcgcgctgatgaacgtcgacgccagcctgctctgctcgttccagatcctcaagccgtacaggggcaaagcacaaacggagtgacgacgacaggctgcgaccgagacacaggaaggagacgtcgattagaggcttcgtttaggttgcaaggagagtatgcctgcgcgtcttgcattcctctcgcaattttttttttgctccccctccgagagctgtcgatcaagtccgcagttcttctgaatcttttgcatgtatgtaactgattcaatacgtgagtgtctgtatatataaaagactatagtttctgaacaaaaaaaaaaaaaaactcgcgggccggc

SEQ ID NO: 14799 - DNA, 2891 bp, Zea mays
  misc_feature (992)..(992): n is a, c, g, or t
gtcaaacaaacagagggtgtggcgagatttgcttgcgcacgacgcatgaccgctccacgttcgtgttctctgtgccatcccatggcgaacgtgaacggggttgcaatggtcagagcaaagacagaaggcaaaagatggggttgcaacacgctgcggcgtggtgatcgtggacgagacagacaaaacatcctctatcagttttgtagaggatggtgtgatgtacatgtggtgcagcggtgggagatcgataggggcgtcttgaattagctcgactattgtcgtgcaagttcatggtctgctgttgatgtgcaacttggtgtgcaactgcgacggtgcttgtttcgttggccacggtcgtagtgtggcggcagccggattcggctctggtgggcggcattgtggcgcacacgacaggtgttccctggttccttgtggctaggtagaggggttggtgggcgacacagatttggagccgttgtgacagccggcgtgtcgatgcccctcagtaggggttttaggagaccagggcggtgacgacggcggaggctgcatgctttgacctggggtccttacctaacattgtgttggagggcatcttggacgaaagccttggctatggtgacgcccgtcggcgccacatccccctgttgagggtgtcgcattgctctgtcttctatgggcgaaagcccggtccatctcggacatgtgacggtggcatccatgacgtcactttcttccagaaggcgtcacgtttgaagttcgtctcggcctcgacgttgctggcggttgatgcttttgcttctcagcgtctggattgtaggtgacagtggggttttgcaacgtgaagtcgaagctgccacgttaggggatgtggcttggcaacgatgacatgaggcgaaccaccttcctcatggtctagattgtttgggaagttaggcaaaatccggaggtgggtgttggatcaagatcgttggcgaataatcggagctgcnttgtgtgggtgtgttgaggcttgacaacgatggcgcgtcgtggtctttctcattccgtgccaggtcttaagtgtaggtattatcgtgtttcttttggtcatctgcggcctagcaaagtcggagctgattgtactttttgttaagctcggcgacgataactctagatggactttgtgtgtgaggttgccgttgcctgtttttctgggtactctgcgtaggtttaggatccgttttttttaaaattaagtcaattctagttacgttaaaaaaattagctcggctattaaacttgtaaccattttgcaaaccaactcgcctctgtagcattcgagtgatcttccctttccatccgccttcgacctccgccgaccctgcaactccaatttgaactgtggggaatctaaccgcgggccccaccttgtaacgaagtcaccaaccgacctatcagcagctcagcatcctccctacaaatacccgtgccgcctcgccaatttcaaaaaacgatcgcaacacaatcgaaagaacgacgtgggatagcgagcgataaaagccagagcaagagcaagagcaagagcaagagaggagcgatcgatcgagaggagaagacgaaagagtcggattgccatggacgacggcaccgtgatcatcctcttcttcttcttggccttcttcatgttcaccttcgccgcgtccctcttcttgtggttcacgatatggtggccctggctctgccgcgttatcaccctgacgcggaacctgctgagtaacctctttaccctgtgccaagccagcatggaggccgacgagtagatccgcacgctctcctgccgccacgtcaagtgcgatgtcatcgacgaatggcttcgcactggacggatgacgtgctaccgtggaagcggttgccgcggacgtcgtcgacgcgggatttgaaggaggcgcggctagttgctttccggcgcacaacgacaaactacctgtagcgtcgtttctttttatgcatctatcatttcgtcatttcttttccggcatccttggaactggtcgagggtgggtagtgcgtctttctgatagtcaggaactcaggatctgttcttcacgtactccttagttgtttccgtttttgctgcgttggaactgatcgacattagctacattcctgttcttttgttcagacttcagagttgagttcaccttaaaatgtttgaatgcctagaaacgatgacttgttagttcttgcatcagctataatgttccgacagaagctaatagatccttggttttgatttctctcatactctgtttaattctttagaaccttaatgtgagaatggtctcagtgaaaaaaaaaaaaaaaaggcatcagttacttcatctgctttcatgatcgagagccaaaaccttgtaggtttggtatctgaacatatggttcgtagttcgctgcttgtttgctttatatcgcgttttttcgttcttgctattgccggtattgtacatctacgaatatatgataactgaaaatcattatagtgcatagccctctactcttcagttttttccctgtatatggaacacctgatcaatttgagatataagttgaacctgtatcaggacgatatgagcaggttttgatttaaacctgaatccgcttgtgatatattgcgtatgatgccattattgttttttttcagttgccattatttttttttcagtttcttatgcaggaatagtaccagcaagctttactgaaaatcttagttctgtcaaacctgaattacttaacagctctctgtgcttgtctatctgttcctccacatttttttcgtcagttgatgaagtttgtcatgtactattagtattaggcataatcagttcgtttcgtcggaaacttggaacgcaata

SEQ ID NO: 14800 - DNA, 952 bp, Zea mays
tgggccgttctcaccggctgggtcaaatctgacgaactctctgttggtagcctcgccggaccattgggtacctcgaggccggcctaagggttctaccacaagccgcgcatggatgctgctggatcgtcaggagctggatttacacctcatgttatcacagttcaagctggggaggacgtgtcatcaaagatcatgtcgttttctcagcacggaccgcgtgcagtctgtgttctctcagcaaacggtgccatatcaaatgtgacgcttcgtcagactgctacatcaggcggaactgtaacatatgagggtcggttcgagatactgtcactgtcggggtcattcctcttggtggaggatggtggtcaacgcagtcgaactggagggctcagtgtgtcgttggctggtcccgacggtcgtgtgctgggcggtggagttgcagggctcctcgtagcagcttcgccagttcagatagtactgggaagtttcaattctggaggcaaaaaagaggcaaaaaagcatgctccttcagcacccacaccagcgccactgaaggtcgctcctccgacaacaaccaggatgggacccaacagcagcagccctccttcaagaggaggtacattgagcgagtcatccggtggcgccggaagcccaccaccgccgctgcatcaaggcatggctgctagcagtagcaacgaccagccgccgttcctgtccagcatcatgccatggaaatgatcctcttatgtagtagtataagtcagaagctttgagtagggaggtaaatttgtagctctactgtaggtttaaacctgaattcctgtgctacgtaggtgtattgagctgtaacggatgtgatcatttgagagctacctagtgttgtttagttaaatgttttaccaaggcatgtcgatctgagccagaagattcttgctgtgaatttgttgtttgcgcg

SEQ ID NO: 14801 - DNA, 1641 bp, Zea mays
catcacatcaattcacaattcacatacatgttcatcagtttaacccataattatatttgcataaaccaaattaacacataaacatagttcattaatcactagtttaacttataagaaatagacacctcacatatatataatattttcatcaattattctgtaaatgatatgcatatagtttcgttttcctggaatgtggtagcttgtttagctcgcgagctggctcgttaacgaatcgagctaggagatatcagctcagctcgtaaaaaaattcaaacgagccgatccgagccgaaccgagctgatcataaaacgagcgagccaacgacacacaagcatttcgtccagccctatattgattagtccgtccggcgccgcgtctatcctctatattttatttcttttcaaaatttgttatatttcatctcctatacgttaatacatgtaaaaaagatctaatttatttgtattctgctttttagatttattaatgaattctgctttttagattaattaatgagcttgttataagatgaatcttacatttttttaagatgtgccgagaagcgacaaggacggacgagccaactccgcgtgcctgcctactattataaatttgccggcgctcccccccggccggcaccagacagaaccaagccaccgagactgacctctgcatccatccatggcgaccaagagcagcgtcaccggcaatgccgccgctaagtcttcggcgccaaaagcagccgaggagcaggtgtgcacgctcctctccaagcggctccagcgcgtgtcgtgccactgcctccgcatcgccgcggcggtcctcgtcgtctacagtttcgccgtcacggcgtggcgcgtgcgtcaccagccgcaggacctggccttcgtcgctgccgccttatttctccttgccgagctccaggcgtgcctccgacgcgccgagcggctcgcgccggaatcgcccgccggggagaggcgccgagtgcgggccgccgtgtgggcgctgtccaccgccctcagctgcgcgttcgcctaccgcgtggccgcggtcatgccgccgccgctggccgtcctcgtctggtgcattaccgcgtccgtcggcctcgtcggtctgtgtctgcttgtgctctgcagagaccaacagtatcaagcgctccgcaacgacgatgccgcctgcgactgcgacagaagggcctctgccaagactagtcctactgatgaattggtctaaagcattcagattcaggggggcaagaaattacaaagagtttttctgaaaatgtcttggattttggtattgattttcgtgctaatgcttccctgctgtcaaagaaaaaaaaaaaacctcgcttggaacgacgtcatctaccaactcagatgaagagtagtgcctgcattttcgttcatcacgtataataaaaaagatgtgttctagctcagcttagtagtactgtaagaacaatttgtggtgtgaaggtgttccacctccaccccaggagaacgtaacgtgtctgtggtggtactcggctctggctccgccgcaagaacgattaatcttaaagccaagcaagtcttgctgtttagttaaggaaatgtaacataaatggtaatagtctatactatacttaaagcacc

SEQ ID NO: 14802 - DNA, 1984 bp, Zea mays
  misc_feature (1957)..(1957): n is a, c, g, or t
gggaccctcgaggccggccggccccggggctatagcttaggtaatccttttctttataccgactccctcgtggcctcgtcgcctcagctccaccaccaccacctccacccgcgcctccaaaatccaaatccgatcgatctccgcggcctccagatcccccggcgggcggagacggcgagctccaggcggccaagaagcccccccctcgcagcgctcctctcctctgcctctccgaatcccttaccagggggaaaaaacattgcctgaaagttcttcaggccctggtgtagcagctgaattacccagtttaatggcgaagaacgagctttagatggtctaaagatggagatgagatagaagcaccacaaagtgtacagtggggtagcaaggatatgactgtcatgatgcctcagcgccaccgggctacagccaagaagcccatgtggataatcgtgctcttgtgcatggtttgcatcgtgctgattggggcttacgtcttcccaccgcggcgcttctctaactgctacctctctgcttcaagtgtatgcgcacctttcaaggattggctcccttctatgggccgtcgggagagaactgacgaggagattatttcatctgtagttattagggatatcctttcaatgcccatgcctatgccaaaaaatccaaagattgcccttatgttcttgacaccaggttcattgccctttgagaaattgtgggagaagtttttacagggacatgagggaagatactccatctatgtgcacgcatcacgtgaaaagcctgttcatactagttctttgtttgctggccgggatattcacagtgatgcggtagtatggggattgatttcaatggttgatgctgagaaaagattgttagcgaatgcactggaagatgttgataatcaagtttttatcttgctttctgacagttgtgttccactgcattcatttgattatgtgtataattacctcatgggaacgaatgttagcttcattgattgtttcaaggatccaggtccacatggcagtggaaggtactctattgagatgtatcctgaaatagacgagagggattttagaaagggtgcccagtggtttgcagttacaaggagacatgctttaatgattctggctgacagcttgtactacaagaagttcaagctatactgcaagccagcagaagggcgcaactgtattgcagatgagcattatttgccaaccctgttcaatatggtagatcctggtgggatctctaattggtctgttacacatgtggattggtctgagggaaaatggcatccaaggtcatatagcgctgatgatgtcacctatgatctcttgaagaacattacagcagttgatgagaacttccatgtaacaagtgatgacaagaaacttgtgatgcagaagccgtgtttgtggaatggatcaaagagaccgtgctatcttttcgctaggaagtttaatcctgaagcacttgacaacctactgaagcaatttaccagttacacatctgtttgagtcctaccggattctttgccttgtgctgtcaaatccgacaagcttttttctcttcctgtttatatgtaaattgtgaagtccgtacttattaggatctgggcctgaagataccggtacaactgcaacagctgtgatggcttggagctgagtcatgggtaaaacggccacagcgatgtttatagaatggcactgccctcatagtaatttatcgtgttcaatgtatgtctccatagtcttccacccaactcccaactcattagttctttattcttggagaacagtttttgtcagagtgttatactgtcatgatatgatccattctttgtagacacagagattacaacagatgtatcacaaatgcagtcttaattttgtcactattaaatcttttatcatgcgttctactggaaaaaaaaaaaaaaaaaaanctcgagggggggcccggtacccaattg

SEQ ID NO: 14803 - DNA, 6146 bp, Zea mays
ccttcctcgagtttttttttttttttttttttttttttttttttttttttttggtcgaaattgttccatctcatctcgtttcttgttttttttttttactagtcaaacgtcaaaggttcaatcttttattgttgcagcaatgtagtactctgctccttacacagagcacccctgatgacagattttttcagaatatggattctgactgcacatcagcatggcaggatctacccatctaatcagaaacggaacacgactttaagcaaattcatggatggagacggaagcacagcatcactcgacctatgcttcgatccgcatgttccaggtcatggtgaagctcttcccgagcggcaatgccagcccgccgatctccaccatgacgccgttcttactatcctcgacgccttcttccccctgcagcttcgcgttgccacctgctgcgaagtaagggctcgacgtcgcgacggcggtggcgtccgtgccgtccacctggatggcaaggtccttgccggtaccctccagacccagcaccgagagcttctcgacgaccagccccttgtgcaggctgtagcttcccatcagcacctccgaccgcaccgtcacagccttaccgcgcacgctcgcgtggaagcgcacgtacgacgcctgcccttcggcgagcaccatctccgggcgctcgtcgtcgtccacgtacaccgcgccctccgcgtcggcctgcgtcgccccgaacgggaacgcgaccacgagcgtgaacggcgtcgcccgtgcgtccttggagacgaacccgccgcgctgcatcggcaggatcgtgttctggtacacgtgcacgttgatctcgttcagcggcgcgtccagcttcactggggccccgctcctggacaccaccaccttactcatgtcgaacaggttgtaccaggtgcccggcgggaacatggcgctcaccgaagtggcgccctgctcgaggaccggggacaccatgacgccgggaccgagcaggaactgcgtgctcagcccgtagcacggcgtgaagtcggggaaggagaagaacaccggccgcgccacgggggccccggtcaggtgcgcctggtagttgagcgtgtacaggtaggggagcagcttgtaccgcatgccgagcgcgttccgagcagacttcgccacggagtcccagacatacagctcctgcctcggtgacgcgaagttggcatggtccctggagaaggggtagaaggccccgagctcaatccacctgttgcagagctcctcagtcggcgacgggtagaaaccgcagatgtcagagccaaccatgggcatgccgaagatgccaaagttgagcatggttgagatcgagtaacggagattttcccacgtgcccttgttgtctccggtccagtgcgcggcatacgcccccgacccgacgaacgtggagcgggtcaggatgaacggcctcttcccctgcagcccttgcagcgccgtatgcgtggcaatggcctgcgagaagccatacagactgtgcgcattgtactccaggatgccgttgtagtgtgtagcgctggttgcgatggtgttgaagccgagacgggcagtctgcccggaggcgttgatcttgtacggcggctcatcccacctcgtgtttgtaaggttcttgcaatccaagcaacagagccatggtgtcttggtgtcaggaatagggcactggtgcgtcttcggaatcgtgcacttgcccgtgcagaagttggaggcctcgttcatgtcaatccagaggccatccaccgggaccagatcatgaaacctccgcacctcatcgatccaccacgacacaccgttcgggttgaggaagtccgggaagtagacggggccaggccacacctgggcgaggtatggctgcccgtccagcttgataaagatgtcacgttccatgccacgctggtagacgccataggagctgttcacggcaatgccagggtcgatgaggacgatgtacttcatgccttgcgcatggatcttgtcaaggaacgccagcagtttggggcgtgggtagttgaccggatcgagtgtgaagtccttagcggcatccatgtggtcgtcatcgttccagatcacgtccagcggtatctgggcattacggtaaccttccacaacgccctctaccactgaaaggttcttgtacccccacctacattggtggaaccctgaaagacaagcacatggagtattcagagacttgaagaatttcacggtacaagaatttatgcagagacagcagctttcaactctattgaactgacaaaagaaagaaaatggtaatagtaattggtgaacaattatggcaacaaattctcaatatgcccatctgcattggcaaaattaattgtcagggttccgatcatcgattttcagggtggtccatgaactgagcaagatcagtgcagagcacatggaagacctcatctttattggtaacacggcctcactagcgggtgaaactaactgacacactatcttgtaaagggaagctgcattcaggaagctgtatgattgatagttgatgcctcacccttacaggtaacatggcctcactagcgggtgaaactcacactatcttgtgaagggaggctgcattttgggaagctatatgtttgaatgtagatatggagataatttacaaattcctaaagaatgatcatacaagtaaattccagttcccaaggcttccagcaaggcacatcaagatgccagattttgttattatcatgatatgcaaggctacaaacactagtgaacaaaagttttcagtattttatttgacaggacgaacaaggaaactgaattttttttctgatgaaaggaatttcacacatcagtggaatactaatctactgggaataagacacatggtacgcttatcactgtctccccctaagttaaatcagtgtgtgtgtgccagggtgacgatgtttcatccaatgcattagttactctggaagcaatgaatgttcgtagcaaaatactccctctgttcttttttatttgacgcgttttagttcaaaaatgaactaccgggcgataaatatttgagaacggaggtagtatagttcataatttgatgactatgttattcagaacaaagaacatgcacctttgatgtagattcatgtactgaacaagtaatcggcaaaagcaacagcactgaacatactatatgagagagagaaacaatcgatgcattgcatttttcttagatttccgaacttcttcagcacaagcttctccatctgctagcagtctgcgcagtgcatgcgttgatgcatatccgcagtattttgcacataaatcagtcacacttatggctagtttgggaaccccaattttccaagggtttttcattttccaaaggaaaattagttcattttccctttaaatattgaaaatcccatgaaaaaataggattgccaaactaggccttagttgtctaatttgcatggttagcggaagtgcttcaaggggatacatttgcactactggcaatctgaaaggtagtatactggattatgccatgatttccatgacgtgggaggagtattctgctttataacagagtctctacatgactttatttatcttttgaccaaagagttcacatgatgcgaatggtaacagtaaacagtaccagcatgcttatcactgtctagtgacgcctgatacagcaaataaactgcctatgtcacctaagatctacattagtgtgtgtcagactgccagagaacgttacatgtcattagtcaacctgaaagttagcttgtcataatatatatgaccaaatggatcaaactaatctggcaacaattaagtatccatccatgggcccatagcatcagataaaaaaccaaatctcaatctggcagttagctaatcataacttaaccaattgattgtgccaatcaggaatttagcaagccataacttaagcatttgatgtatatccttctaatctgacaatgagtaaaggacagcacaaaaggctgaaatcgactctgagtctgagcaaggcagtccttaccgaatgcccagtaaggcatgggcgcgggacggccgatcatcgacgtgtactgatccactatggccaacggcgtcgggcccgagaagaagtagaagtcgagaagacctccgatgaccttgtaggtcagcgacgtgcccctgtagaacacatccatgccattgctgttgagcagcagcacggcgtgcgcgacgccgcggccgcccaggctgcggaggtccatgtacaccgggtgcgagccgtagaggtcggtgttgaggttgatggcggaaatgtccgtggtgtagatggtgtaggggtcgttgggccgcagccggatgccccccggctgcgtgttctcgccgagcccgtacagggcggcgttcttgggcagcgccgtggacacctccaggtactggtccttgaacaccagcgcgccggcgctggtgttgaacagcggctgccgagtggaccggcggtgcaccgcgaaccagaacgggtcgcgcccataggtgaacaccagctcctcgccggggtactcggcgcccgtgaagggggcgcccgtgaccttgccgccggtcacgggtggggctggctcccttgggagcaggttgtaggggacctcccacctctgcttatctgcatctgtaatctgcacgcgcaccctctccctggtctcgtgcctgcatagcgtctcaccattagaagatgacctcggataattttttttaagccatcgcaaagttcaggcatactctgagctcgtgattggaagtctttagaatacttgagaaatcatggtttgggcctttggggtctatgcaggtgaacattcagtgtagaagcagtaaaatatcgaggtcatggtcatgctctcatgcctgggaccgcatgcagatgaactaattgtcaaccattaaaacatgaccttagggggaagaatagaacactattggttgcagtccaatcccaaaatgttctgaataattccttttgctctacatctactagccgtaaatctagatttgtttgtcatgaagaatttaaacaatcgattcttgcagcaaccaacattctcctcgaaagtactacagggatgcgttcaagttcaacacttcagacgacatcaatgaatatagaacaaccgcgggaaaaaaaacgaagaacaggagcgctactgatttgctgattggcgaggagaagcgagttcttacttgacaaagagcctgaggcgagggatgtcaggaccataagtggaggtgcgctgcttcacctgcaggtaacccacaaggcctcccccgtgggcctgctgatcaagggagaccagcttgtacccgcacccagccttcggctttgctgtggcgaccgcgccattgctgcttgccaatgtgagaaatagaagacaccacagtaggtaggagaggatggccgaacgagaaaaagacagcatttcgttttgccccgttgttttttttttctttttcttcactggtttttgctccctcgctcacgagctactctatggccactgccctgcagcgtgaactgtgaactgtatatgaaatgcaagacagtgacgaggtcacgaggagatgcctagatagaaggtgagagagagagagagagaggtactgctgtggtattgaatactacgaattaatggcggggagtgagcagtggcagctgagcagctacgccctctgaatgcattgagtggcatgtccaggggataccgatgaggcgatgatctccgaaccttttcctcctttataggctccctgcccactccttacatcaatcactgataagtggacccagctggtttgcagagcatggaatgtcagcttttcttttgctcaagccagtctccaacgaccaacaaggtccattaaaaggccaaaccctgaaatttaaggacgaagtcatgcccaacatcaatatttaaaggtactctaaatataaataacgctactggatatattatggagtgtttgaatacactaaactaatagttagttgactaaaaattggttgtgaaattaagtagctaacaaatagttatctaactattaactaattaaaaaaatagataatagctaaactattagct

SEQ ID NO: 14804 - DNA, 1895 bp, Zea mays
  misc_feature (59)..(59): n is a, c, g, or t
  misc_feature (67)..(67): n is a, c, g, or t
  misc_feature (70)..(70): n is a, c, g, or t
  misc_feature (166)..(166): n is a, c, g, or t
  misc_feature (198)..(198): n is a, c, g, or t
tatgcgtggcaatggccggcctgtgagcccccacacactcggtggcgcattgtactccnaggatgcncgnttgtagtgtgtagcgctggttgcgatggtgttgaagccgagacgggccagtctgcccggaagcgttgattcttgtacggcggctcattcccacctntgtgtttgtaaggttcttgcaatccaagcaancagagccatggtgtcttggtgtcaggaatagggcactggtgcgtcttcggaatcgtgcacttgcccgtgcagaagttggaggcctcgttcatgtcaatccagaggccatccaccgggaccagatcatggaacctccgcacctcatcgatccaccacgacacaccgttcgggttgaggaagtccgggaagtagacggggccaggccacacctgggcgaggtatggctgcccgtccagcttgataaagatgtcacgttccatgccacgctggtagacgccataggagctgttcacggcaatgccagggtcgatgaggacgatgtacttcatgccttgcgcatggatcttgtcaaggaacgccagcagtttggggcgtgggtagttgaccgggtcgagtgtgaagtccttagcggcatccatgtggtcgtcatcgttccagatcacgtccagcggtatctgggcattccggtaaccttccacaacgccctctaccactgaaaggttcttgtacccccacctacattggtggaacccgaatgcccagtaaggcatgggcgcgggacggccgatcatcgacgtgtactgatccactatggccaacggcgtcgggcccgagaagaagtagaagtcgagaagacctccgatgaccttgtaggtcagcgacgtgcccctgtagaacacatccatgccattgctgttgagcagcagcacggcgtgcgcgacgccgcggcccccccaggctgcggaggtccatgtacaccgggtgcgagccgtagaggtcggtgttgaggttgatggcggaaatgtccgtggtgtagatggtgtaggggtcgttgggccgcagccggatgccccccggctgcgtgttctcgccgagcccgtacagggcggcgttcttgggcagcgccgtggacacctccaggtactggtccttgaacaccagcgcgccggcgctggtgttgaacagcggctgccgagtggaccggcggtgcaccgcgaaccagaacgggtcgcgcccataggtgaacaccagctcctcgccggggtactcggcgcccgtgaagggggcgcccgtgaccttgccgccggtcacgggtggggctggctcccttgggagcaggttgtaggggacctcccacctctgcttatctgcatctgtaatctgcacgcgcaccctctccctggtctcgtgcttgacaaagagcctgaggcgagggatgtcaggaccataagtggaggtgcgctgcttcacctgcaggtaacccacaaggcctcccccgttgggcagctgaacaagggagaccagcttgtacccgcacccagccttcggctttgctgtggcgaccgcgccattgctgcttgccaatgtgagaaatagaagacaccacagtaggtaggagaggatggccgaacgagaaaaagacagcatttcgttttgccccgttgtttttttttctttttcttcactggtttttgctccctcgctcacgagctactctatggccactgccctgcagcgtgaactgtgaactgtatcccaaacccggcccgctgacgaggagatgcctagatagaaggggtgtgtgtgtgtgagagagagagagagggagaggtactgctgtggtagtgaatactacgaattaatggcggggagtgagcagtggcagctgaggcctctgaatgccctcgtgccgaatt

SEQ ID NO: 14805 - DNA, 3206 bp, Zea mays
ttttctattaccttgggttgctgcaaactatatgtttctgaaatatagttttatctggtcgacgtcttgtatcactctttctaatactaaacccaaccatacatgcataagcattgtacatctcataagcttctttctcagagtcaaaatacattcctactttaggaacaatcacagctggtccaactggatcaaccttctattgcaaaatacgtttagaataaagtcacgttacaacagtacggaaatttattgcaaaatacgtttagaataaaatcaccttatatgtcaccacttctggaatcgtgttctccttgccttgaatgttagtatcgatagcgccaacaatatttacttcggtgtttatacactcaatgttctatgcaaatgtgggaattacagtcaaatagacaaactaaatagacggaaaaagtacaatgatcaaaagaactaatgatgacagtacctgcagtgtcgcctcttcatgatcagatggatcgacgatttgggtagggacgtcacatagcaagggttgcagctgggacatgatattcgtggtggcggcggcaggatcgctgtactcttccatggatgcaatcgtccctctagggctgtgtgtttgcggtacgcaaggaatggcggcgctcgtttgtgtagggcatgaaaaaaagtagatggcttatttgcttgtacggctggcagctggctccaaacgttggctccttttaacattaaattagtgtggccagccgatccgaaagattgctttgagattaataaatgaacacgtggcatcaatccggtaagtgctgcacagatatcgctctgcagcacgcatgtatggaattttttccctcgaggtcgagctactaccatccatctctccccattgcatgcgaaacaagaaagcaagaggccaagaggagcagagtgagtgagtggcgtttggtgtgaaatgtggacttggacctggaaggaggacgaagcgggtcatggaatggtgatggacctgctgcttgctcccctccctgccgatctctaatcactttgcccctaggtaccgtacaggcgtgcgcgcggggcatcagacacacctccccttcctaacttccaccaaatctccctccctaccgtgctttccgctttcctcccttgattttttttatccgtctcctagctccagattttaaaaattatctcttgtgagcaactcatagctaactactactagtagctgagactaaaagggtgtgctctctcgcttttaatctccatgttaccgctagtgctctagtcttacctagccttgctgagccccttgcagtgctgggaggagaaggacaaggtctctgatcagctcagcttgtctggtcaaagctgagagcctcgttgtgctgtgagtgcaagctcgaccgacaggacccctgccactgtgaagcacagcgtcagcggcgacaagacgaaggggcggaagctgccaagccgatagatctacgcaaatggagaccaaggacgtgtcgccgctcgccgccgccaccaccaccaccgcggcgcccgtgcctgcaccgacctctcaaccgcctccgccggccccttcttctatggcgccgccgcagcaccagcaccagcaccatccgccgccgccgttcgcgcagcaggcggccccggttccgtcgcctgccgcgtccatgcccggcggcatgcggctctcgttcgaccagatgtccgggaaggcgcccggggagcagcaccaccactccgcgcccatgctgtacacggtgccaccaccgcagtccgccgcgggcgcgggcgcaccgggggccaatgtgctgggcatgggcgagctgatgcgcaagaagcgcggccggccgcgcaagtacgcgcccgacgggagcatggctctggcgctggcccccatctcctccgcctcagccggcggcgccgcagcccccggacagcagcagcacggcggcgggttctccatcagcagccccccgtccgaccccaacgccaagcgccgcggccggcctcccggctctggcaagaagaagcagttcgaagccttgggctcctggggcatcgccttcacccctcacatcctcaccgtcaaggccggcgaggatgttgcttcaaaaataatgacattctcacagcaaggccctcgcacagtctgcatcctttccgcgaatggtgcaattagtaatgttacacttcggcagccagccacatctggtggactagttacttatgaggggcgctttgagataatctcgctatctggttctttcctgcttgcggaggatggtgatactcgcagcaggactggtggcttgagtgtcgcacttgcaggatctgatggccgagttcttggagggtgtgttgctggaatgcttatggctgcaactcctgttcaggttgtggtggctagctttatcgcagagggaaagaaatcaaagccagcggaagcacggaaggttgaaccgatggctgctcctccaccgcagatggctacctttgttccacctccgctggccaccagccctccatcggagggaacatccagcgcatcatctgatgactctggcagcccaatccaccacagtgcgatgccgttcagcaactccagccagcatcaacaccctcaccagcaccagcaccagcacatgccgcctgcctacgcatccgggggttggtccctctcagtgcaccagcagaataggcatgattctgacatgaagatgatgtcgaactaacagtgctcaacctaggcgtcccatttgttggttgggctggagaggaaggaagctgctgatggttggtactgccgctatgaaatggtcttcttgcgccgtctgtcctgatcagtgaccccgtgttgctctggtcaatgacggtgtgtctgctatagctaagatagctaggaaggattagagtttatgggctcacttgctgttgttcccctgggtaagattaatttaatttgaattagccgctgttgtaatgctgtagccagtgtcctgaagtcgcttatcagtcagtccctgacgcgagctgtgatggttgcctgatgagatcttcacctcctagtcctaggctagttaaaatatcatttctctagtactatgaatcatgaatttacttggatgcttcggtttgattcaggaatttgatcgtattatgtttagaaaaaaaaaaaaaaaaaaaaa

SEQ ID NO: 14806 - DNA, 1024 bp, Zea mays
atccacagatatgttaagacgtacaaccagcctctacaaaacctgcactgcattggctgaccacgccattccccaaaaaaacaccgccctggctagcaccacacaccgcaggtatggagaaggcgacgaggctggccttggcagcggcggtggttctgtgcctgctgctggcgaccgggccgcaggaggccgccggcgccgaggggatgctgtcgtatgataagttgctcagctgcaaggtgctgggcaactgcgacaagaacaggggccccggggccacccgcccggggaagcccgtaaacaagtacacccgcggctgcagcccgctgacccggtgccgcggcggctgatcatatctccggtggttctggtcgatgtgcgcgcaacgtcacgcgcgtgcaggcaccagcgccggccggcccctgagggcgggggcaaagggggcaaccgccctggtgggcctcgtaatctggaggaccccaattccgtgtacacattagtatactgcatatgagtttttgcatgtgtattacgtgatttgattataagaatcacactagaccaacataaattagtctcgaagcgtcacgcgctgcgtgagacagacattcttcaccgcatgttcttgacggcttgcatggatatagtttatatgaaaataaagtttatatgaaaatcatatagctctcgaattgatctacaactttgtagtacattatatttttgtttgatcacatatctatgtcgaaattattaaaataatatcagaatttatatcaagtacccgactatatgtcacatgcgtaattccaatactccataccttattaatggactatatatatattacatatatatcacatatgttgaatggccttgtgttgtattagactatattatatcatttaaaaattatcatgtgctgtgttatattattgtgtgattcaaatattgtcattacattggaactattatgttggactattgaatgatctcaacttattgtctatattattcacgggaa

SEQ ID NO: 14807 - DNA, 2112 bp, Zea mays
cccacgcgtccgcccacgcgtccgcccacgcgtccgcccacgcgtccgcccacgcgtccgctccgatgtgacagatgagatggaatcgtactctttacagcttcaagaaccagatgataaatctccattggaggtaaagaaaatgagtcacaatgctctagctgcccttgtgaagtatttgcagaagaaaagaagtggaatatttgagagagcgacggctgaagtaacagaggaggtggtctctggagctgttcaccacagcttaaaattatctgagccatataagtcaaagaagctgagcaagaaacgagctcagacacatacaagctctattgctagagaaatggcaactgtactggatacttgtctgcttcaagctcttattcttactgggcagtcctcaggggcaatagagttgttgaaaggactcaattattgtgacctgaagatatgcgaagagtttttgaaggaaaggagagaatatatggttttacttgaactctataaaagcaatgaaatgcaccgtgatgctctccaactactcaatcaattagttgaagaatcaaaatctgaaatggagaatacatattttaataaaaaatttaactctcaaatgatacttgaatatctcaggcccctttgtagatctgacccaatgctggttttagagtcttccttgtacgtccttgagcgcaacccatcagaaactattgagctctttttgtctgaaaatgttccagcagatttggtaaattcatatctgaagcagcatgccccaaatttgcagtcaacttacttagagctaatgctctcaatgaatgatactgggatcaaccctaatctgcaaaacgagctggtacaactgtacctttctgaagttctagactggtacaagattctgaaggaagagggaaactggacagagaagacatattccccaacacggaagaagttaatatctacgttggagagcaattcaggttacaatacagacgcacttcttaagcgccttccccaggacgctctttttgaggagcgagctatattgtatggggaaataaatcaacacctcagagctctctctctctatgttcacaagcttcagatgccagagcgagcagttgcatattgtgaccgtgtttatgaagaaagagaacaacaaccgtccaaatcaaatatctattttaatcttctacagattcatctgaacccaagaaaagctgaaaaggaatttgagcagaaaattattccagttgcatcacaatactctggaatccaaaaggctagtgctactaagcccaaagggggtcgcataggtaaaaaggttgtagagattgagggggctgatgacatacgctttagccccagcggaacagatagtggccgaagtgatggtgatggagatgatgtaaatgaccgaggccctataatgttaaatgaagcactggaactgttgagccaacggtgggacaggataaatggtgctcaggctcttaggctgttaccaagagatactaaactccaggatcttgtatcatttcttgagccactattgcgtaactctagtgaacatcggcgcaattatttggttatcaaaaacttgattttgcgggcaaacttgcaggtcaaggaggatctgtataatcggtgtcaagctgttgtcaagattgatggagatagtacgtgttctctttgccataagcgtgttgcaaatagtgcttttgcaatatatccaaatggacagactttggtgcattttgtctgctttaaagaatcacagcaaattaaggccgtcagaggagcaaattctgtgaaacgtagataatatggccgtgatccaggtttggttgatgccagcttatggaattccttctctttggcttcacaatggattttagtggactgcttcagaagtttttactggagtaatcttcactctcttcagagatcgagtttatagccgtgcgtgtgtgctcggctgctcgctctctgttttctggccagcgtactggaaaactggaacccctttcttttggttttcatgtacagaatgtaaatgatactgtaaagtttcggtcaacagattgatgatggtcttgattatagtgccgc

SEQ ID NO: 14808 - DNA, 3473 bp, Zea mays
gcacgagaccattacctagaacatcctaatcgaaaaaaaataatgctgcgcgcgcacgagcacgacacgagctttcttccatcaagacatggcgacgccggagctttggtggtactggtggctatgggtgacgacgatgctggccgtcgtcgtctcgaccgtcgtctgctacctgaccaaccagcaccgccgctgggggggctggggctcctcctcagggcgtcgtcggccgccgggcccgcgtcctctcccgctcatcggcaacctgctggacctgcggcgcgcgcccggcagcctccaccacacgctggcgcgcctggcccgcgcgcacggcgcccccgtcatgcgcctcgacctgggcctggtcccggccgtggtcgtctcctcccgcgacgctgcacgggaggcgttcgcggcgcacgaccgccgcatcgcggcacgccccgtcccggacagcaagcgcgcgctcggcttctgcgaccgctccatgctctcgctgcccagctcggccccgctctggcggaccctgcgcggcgtcatggccgcgcacgtcctgtcgccgcgcagcctcgcggcgtcgcgcgccgcgcgggagcgcaaggtcgccgacctgatcgggtacctccgcgcgcgggccgggaccgtggtggatcttaaagaggccgtctatggcggcgtcgccaacctcgtctcgactgccatgttctccatcgacgtcgtcgacgtgggcgccgccgagtcgtcgtcatcgtcgtcggcggcggcccacgggttgcaggagctcctggaggagctcatgcagtgcatggcccagcctaacgtctccgacttcttcccgttcctcagcgcactcgacctccaggggtgtcgtcgccgggtggccgtgcaactgggccaggtcctacaggtcttggacgacatcactgaccgccgtttggcctcctcctcctcctcctccacgtccagcaagggcggggacaggcgcggcgacttcctcgacatcctcctagacctccagtccacgggcaagatcacgcgcgacaacgtgacgctgacgctcttcgacatcttcgcggccgggagcgacaccatggcgctgaccgtggtgtgggcgatggccgagctgctccgcaacccgggcgtgatggccaggctgcgcgcggaggtcagggacgcgctgggcggcagggacgccgtcgaggaggccgacgcggcgggcctgccgttcctgcaggccgtcgtgagggaggccatgcggctgcacccggcggcgcccgtgctgctgccgcacaaggccgtggaggacggggtacagataggcggctacgcggtgcccaggggttgcaccgtgatcttcaactcgtgggcgatcatgcgcgacccggcggcgtgggagaggcccgacgagttcctgccggagcggttcctggccagggacctggacttccgcgggaagcagctggagttcgtcccgttcggctccggccgtaggctgtgcccaggcgtgcccatggcggagcgggtggtgccgctggttctagcgtcgctggtgcacgcgttccagtggcagctgccggccggcatgtcggcggaccaggtcgacgtcagcgacaagttcaccaccaccagtgttttagccttccctcctatcaaagctgtgcctctgctctgatcaccacctagcaacccagcttgagtgtccagtcgattttggccagcaaaatcggaaaagaaatccctgcagccggctgcacacaagcaccacgcaggcttcgttcgtgacacgtatccacgcccaacaattttaaagcaatataacatcaatcttaaagcatcaaaaaaaaaaaaaaaacggccttttatggggtgttggctccgatttgagcccaaacacacgcgatgtaccgtctgacgatgcttttaacggtggtgcgaacggtcacgaccctatgataaaagcggatcttttcttctcacgcgccggacggtctgcgagtgcatagagggtcggcacgccactcgagatcccctagataacgtagagatccaagagggatgaagatttgaggttggggaaacgctaaactcagtctagattacttctactcataatgcaatgaagaacaaagtaaataaagtagatttaattgattggatcgattgtggtccgcgcaatcgacagtacccctttatatatatatagggggatgtgtggacctgttcctaggtgtttcccaatagaacccacgtgattagatggataagcacgtatggaaacaatgattttttcgcctgagttaatctgattgtggaccgttcgggctatcccgtggactgtctggggtccggccttttcaggtgcatgataagtttgcatcagttgggtcatgtatttataaactaatatttcatatttttaacaaataaatctaaccaattagatcgtgtcatgtcacctatttctgtggagccccactaatttattaaaaaatatgatatcttctgagtcaaatattttgttttaatttgttcaaattgcgttaggttcatattaattttgcgtacatagtaataacattgctttaatcacaccacatgttttaaataaataaataaataattatttgtttgattaatcaatgttaattagctagacaatctagttaatctagattatagttgtaacctacacttattataaataattattaaattataattattaaattgattaatatcaactcaaatattttaatttaatactgcttagtttgaatgcaacatctattagatttattgcgcctaaaaatagtattttacccattgttggggccttcgtcttccgaatatccttaaaaacacgactaatcatttattattagcatattgctaagtgttataggagcttcagaatcagaataagcttcggcgcagaacaatggaagtacaatgaagtaagcttcgtcacaacgacgcaggaaggtgatacaaggagaaggtgttattcaagttgctaggagcaaatgacaatgttgtctctatgatatttgtaaactttgtgtgtaatatatgagggcatgaatgtaatgtcatacgaagttgtacgactccctataaatagataaacagtgccctgcataaagtaccttttggtggatggcacgattgctctgtaattctccctctacggtataaaaccactgcttcatccatgaacccgaccattttttcaaaaggttagcacgggatgcctagcatctgaccggtatacgaaggtgtagcatccaagttattaggatattgctcttttccagtggccttcgtctggtaggacaactcatgaatattgcaaaagtaatcaacatctggtttcagtccttgactttttattgcccaaataaggatcccaaccttaatcaatgcgtcaggagtgagctcatgatgaaagattcaaacttttttatgacttcaac

SEQ ID NO: 14809 - DNA, 2417 bp, Zea mays
gcacgaggcgcctctcaccatttgggcccccgcgcactccgccccgcgacgagcgcgccacgacccccgcctctatttctttagcatcgccgcccccgcgccctgcccctccagcatcgccgccccccctctccgcctcaaggctctcctctcggaggtctgataggcaacccaataatggcagaagtcctatcaggatctcatgaacaccgtctaagctctgccttagatggacactacgacgagaagaggaaatccaatgtggaatacacagaggacgagaagaaagccgtgatcgcggctctgaaaaagaaggctttgagcgcctcacagaagtttaggcattccatgaagagggggaggaagagcagcaaggtgatgtccatctcgattctggatgagcgtgaacctgaggaggtgcaggctgtggatgccttccgccagcttcttgtacttgaagagctgctaccatcgcagcatgatgactaccacatgatgctaagatttctcaaggcaagaaagtttgatatcgagaaggcaaagcaaatgtggtctgatatgctgaagtggagaaaggagttcggtgcagataccattctcgaggaattcgaattcgaagaagctgataaggtggcagaatgctaccctcaaggttaccatggggttgataaggaaggcaggcctgtctactttgaacggcttggacagatcgatgtgaataggctaatgcaggtcactacaatggatcgctttgtcaagaaccatgtcaaggagttcgagaagaactttgctgttaagttcccagcttgctcaatcgccgcgaagcaccatattgaccagagcacaacaattcttgacgtgcaaggagtggggatgaagcaattcagtaaagctgcaagggagctcattggcatgcttcagaagattgatggtgacaattatccagagaccctgtgccgcatgttcatcatcaatgcaggccagggattccggcttctatggggcaccgtcaagagctttcttgacccaaagaccactgcaaagattcatgttctgggtaacaagtatcagagcaagcttctcgaggtgattgatgctagtgagttgccagaaatttttggtggaacctgccgatgtgaaggtggttgcatgaaggctgacaaaggcccttggaaggaccccgaaatcatgaagatggttcaaagtggtgatgggaggtgtggatcactcggtacggcctctttcgaggctccggagaaaatgatttgtgaagacgacacgtatcctaagaaacaagctttgtttgatggggaaacacaattagctggagacgagcattctcagtcacagaaaatttcccgtggccggattgaacatcctcacgtgtcacctcttcacgaggaacttatccccacttcaattcatacccctggatcaccctattcttgtgatgtcccgatggttgaagaggccatagacgccatctgcaagagccacggaacaccaccagatgagaagattgccatcaccaaagctattataaatgtatcgaatggatccaagcccccactctttgctggcatcatagcacttgtgatgagcatcgcaacgatggtccgtctgacccgcagcatgatgcctgggaaggttctcggtgctgccataggtggagctaccctctcagaaggtaaatcaaaagtacaagagcgccagcggtccaagctatcagaagaggctgtggaggaagctgaagacgccgtctctgcaaagcgcctctcggagcttgaggagaaggtcattgcactcctgacaaaacccgcatcaatgcctgctgataaggaggaggttctgcaggctgctgtctcccgcgttagtgcactggaagaggagcttgcagctacaaagaagaccttgcaggagactcttgagcgtcagttggagatcgttgcatacattgagaagaagaagaaaagcaagcgtttctttcgttggtagaagcaaacagcagtgaattgttcacgcccacgagaaaaaaggttttgcgtgtgatggaagcgagctggtgcttgcgtatgccagcaagctgcgattctgagtgtaacacataaggatgttctttcattcttcttttttgttcccttgttgcatcaaattgtgccttaaccacgtcgatgtgctgccaaattgtcaatccctgatacggtcaatcatggatggaccgactgcaatataaatatattataccacaaaatagcgcgacctttgctacgaacgtgttctgtatgtctctcttttttaaattcctactttctacatcttagattcaattccatcaaacttttcaaggttcgacaagtacgaattgcaaagctatatatgggctgagacgatgcagcggctcatcacatcttatcaat

SEQ ID NO: 14810 - DNA, 5253 bp, Zea mays
atgtcggcccgcgcgtgccgctagcccgctacagtgccctccatgcaaaatacagcgctcaagacaacagcagcgaatgccaatgccaattaataactagctactgtctcgtccgtccaggaaataggccggagaaggagacgcctcggcctctcattgctgggtgcgctccatgttagcggccgtaatggctgattgcggcgatgcggccatggccgttgttcttggctggtcgtcatcttggatctgcggggaagaggacggcgggcggctcaccctcaccgtcgcgtccaagtgcgtgcagaggacactcatagactgcgtcaatgtggtcctgttcatcgcgtacgtctgcacgctggctgccgcctgcgtcaggcggcggcagcgctctgcagatgcgagcagcgggaggagcggcgctcctagtaggtgggtgctgctcgtcgtctccacgtgctgcgtggcagctgccgtggcctactgtgtcacggctctccaagacgcctacgacatcaagacggcggttccttacttcgtcaggggcctggtctggatcgcgctggcggcctcgctgcacgcccagccgacgaggccggcgagggtcgtggccgtgctctggtgggtgctcttgtcgctgctggccaccgcgtacaattcggagatccttgccggggggcacagcctggacctcgcggagatgattgcgtggccggtgagcctcctcctgctgctctgcgccctcggctccctgctgccgcggggcgacgggcaccactaccgggacgcctccaacggcagcagcggcttgtcggagcctctgatcggcaatgacagaaccgtgccaacctcggagttgtaccgcgctggcctgttcggccagcttgccttctcgtggttgaaccctctgctccgtgtcggccgctccaaggcgctggacctcggcgacatcccgctcatcgccaccgacgacaccgcgcaccacacgtcgcagcagttcacggaggcctggagccgccacgtgagcgacaaagccaggagccgccggggcgtgggcagcaacagcctcgccctcgtcttgggcaagtgcttcctcagcgagatcctgctcaccggcttctacgccttcctgagaatgctgtccatagcagttgcccccctgctgctcttcgggttcgtgtggtacagcaaccaggaggaacgagacctccgggtcggcctgtcccttgtcggctgcctgctgctcgccaagctcgtggagtcgctgtcgcagcggcattggttcttcagctcgaggaggaccgggatgcgtatccggtcagcgctgatggcggtcatcttccagaagcagctcaggctgtccattcaggggaggaacaaccactccactggcgagattgtcaactacattgcggttgatgcgtaccggcttggcgacgccatcagctggctgcacatggggtggacctcgccacttcagctcgtctttgcagttgccacgctcttctgggcactcaagcttggggctcttcctggtctagtcccgctagtcatctttggtttcctcaacgtgccattcgcgaaaatgctgcaggggtaccaggccaagttcatggttgcacaggacgagaggctccggtccacgtcggagatactcaacagcatgaagatcatcaagctgcagtcgtgggaagacaagttccgcagcacgatcgagtcgctcagggacggcgagttcaaatggctgaggcagacccagatgaagaaggcctatggtgcagtcatgtactggatgtccccgacggtcgtctctgctgtcatgtacacagcaacggccatcatggggagtgctcccctgaatgctagcacgctcttcacggtcttggccaccctgagggtaatgtctgagccagtgaggatgcttccggaggtcctcacaatgatgatccagtacaaggtggcattagatcgaattgagaagttccttctcgaagacgagatcagagaggacgatgtgaaaagggtaccttcagatgactctggtgtcagagttcgagtccaagccggaaatttcagctggaaggcaagcggagctgatctgtcactgtgcggcgcgagccttcgcgtgaaccgaggagagaaggtggccgtatgcggcccagttggctcagggaaatcttcactcctgtatgcattacttggggagataccaagattatcaggatcagttgaagtttttggttcagtagcatacgtttcacagagctcgtggatacagagtgggactgttcgtgacaacatactctttgggaagcctttcaacaaggaactgtatgataaggcgatcaaatcttgtgctctggacaaggatatcgaaaattttgaccatggagacctcacagagatcggtcagagaggactgaacatgagtggaggccagaagcaaaggattcagctggctcgagccgtctacagtgatgcagatgtttatctactggatgacccattcagtgcagttgatgcgcataccgctgcagtccttttctatgaatgtgtgatgacagcacttgcagagaagactgtcgtccttgtgacccaccaggttgaatttctgactgaaaccgataggattctggtaatggaaggtggtcaagttagtcaacaagggaaatattcagaactcctgggatctgggacagcatttgagaaactggtgtctgctcaccagtcttcgatcacagcattggataccagtgctagccaacagaaccaagttcaagggcaacaagagtctgatgaatacatagtgccaagtgcgcttcaggttataaggcaggccagcgacatcgacgtgaccgcaaagggcccttcagcagcaatacagcttacagaagaggaagagaagggcattggcgacctgggatggaagccatacaaagaatacataaatgtatccaagggggctttccaattctctggcatgtgtattgctcaagtgctcttcacgtgcttccagatcgcatccacatattggttggcagtggctgttcagatgggtaacgtcagtgctgcacttcttgttggggcatattctggactctctatcttcagctgcttctttgcctactttagaagctgttttgcggctattctgggtctcaaggcctccaaagcattctttggcgggctaatggactccgtattcaaggctcccatgtcattttttgactcaacaccagtgggaagaattttaacgagggcatcttcagatttgagcattctagacttcgacataccttactccatggcttttgtggcgacgggcggcattgaggttgttaccacagtactggtcatgggtactgtaacttggcaagtcctggttgtagcgatcccagttgctgtcaccatgatatatgttcagaggcactacgtttcctcagctagggagctagtaagactcaacggaacaacaaaggcacctgtaatgaactatgcatcagaatcaattctcggtgtggtgacgatcagggcatttgcagcaactgagaggtttatctacagcaacatgcagctcatcgacactgatgccacactgttcttccataccattgccgcacaagagtgggtaccccggccgcgaccgcccctgcagtccttgacaatcctcgcggccgcattgttccttgttctggttcctccaggagcaatttctccgggctttgcaggactttgtctctcctatgctttgactttaacttcagcacaaatattcttgacaaggttctattcgtacttggaaaactacatcatctcggttgaacgaatcaagcagtatatgcacctcccagtggagccacctgccattataccagatagtagacctccaacttcgtggccgcaggagggaaggatagacctgcaagatttgaagataagataccgtccaaatgcgccgcttgtcctcaaaggaatcacttgcacttttgctgctgggaacaagattggggttgtagggaggacaggaagtggaaaatcaacacttatcagctcattgttccgtctcgttgatccggcgggtgggaggatacttattgacaagttggatatttgctccattggccttaaggatctaagaactaaactaagtattatccctcaagaacctacacttttcaggggaaccgtgcgcaacaatttggatccccttggccagcattctgatgaagagatatgggaggccttggagaagtgtcaactgaagacagcaatcagcaccacctctgctcttctggatacagttgtgagtgatgatggcgataactggagtgctggacagcgtcagctcttctgtcttggcagagttctcctacgcaggaacaaaattctagttctagacgaggcaacagcatccatcgactctgcaacagatgcaatcctgcagaaagtaatcaggcagcagttctcaagttgcacggttataaccatagctcacagggtaccaactgtgacagacagtgacaaggtcatggtcctgtcctacgggaagcttctagaatatgaaacaccagccaagctgttggaagacaaacaatcagcatttgctaaacttgtggctgagtattgggctaataccaagagaaattcaacatgatctaccattattgcaggacatgataaaagatatgatcattttaatcaagatatcgaaagattcaagggttctcaaattgaatctttaacaagacaaggaatgccatcatgattatttgattgatgtggttactgggagtgaataagatatcaacagaaattcaattttggtaatggaagcaatttttggagtgagggctgatgttcgagagaactccagctggttgattgaacatgtggtattcaatgcaaaatgaaatggaggatccacttctagcatgatcaatggcatttttcatacataagcctttttgaataagagaagcgaagtaccaagtcgtgaattgcaatgaagaatgagtaaagtgcagtgctgagaagaataattttcatgtatcttgtgtactcaataatgataaactttatatgactgagaaggaaactgtcgcaaattacaaaaaaaaaaaaaaaaaaaaaaaaaaaaaaaaaaaaaaaaaaaaaaaaagtaagaaaaaaaaaaaaaaaaaaaataaatcccggaataaatacctgcacccgtccctgaatgcacctataactagccctatttagagctggact

SEQ ID NO: 14811 - DNA, 2524 bp, Zea mays
aagatctattagagaaatgtttaaaatctacccacactaattttttagatgtccattaaaactgattttcaggagttatttgctgggaagctcctctaaccaagcagaatatcatctaaggcgtgtatggagtaaagtacagccatttttttgggatagtcaatgaacttagccgctaagaaaatatatatttatatttatttatggcagtatttagggaggaaagaaagaagaaatagactcccatgcagttgtccgttcaaatgcaacgtccagagaagaaaccgatgagcagcgagccagccatccttttctagtcaagcatcgtcagcgtcgcaaccgtccgtccgtccgtcccaacaaggccagccgccacctccccagctgacaggtgagccccaccccacatctcccgccacactatttgggcccccccccccgtccgcccccgcccactcgctcaccatcagcgatccttctctcttgagtgtcctcccatctcatccaatccatccccgccaccacaggcaaaggcaacccaaaaggagccgccatgggctcccgctacgaggtggaggtgacggtggggtcggcgagcaacctgaagaacgtcaactggcgcaacggcgacctccggccctacgccgtgctgtgggtggacgacgggcccaagtgctccacccgcgtcgaccccgacaacggcgaggaccccgtgtgggacgagaaggtggtggtccccgtcccgcccgcctccgccgcgcgcctgggcgacgccgtcctccacatcgacgtcgtccacgccgccggcgacgacgccgacgccgtcaagccgctcgtgggctccgcgcgcctcccgctccgcgacgtcctcgatgacgccggcggcgtcggcggcgccagggtctcgcgcacgctcaggctgaagcggccctcgggccgcccgcagggccggctcgaggcccgcgtcgccgtccgcgaggccgcgccgccgccgcgctactacgacccgaacccgtacccggcgcccgcgtacgggaaccccgccgccgcccgcgacccgtactacgcggcgccgccggcgtacggcggacagccgccgtacgccgcgccgccggtggggtacccggccgacgctcctcctccctacggcggtggttatggctacggagctgctgctccgacggcgtacggcgctgaggctgctccactacctgcccagcagcagaagagcagcaagatggggatggggacggggctggccgtgggcgccgcggcggggctgctgggcggcctcgcgctggcggaaggggcgagctacgtggaggacaagttcgaggatcgcgtcgccgagagggtggaggaggagacgttcggcgacggagattacgatgacgattactagaatgaagcaggtcggagaggagatcatgatcatgcatacggaaccgaaatccaggcaacaagtcgaagtcgagtagctcaaatgtattcaaataataagtgagatcaccccagtcgagaaaaaaaatcaaaacttgaaccatggcaatatatgttaatcgccaaccatttgatcgagtacttggtttgattgtccaattcgaaccgtatcttgctttccatgtcgtacgtgggcgcctatatatattttttgcagtatgaacagaaaagaaaagaaaaagatgtcagtgaagcggcaaggccgtacccttgctaagaagatccatggcagtcaacgatagcctatttgattgagttctacaacttctataccttcgaagagatgcctttaatccgaagcgtggaagacggtcaaacaatcgagcgttcaatgctttgaagcttaacgaaacactcgacgcctcaactgagagctagctttcacaaaagcgaaacaaagcaaagcacagcaataatgcaaatgaaacagtggttcagctgctactgggtgattggggtgtttttggatgcacgaacgaaggtggccacattttcaatactcattgtcagctgctgcagcctgtaggtgcgactgcgacgctacacgcacactaccacgtattctagaagcactttatggatctatttcttattctctcttcctttttcttctttttgatataagaagagtgttcgaatttgtctgtggaagcaccttgattgggcctgctatgttcgagttgggccaggttaggatgtaagtggaccaggatgcatgcgtcctccgctcctgccactaaggctatattcggttcatagctaggggtaaaatcaagggagggatttaatctagagattgattgagttaaccctctcctgtcacttgacccattgagggcatgttctgttgcaaacggatgaaagctgatctaatccccatcaatcccctccaattcgcttccaaacgaactagccatgagggtatactcccctcctcctgggggccccggctccaaaaggttgtttggttaatctagggagatatacaatttttgttacaatgaaggcatctttattacaacaa

SEQ ID NO: 14812 - DNA, 1629 bp, Zea mays
ccgggaacaccttttgcccctgtttcgccccagcgcgcccaattaccctccctaaaggggacaaaagcggaactccacccccggtgccggccccttttaaactaggggtcccccggggctccaggattcccccggaggccattccctagacatccttatctatacaaaccaaactcgcgctccagaccacagctcaccctcacctgcgacctgcgcgcattcacagccgccggcgccacacgtgcccgcgcgccgggcgccacctctctcccatccaccagccttcctctcccgggccaggcggcgcccctcaatggccgccaccttcaccgtcgccgcccgcctcccgctgcggggccccgcgcgcgctccgtcccggccggccgtcgctgctgtaacccggcttcgaagccggcaggagcggcgcggcctagcagcgacaggcgggaggggacctgcccgggttcgggccgagactttctccggtggtggaggcgtggggcggagggaccccatggcgccgccttacaatgtcctcatcaccggctctacgaaaggtataggatatgcattggcaaggaaatttctggaggctggtgataacgttataatctgctcgagatcagctcaaaaggtagaatctgtggtcggtgacttgaaggaggagtacggagagcaacatgtgtggggaactgtctgtgatgttagaaatggaaaggatgtaaaggcacttgtggagtttgcacgtgacaaacttaagcatattgatatatggatcaacaatgctggatcaaatgcatatacatacaaaccactagtggagacctctgatgaggctctcatgtaagttttgtcctatttgagaaaccctggcaaatacacttctattcttttgtgctgttaatatcagtgattacttggacctcttctctgatttactagggaaatcatcaccactaacacccttgatgatatgttgtcgtgaggcgataaatatgatgaggaaccaacctcgaggtggtcacatattcaaccttgatggtgctggttctgatggaaggccaactccaagatttgctgcatatggtgcaacaaagagaagtgttgtgcatcttacgaagtcacttcaggctgaattgcagatgaatgaagtgaataatgtgatggtgcacaatctatcgcctggcatggtcacaacagatcttcttatgtctggtgcaactacaaaacaagcaaaatttttcatcaatatattagctgaacctcctgatgtggttgcagactaccttgttccaaacgtcagagaaatccctaccaagcaatccatgaagccaacctacattcgtttcctcacaggcttgaaggcctactcaagaattttttctagacttgcttttggtgctaggagaaacaagtatgttactgaagattagttatgctgccagcttccaactgaagagattaggaacaattcttttcattaagcgtcacttacttttctcataagatgggatgtattacagatgtcatctcatgagaacagtgatatactcttctgtacagtagtagcaatttttttagtaaaaaaaaaaaaaaaatgtgcataaataaaaaaaaaaatttgcggcc

SEQ ID NO: 14813 - DNA, 1488 bp, Zea mays
atctatacaaaccaaactcgcgctccagaccacagctcaccctcacctgcgacctgcgcgcattcacagccgccggcgccacacgtgcccgcgcgccgggcgccacctctctcccatccaccagccttcctctcccgggccaggcggcgcccctcaatggccgccaccttcaccgtcgccgcccgcctcccgctgcggggccccgcgcgcgctccgtcccggccggccgtcgctgctgtaacccggcttcgaagccggcaggagcggcgcggcctagcagcgacaggcgggaggggacctgcccgggttcgggccgagactttctccggtggtggaggcgtggggcggagggaccccatggcgccgccttacaatgtcctcatcaccggctctacgaaaggtataggatatgcattggcaaggaaatttctggaggctggtgataacgttataatctgctcgagatcagctcaaaaggtagaatctgtggtcggtgacttgaaggaggagtacggagagcaacatgtgtggggaactgtctgtgatgttagaaatggaaaggatgtaaaggcacttgtggagtttgcacgtgacaaacttaagcatattgatatatggatcaacaatgctggatcaaatgcatatacatacaaaccactagtggagacctctgatgaggctctcatggaaatcatcaccactaacacccttggattgatgatatgttgtcgtgaggcgataaatatgatgaggaaccaacctcgaggtggtcacatattcaaccttgatggtgctggttctgatggaaggccaactccaagatttgctgcatatggtgcaacaaagagaagtgttgtgcatcttacgaagtcacttcaggctgaattgcagatgaatgaagtgaataatgtgatggtgcacaatctatcgcctggcatggtcacaacagatcttcttatgtctggtgcaactacaaaacaagcaaaatttttcatcaatatattagctgaacctcctgatgtggttgcagactaccttgttccaaacgtcagagaaatccctaccaagcaatccatgaagccaacctacattcgtttcctcacaggcttgaaggcctactcaagaattttttctagacttgcttttggtgctaggagaaacaagtatgttactgaagattagttatgctgccagcttccaactgaagagattaggaacaattcttttcattaagcgtcacttacttttctcataagatgggatgtattacagatgtcatctcatgagaacagtgatatactcttctgtacagtagtagcaatttttttagtaaacgcataggaaaactgtgcaccaatatatcaagaagaatatagaaataaggtctaaaatagaccacaacatgataaccacctcacctcacgaatatacaaaagggtccatctaaatacgatcaaacactagccaatactaagattgtgtcctgca

SEQ ID NO: 14814 - DNA, 598 bp, Zea mays
ccctggttcgttaacttcgttatctatacaaaccaaactcgcgctccagaccacagctcacctgcgacctgtgcgcattcacagccgccggcgccacgtgcccgcgcgccgggcgccacctctctcccatacacggtccaccagccttcctctcccgggccgggcggcgcccctcaaatggctgccaccttcaccgtcgccgcccgcctcccgctgcggggccccgcgcgcgctccgtcccggccggttgtcgctgctgtaacccggctccgaagccggcaggagcggcgcggcctagcggcgacaggcgggaggggacctgcccgggttcgggccgagactttctccggtggtggaggcgtggggcggagggaccccatggcgccgccttacaatgtcctcatcaccggctctacgaaaggtataggatatgcattggcaaggaaatttctggaggctggtgataatgttataatctgctcgagatcagctcaaaaggtagaatctgtggtcggtgacttgaaggaggagtacggagagcaacatgtgtggggaactgactgccatgacagaaatgggaaggatgtgaaggcgcttc

SEQ ID NO: 14815 - DNA, 2389 bp, Zea mays
gcaatggatgcaggatcgaacggttagaactgtttgatgagtttgaagagtggtatatgatgcaggtatgtgataccttgagaaacactgtactgctcattgtttgaggaatatttttttttcttgatttactaccatatataaagaagtcgatcagttaagtgtgtttctgttctgaaacctttgacttgtgctttcaggaacactactgtgtggcctatggaatcaacgacgccgaggttatttgactacttgacttcatatgattattctgaaatcagtcgaatccaccagtctacaattttgtgtcgaggctaaatttagtctttctcaatttcagggcatatttgacagttttggatttggggagacatagcagcactggtgccttttcttctgtgggtaccagctgcacttgttgtaaaccgacaccattaattcaagtattactcgaagtaaactttgcttgataaaagaaggaacgattgcttgataaaagaaggaacggacaggggtaggatacctaaacatctcctgatgttggagcttgctttgataggctgttcaagttcaacggcgttgtgcttggtttaaggtctttggtgccagtcgcagtggtgtttgatgtcaagcatgccaggctgccagttcgtcacaatatgaacagaacagtggtgctttccattttactgtttgcagatttaggttaaatctggtagcacatgtttgcagaataaatccgatgtagtttccttcagcctcttcagatacgagaggagatgacatatacgtccggttccaatttgcgcttgacgtgcgaggagctttgaagccaaaatagtttcctaacatgttgaaacaaccgctgtaagagtcaactccgaccaatgattttaagtcgcctggtcgaaccctgagactgaccaggtgacgaccaaggtgattagtcgaccatttaggattttaggattagagcagtagcagccattagttcggcactagcaccgacagaggtaagccatagacggtgtaagccatagagacagacaaaatcacataacagaactacagagaagggggaaccttgagatgatgagctcaactcgtcactagtgttgtagacgctcgtgatatagagcagcggtcgctcgccggtgatctggagcagccgtcgcacgcaggtgatctggactggagctatggaacttgagcaggcagaggaggggcaacccgcggtagaggaaaagaagaggaggggcagctcagagcagaggaggggtagacggcgttaaggtctggctggtagctgaccagtgaggaggaggcggtgtcacgaggaactaggcggcggcaggaggcagcacgacaacggactgttaagtctcttatgggcgcgtgaaagaacaggcacgtgaaaaacccctaatgggccattggctgccagcgcattagaaccctgcagcctagtcatgagatcactcctggtcgcgcgcagtgtctagttgcccgattaggcgacgattaggcggacgatcgaacgaccagaactcctagtcgaaccggaacccctagtcggtcatcgtgactaatccgacgacttgaaatcactgactccgacaaagagggtgatcccatcccatcgcataattatggggataaggggattaagaggtattaaatacttttctattcaattttaactttgcaagggattttatacccttcaatccactcctaaacatataaagcccttaggttatctccaacaatcgcacatatggtcatgtaaaatattgttttgtatcatagataatattttttatagtgtgaagtttaaaataagacgtgagatgagaaatagaatggaagagttgctgaaaatagccttaaatacatcttttgttgtaaaacaatctatactctataccactatataatccaccagtttaaactttataaaactcatctaatcaaatcacctctacacttataacatttactaaattcatcaaacaaattgtacctatacttaacacacaatcacacaagcaaaaccaatggttcacatcgctggataaccctcttctcatacctactcaaatccaatagacaatattattcagatcatccttatttcatccctcctgtgtccctaccatcacttacactatcgttgacatcgacttttgttctctacttcttcagatcgtaatgttagcatgagctatggtagttacaagaaagtttagcaaaattgagagacgtgcccacgccacacggctcttgtgttgatgattagtggatcattacggacaatacatttgttaagataacagactgtttttttcatcgaagggtccatagctcagtggtagagcaattgactgca

SEQ ID NO: 14816 - DNA, 1576 bp, Zea mays
gctcagtgctgagtctgctccgtccgtctccgtgccgtgtgctggcggtggcggtccaggccccgctcgctcctaccagtggcccgtgcgtgcggccgccggcgccctgatcgatcgacccgcgcctcggccggatggaggcgtcagcagcagcaggaggtgggggaggcagcgccgccacgcggagcagcccggcggccgtgcaggccaccaacgacgacgccgcggccagcaagctgtcctgtgttaacaaaggatacatgaaggatgattatgtgcggttttttgttaggcgaccaacaagaagggctccaataatcaatcgtgggtattatgcgcgttggtctgttctcaggacgcttctgcatcaattcctcaatgcggggaagaatagtaacaatgacaagcctaaacaaatattatcccttggtgctggctttgacacaacattcttccagttgcaagatgaaggaatggctccacactgttatgtagaattggatttcaaggaggtaaccagcaaaaaagccgccatcattaaccattatagtgaaatgaaggaaaagttaggctcagaagcttcaatttcaatcgaaaaaggtgaagtgataagcacacattacaagctattttccgctgatattcgtgacataccaaaactggattcagttattcgcatggctgaaatggatcctagcttgccgacctttataattgcagagtgtgtgcttatttacctggacccaactgccactggtgctattgtgagttgggcatctcaaaagttctccactgctgtctttttcttatatgagcagattcatcctgatgatgcatttggggagcaaatgattagaaatcttgagagtagaggatgcccccttctcggtataaatgctacaccaaccctgagtcacaaggagaaactttttcttggcaatggatggcagagagccgttgcatgggatatgctgaaaatctataatgacttcattgacagtcaagaaagacgcaggatcgaacggttagacctgtttgatgagtttgaagagtggtatatgatgcaggaacactactgtgtggcctatggaatcaacgacgccgagggcatatttgacagttttggatttggggagacatagcagcactggtgccttttcttctgtgggtaccagctgcacttgttgtaaaccgacaccattaattcaagtattactcgaagtaaactttgcttgataaaagaaggaacgattgcttgataaaagaaggaacggacaggggtaggatacctaaacatctcctgatgttggagcttgctttgataggctgttaaagttcaacggcgttgtgcttggtttaaggtctttggtgccagtcgcagtggtgtttgatgtcaagcatgccaggctgccagttcgtcacaatatgaacagaacagtggtgctttccattttactgtttgcagatttaggttaaatctggtagcacatgtttgcagaataaatccgatgtagtttccttcagcctcttcagatacgaggagatgacatatacgtccggttccaatttgcgcttg

SEQ ID NO: 14817 - DNA, 2104 bp, Zea mays
aaacatggaatggtagtgggggggtggtttcggatcgggactccacagcttttggcggcgtattctagtatacaccaaaaaagagaaaaagaaaagcaccgaaaaactagcaaaccctacctcctctcctcccctcccctcctcggcggcggaatgtccgaccgccgccgcgacaaggagaagccccgcgaccgcgacatcgaccgtcatcgcgaccgagaccgcgacatcgaccgtcatcgcgaccgagaccgcgaccgggaccgggacagggacagggatcgcgagcgagaccaccgccgcgagcgcgagcgcgagcggaagcgctcccgctcccggtccccgtcggcggatcgggaccgctcccaccgccgccactctcattcgcaccgaggccgtccttccccctctcccgacgccggccgccacaagcgccgccgcgaggcgtcccctgcctccgcggaccatcaccataaggaggataagaaggctgccgactctcacgcgacacccggcggaggggacatcgcggccgcggccgctgcggtgggtgacggcgacgtgaatgcggaggaactggagatgatgaagatgatgggcattcccgtcggtttcgactccaccaaggggaagcacgtgcccgacgccgacgtcagcggggtgcgtgccgtcaccaagcgccagccgcgccagtacatgaaccgccgcggcggattcaaccgccctctgccgcctgagcgcaaccgctaaggatgggaaaaggatcatgcgccaacacaaggatgtgctgatttctgggtagcagttactctgttactggacagtgtagtgagcatgtataaaccttgatggctatttaatttgcaaaacactgtagaatgatttcccgttcccttttgtcatcgtttattctgtgggcattccaggaaaacagaatttggtggatcattttgaaactgtggctttacagctttaacatgatgtttctggctttctgcgtgcaaaaaaaaaaaaaaaaagcaatgcttgtgcagtcctttgtttcttgatcggctccgcgtttctggctgtctgcgtgctctttgcatttgtttcaggtaatcaggcatgcaccacatggattcccaagtgaaactgcttttgcttttagttgtatgctttgcaatgaaattattggtaatggacatgagtgcaacatttgtgattataagtttcgaagatctcactgagtagcaggaccaaagagacctgttctttcaataatacgtagaataattctgtaataataatttaagtttaggctactgcattagatccagaaactagtaccttgagtggtcgaccagtttatggtttgagggaattatagggcaatagtttgaggttgctagatcacttactagtttgctttatgctccagtggttgtttcatgtaagtttgttgtatgctgatgctgccatcctgacaatttaccttggctgctgtcgtgcgctgtttggacaaacaatgcaatatcagaactcgggtatgtgtttgatgttaaatgattaaggactgggttggcacatccttgtgatacgctgtggtgtggtctagccacggtgtcaaataacgatcaagtcagtgctttcttagtggcgtggttaggggtggtaatgagctttaaattttacactataaaatttaatgatcaaatagaattaggattaagctttattcctattcattttgaattaagattaattaggagttctaacttatttgttataaaattaaaagatcaaatcgaattaggattgggctttattcctatttattttgaattaaaattaattaggagttctaacttatttgttgtaaacgtatcgtgatccattgccgccctttggcatggtacattggcgcttgggtatagtaaaaaatacgcaaatgatcatattatcggtggtggatcttcacatcattgatagtcaaagcaatttgcattcaaccacatcatcgatagttcgagttaactagggttcattgaggtattttgaatgtatatggttgtttacagttaagagagttgagacatcatctagaagatatgtaattataaaa

SEQ ID NO: 14818 - DNA, 2212 bp, Zea mays
ggggcgcctagcttcttactagtttttttttccttgcgcaaagcttgcacttgctgagcgtgggggaccgcgaggcccgccgggaaaggcgcttcattcattccctctcctgctttctctctccaacccatccgtcctctctctccacacataaaaaccaacgaagcgggcgagtgatcaggcagaggcagcaggcaggaaataaatttgaagaaagctagacctctgatcagcaggagctcatgggcgccatgatggcctccataaccagcgagctcctcttcttccttcccttcatcctgctggccctcctcgccttgtacaccaccaccgtcgccaaatgccacggcacccacccgtggcgccgtcagaagaagaagcggcccaacctgcccccgggcgcccgcggatggcccttggtcggcgaaactttcggctacctccgcgcccacccggccacctccgtgggccgcttcatggagcggcatgtcgcacggtacgggaagatataccggtcgagcctgttcggggagcggacggtggtgtcggcggacgcggggctgaaccgctacatcctgcagaacgaggggcggctgttcgagtgcagctacccgcgcagcatcggcggcatcctgggcaagtggtccatgctggtgctcgtgggcgacgcgcaccgcgagatgcgcgctatctcgctcaacttcctcagctccgtccgcctccgcgccgtgctgctccccgaggtggagcgccacaccctgctggtcctccgctcgtggccgccctccgacggcaccttctccgcccagcacgaagccaagaaggtacggtactcatcaccatccttcttctgacccttcaatttgtctccacgcgtagtacgtacgtgccacatcagatcagttctatctatatatgtggctgaatctatgcaaaggatcgccgctaacaaccggtgccccggccgggataacaaccggtgatgggcgcgcggccggccggatgacgagtgcagttcacgtttaacctgatggcgaagaacataatgagcatggaccccggcgaggaggagacggagcggctgcggctggagtacatcaccttcatgaagggcgtcgtgtcagcgccgctcaacttcccgggcacggcctactggaaggcgctcaagtcacgcgcgtccatacttggagtgatagagaggaagatggaggacaggcttgagaagatgagcagggagaagtcaagcgtggaggaggacgaccttcttggatgggccctgaagcaatccaacctgtccaaggaacagatcctggacctcttgctgagcctgctcttcgcggggcacgagacttcgtccatggcgctcgccctcgccatcttcttcctcgaagggtgccctaaggccgtgcaagaactccgggaggagcatctcctgattgctaggagacaaaggctaaggggggcgtccaaattgagctgggaagactacaaggaaatggttttcacgcagtgtgttataaacgagacattgcggctcggcaacgtggtcaggttcctgcaccggaaggtcatccgagatgtacactacaatgggtacgacataccgcgggggtggaaaatcctgccggttctagcggcggtgcacctggactcgtcgctgtacgaggaccccagccggttcaacccttggagatggaagctgcagagcaacaacgcgccaagcagcttcatgccgtacggcggcgggccgcggctgtgcgccgggtcggagctggccaagctggagatggccatcttcctgcaccacctggtgctcaacttccggtgggagctggcggagccggaccaggccttcgtctaccctttcgtcgacttccccaagggcctcccgatcagggtccagcgggtcgccgacgaccaaggccatcgtagcgttttgaccgagagcacaagaggctgagagggaggaggcagttcaatttttcgttgcattttgagggctgtggtctcgtgttttatgtagattgtgattattattattatacatactaaaacaagatagaagcacgtatagacagagcaaagaggaggatggtccaaaagtgtttggggtagataaaatgtgtactcactagggttgtaataaggccggtccatggcccatgtcaagtaatactagagatatatagaatatagtggatatccaaaaaaa

SEQ ID NO: 14819 - DNA, 5411 bp, Zea mays
  misc_feature (1254)..(1254): n is a, c, g, or t
  misc_feature (4267)..(4267): n is a, c, g, or t
caatcggcaaaatatttggtattcggcaaagagccaaatttcggtagtcataggtctataatttcgtttccatacgtctatatactatgaaagtatgaatcatttgtgaaaaaaaatcacaactatgaaccaaaatcgactgtatactgatgaagcagaccagaggactgttagctaaagatgattgcgtgtattgagtctggtttccttgtcctcttgtcaatttcttctgattactcttagcttgcttcagtgcacagcacttgttggtttgggtagtttcttctaaattatggttcatagcggtggcggacgcaggaccaaaattgatggagggccaaaaaactcattacaaaatcaagcaagacggtaaaaaatatagttgcataaaattcaagttccatatctatcaatataacatacaagttcaaggaagagaagcaaacatacaactaagttcttccagaccgaatcaagtcgtgtgtacgttgtcaaatatcgatctcctcgaagggtgggacaccgagaaagaggcggggtcagatgatgtctccagttgagagccagggctcgctggttcgtcaagctcgccagttgtcgaggacgggtcgcatcgtcgaggcgaacgaggtcgggtctgccaagagcgggatgatgtcatgacaataacgagcgaggcgaggacgttgggaagaggccaaggtcaggcgatgtcaggcgtcagtaaggagacggcggtgtcaagaacggagcatctgggcgtattggccccgacaggtggggcgtgagaagaaatgggacctgatggatagatgcgaggactagaccaaagaggatggaagttgtgagaactgctcagggcaattttagcctatccaaaccttttttatatactttacagtatgttaacattaggtataagaggttataaaaaattgagggggtcattctatggttccgacacgatcgaaagaatgagactgaatgaatagacgtgaggattagactaagtaaaaggacgagaggatagaattagactaattcgacgatgagacccataacacaatattttaaatatacttaacagtaaataaacatgatatataaaaggtcataaaaattgaggggacatggcccactttacccctggttcatagactcatagttaagcaacagtctttactatggccctgtttgggagggctctggcttctctaaaactggctccaaccgttgcttttttaaaggagcagnttctctgctagagccgatgtcttttacaaatcgtttgacaaaacggctctttattgaacgctagtgagaggctgcgcgtggtgggagaggctgcacgtggtgcctgcgcactgggatgggcgaggagccagtgcgagagcaggttttttgggctccggctcttaggagctaaactggattctgctctctttaaagagtcatttcaacaaacttgtttgggagagctccgtcgcggagccggagctggagccacgggagagccgtcccaaacggcctctatatttgctatcgacaagtgatttttaacaaattcccgcagcaacgcgggatatcacctacttcaacaaggcgcgctaaaacgttctgtacgttaaatatagcggacgaggacgtacgctacgtccccagcaagaaccggtaaagcgcacgctaaattatagcgagccttcatcgtccgtcaaatgtggcggactcgttatcgtccgctatcgtctgtttgctcctgcgtcgccgcctatcggttcactcccgcgcttgcttggaagtcactcgtcgctccgttctctccctcgcttgcccagaagctttgagtccttcagtgacctgcaccgtcgtgaagatgaaggagtcgtccgcctccgatggtgggaaccgccgcaccagcgtgtatagccggacgatgtcccttggcccgcctcctgacagctcgtcaaagtcgtcagagctatcagcgacagtgagcttgacggcctcgtcgtcgttcccattggtgccccctcctacggagtagaagaagtcatcctcgccgccgtcgtccagatcacgcgggctagtgcgaccaaacatcaggttggtgctcgttgaaaatgtctgggaagcagcagacatgaacgatgatatgtccaatatagaaaacagggtccgctgattttttcttaaatatgtaataatattattttcaccataaaatcaatatgcattgtgtagcgtatttaacatatgaactgtttttaagcgaccaatggaaataataaaatctggtaacactgtagatatagaggacttaatttagaggacgttgctggagacgatgaaaatatagaggacggaaccttttagagtgtgctgtaaagtacgaggaatattcctttagaggatgaaatttaggggatattgctggagacagtcttagggcctcggttgtagcggttcctgtgtactagtatcattttgcaaccgaccgtactcctaagcgatggaccaaggtttagacgtcctactaataggccagacgctagctaacaaggtagctcatcttagttgatcttcccactcacagtctcacacccaccttcacctctacgttgctgaagtcaagccccatggtattgtactcgaactgaacccggcagatcaccaacgtcccccagcagacacaccaactgggtcgatcgccaacccaaaaagaaggccattcctatcctacgcggccagcacgctcaacgtcatgatcgttcggtgcccagaaggcacataagagctccttcctcacgcagagaccagtctctcccttccaactagagagttgtcgtctgctgcagggatggccggcgtcctgccgaggtttggccccttcggccctctgccgccatcggatgagttcgggatcagggagacgagaccccgtctcgccggcaggcgggccggcgggtacgacctcgtggagcggatggagtacctgtacgtgcgcatcctcaaggcgcgggacctcaagtggactggcagcttcgacccgctcgcggaggtgaagctcgggagctactcctgcgccacgcggcacatcgagaagacgacgagcccggagtggaacgacgtgttcgcgttctcgcgggagaggatccaggcctcgttcctggacgtcgtggtcaagggcaagggcttcgccaaggacgacttcgtcggccgcctgcgcttcgacctggccgacgccccgctccgcgtgccgcccgacagcgcgctcgcgccgcagtggtaccacgtcttcgacaagaaggcggagcgcgggggcgaggtgatgatggccgtgtggttcggcacgcaggccgacgagtgcttcccgctggcggtgcacgccgacgccgcgttcgccgtggacgccaagctggccgcgcacatccgctgcaagcagtacaccgtgccgcgcctctggtacgtgcgcgtcaatgtcatcgaggcccgcgacatcgcattcgcggacaaggcgcgcgtcggcgaggtcttcgtgcgctccaggatcgccgcgcaggggcacaagaccaggacgtgcgtcgcccgcctgcccacgtgcggctggaacgaggaccacatgttcgtcgccgccgagccgttcgaggaccacctcatcctctccgtcgaggaccgcgtcaaggtcgacaaggaggaggtcattggccatgtccacatcccattcaaagaattcgaacggcggtgggacgcccgcccgattcgcccaagatggtacgtaggtgcactttcgtccttccccagaaagaaaggaaactccaagatcaatcaaacactacttgtttgcgaatcaacaggtttaatctggtgcggccagaaggagccgccaaaatcgacaagttctctgccaagatatgcgtccggctgtgcctcgagggcggatacagagtgctgacagagccggtccactacctgagcgacgtccggccggcggcgagggagctgtggcaccacaggccgcccattggcctcatcgagctcggcatccacaacgcgttcggcctgagctccgttcgcacgcgcgacggccggggctcctgcgacgcctactgcgtggccaagtacggcgtcaagtggttccgcacgcagaccgtcatcgacagcctcgcgccgcggttccaccagcagtgcttctgggacgtgcacgaccactgcaccgtgctcaccgtcgccgtcttccacaactgccagataggcgacaagggtggcntcgtgaccggcgaccccgtcaaggacatcctcctcggcaaggtgcgcatccggctctcgacgctcgagaccgggcgcatctacacgcacgcgtaccctctcgtctccctccacggcggcggcatcaagaagatgggcgagctccagctcgccgtgcgcttctcgagcacgtcgacgctgggcctgctccagacgtacgcgcagccacacctgccgccgatgcactaccactccccgctgtccatcgtgcaccaggagacgctgcggcgggaggcggtgtcgctcatcgcgcaccggctgggccggatggacccgccgctgcggcgggagtgcatcgagcacctctgcgaggcgcactcgcaccggtggagcatgcgccgcagcaaggcccacttcttccgcctcatggcggcgctggcgcccctgttcacggggctcaggtggttcgtcgacgtctgtcactggaagaacccgtccaccaccgtcgcggtccacatcatctacgccatgctggtgtgctgccccaacctcatcatgcccaccttcttcatgtacaagttcctcatcggcctctggaactaccggcgccggccgaggcacccgtggcacgtcgacaccaaggtgtcgcacgccgagatggcgcacctggacgagctggacgaggagttcgacgacttcccgacggcgcgtcgtcccgaggtgatccgcatgcggtacgacaggctgaggagcctcggggcgcggatacaggagatggtcggcgacgttgcggcccacgccgagcgtgcgcggtgcgcgatgacgtggcgcgacccccgcgccacggcccatgtacctgctggcgtgcctgttccttgcggtcaccaccctcctggcaccgttccaggcggtggcgctgctcacggggttctacgtgatgcggcacccgacgctccggcagaggctgcccgacgtgccggcgaacttcttccggcgactgccatgcaaggtcgattgcctgctttgattgcggatcaaatgatgtttcagtccgtaatttgatattttattgttagcaccgttcgactcttcaattctataaatgttgatctagtatacaattcctccgtttataaaagttgggagttgggactcgcgagtcagac

SEQ ID NO: 14820 - DNA, 1529 bp, Zea mays
gcacgagaccattacctagaacatcctaatcgaaaaaccttggtttctctatcccctctcctctgatcggctggtccccgttgcattggccttggcccttgccatgccaacctcatcaacgcctctcaactctagctagccagccacacctcctctgctctggtcctccccgccattagccggtagctgcctaagctgctaaccttgctatcttagctacttctactagtctagtgcgtattttgtgtcctgtacatgcttagttcgtcccccgccccgacctaacgtgcgagtgccggactgctgcggaaggaaggaagggagggaggaggccgggcatcagggacaaggaagactagctcgacattaatttcgttccggtaaggggaatccggaatcgttcggcatggataatcagcgagccacctcaacctcaaagggaatcggctgctagctaggagctagcgaggaggagggttatcggctcctccggcaatcctgaggccggctagctgagggcgaggcagcgtcacgcccgtccgtatgcatggagagccagagggtggtggtggtggtggaggacgcgggcgccgcgcggtcggcgctgcagtgggccgtcggcaacttcatccgcggcagcgactccatcacgctgctccacgtctgcccgccggcgcggtcgcgcaggaagcgccgccgcctccgcctcggcggcttccagctcgcgctcgccttcaaggacctctgcaacggcatcgccgaggccaaggtggagatcgtggtgacggagggggagctcggggagacggtggtggcgacggtgaaccagctcggcgcctccacgctcgtcgtcggcctccacgacaagagcttcctctacagcagggcgccgagccagtacagccgagtcatcaggagcctgggctgcagggtcctcgccgtccggcagcacgccacggcgcgggacggcttcctgaacgccgagctcacccagatcgagaccgtgaacctgcacataccaccgccaaagatctcgttcccgatgttcacgctcccccttggcgtgatatggagaagatcgaagcggagaaagtgatactcaaactgcggggaagacggaggaacagcagaacaggaacagcacggcaggcatagctgagcctgtcctgatggctagtagatatatacacgtacacgcacgcgtgcacatcaacggaggcgcagcaaatctgcggattgacgtaactgtaatgacgacagcggcaggcacagaatgttagagaggaagggtatactccagctccgggaaagacggccccgtacttgtattattagatgattaatcgacaggttggtttactggaaactagaggagccattctgttttctgaagaaaaagaagaatggagcaaggttagaggactgccggttctgatgttaagtctgtaacctctcacgacctgatgctctgttatccttaaaattgatctaagttagaaaacttcaaaactaaagaggttttggtttct

SEQ ID NO: 14821 - DNA, 983 bp, Zea mays
  misc_feature (78)..(78): n is a, c, g, or t
ctgtcactgaacgccaacatcgcgaacagatcggtgctgccaccgttcatgttgcccaaaaccctcgccagcacggancttcggcggtggaggtggaggagctagcctcgctgcgctggcacaagcagttggagtagggagtagtgcggctggtgctggcttctcagcacctgccgccgccgcgcttcgtcccggaaattgaccttggctttcttcccgcgtatcctgcgagcctcggcgtcgtacgccctggccgcctcctcggcggtgctgtatgtgccgagccagacgcggacgcccttgctggggtctctgatctcggccgcccacttgccccagggccgccgccggattcccctgtactggttcttccgcctgcgcttatttgctgctgagttgttagcggtagtaggcatgtctccttcaccatcctttggagtcatcacgccgtcaactgcagtgcgcggcgccccaaccgcggcggcgaaggcaagcctcgccggctccggcagagcaagctcctggacctcgtcgccggccccgtctacgtcatcctctccgaggccgcgctcgaactcgcggaagtcggcctcgaagtcctcctcccggggcgctcccttcttgccgggccccggccacagcaggtccgccgtcgcacgccgctgctgtttcttcttggccgccgctgccgccgccggcaccccggacggcgggatgagacccgagaggatggcgccgccgcacatcgccgcagcggggtgctggtggcggatggattgttggttgggtcgggtgaaccgagggtggatggcacgagcggcacagtgagtgacgcgagctggggaaaggaggccgcgcgagatctttgcggttgcggctcggctttggctgccccactggctctggctctcggtgagcgagggagggaaggagtgggccggagcccggaggaggcgaggttgggtctttcccggccggcccaa

SEQ ID NO: 14822 - DNA, 1865 bp, Zea mays
agtaaccactatggcactatccactaaccagacacagcgtccagccaggcttttgcctacaaaacaacgcaccacgccgccgccgctcgccgcccacttctctcccacctcccctccactcttttgcctgtcgcggggttagaatcccatggcgctgtcgtccgagatccgcttcggccaccagatccccctatcccactgcgacactgactcctacgaggaggaggaagaagaggaggaggaagacgaggaggagttcgagggggaggaggaggaggagatggatgaggtgacggtttcgtctccgctgctgcttccggcaacggaggccaggggaggggtgtccgtggtcgagatggtggcgggggcgctccggaggtcgctcatgctgtgcagcagcagcgccggcgccggcgtgcgcgagccggagcaggaggaggacggggcgactcccccgggtggtatgcagataggggggccaacggatgtgcggcacgtctcgcacgtcaccttcgaccgcttcgttggcttcctcggcctccccgctgacctcgagcccgacgtgcctcgccccgtgccgagcgccagtgtgagcgtatttggagtttcacccacttccatgcagtgctcgtatgatagaagaggaaacagtgtgccaactatactcttgactatgcaaaagaagttatattcacttgggggtcttcaggctgaagggatattcaggataaatgcagacaatagccaggaactatatgtgagggatcaactaaacagggggattgttccagatggtgttgatttgcactgccttgccggactgatgaaggcatggttccgggaacttccaagtggagtactggactcgttgactccagaacaagtgatgcactgcaacactgaagaagagtgtagccatcttgcaagcaccctacctcctgtcgaagcagcattgcttgaatgggccatcagtctcatggcagatgtcgtggaaaacgaaagctacaacaagatgaacgctcgcaacatcgctatggttttcgcaccgaatatgaccaagatggcggaccccttgactgctttgatacatgccgttcaagtgatgaatttcctcaagacattgatcttgagaactgtaaaagaaagggaggaggctgctaaagtagccagggcgttcccatcgagctctggttccccgagcgacaaagatgagcctcaaactgtagaacagttggacatgctcttcgtctgttcaagtcagcaaaatgtagagtatcctatggttgatgaggctaagtttgaccagttcctttttagagtggaagaagctcttcaccatgagacgcaaggcagcacagatggacccaagaatcatgacagcggtagaggtgaccagagaagtaacagtgagatcactccattggacaccggtttgaccggccaaaatgagttcagtaacaacagcgaggaaggtctctttgacaagtttaaatttaggaaaggggtagggaggctctgcaggcaccctgtgtttcagctgagtaggtccatgaagaagtcagatgaagcggagcaagcatgtgtatagggcatgcctgtgcagtggataatattgacacacctgtatttctctgcagcttgtttactgtgtaggtcttcggctattctcctagattgtgtgcctagaaggcattggccccgttattagtactgatttgggtgtatatgtgactatgtcagctgttcacttattgctgtcctaattgttaagaagctatcatgccctagtgatttttcttagtttgtcagatagaatctcgtgtgtgattttcatttggagggtgactccgaattgctttgtgctt

SEQ ID NO: 14823 - DNA, 1459 bp, Zea mays
  misc_feature (23)..(23): n is a, c, g, or t
  misc_feature (34)..(34): n is a, c, g, or t
  misc_feature (36)..(36): n is a, c, g, or t
  misc_feature (51)..(51): n is a, c, g, or t
  misc_feature (129)..(129): n is a, c, g, or t
  misc_feature (163)..(163): n is a, c, g, or t
  misc_feature (256)..(256): n is a, c, g, or t
  misc_feature (288)..(288): n is a, c, g, or t
  misc_feature (424)..(424): n is a, c, g, or t
  misc_feature (455)..(455): n is a, c, g, or t
  misc_feature (491)..(491): n is a, c, g, or t
  misc_feature (598)..(598): n is a, c, g, or t
ccatacataaccactaaaccacngcgacaaaatntngcgcataccactggntggttctcctgcatcatcacaaaaagcaggagacctggcataataaaaaaaatcaaaagcaaaacgaggctgagaaanactcaattcacggaacagcaagtaaccgtctagnacatgcgaatgaacatagcttttctcagtaagcgccggcggccatgagcagctcgtcaaggctccagatatcgccggcgccaccaccaccacngctcgccccatcctgtggaacatcgccagccngcatcatttgaaggcagtccatgtcgtccgtcgacgcgccgtctgacgggctgctctcgacgacataaggcaacggctggtactggtagttcgtctcagggtcaaagccgcccggcatggccgcaccgtagccgtngctgctcctcgttctcttcgacaccggtccnccttgcgtgtaccatgctggcacaacgttactgggngcagctggagcaaagactgaggcgtagtctgaggtcatggtgtcatcgtcccagtccaactcccaccccaagtaacaagagccatacgagtcgctgctctggtcggngagcacggaacttcggcggtggaggacgaggagctagcctcgctgcgctggcacaagcagttggagtagttgcggttgcggctggtggcttctgagcacctgctgccgccgcttcgtcccggaaattgaccttggctttcttcccgcgtatcctgcgagcctcggcgtcgtacgccctggccgcctcctcggcggtgctgtatgtgccgagccagacgcggacgcccttgctggggtctctgatctcggccgcccacttgccccagggccgccgccggattcccctgtactggttcttccgcctgcgcttatttgctgctgagttgttagcggtagtaggcatgtctccttcagcatcctttggagtcatcacgccgtcaactgcagtgcgcggcgccccaaccgccgcggcgaaggcaagcctcgccggctccggcagaggaagctcctggacctcgccgccggccccgtcgtccacgtcgtcctcttcgaggcctcgctcgaactcgcggaagtcggcctcgaagtcctcctcccggggcgctcccttcttgccgggccccggccacagcaggtccgccgtcgcacgccgctgctgtttcttcttggccgccgccggcaccccggacggcgggatgaaacccgagaggatggcgccgccgcacatcgccgcagcggggtgtggtggcggatggattgttggttgggtgaaccgagggtggatggcacgagcggcacagtgacgagctggggaaaggaggccgcgcaagatctttgcggttgcggctcggctttggctgccccactgggtgagcgagggagggagggaaggagtggggggaggcgaggttcccgctttcc

SEQ ID NO: 14824 - DNA, 1782 bp, Zea mays
  misc_feature (1702)..(1702): n is a, c, g, or t
  misc_feature (1714)..(1714): n is a, c, g, or t
ggcctctttttgtcgctccttcttactatataaacattgtcttacagttccactggcaacaaaagcatagtaccccattctgtatgtaataatctaccatacataaccactaaaccaccgcgacaaaatgtagcgcatacgactggcttggctctcctgcatcatcaccacaagcaggagacctggcataaaaaaaaattaaaagcaaaacgaagctgagaaacactccattcacggcagaacaagtaaccgtgtagcacatgcgaatgcgatgcacatagcttttctcagtaagcgccagcggccatgagcagctcgtcaaggctccagatatcgccgccgtcgccgccaccaccaccactgctcgccccatcctgtggaacatcaccagcccgcatcatttgaaggcagtccatgtcgtccgtcgacgcgccgtctgacgggctgctctcgacgacataaggcaacggctggtactggtagttcgtctcagggtcaaagccgcccggcatggccgcaccgtagccgtagctgctcctcgttctcttcgacaccggtccaccttgcgtgtaccatgctggcacaacgttactgggagcagctggagcaaagactgaggcgtagtctgagtgctcatcggtgtcatcgtcccagtcccactcccaccccaagtcacaagagccatacgagtcgctgctctggtcggagagcagcagcatgttagccgcagacctcttactgccgggcaacagaggctcgtcgaccaacacttcttccactgcggggaggaaaccggcggcgccctcacctggctccacacgaacgaccttcaccttactgtcactgaacgccagcatcgcgaacagatcgttgctgccaccgtccatgttccccaaaacctcgtcagcacggaacttcggcggtggaggtggaggagctagcctcgctgcgctggcacaagcagttggagtagttgcggctggtggcttctgagcacctgccgccgccgcttcgtcccggaaattgaccttggctttcttcccgcgtatcctgcgagcctcggcgtcgtacgccctggccgcctcctcggcggtgctgtatgtgccgagccagacgcggacgcccttgctggggtctctgatctcggccgcccacttgccccagggccgccgccggattcccctgtactggttcttccgcctgcgcttatttgctgctgagttgttagcggtagtaggcatgtctccttcaccatcctttggagtcatcacgccgtcaactgcagtgcgcggcgccccaaccgcggcggcgaaggcaagcctcgccggctccggcagagcaagctcctggacctcgtcgccggccccgtccacgtcatcctctccgaggccgcgctcgaactcgcggaagtcggcctcgaagtcctcctcccgggacgctcccttcttgccgggccccggccacagcaggtccgccgtcgcacgccgctgctgtttctttttggccgccgccgccggcaccccggacggcgggatgaaacccgagaggatggcgccgccgcacatccccccaccggggtgtggtggcggatggattgttggttgggtgacccgagggtggatggcacgagcggcacagtgagtgacgcgagctggggaaaggagcccgcgcaagatctttgcggttgcggctcggctttggntgcttcacgcgntcggccctccctcgcgagggagggaaggagagggccggagcccggaggaggcgaggttgggtcttccc

SEQ ID NO: 14825 - DNA, 1059 bp, Zea mays
  misc_feature (1024)..(1024): n is a, c, g, or t
cctggctccacacgaacgaccttactactactgtcactgaacgcgaacataatcgcgaacagatcgttgctgccagtgccaccgttcatgttcccgaaaacctcgtcagcacggaacttcggcggtggaggtggaggacctagcctcgctgcgttgccacaagcagttggagtaggtgcggtgcggctggtgccttctgagcacctgctgctgccgccgcttcgtcccggaaattgaccttggctttcttcccgcgtatcctgcgagcctcggcgtcgtacgccctggccgcctcctcggcggtgctgtatgtgccgagccagacgcgcacgcccttgctggggtctctgatctcggccgcccacttgccccagggccgccgccggattcccctgtactggttcttccgcctgcgcttatttgctgctgagttggtagcggtagtaggcatgtctccttcaccatcctttggagtcatcacgccgtcaactgcagtgcgcggcgccccaaccgcggcggcgaaggcgagcctcgccggctccggcagaggaagctcctggacctcgtcgccggccccgtccacgtcgtcatcctctccgaggccgcgctcgaactcgcggaagtcggcctcgaagtcctcctcccggggcgctcccttcttgccgggccccggccacagcaggtccgccgtcgcacgccgctgctgtttcttcttggccgccgctgccgccgccggcaccccggacggcgggatgaaacccgagaggatggcgccgccgcacatcgccgcagcggggtgtggtggcggatggattgttggttgggtgaaccgagggtggatggcacgagcggcacagtgacgagctggggaaaggaggccgcgcaagatctttgcggttgcggctcggctttggctgccccactgggtgagcgagggagggagggaaggagtggggggaggcgaggttcccggcccgcctggtggtacccaatgcttttttttttttttttttttttttttttngaaaaaacacccggccggcctcgaggtacccaatg

SEQ ID NO: 14826 - DNA, 6901 bp, Zea mays
  misc_feature (4474)..(4474): n is a, c, g, or t
ggaagggggcccggaagcgttcaccgtggggttcagtcttaccataagatgcgatggtgcgtgagccacgaggtgaacgaccttagaactagcccatgctttaatccgtatcaacttctgttgtttttataatgtttatttgtctctatagattatagtttaaatagttaattttaattcagtgccggctccacgacacatgaatcgtagcgtcgtagggcaataagagccgtttgtaggacgctagaactgtagaagatagtaagctaaaaaaaaactaatgatttggagaaatctaaccatctgtgtttctttatatatagccaaatcttctagtgcctttacaagtctgtttagaaagatgatttttggacctgcaatgttactatatatatacaatataaacctttctagacaaatctttctgttccaagtacgcagttaactaaaatttctctcttctggttcactcgtttcctaggcacccaacactggcccagctgctggaagcaacaagcaaggcagccgcctcttttcaacgtcaccagcatcattaaagattataagatatcataatcccagtgctgactgactggccctctcttttagacctgtttagatttattattatcggctaataattaactagctaataactcatatttaatgatatagttagctaactattaactgaagtgtgtttagaactgataacagatgctactaggataactattagctactataatcggatttttttaactagtgagatagttattacctagaggttcagttaacaattacctatttttattacttgtacatgttgagataacaaaggtaattattaacaattagttattttattagctatatattttagatctaaaagcgataactactagcatattactattatatataggcatctgaacagggtcttaatccatctattttatttgaggctaggatgcagtcaaaagcaccatccggacggaaacaagcaagcggctgatccaacgaccagccgcaaggaatgaactggttgcctttgcctgttgtataaactagcagtaaccactatggcactatccattaaccagacacagcgtccagccaggcttttgcctacaaaacaacgcaccacgccgccgccgctcgccgcccacttctctcccaccttccctccactcttttgcctgtcgcggggttagaatcccatggcgctgtcgtccgagatccgcttcggccaccagatccccctatcccactgcgacactgactcctacgaggaggaggaagaggaggaaggagaggaagaggaagacgaggaggaggagttcgagggggaggaggaggaggaggagatggatgaggtgacggtttcgtctccgctgatgcttccggcaacggaggccaggggaggggtgtccgtggtcgagatggtgacgggggcgctccggaggtcgctcatgctgtgcagcagcagcgccggcgccggcgtgcgcgagccggagcaggaggaggacggggcgactcccccgggtggtatgcagatagggggaccaacggatgtgcggcacgtctcgcacgtcaccttcgaccgcttcgttggcttcctcggcctccccgctgacctcgagcccgacgtgcctcgccccgtgccgagcgccagggcgggcgtccttcgccttttactccccatttgtttgatctgtctatgcgcatcgtttcctgcccgggattcccaggcaattttgtgggtgaactctgcgactgggatccgcccctagaaatttggaatttggtgtctggttgaactgaattttgcgttgttctgacgttaaagttaagttgtccaacagcgctgcctatacatgtcactctacgttaagctcacttgggtgaatcaggagttctggacatgttagatacgtatatgaatctggagttctcgacatagatacgtatgttaggtaggtgttgggctggtgagcggcacgccactgtattgcctgccgtgcctccgacaagccgagctagcagctcgtagtctgccacggcgaggtcggcgtgccctgtctggcccgatcaaaatactgccgtgcctgaccctgcccgtgtaggcacggggcgcctattcgccacctaactgaacaaagatgccacagtacgatagatgtttagctttcgggattacataggatgagccgatgatgctgttgctttgtgatcgtgacctcatttacaggacaactgctgtttccaaggctgacatgaccaagttcaactactggggaatattctaaagtgcttttcctgtgggaaattggtctgtttgtacttgcgatggagtgggatattgtgttgctccgtcctttttagttttctatattcatttcctggcagggaaaggtacttgagtttattagcggttttgtttagttagtgtttatctgttgcagtgtcctggtatccatagcctttgagttgcacttgtgtttacgacaaatagttgtttgtttttcctcgacgcacgttgaatcctgaacgtccatatttcctgaagcctagctgtatttaggtttactgaatggtttatttctgcatacagtgtgagcgtatttggagtttcaccaacttccatgcagtgctcgtatgatagaagaggaaacagtgtgccaactatactcttgactatgcaaaagaagttatattcacttgggggtcttcaggtaacagatcccaaaattctgaaatcagagtggcagcattggtactggttgttctgattttttttcttgttctaacaggctgaagggatattcaggataaatgcagacaatagccaggaactatatgtgagggatcaactaaacagggggattgttccagatggtgttgatttgcactgccttgccggactgatgaaggtttgttcgagtgtttacctttgaattttttttcttccttttgcatcgcctttgttttattaacgtaacaaacttttgcatatacgcattagcagtgtcattgtctaaaatttaaagattccttaagtctttaaatatgttcattgagacacacccaataatcagtacaccgatcagtacgaagcacaaactatagctcggcagattaagattccttttcatttagcttctcgtctacattagtcatcattaatgtatgtgttgctgattataggcatggttccgggaacttccaagtggagtactggactcgttgactccagaacaagtgatgcactgcaacactgaagaagagtgtagccatcttgcaagcaccctacctcctgtcgaagcagcattgcttgaatgggccatcagtctcatggcagatgtcgtggaaaacgaaagctacaacaagatgaacgctcgcaacatcgctatggttttcgcaccgaatatgaccaaggttactgacaagcatatttgtttctctcagcgtaccttttttctctctcttcaaaatccgtagtctaaccacggagcattcatccctttcagatggcggaccccttgactgctttgatacatgccgttcaagtgatgaatttcctcaagacattgatcttgagaactgtaaaagaaagggaggaggctgctaaagtagccagggcgttcccatcgagctctggttccccgagcgacaaagatgagcctcaaactgtagaacagttggacatgctcttcgtctgttcaagtcagcaaaatgtagagtatcctatggttgatgaggctaagtttgaccagttcctttttagagtggaagaagctcttcaccatgagacgcaaggcagcacagatggacccaagaatcatgacagcggtagaggtgaccagagaagtaacagtgagatcactccattggacaccggtttgaccggccaaaatgagttcagtaacaacagcgaggaaggtctctttgacaagtttaaatttaggaaaggggtagggaggctctgcaggcaccctgtgtttcagctgagtaggtccatgaagaagtcagatgaagcggagcaagcatgtgtatagggcatgcctgtgcagtggataatattgacacacctgtatttctctgcagcttgtttactgtgtaggtcttcggctattctcctagattgtgtgcctagaaggcattggccccagttattagtactgatttgggtgtatatgtgactatgtcagctgttcacttattgctgtcctaattgttaagaagctatcatgcactaaagatttttcttagtttgtcagatagaatctcgtgtgtgattttcatttggagggtgactccgaattgctttgtgcttaatctacccttagactatctctatcaacttactcatctacgttcttatatttaaacttcactatacaagaatgtattcaaagctcactatacaaacaatataatctaccatgcaaaatatatgagttaatgggtaagntgttggaggcgggtcttagtagtggaaaagttttcgacatttagatgtcatttggttttacatattttataacgtaatggataattgataatgttaaattatatttgtttaagtctaactataatcagataccactaaagatggccaaacgggccgcgctggtccggcccggtgaagcccggctcgttttgggctcggcccaccaggcacggttagaaaatcgtatcggaccgtctaagcccgcgggctcgattttctgtctgagcccggcccgttgagcacgaaaaaacgggttaagcgggccggtaagcacgttttagtgcaaaaaatgggtttaacgggctttgaggtaaacgggccgtgccgactagctcatcgtacctagttttctgtccgagcctggcccgcttattcgtgccgggccggcccgggccgtaccggactcgcaggcctcgtgcttattggtcatctatagataccacactgtgaattggtatcgatctattcaaacctattgccgttggtacttaaaatcgaatcattatcattattattatatttcgtgaataaacaacaacttagcttgtgattgtctacacaccctttgaacagcaaggacaaggagtaagcaccgcagggccagaaaggcaagcaactctgccgcagttcttgatcctacgactacgagagcaactctagactcattgggaagtacatgaaccgaatccatccacttaatcttgaaaatgttgtcattgtcctgggacctttctcgctggcgttttcctatccatccccatcaagccggcgtcgacgtcaagttgaaagaagcatggagacgcaaacgttttatcccgtcaaagtagatagatacgtacgtgtgctttgacttgagccggtccgctgccacagttccctatcagatgcagccggatcaaatgcagcgtggtggggtttcagaatgtaaggcgctacgaatttctagccctttcgccagcggaatgaatattccggtattggttcaagtgcagcatggtagggtttcatgaaagcgatgctgtggatggtgcccgcggggctcgtctcgtcctcctcggtcggcaccccgctcgtcgcgtggctctccgtcctcgcctagggggctaggagcgtgtcgcagcttttctatttctcaatcatccgtcctcggcacgcgcatgttcttggtcctgggcttaattatgtatgggctagccaaggcctcatgctgtgagagatgcttctcaaccctagggcccagttgggtgcagtgctgggccttttttaggcttgggcccaaagactcagcggcggcggcactgcaaagcgcctggccgcctgggacttctttttttccatttcttcccgtctctcgcggtgtgtacggatccgcagaggtcatgttgaggcgagctctcacgatcaatacagtctttcaggggcagaaaccagctgtcctgtataattgcccgcccagaagcaagggccacagggacgggacggggaaggcttcgtccctgtccctgtccaccaaagcattgcatttgcatgttcctgtcctgcctcctggtcatcctgacctgaggggaccttggttggtggtcgaatggagaacggagcgtatggctccagaatgcgtacttttcaccgcttttcgtttttcttacagtccctgactgacatctaacggatcggtcccatcccccgctagagctggtgattatgcagttgatgagtacgatgagtatgcagcgacacatgcacgcgttgacataggtaaaaagcaacggtacacaacacagtaatgctagtatacctaaaaaccaacaaaaccgagaactatcacgtatccgcatcgcaaaccatctgatgtggccaggcatgtgctttttttgtgcggacgtgattcagacctctccccggtagcgacaacattagacctggcatttttttccagctaacttcgtgtcatgttgcagtggcgaagctagagcaaaattgagagtgatgcatttgccttgtggatgcataagaatttattttaaccaattctataaattttatgtttttggggtgcatttgcatccgctacctatagtgtagcttcgcctaggggtgggcattcgggttacccgaaaaattcgggtcgggtaattcaggtttttttaatttcgggttttaaaaactgctacccgaagtatacccgaaataaacgggtacccgaaaattcgggtatctaaaaaaatcgggttcgggtaatcccgatttacccgattactacactaggtagaaaaatacccatctatactgtatggctcctgtatataatattacatccacaaatgaatattcaagtaggagaggcacacgtaaacaccgacacatgcaatgacgaaattaagccgccct

SEQ ID NO: 14827 - DNA, 903 bp, Zea mays
acgatcctttccccaattaccgactttgattatactgtgcgatttttcgagttccgtctcctcggagatggctccattgctaccgcccggcggcggcggaatccactcgatcgcagttgatccagtacacaattgcagagagctagaagacacaagaacatggcgtccaagcgactcctcgtgctagtagctctcctgctcgccgccgttttccttgccgtctcaggagcagctaacgacgaccaagcccaaccgaggaaggacggcggcgagaacaaagccgacgtgcaggactaccgtggcggcggcggcggctggcgcggtgggggtggctaccccggcgggggcggctaccccggccgtggctaccccggcgggggcggctaccctggcggcggccgcggcggttactgcaggtgggggtgctgcaaccgcgggtactatggcggctgccggtgctgctcgcgcgccgacgaggtcccggagcccatgtaccgcccggagcccaccgaggtccacaactgaagccgagccacacatcgatctacaaagatgcatggacgacgactcttatcgtagctaattaataagcactacatccatgtccacaatagggccctagccctactatacgtcgtcagcagaaagtctggtttttatttgaataataagatgcacctatatgtgcgtgttatatgtacgctgttgtcttaattactgtgtggtgattggactcactagtagctattgtcgtcgtgttgtcgtctctcggtgagtcggtgtagcgtagtacttgctcttggaccaaatgctgcgtttaatctgtaaaactaccttataaaaaaaagaaattatactaaacaaaaaaaaaaaagaaaaaaaaaaaaaaaggcccccctaggg

SEQ ID NO: 14828 - DNA, 843 bp, Zea mays
gccggccgtttcgaatcactctcgatcgcagttgatccagtacacaattgcagagagctagaagacacaagaccatggcgtccaagcgactcctcgtgctagctctcctgctcgccgccgttttccttgccgtctcaggagcagctaacgacgaccaagcccaaccgaggaaggacggcggcgagaacaaagccgacgtgcaggactaccgtggcggcggcggcggctggcgcggtgggggtggctaccccggccgtggctacccgggcgggggcggctaccctggcggcggccgcggcggttactgcaggtgggggtgctgcaaccgcgggtactatggcggctgccggtgctgctcgcgcgccgacgaggtcccggagcccatgtaccgcccggagcccaccgaggtccacaactgaagccgagccacacatcgatctacaaagatgcatggacgacgactcttatcttagctaattaataagcactacatccatgcatgtccacaatagggccctagccctactatactatacgtcgtcagcagaaagtctggttttgatttcaataataagatgcacctatatgtgtgtgttacatgtacgccgttgtcttaattactgtgtggtgattggactcactagtagctattgtcgtcgtgttgtcgtctctcggtgagtcggtgtagcgtagtacttgctcttggaccaaatgctgcgtttaatctgtaaaactaccaaattatactagacacgtgttgcgtttaaaaaaaaaaaaaaaaaaaaagaaaagaaaacgcgaagaaaaacagaaataccaaagggggcgccccccttttttttt

SEQ ID NO: 14829 - DNA, 839 bp, Zea mays
  misc_feature (831)..(831): n is a, c, g, or t
gccggccggcccggcaacgattctcatcacactcgatcgcagtttgcagaaagctagaagacacaagaacatggcgtccaagcgactcctcgtgctagtagctctcctgctcgccgccgttttccttgccgtctcagcagcagctaacgacgaccaagcccaaccgaggaaggacgacggcggcgagaacaaagccgacgtgcaggactaccgtggcggcggcggcggctggcgcggtgggggtggctaccccggccgtggctacccgggcgggggcggctaccctggcggcggccgcggcggttactgcaggtgggggtgctgcaaccgcgggtactatggcggctgccggtgctgctcgcgcgccgacgaggtcccggagcccatgtaccgcccggagcccaccgaggtccacaactgaagccaagccacacatcgatctacaaagatgcatggacgacgactcttatcgtagctaattaataagcactgcatccatgtccacaatagctagggccctagccctactatacgtcgtcagcagaaagtctggttttgatttcaataataagatgcacctatatgtgtgtgttatatgtacgccgttgtcttaattactgtgtggtgattggactcactagtagctattgtcgtcgtgttgtcgtctctcggtgagtcgtacttgctcttggaccaaatgctgcgtttaatctgtaaaactaccaaattatactagacacgtgttgcgtttaaaaaaaaaaaaaagggcggcccgctcgcgatctagaaccccggtttccactaatgttgaacaggtaaagtaaataatcntaattgct

SEQ ID NO: 14830 - DNA, 504 bp, Zea mays
ctcgcacccataatttcggcactccccttcccggagccagctcttccgatggcgtgcagcggcctccgcctctcgctccccgccgccgtcctcgccctcctcctcctcccctccgcgctcgcttccgagcccctcaaccccgaagtgcaggcgttgatcgccatcaggcaggggctggtcgacccgcacggcgtgcttcaggagctgggaccaggactcggtcgacccctgcagctgggccatgatcacctgctccccgcagaacctcgtcatcggcctgggagtgccgagccagggcttgtcggggactctgtccgggaggatcgccaacctcacccacctcgagcaagtgctgctgcagaacaacaacatcaccaccctccgatacctgaggctgaacaacaacagcttgtccgggccgttccccgcgtcgctggccaagatcccgcagctctccttcctggacctgtccttcaacaacctcactggccccgtcccgctctt

SEQ ID NO: 14831 - DNA, 3318 bp, Zea mays
attactattgttagaatgaaattcaatttcgttgatccaaacggggcgttactagaatggaattcaattccaatgatccaaacggggcgttaacgattttgggtctccaaggaatttccgacatgctgtagcacaatataactccatgaagcgggtttattattataaaccagaaccttatgtcagagaacacgattaagttgatgaggcacaacatagccataatcaccaccagagccgctgccgccgccgccatatattgtcttcttagcaacaagacgatatatgttgacaagagaagagaaccatgcattattgtaaatttttggtcgaaaatttaagtgcgtgcaaagttttttttttagagtcaaaggagagaaaaaagtgaactccatgggcgtgaatctggtacatacagatgggtcatgctttagcggtgggacgatgagacagttgagtgcaattgcgaattggcagaggtgggggcagcggacggacatgcagccatgggcacgcacagcccgcaagcactacgaccgaaccatccatctctctagaacacccggacaagaagaggacagccacagacacggctgcagtgcacgcggcgcgtccccgtcccgccctcagctcccgccacgtcgtcggcctcctcccccgtttgactgcaccacccactcccccaccccagcgcctcctataaatcccgccccgaacccgaatccaccacaccgaaaacccaaccccagctcgctcttctctccctcgctccaagtctcaccatccacacaggccagcgcgcaaacgccacaaagctagcctttctgctcccgctcgatcagctggctccgttgatcaccgggccgggccacaacccccagctcgctgactgattagtttccgctgcaatggcgtcctccatctccgctccagctccaccggcggctccggccaccgcgccggcttcgggcagacccaagaagccgtcccagttcaaccccagcaccggcaagaccaggaccccggtccccgcgcggccaatgcgcgccgccgctcccaagtggaacccgctccagcggctcgccgcggcggcgctcgacgcgctggaggaggggctcgtcgcgggcgtcctcgagcgcgcgcacccgctgccacggaccgccgacccggccgtccagatcgccggcaactacgcgcccgtcggggagcgcccgcccaccggcgagctgcccgtgtccggccgcgtcccggcgtgcctcgacggcgtgtacgtccgcaacggcgccaacccgctccacgcgccgcgcgcggggcaccacctcttcgacggcgacggcatgctgcacgccgtgcggctccgcgggggccgcgccgagtcgtacgcgtgccggttcacggagacggcgcggctcaggcaggagcgcgccatcggcagggccgtgttccccaaggccatcggcgagctgcacggccactcgggcgtggcgcgcctgctcctcttcggcgcccgctccctctgcggcgtgctcgacgcgtcccaggggatcggggtcgccaacgccggcctggtgtaccacaacaaccgcctcctcgccatgtcggaggacgacctcccctaccacgtgcgcgtcaccgccgacggcgacctcgagaccgccgggcgctacgacttcggcggccagctcgacaccgccatgatcgcgcaccccaagctggacccggccaccggcgagctcttcgcgctcagctacaatgtcgtgtccaagccgttcctcaagtacttctacttcaccgccgacggccgcaagtcccccgacgtcgagatccccgtggacgcgcccaccatgatgcacgacttcgccgtcaccgagaaccacgccatcatcccggaccagcagatcgtgttcaagctccaggagatggtgctgggcggctcccccgtggtgtacgacaggaacaagaccgcgcggttcggggtgctgccgaagcgcgccaccgacgcgtcgcggctgcggtgggtggacgtccccgactgcttctgcttccacctctggaacgcgtgggaggacgaggccacgggcgaggtcgtggtgatcgggtcctgcatgacccccgcggacgccgtgttcaacgagtccgccgccggcgaggagagcttccgcagcgtgctgtcggagatccggctggacccgcgcaccggcacgtcctcgcggcgcgcggtcctgagcgacgccgaccaggtgaacctggaggccggcatggtgaaccggcagctgctgggcaggaggacgcgctacgcctacctcgccatcgccgagccgtggcccaaggtgtcgggcttcgccaaggtggacctcgaggccggcaccgtcgacaagttcatctacggcgacggccggtacggcggcgagccctgcttcgtgccgcgccccgacgcccccgcgggcgccgcggaggacgacggctacgtgctgtgctacgtgcacgacgaggcccgcggtgcgtcggaaatgctcgtcgtcaacgcccgcgacatgcgggccgaggccgccgtcaagctgccgggccgcgtcccgtacgggttgcacggcacgttcatcgccggcaaggagctgcagcggcaggcctaggggtgccgttgccgtgtggtgctgcggctacctcgtcgatcacgaactcgaccaactcacgtacatacactgatatacacagacaatacagtagctagctagatagtgacgtggcaactcgattatttaccgtgtacgtagtacagtaatttgttcattattagagcagtagagggccgtgtgggactgatttttggggcagacgccggccctacatcttcatgtatatatacaaaaacatataggaatcaaaattgttgaattttaatttttgtgcagaaataaaaaaggggattttttgttatacataactacatatttttatttctgtatgtatatgtataccggtatacgaacgtatatgtatcccacgtgtgtatttgcatgcactatacatgtagtctaccaaacaatttgcatcagactagtatttcttttttttttttttttggctgagtttggcttgtgtcggccggctagcttgtcggaaagaaatacagtgcagtgtgaaccggcgagtgttgacaaaggggtgcagcaggtgcatcgtgcgtgttggtttggttgttacgggatgctctgtcaagggcatagctagaggacggacctaccttaacagagagtcaaagtcgtcttaacacaaagtgataaaagcgtcaactttaaagataaagttgattaattaatc

SEQ ID NO: 14832 - DNA, 1306 bp, Zea mays
gggtaccccctcgaggggccggccccgggtcgtaccaacccccagccccaccgcaatagaggttactgctctcctgggctgtgaggctgtgaggctgtgaccaaacgctctacgctcccacttcccaccaactcccaaatcctccctgaaaataagaatacgagggtgagcgatcgagcggtcgagggggttgtgcttgtgcgtcagatcaaccgactggtggcgaggctgcgggaggagatggccggcgaagggaatggggatgaagggtggaggcggagcggcatcgaggtcagcgccctgcagttcggctacgacgggcagccgccgctcttcgcgcgcttcaacctctgcgtcgcacccggctcccgctgcctcctcgtcggcgccaacggatcaggcaagaccacactcttgaagattcttgcgggaaagcatatggttggaggaagagatgtggtccgtgtcctcaatggttccgcttttcatgatacacagctagtgtgcaatggtgacctttcgtacttgggtggttcttggagccgtactattggttcagctggggatgttccactgcaaggcgacttctctgctgagcacatgatttttggagttgatggggttgatcctgtcaggcgagagaagctggttgatctgctagacattgatctgcagtggcgcatgcataaagtttcagatgggcagcgccgcagggtgcaaatctgcatgggtcttcttcatccatacaaggtgcttttgctcgatgagatcacggttgatctggacgtggtgaccaggatggacctgcttggtttcttcaaggaagagtgcgagcagagggaagctaccatcgtgtacgccacccatatatttgacggactcgagacgtgggctaccgactttgcgtacatccaagaaggcgagctgagaaggtccgggagatactccgacatcgaggagctaaggagcgccaagaacttgctgtcggtagtcgagtcgtggctgaggtcagagaccaaactcccgaagaaggaacccccaccacgtcctgagacccaggccaggcgttcctcgccgttcgatgcttctcctttccgttcgtcacgccacatggcctactaccgttgatggtttcccaactcgtactacaccattgcctcttgttattttgttgtcactcatatcgtatagtagctgtggagtttaatatgtgtcctcttcacggcccttgtagacatcaatcaatatatagcaggcagcacagaaataaaagtttggttcggttggtctaaaaaaaaaaaaaaaa

SEQ ID NO: 14833 - DNA, 1891 bp, Zea mays
aattacatctattaaaagttggccgtatacaatttcttttatttgcagggtaaggtaaatgtgaacacacagttaccagagctctgtacattgacagatcatgatgttcatcgtttcttacttagtggaatttctccatgaatcactgacaaacaattttctcagggggatgttccactgcaaggcgacttctctgctgagcacatgatttttggaggtattctatcactctaatgcttatgattttggcatatcccatacttgggggttcttattgacagaagatatcatgaatctaacacaatgtttccaagtcgagtcgagttgtgcagctactggctggtacactagttgtgactaggacagactagtcgtgactagtcgaatataagtcgatgaatatagttttatcatctgattgtcccacctattatcaacaatagaaattacttcatccattaatcactctttatgttccgaagcttccttgatgctcttttttgcatggtccatggcagcccacatttcagccattgctggtctctaccatttcagcctaacaagatctctaccatttgtcttggtcctcatcaagtcttaaattcttccatgtccatagataaatctagttatcttctttgctttagcaatgcagccactaaactcttttatcttcccaataacctacatcatgagatccttgtggatagcacacggtgtccaaaataaggtaggaaacttgtccattagcatcctacctactagggttgagatggttgtgtgggctcacatttttatacctaggcccaaataagtcacccgactcaaatgctatgactagtcgatgagtcgaacgactagctgagaaagtcgagtcaccgtcgagtcgctctggtcgactatcacctctacaccgacttctcgactagtcgctcgactttaaaacctaacatactcctatatttgtcctttaacaatcagctctttagagattactttttccctggtcgcattagtttttgcttaaacaaatcctgctttcacacgttgctgtcggtttttcctagtttaatcatgcctttagttagaagattggcactaaggccatcatttctgctggtagaaaacctactggcttatcacttgtttcgttctgtaccctgaaatatgagcagttgatggggttgatcctgtcaggcgagagaagctggttgatctgctagacattgatctgcagtggcgcatgcataaagtttcagatgggcagcgccgcagggtgcaaatctgcatgggtcttcttcatccatacaaggtgcttttgctcgatgagatcacggttgatctggacgtggtgaccaggatggacctgcttggtttcttcaaggaagagtgcgagcagagggaagctaccatcgtgtacgccacccatatatttgacggactcgagacgtgggctaccgactttgcgtacatccaagaaggcgagctgagaaggtccgggagatactccgacatcgaggagctaaggagcgccaagaacttgctgtcggtagtcgagtcgtggctgaggtcagagaccaaacttccgaagaaggaacccccaccacgtcctgagacccaggccaggcgttcctcgccgttcgatgcttctcctttccgttcgtcacgccacatggcctactaccgttgatggtttcccaactcgtactacaccattgcctcttgttctgcgctatatatatatatttttgttgtcgctcatatcgtatagtagctgtggagtttaatatgtgtcctcttcacggcccttgtagacatcaatcaatatatagcaggcagcacagaaataaaagtttggttcggttggtcttaaaaaaaaaaaaaagtggta

SEQ ID NO: 14834 - DNA, 598 bp, Zea mays
gcacgacgccgcggccgccccgcgaagagaggtgacgcggcgagcacacggccatagaggttactgctctcttgggctttcgggctgtgaggctgtgaccaaacgctctacgctcccacttcccaccaactcccaaatcctccctgaaaataagaatacgagggtgagcgatcgagcggtcgagggggttgtgcttgtgcgtcagatcaaccgactggtggcgaggctgcgggaggagatggccggcgaagggaatggggatgaagggtggaggcggagcggcatcgaggtcagcgccctgcagttcggctacgacgggcagccgccgctcttcgcgcgcttcaacctctgcgtcgcacccggctcccgctgcctcctcgtcggcgccaacggatcagaatttgtctacctccaaagttggtgtgtaacaggagggagttcattatccatttcagataagtcttatgtgatgtacagtcatacagatggcccctagtgcttcatgtagcgctttccaaccgagatgtggtttccagctttgctgagtaaattttatgtacaacggcttatgcacttacttatgccaatactcaggcaa

SEQ ID NO: 14835 - DNA, 6061 bp, Zea mays
  misc_feature (3878)..(3878): n is a, c, g, or t
attcagcgtggacgtgtcccttcgctcccttgtcacccgtcgtagcatcggcctagtcccaccgcccaccaccaaagcagacgagcgtccaccacaagttccacaacgcaacacctcgtgctgccgttgcacgccaggacagacgtcgccggctggaacccgacgctggtcgccggccaacagcggcataggagatgggggtagccgcccgaccctccccaactgatgcttgcacgcgtacgcgagcgtggccataagggaacgaaggaatccaggctcggtacggttatgtgcacgagaaccgtttcttgttgttgcagacttgcagtagcaccctcagtccgtcacgcgtgtacggatatgtttgttcctgacacacggcaatgagaagcaaaatgatcatccaaaccaactgtccctgcagttgctgcaggcgagacttgtccgttcaaatggagccgcgtcctgctccatattcgcaaagcaacgttgcttcagtctcagatcagctagtaatttcgagcaacagatccagcaaggactagcagaaagcagcctgtaaattctagccaccgggaaactgggcaaacgctgccaatcattgaagccatcactggatatgtgtgtccatctccatcatcacaaacaagagccacgcagtcggcacacacacagagacaagtcactgtctcgaagtgtcgggtttcgaactcgaacagggcaggtgctcgccgtccctcttttactagccttcggaaagcgcggcctgtgtctccggcctttgccgcttccacagggagtccggggccatgcagagctccgtaaagctcgcggtgcttgctctactgctagcggcagcagctcaccacggtctgctgccgctgccgacggcgcgatgctactggctcaacccggagatctacgacgccggcgggctgagccgccgcgcgttcccggacggcttcgtcttcgggacggccgcgtcggcgtaccaggtcgaggggatggccaagcacggcgggcggggccccagcatctgggacgccttcatagaggttcccggtaagtgaagccgggccgaccaggttcagcaacacaaccatggccgccgccttcttcttcttccgattcttggttgggatggtggcactgatgtttgaaattgtcttcttgttgatccggggaatgaaaaaaacaagggaccatccctaacaatgccaccgctgacgtgacggtcgacgagtatcatcggtacaaggtgtgttctctgaatgcattgggttcttcttgtttttgggtgctccttgttgtttcgtgacgcctgacggatgttcttcgaggaacaggaagatgtgaacataatgaagaacatgggctttgatgcgtaccgattttcgatctcttggtcgaggattttcccaggtaggtgtgctccattctgtagaattttcttgggtccaaggagtttctgaggtagagttctgtgtgtatatataatatacgcagatggaactggcaaggtaaaccaggaaggagtggattactacaacaggctcatagattacatgctccagcaaggtaagtttccaccatatggcagttaggcagttatttatgtatatagatatagatatattctttcaggaaacattcagattcccgggttaccctttatatatatgtatacatacaagtcaggtatcgcgcggtatgcaaatctctaccattatgacctcccattggcactccatgaacagtacctgggctggcttagcccaaagattgtgtaagaattgcaaactagacgacatctagaaaccaaatttcaaattgattcaaccatgtgtcagtcagtctgacccagctgcacgccgtgcccaatcgaagggaggcgtttgcagactacgccgagttctgcttccacgcgttcggagacagggtgaagaactggtttaccttcaacgagccgaggtgcgtcgctgctctgggctacgacaatggcttgcacgcaccgggaaggtgttccgggtgccccgccggaggcaactccaccacggagccgtaccttgtcgcacaccatctcatcctttctcatgcagctgctgtcaggcgataccgcgacaagtatcaggtaaaaataaaatgcagacctgctaactatatatttcaagcctccgaacccagaaccagaagtgtgaattgcacggtgcagatttagttcagtaattaaaatgtcagtgttcaggcatccagaaaatgatccgtattccttttccactaaacgaacagcttcaccagaaggggaagattggaattctcctggatttcgtgtggtacgaacctttcagcgacagcaatgcggaccaggctgcagccctgcgagccagggacttccacctaggctggtaaacgcctgaaagcacatgcacttgattatacaaggacccaattgtcattgctgatcttattagaggttctttgtatcagtgacattattagctatagtgtactaggcaactagacacaaactgatgatatcttatatttggggaaacaaaccaacacagctcgttgccaagaacaaactgatactgcaacatccttacaggttccttgaccccattgtacatggacggtacccgtactcgatgcaagagattgccaaagacaggctaccgttgttcagcgatgaagaagccaggatggtgaaaggctctatagactatgttggcatcaaccactacacttctttctacatgaaggaccctgggacatggaacctgacaccagtcagctaccaggatgattggcatgttggttttgtctgtaagtttctgactccacgaaccaaattcttgaattccgcagtttcttgtgctgccgtcacctcatctagtcgtatgttgatcctcacatgtttctgcagacgaacgaaatggagttcctattggcgctcacgtaagtgtactgctagatgtcttcagacgtcgaaagcaggaaagttggtttgcctctgattatggtactgtaaatttctttgagctctgtaggcaatcccccactggctgtacattgtgccgtggggcatcaacaaggctgtcagctatgtcaaggaaacttacaaaaatcctacaatgatccttgctgaaaacggtaactcatgaatcgaaattcaaatttccaggtagaacggtatatgctttgaattaattaagtggtgtgctcttgcaggaatggaccaacctggtgatgtcagtattactcagggtgtgcatgacacagtaagaatccgttattacagagactacataactgagctcaagaaggcaatagatgatggtgccagagtcattgggtactttgcgtggtcgctgcttgacaacttcgagtggaggcttgggtacacttcgcggtttggcttggtgtacgtggactacaagactctgaagaggtaccccaaggactcagctttctggttcaagcatatgctgtccaagaaaaggagctagagaattgcagacaagaggaccactggcttcaggtgtcatacaaaagttcactctgcaaatcctcttagtatgtcagatttagcttaagaaaccgtgcagacaattgagtctcaaggctcgacatctctagcttcgttaattgttgcaaggcaataaattggtatcttcgaaaaccttgagtctccataatagaacaagtagaagcacaatgacgggatcacagacaaatgacacacaagttcaccaacataaacggcataaaaaaaacaaaaggggcgaattaaaacttcgttacattcaacaagctgaaaattgaactcattttattcgataatccatttagccaaaccatatatatttgaccacacngtatatagctcaaatcaacaacgaaatcatggtagcttcatcgctatactttatatactgaacttatacttgagattctatctcgccgtttttctgttcaagagcttatcttcaccgtgctaacatgacaacttaacttctatcctatacttatctgtggtagggggaaaccaggtcattaagacaacagcatgtagaaattattatagatacacttcagaagataacttggcctgtccaattgccttacagtaaacatctccatcgctatttctataaacaaagcttagttaacttcatctgatctgtctgcgacctgaaaatttattcagaaatttaactatataatgcatttcaggaaaactaagatatggttaaattgcttagtcgtgcttgtggcaagttcctaaatcctaatttgcagttctaggaattcttacattttgcgctgatttgaagttcttagctgcgcagtacatgttccggaattaaaaatgcaattccaactaccatcctaattcaagtagtccgctcaagtttaacataccatataaacatacggatccagggcaccaccattgcctgcacgccgcaagccgccctcctgcttcaacagcctgcaagttttgcatgagcagaagcacacagatacgcggatacacaggtcaggcagaagtaatcaggtaaccattgcaaaaccttttcaaatggaagttggaggcagagtcaagctcaccatcgtatcgctttgctcgtgccggagttgtcgccgacggcggcgcggatgtcgttctccgtcgctggcccagcttgcgtctgcgaaaaccactgcatgatcacctccgccctcctcggccccttaccaccagcagcacaacccacccgcggagccccgcggcatctccccgacgtggccgtggagcccgcggacgcggcggccgtgacggtgctcccctcgctggccacggcgctgctcctctcgctctggccgtcgtcaccaccgctgtcgatctcgatccacacgcccttccgcttcttctctgcgtcggtatggaacagcgcgcttgtggcctcggctagcacctggagccaaggagcagagccatcagtgcgtaatcgcagaagagatattctcgcaaccgcgtgctgatcacgatcacgagtcgatgaactcgccgattgcacaccttagggtcgatgcggcggagggaggcgacgacggagagcacgcgtaggggatcgacggggcgaccgcgctgtgccgagtcggagacgcatgacctcgtcgacgcgccggagtaggaggacgaggagcccgagtagcagtagaactcctcgctgcaatgcagagaagcgcgccgcaacggagggtcgggtgaaattgcggtgatgaagtgcaattccgtagcgcgatgagcagatgacgcgaggcaggtacctgagagcgggaggacgcgaaggcggggccagccggggtgtggagtcggcgaggaagaggagcgcgcgggccccggatacgtcggcgaaggtgggatactctgttcccatgccgcccgccgagctctccggcagaggaggaggagccgcccggcggtcgtggtgttggagggctggaggcagcgccagcggttgccggggcccggggggatgggattctgtgggggattttcgaaaagtttcgggggcgtggccgtgaggatgacaggggagcagcgccattttaaaatttcgagcgactgggggaaaggcggaaactccgaaggcgtgcggcggtgcgggcccgtgtttcgcctcttaaattgatgggcccaattcagattcgaatccggcccatgacattgaaaattgtccgggaaagaggcccgcagttcagtctaagtctaactatcgttggactgttggtttgttctccagcaatatcgtttaaattttatttttaaataaatattttttatttttttatagttttctataaaagattctgtcatttatatcttttttatcttcagcaacattctctaaattcgatcctgtataactagagtgttaccaaattccacaatatatattgtatttaaatcagtcacttgtaaaaaaacgttcctatgttaccaaaatggaactatgcaataaataaaataattatattatgtaatatacagtactaatcgtttttgctaaag

SEQ ID NO: 14836 - DNA, 2141 bp, Zea mays
ctgcaggcgagacttgtccgttcaaatggagccgcgtcctgctccatattcgcaaagcaacgcttgcttcagtttcagatcatctagtaatttcgagcaacagatgatccagcaaggactagcagaaagcagcctgtaataaattctagccaccggagaactgggcaaacgctgccaatcattgaagccatcactggatatgtgtgtccatctccatcatctcacaaacaagagccacgcagtcggcacacacagagaaagtcactgtcacgaagtgtcggtttcgaactcgaacagggcaggtgctcgccgtccctcttttactagccttcggaaagcgcggcctgtccgcctgtgtctccggcctttgccgcttccacagggagtccgggaccatgcagagctccgtaaagctcgcggtgcttgctcttctgctagcggcagcagctcaccacggtctgctgccgctgccgacggcgcgatgctactggctcaacccggagatctacgacgccggcgggctgagccgccgcgcgttcccggatggcttcgtcttcgggacggccgcgtcggcgtaccaggtcgaggggatggccaagcacggcgggcggggccccagcatctgggacgccttcatagaggttcccgggaccatccctaacaatgccaccgctgacgtgacggtcgacgagtatcatcggtacaaggaagatgtgaacataatgaagaacatgggctttgatgcgtaccggttttcgatctcttggtcgaggattttcccagatggaactggcaaggtgaaccaggaaggagtggattactacaacaggctcatagattacatgctccagcaaggtatcgcgccgtatgcaaatctctaccattatgacctcccattggcactccatgaacagtacctgggctggcttagcccaaagattgtggaggcgtttgcagactacgccgagttctgcttccacgcgttcggagacagggtgaagaactggtttaccttcaacgagccgaggtgcgtcgctgctctgggctacgacaatggcttgcacgcaccgggaaggtgttccgggtgccccgccggaggcaactccaccacggagccgtaccttgtcgcacaccatctcatcctttctcatgcagctgcggtcaggcgataccgcgacaagtatcagcttcaccagaaggggaagattggaattctcctggatttcgtgtggtacgaacctttcagcgacagcaatgcggaccaggctgcagcacagcgagccagggacttccacctaggctggttccttgaccccattgtacatggacggtacccgtactcgatgcaagagattgccaaagacaggctaccgttgttcagcgatgaagaagccaggatggtgaaaggctctatagactatgttggcatcaaccactacacttctttctacatgaaggaccctgggacatggaacctgacgccagtcagctaccaggatgattggcatgttggttttgtctacgaacgaaatggagttcctattggcgctcacgcaaactcctactggctgtacattgtgccgtggggcatcaacaaggctgtcagctatgtcaaggaaacttacaaaaatcctacaatgatccttgctgaaaacggaatggaccaacctggtgatgtcagtattactcagggtgtgcatgacacagtaagaatccgttattacagagactacataactgagctcaagaaggcaatagatgatggtgccagagtcattgggtactttgcgtggtcgctgcttgacaacttcgagtggaggcttgggtacacttcgcggtttggcttggtgtacgtggactacaagactctgaagaggtaccccaaggattcagctttctggttcaagcatatgctgtccaagaaaaggagctagagaattgcagacaagaggaccactggcttcacgtgtcatacaaaagttcactctgcaaatcctcttagtatgtcagatttagcttaaggaaccgtgcagacaattgagtctcaaggctcgacatctctagcttcgttaattgttgcaaggcaataaattggtatcttcgaaaaaaaaaaaaaaacataatagaacaagtagaagcac

SEQ ID NO: 14837 - DNA, 1101 bp, Zea mays
attggacctagtggcccaagcccagtcgagggctcggcccagtcagccttctccgtctccctgaatgccaccgaaccgcaagaggcgagcagcagccatggatcccgcggcaggaggcgccggccagcagcgccagaacaaagcttcggcgggcaagaaggtaaagaagggcggtggcagcggcgggagatggccggcggtcaagcccaagaaggatctccagatcaatcgcctcaagggcacccacctcctcaccattccagacttcttcacttctgcggaggcaaaggctttcattgatatcgctgagtcgatgggcttcacgcaccagggcagtttggggccactaaagggggaggcttacagagacaacgatcggatatctgtgacggatccattgcttgctcaagccatttgggaatcaggaataaacaggatttttacagacatcagcgtctctggcaaagtagcaacaggattgaatccaaatatcaggttctacaggtacactgaaggtcagcgttttggtcggcatatcgatgagagtgtctccctcgctgatggttctaaaacgtattacacgcttttaatatacctttctggcaaaggaagtgcaaaggattcatctgggcaagctcttgtcggaggggagactgtcttttatgatcaaagaggtggagttgtcgctgaggttgctccagtgcaaggtatggcactcctccacctacatggcgccaaatgtatgctgcatgaagctcgggttgtgaaaaagaatgccaagtatgtactccgttcagatgttgtattttcttagctgaagaaatgcctcaacttgtttcagatcaacccgtctagggcataatggatctggggctgggaagtacttctagttactttccccttttgtaagttgtcatacaaagagtcctgtaaccttttcaatgttggaagtgattcttttggcatcagaaccgtgatctgttatctgttgatgcatttgctgttgtccaagtacaaaagaaatcattatatttagccgcaaacattggctgaaagtgcaaaaaaaaaaagaagccgaataaattgcccctagtttttggt

SEQ ID NO: 14838 - DNA, 1013 bp, Zea mays
tacaggtgttttttaaactctattctattgtttcttttaaaaagctaattgctcttgatatggttgcattgattgctggtgtcaaatatcatggagagttcgaggatagacccaaggttgttctcaaagaagttacagattctgatgggcagaccattcttttcattgataagattcacaaagttattggagcagcgtccattgcaaggaagatctaccagaggcaagacattggtgtgggtggctttcagaagatttacggtggctacacctcaagcgcttcggcaaggctttattcagagctctaaagaaaagcattctacacccaagtatgggctcatctaccatgcatcctcaattgggaaggcttctcaaaagcataatggaaaaactctcagtctctatctgcaaaagctgctcttgctatccgataggatgcccttggtgttgatgaggacaactccattggcactaagagtcgactcaaggtcgtgacggttgggctggagagcacgctggtaggggaggacctcaacgactgtgcctttgtctatggcttccttagcttcctggacaagatctcttgcgtaatcgtcctatttgtcttggaattgtacgaagacacgaatgagatgtagcgagatgaggggacacggtgagcaggtacgagatgggcctgatctcctcatacttcaccgtcctctccctggtggtcacatccattctgaggctataggtcaccactccgtaagccattgcaatggaagccccactgcttgtctgacaaactgaagaaaccggtgagtgtagatgtcgatcgggttggaagaaagaagaaagaaatgtgcatcctcttcaattagtttcaattagatttgaaagcaggtcactttgtaatagtatgtgtcttgtcatcgtgttggcacaacacagatgtgtatgatgtagttacgtataactcaagattctcattgctatgctttattataccaacaaagttcagatgtttggat

SEQ ID NO: 14839 - DNA, 2190 bp, Zea mays
gtttgacaaggccaagctcttgtgaaatggaggaagatgcaggccatgatttactgagggcatcagtgctcgctttgtttgtttctgactgctttggtggttgtgaccgaagcgcttctcttgggagaacacgtagagctattgttagcttgaggaaggagcagccttttgtttgtacttgttctgctgggaacttgggcgacaacaatgaagctaagcagaccaatattctttctgggcactttgattttgctggtttgtgtaatagatcaatacatctcatcaaggaaagaagaaattcgggtattgtacctataggttcactgcaattaggtgtttgtaggcaccgagctgtcctaatgaagtatttgtgtgaccgggcggatcctccaattccttgtgagcttgtgaggggccatcttgactatacacctcatgcttggaacattgttcctgttaaaaagaggaatggctgggtaaggatgattgttgatgcttgttaccccaccaacataaaggaagagacagatccagagtacttttgcaggtatataccactcagtcgacttcaaattgtgctcgatgatgagggctatactcctcggtgctctttcccatctgtgtcatcatgcaaagaaattgaagttacaccttctagttctgtctatcactgtaaaattggtgctgttgatgctgctgcaaagatacgatatctggatactcgtagggtctcaaatgatgaagttaaactttttgaatacaagcttctgggggaagtaaggatgctgggtgcgctaaggaagcacagatccatagtggacatatatggacaccaactttcatctaaatgggttcaagtcggcggtgataaagaatataggatattgcagtctataattttaatggaatatgtaaatggaggttctcttaagggatatttgacaaagctactgaaggagggcaagaagtgtgtccccattgatctgtcagtttacattgctcgggaagttgcttgtgcattgttggagatgcacaagaagctagttattcacagggacataaaaagtgagaatgttttgattgatttggaccccaagaggaatgctggtgcacccattgtcaaactatctgattttgacagatccgttcctttgtattctttgtcccatacatgctgtatatctcagcttggtacacacccacctgatgtttgtgttggaacaccttgttggatggctccagaggttgttaaggccatgcatgaaaaacaccactatggactggaaatagatatctggtcatttggatgttttttattggagatgcttacgcttcagatgccttaccagggactttctgacactgaaatatatgatctgatactgaggaagaaacagaggccaaggctaactcaggaactagaagcattctggacaatggatgagccagctacgagactcaagttagggatcacatctgatgctcatgcagataaattgagacacctgatagatctcttctaccagtgtaccagaggacatgcatccaggcggcccaaagctgtgcaaatttacaactcactgtgctccttgcccacatgttacgacatgaggtgaacgttctgatactgtatgaacgcgaaacttgatgcagaagtgcaggggaagaaggtcaaggcaggacatctagccagcctcagagggtttggtgctctaacccgaacatttcaccgtgagttggccttcaggtgctgccaggcagaacatgagaagtgggaccaaggctagcggctgtggtcgccagagctcctcctgagttggtcagttttgtagcggcacggcatctgcgtccacttgtagtcatcatcagttggtcagttttgtagtggcacggcatctgcgtccacctgtagtcatcatcatgtatgtgttatcacatccattgtttccccttttcatggttgctgccatcacaatggggtttaagttatcaaattaggtcattggtgccccaggggcatttgtctgctagaccgctgcatttacttctctatgtgtattgtattgtttatatctgtttagaaaaaaatgactgttgtccatgtaacaattgatgacatctgctatgtgttattgcgaggttatttgtttatgctgattttaccagccattttcgggcatgagctcttgg

SEQ ID NO: 14840 - DNA, 3990 bp, Zea mays
  misc_feature (3605)..(3605): n is a, c, g, or t
  misc_feature (3618)..(3618): n is a, c, g, or t
cattgggtacctcgaggccggccgggacccggaggaagtcacttccttgtagctgactcaaccacatggtaccatcttagcagagtagcaatggctatcaaacagagcatcagcttcacgctgcgtgttcttgctgatctatccctcctactcttttgcgtcctgcttgcacctgtatgttcagccacagctcctgctgttctcctgcaagtgaagtccggcctcactgaccccggaggcgtcctctctggctggtcactggaggccgacgtgtgctcatggcatggtattacgtgcctacccggggaggtctcaccgggcattgtgacaggcctcaacctgtccgggcacggcctgtcaggcgtgataccgccggcgatgagtggcctcgtctccatcgagtccattgacttgtcctccaattccctcaccgggccgatcccgccagagcttggcgcgctggagaacctgaggacgctgctcctcttctccaactccctcaccggcaccatcccgccggagctcggccttctcaagaacctcaaggtgctcaggatcggcgacaacgggctgcacggcgagatcccgccgcacctgggcaactgctcggagctggagacgctcggcctggcctactgccagctgaatggcaccattcctgctgagctcggcaacctgaagctgttgcagaagctggcccttgacaacaacgccctcaccggtggcatcccggagcagatcgcgggctgcgtaagcttgcgctttctgtcagtgtctgataacatgctgcaaggcaacattccttcgtttgttggaagcttcagtgatctccagtcactcaatttagcaaacaaccagttctccggtgggattccggcggagatcggcaacctttccagcttgacgtacctcaacctgctcggtaacagcctcaccggctccattccggcagagctgaaccggctgggtcagctgcaggttctggacctgtcagtgaacaacatttctggaaaggtcagcatctctgcagcacaactgaagaacctcaagtaccttgtgctgtctggcaatctccttgatggcgccatccctgaagacctctgcgccggcgactcatcaagcctgctggagaacctgttcctcgctggcaacaatcttgaaggcggcattcaggcgctgctcagctgcactgctctccagtccatcgatgtgtcaaacaacagctttaccggagtgataccaccgggcattgaccgcctgcctggcctcatcaaccttgctctgcacaacaacagcttcaccggcgccctgccgtcgcagatagggagcctgggcaacctggaggtcctgtctctgttccacaatggcctcaccggtggaataccgccggagatcggcaggcttcagaagctgaagctcttgttcctctacgagaaccagatgtccggaaccatccccgacgagctcaccaactgcacgagcttggaagaggtggacttcttcggcaaccacttccatggtcctatccccgaaaggatcgggaacctcaggaacctgaccgtgcttcagctccggcagaatgacctgtcgggccccatcccggcgagcctcggtgagtgcaggagccttcaggcgctggcattggcagacaaccggcttaccggctcgttgcccgagacgttcgggcagctcgccgagctcagcgtgataactctctacaacaactccctcgcgggccccctgccggagtcgctgttccagctcaagaacctgaccgtgatcaacttctcccacaaccagttcaccgacagcatcgtccctcttctcggctcgacctccctcgccgtgctggcgctcaccgacaacagcttctccggcgtcatcccagcagtggtcgcccgatcaaggaacatggtccggctccagcttggcggcaaccggctcaccggcgcgatacctgccgaactaggcaatctgacaaggctcagcatgcttgacctgtcgctcaacaagctctccagcgacatcccggcagagctctccaactgcgttcagctcgcccatctgaagctcgacgggaacagcctgacgggcaccgtctctgcatggctcggcagcctcaggtcgctcggcgagctcgacctctcgtggaacgcgttgactggaggcatcccgccggagctaggcaactgctcggacctgctgaagctgtccctcagtgacaaccacctcaccggaagcatcccgccggagatcggcaggctgacgtctctgaacgttctgaacctgaacaaaaacagcctcaccggcgccataccgccagcgttgcaccaatgcgacaagctgtacgagctgagactgtcggagaactcgctggagggaccaatcccgccggagctcgggcagctctcggagctgcaggtgatacttgacctgagccggaacaggctctccggcgagatcccggcgtccctcggcggactcgtgaagctggagcggctgaacctgtcatccaaccggctggatgggcagataccgtcctcgctgctgcagctgacgagcctgcatcgcctgaacctatccggcaaccacctctcaggcgcggtgcccgcggggctatcgggcttcccggcggcgtcgttcgtcggcaacgaactctgcgccgcgcctctgcagccgtgcgggccgcggtcgcctgctactgctaggcggctgtcgggcacggaggtggtcatgatcgttgcgggcatcgccctggtctcggcggtggtgtgcgtggcgctgctgtacaccatgctgagggtgtggagcaactggcgggcggtgtcggtgtccaactccgatggcgaggagtcggcacatggtggcggcggggggaagtgggtggacggcaagtacaggaaagtggggtcatcggtgtcttggtcgtcggaacagaagcacaactcggggtccgagaccaccagcgtgctccatggcaagtccacggaggccgccggcgccgggaagagctagctgctcgcggcgtggcagcagtgaacgtcactttttcttcctagcgagctcaaaagccaaaatgtatgtgtatcgatgatcgtctcttgatctcctcttgtttccgtgtgtgtttttctttgattaattgttactgcttccgccacttccgttcgtctgtgggcggcccttgattggaggtacaagctggactgccggagcgaagcaaaaccgagaattgtgttaccgtgggctgctacattccatttcgtagttatgggccttcttgaaggcccaacggattcctagactagatagacctgcataacacctactcttatttttttattgagaaactgtcctccgtgtttataagaaaagcttcctagatagaccggcatgcaaccatatttttaccaggtagtttaataactcgacaattcggataacgaaaaatgctaaaaagaattgttcataatttttgtgtacatgatgatttggattcgtgtctaggttgttgagcatcgagacggtcgaacggtgacggtccgcgacttggacggtctctcgtgttagcccggacggtccgtgaacaaattaattcatattgnagtccttatcccntgcggggttatcctactaactcgcgagaaacaattggattttgtctcggagcgggtacacgagatttcaaaggtaccttcaaacactcgaaggtagtttaagaatgctcttgctccaacagcttcagatgttgagcaactcaacaaaaaacacgctatgggtttttagaaaaactctgcccaaagggcgaattcgcccttcctagataaggcactttacggacttcgtcaggcatcacacacgtggaatgccaagcttgacgaaacgctgatggcgctcggcttcagccacaacatgttggagcatgttgcctatgctcatggcaagagtgcttctcgaccactggtgggattctacgtcgacgacctcatc

SEQ ID NO: 14841 - DNA, 1908 bp, Zea mays
  misc_feature (390)..(390): n is a, c, g, or t
ctctaaacagggacgaagagagaaggattctgctcgagtcggtcggttgagccaagaattgaatgtgtcatcgagagtcagcacattcaattcgttacaagctgcaccgttttttccggtcctctcatggcgatggtaggaagaatatatggatatggaccagcagtcccagttggaccgttccctacgacactggtgtaccgcattgcctgctccgtttggtaagtaacctcgtcgtgaggcggcagacgaacggccaggagtccggaccgggaccgggacggcagcagatgtgcagtgcagttcattcagcttcgtcgatctcgatcatgccaaccacttttgccggcctgcatttagtactgatgttcttctggaagcaggtcgcantcgcagcccacgacgcttgcattgacaagctagagattccacgctagcgacagctgccatggtcagtgcatgcatgcacgcatgcatgtgggcacattaagacacctcaccaaatactacaactgcaaactgtccgtgtgcgtgcgtcttgtcttgaaccgccggggccgggggtccggcatgctgcatacagtatactactatgcgctgaccaacgccgtgccactagtcagtgatcccgctgtggaaggaggtggagtactacgaggagttccagcggcggctgcgcgcgcgcgtgggccggtcccgcgccgccgccatcgtccgcggcgcgctccacgtggtgagcatcggcaccaacgacttcctggagaactacttcctgctggccacggggcggttcgcgcagttcacggtgcccgagttcgaggacttcctggtggccggcgcgcgggcgttcctggcgcggatccaccgcctcggcgcgcgcagggtcaccttcgcggggctcgccgccatcggctgcctgccgctggagcgcaccaccaacgcgttccgcggcggcggctgcgtcgaggagtataacgacgtggccaggagctacaacgccaagctggaggccatggtgcgcggcctcagggacgagttccccaagctcagcctcgtctacatcttccgtctacgacagcttcctcgacctcatcacgaacccagacaagtttggtgagcatgcatgcaccaattaaccttatttcgtttaataaattagatcgatctctacgtaattaacctgctcagacacgtcgccatcatgcaatgcagggctggagaacgtggaggaggggtgctgcgcgacaggcaagttcgagatgggcttgatgtgcaacgaggactcgccgctcacctgcgacgacgccagcaagtacctcttctgggacgccttccaccccacggagaaagtgaaccgcctcatggccaaccacacgctccaagtgtgctaccaagagggcgtcctgtaacgtagtagtagtattcaaagttatcgaaggaattaaaagaaaaaaatgaaagcacacaaaggtttgtcgtaatcacagaaaatgtactacacttgtgatttgaatgtacgtgtcctgtaacgacgacgtgtgtacattgaaattagagagacggcgtcgcatctatcgattccatcgttattcaaaaaaaaaaaaaaaaaaactggttcttcattcaaagctttggtgtaccgccgtgtcatctcaagctcaaagctagaaactatgccgtcattgaaagaactggtgtaacgtcatgcatatcctgtcaacctcacagctctgtattgtgggcgtgtttagtttcgcttatatataagcgagaataccaccaatcgatctcagcgacaatcgaataatcgagagaaaccgttgcatttccaagaatctaagctgttgagcaccaataacggccagcgggcaaacggtccgacgtggcggcacagacggtccgtacgag

SEQ ID NO: 14842 - DNA, 1543 bp, Zea mays
  misc_feature (11)..(11): n is a, c, g, or t
ggccggccggnaaaaaaaaaaaaaaaaactcgaggccggccgggagcgcccgcaggccgcagctgcagtctgcagagcacagccgtgcgcggtttgcaaccgtaccagcacaagcaccccaggcgggcaggaaacaagcctcctccgctgctccgccgcaatggcgtccccgcgcggccatcgccgggccagcgtgctgcagaaggcggcggcgctcctcctgctcgccctgtcctgctgcggctgcaccggtgccggcgccggtccatcggcgccaaccccgaaggtgccggcggtgatcgtgttcggggactcgacggtggacacgggcaacaacaacgcgatcgggaccatcctgaagagcaacttcccgccgtacgggcgcgacatggccggcggggcccagcccacggggcggttctgcaacgggcgcctgccgccggacttcatctccgaggcgctcggcctgccgccgctggtcccggcctacctcgaccccgcctacggcatccaggacttcgcccgcggcgtctgcttcgcctccgcaggcaccggcctcgacaacaagaccgccggcgtcctgtcagtgatcccgctgtggaaggaggtggagtacttcaaggagtacaagcggcggctccggcggcacgtgggggtcgcgggggcccgtcgcatcgtctccgacgcgctgtacgtggtgagcgtcggcaccaacgacttcctggagaactacttcctgctggtgacggggcggttcgcggagttcacggtgggcgagttcgaggacttcctggtggcgcaggcggagtggttcctgggcgagatccaccggctgggcgcgcggcgggtcgccttcgcggggctcagccccatcggctgcctgcccctggagcgcacgctcaacacgctccgcggcggctgcgtcgaggagtacaaccaggtggcccgggactacaacgccaaggtgctcgacatgctccgccggctcacggcggcgcggccggggctgagggtcgcctacatcgacgtgtaccagaacatgctggacctcatcaccgacccttccacgctggggctggagaacgtggaggaggggtgctgcgccacggggaaggtggagatgtcgtacctgtgcaacgagaagagccccgacacatgcgacgacgcggacaggtacttcttctgggactccttccaccccacccagaaggtgaaccagttcttcgccaagaagacgctggacctgtgctacgaccagctcctgctgtgatgctgatgatgcgccctagagctcagtgtggctacgtttagtccacactccacagtcaaaattgttgctgctaattcgtctccgtgtgtatagcatagctagcattcgatgtgatgtatgtagtagtatatggttgctgtgcctgtctcgatgcgtcggtcgatcgattcacgattcttttgggcttaaatgctcataagggagataaaatttacacatttgacgcgagttacaattggttccggccggtccccgccgccttttggccaaaaa

SEQ ID NO: 14843 - DNA, 1108 bp, Zea mays
gggtccctcgaggccggccgggaatcatcgctcgctgagcttccgttgttgcacagcacatcgatcgacgacgatatcgggaagcaatatggggttggccttgtcgcggctggaggagattaggacgcagtaccgcatggcagcggaagacggcgaggctgacagtccggcaccggcgccagtgccgccgaccggtgctgctgctgcttccggcggcggcactgaaaagaagaagcaggcggacgactcgtcgtcgtcgtcaaagacgacagaatgggttcctcataagttctctgagatcgtcggtcaaagacgacctggtgaggatatgttccgagggatctaccttccacgatcggatcagcagccgaaaacaaagaagtactgggtagatgggagaaatgccaactgcttcatgctgttccctaaaggattcagcatcacctggggttcggacgaaaggtactggagttggcgcaagctcacacaagaagagaaaagagggatcgacgacgaggaggccaacatggaggtggcgtacctcaaggacgtgtgctggctggagatccgtgcgaagctggagatgtcccacctcactccgggattcacctacgtcgtcgcctttgtagccaagctcgaaccgaacggctacggctggtccgagccggtcgacctccagatcaagtgtcccggcgacatcgacgggaagcctcgtcagcagcggaaggagagtctatggaagacggttgacgggaaaaagtggacggacctcaatgtcggggaggtgaaggcggaggccgggcaaaagggggagatggagatcgccatgctcaggttaggtggggactggaagagaggactctccctcaggtacatcaagattgccccccaaaaaccctagctagctagctagctaggttcaccggccataaacgacgacgacgacgatctacgtactccgactgcatgcatgcgcgcgtctctgctgccgtagtacgtgcaccgtataatatgcactcaccctgtctactcataagatgaatgaatgccatattgatggccatgcatggaataatatgcactcaccctgtcaactctcaaaaaaaaa

SEQ ID NO: 14844 - DNA, 1230 bp, Zea mays
tgaaatactcaaataagtggtacctaattattttctatttttgatgtcaagtacgaccgccacttcgccccccagtacgagctggggagggaggtgggccgcggccatttcgactacacctgctcgcgcccgcccgcaagggagacatgagaggccaggtcatggctgtcaaggtcatctccaaagccaaggtcttgctattcgtgatctcacagtgctcttttattggacgcacgacacgatcttacctgtttcaatcggctcggttcctccaccggatcatgaacaaactatgtgggatgacataattgccatcctgttgtgatcttttttaactctcttttagtagatcagtatctctgaagtgccactaccacaggtgttgcaatcataagttcatgatttgcttcttggctgacttgcagggtgatcagttttttccccccgatggtattggcattggcattgtcatttccccacagggttagaagtacattgtagagatcttgtttcagcaatgccgcatttaataatgtgcccattttcatgatctgagtgttcaactgttcatccatctatcacctgtttcttgcttttttgttctttctgtaagctatcatggcatagtagtttatgcagctgtagatcactagcttggcagcgacagagttccttgtgagacctcagagaacctgttcccgtgtatctccatcatattgttgttcctgccatgagtttaggtgtcccttggtccattctgcatcattttattatatgatcataagtagaagaaacatagggaaaagtgtaggaactaaagaaatgtctcttagattcttggtgccaaagctgaggacatgttgatattggggactgctttccactgacattgttctgattgttgaatgatttaattttgatctcagttttacttggcatctaaaatgtttgtgcagcaagttgtcgagaaaacctagtgtacgataggcgacacagaagaattctacgtgcatgggtgcattgatgttttcatgcatgtatattgtcgttttttgagcgatacaacattaattaattaatgactattttggcctgctatagttttcgcttgtgctactgaaattatttgagcaggagatgtatttattgaatctattgtgtttcttccttctatatagttctttatttgaattgcgtgcaattttattccttgttacaacatacacacaa

SEQ ID NO: 14845 - DNA, 3658 bp, Zea mays
aattcggcacgaggacacccacctccgccccccggccgccttgcgactccaaaaccctccctccttccccttccttgccccgccctagggttcgcgccgccgcgctgaccctgtcgtagccatggggtcctcgctcccgcccaaggaagccaacctcttcaaagtcatcgtcaaatcctacgagactaagcaatataagaaagggcttaaggctgcagattccatattaaaaaagtttccagagcatggtgaaacactatcaatgaaaggtttgacgctaaactgcatggaccgaaaatctgaagcgtacgagcttgttcgacgaggcctgaagaatgatctgaagagtcatgtctgttggcatgtttatggtttgctttatcggtcagatagagaatacagagaagctataaaatgttacagaaatgcattgaggattgatccagataacatagaaattcttcgtgacttgtcccttctccaggcacagatgagggacttgtctggctttgttgagactaggcaacaacttttgtcgttaaagccaaatcaccgcatgaactggattggttttgcggttgctcatcatttgaattctaattcttccaaggcagtagaagtattggaggcatacgagggaacactggaagatgattatcctccagagaatgagcgatatgaacacaatgaaatgctgctgtataagatatcattgtttgaagaatgtgggatgctagacagagcccttgaggaaatgcagaagaaggagagcaaaattgttgacaagctatcattcaaagaacaaatggcatccgtcttgttcaaacttggccgctttgatgaatctgagagcatatacagatccctgctttttatgaatcctgataactacaaatacttcattgctgtgcaaaagtgccttggcttatactctgataatggtcaatattctgctgctgatgttgagcgcttaagtgcattgtacaactcacttaaagagaagtatgcttggtcatctgctgtgaagcgtatccctcttgattttctggaaggtgagaagttccaggaggcagcagacaactatgtcagacctctattaacaaagggtgtgccctcactattttccgatttaagcccactgtatgaacatcctggcaaggcaaacatactggagcagttatttcttaaactagaagattcaattagggattctggatgctttcctggatgtccacagaaggagcctccttccacactgttgtggaccctgtttttgatttctcagcactacgacagaagagggcaatatgacattgctttgaataaaatcgatgaggctatctcacatacaccgactgtcatcgatctatattcagtaaagggaaagatattgcaacatgctggaaatttcacagcagcagccgcattagcagatgaagctaggtccatggatcttgctgatcgttatttaaacagcgagtgtgttatgcagatgcttcaggctgaccaggttggccttgccgagaagactgctgtcttgtttacaaaagatggtgatcaacacaataatcttcatgacatgcagtgcatgtggtatgagcttgcttctggggagagctattaccgtcaaggtgatcttggccgggccctaaaaaatttcttggcagttgaaaagcattacgctgatatgactgaagatcaatttgacttccattcatattgcttgcggaaaatgacacttcgagcatatgtttctatgctgaagtttcaggatcgtttgcatgctcatgaatacttccacaaggctgctgctggagctatcaggtgctatatgaaactacatgattctccaacaaaatcttctaaggaagagaatgatgagatatcaaaactgccacctgctcagaggaagaagttgaggcaaaagcagaagaaagcagaagcgcgtgctaaaagggaggctgaagagaaacaagaggatgaaacagcttcatctaacagttcaaaatctggcaagaaacaacatgcaagaccagttgatctggatccacatggtgaaaaattaatccagattgaagacccgcttgcagaagccacaaaatacttgaagcttctgcagaataactcgtcagactcattagagacccatatactttcatttgagctaagcatgagaaagcaaaaggttttacttgctttccaggcagttaaacagctcattaaattggatgaagataatccagacagtcaccgttgtttgataaagttcttccacaagataaacagtcttcctggacctgtgactgattctgagaagctaatttggaatgttctggaagctgaacgacctgacatgaggcaattacatggaaagtccctcgttgaagtaaacagaagtttccttgaaaaacacaatgcttccttgatgcaccgagcagctggtgctgaaatgatgtatctcttagagccaaataagaagatggaggcaattaatttaattgaagattcaacaaatattacatcatcagggcatagtttgcttggtcctgtaaaaacatggcaaattcaagattgtattgatgttcataaattgctggagacagtctttggtgatcagaatgttgcaaataggtggaaggcacggtgcgcggaatattttccgtactcgacgtactttgaaggcatcaagagcgctatttcaacctatgccattgaccatagtctcgagagcccaccagaaaatggaattgcttcaaaccctcatctgaaatcaaaagatggagaacaagggagtttgaatgggactctgcatattgtagatgatttgagcagcctaagcattcggtaatgcacgaacaagttgctgaatggtcacaactggaacacaacattttagaactggagccagtacccaattaaccaaagcgtacacgaacaaggggaacaaagtgctctggtgcaagtagttgtcggcacatcacatatgaagagtatattattgattgggagctgaggtgtccagtcaggttattgtcttggttccagcctgtacctttttgttgccattttgtagacagggaaagaaaaaaaatcttccgtctcaattacggtgaagttgtgacagcgtttgttgcctagcgatatcagggtgtgaccattcgtttgaaacagtgctccctctctttttggactacaaaattttggcacaaagcaggtgtacaaggttaaaccttttaaaactttcatctatttgtttcgggatagtttggtgtgtgggggggtttgtcttgatcctttgtgctactgcaacatttggtcctcgacattgtaaattagttaatcttaaacatagaaactgtattccagttgtcatgacaaataatgatcaatgttaaccctgggtgtttgatctattccaaaaaaaaaaaaaaaaaagaaggaagaaaacaaaaaaaaaaaaaaaaaaaaaaaaaaaagaaaaaaaaaaaaaaaagaaaaaaaaaaaaaaaaaaaaaaaaaaaaaacaaaaaaaaaaaagggcgggggcttttaaaagtccaacctaaattaaccgccctgcgggctctaatttcttttttttggatgcccaaaaattaaggtttcggcccctttttttaaattgtgggggattgggaaa

SEQ ID NO: 14846 - DNA, 1722 bp, Zea mays
tattataaattacacaattattttagttggaatccttgcttgagtagattcctgaataatcgaatggaccccaagtgcatccgcattccacccggaaccgcggtctcagcgctcagatggctcagatgtcacccacccgcaacaagtgcgtcctaaccgccatctgagcgcgttcttgtccaccctaacctggtgcctctcacggccgcattcgcaccgcgatgaactacgccgcagccgccactaacgcccccgcggcggcgcccgcggcagcgccggcgtcgggcacagaacacgcccactacccgtattacgctggctattcttatccctacggcgcctatcaccaacctgccccgcccacgtactcctccgccgtggccgccgcctcgtcatcctactactaccccgtccctgccgccgcgtcgtccaccgccgcgcagtacgacccctattcgggttaccagcactacagtcacccggagggaggaggctcggcgggggctggcctggtgggctgctacagcaccgtcggcgaggcgttgcagcaggccgcggtagcatcgacgacgcaggctgctctggaggcgaccacaaaggaggcggggaagcaattcggtttcgatccccagagctacgctcaggcagcagttgccagagcctccaatggaattacacaaccagctgcagccccaggcttgcaccatgcccagtggaatgctcattttgggtatcctgtgccgaaatatgtcttgaggaaacaaatgaagaaaaagccgaagactgtgcaaccagcgccatgtgaggtgtgcaagattcagtgtgatacactagaagttctcctgatccataagcaggggaagaagcacaagaaaaatttggagaaatacaaggctcgccccccgtacaccgtcggagcttgatgacaaatgtaggaggggccaagctatgtaaatcttagggcatcacgctgttgcatttactaaagaaccatactttattttgtttaataaaatctcattgttatttggtgaattgttgaacttcggaattatgtcttctatgctagtttgaacaagaagtaatctaaaagaagtgcgtcacatgtttagatttattgagtcttacatgaccatagataggttctagtcaattctcttttttcatggataaatacatagtatatgtgatgcgttgaggggattatttcatctgattagctcttgagcaattgattaggtataaaattgtatttttaaattttatttaaatcttttggatgtagctattttgttccgatctatttagaaggtagggcagcccattggagagaaccataaagtagttaactaggcctcagagctgtgtgtggacagcatcgaaggcgagctcccatcagctggtcaaggactttctgctccctaatcttaatatcatcaattgaagatgtcttacaaatactatatgaaactaggcactggcccgtgagttgctacaggcacataattttttgagcgaagtaatgtaatgcaaacatctggtaaatatattaagatggatacaatttcataaaaataacagcaaagagaaatcatgtcagtcctttatgagtcccatgtataattagacataagcttgtgatacccaatctggatccactaactatataatcctaatcaagatctattactaacatagaacacaataccatgttggacctga

SEQ ID NO: 14847 - DNA, 1110 bp, Zea mays
aaatcatacacgtctctctcttgtcgcagccgccctccatattctgttggtcgccgctgctctgctctccatggcggcgccctccctgctccagccaagtcccatggtgcccagccgagtttccttgcgagcgccaccacacatcactagtgctcgttcctcccttgggccgacggcctcacctcccatggcgcctctctggccccttccagcagcaccggtcgccctcaccctctcggctccacctcccagcgttctccctccccatcgctatcggtagagtctccctggtggatgaccttgccccgtgttccccttctacccaggtcgagctcgtcgtgccccccttaatggggtttgcctgtcgcccctctctacttggacgaccgccctgaagctcacccataccgcgacctcgccgaaccgtgcccctgctccagttctcgcctaggtccgcaccagcaggtcgtcagggtcgcccgaagatgttttccctattgctccttgtccatggccttgggaactctatattctcatctgtagccgccggttattaacctcggcgaggtcctctccatcgtttacaaccccggtgtcatcgtcgtgggacgaaatgatagcttatggaagtttactgattactgttattagtaattgggtttgccattctcttctaaatgctactacagtcttctgatccgcaacaacagagggttgcgttcttttctccaaggaaaacagattgttgctggtccatggaccatagtccatttctccaacacaacagttattgcaagtggtgtcagtgggcatgagactacagggtggatcacctacaaggaagtcaaaataaaagatggaatggaactcaaattttgttggccgcagcgcacaagtgtggagacttgaattatacttagttaggttcaacattagcgcaaacagaaacagttgatggccaagtttttcaattaatattttagtttggatttagagtacatttatgtacgagttattttaccgtgcttatttataagatattgaatgatacttatttatattatattaattataatgttataaaatatgtgcgcaaaaaaaaaaaaaaaa

SEQ ID NO: 14848 - DNA, 1789 bp, Zea mays
cagacgcactacttcagaatccggtgggcgcgcccatgcaggcaggcgcacatgcgctcccgtcccgcctggaaagcgcatccaggccgtcgacttgccttggaggggctcgcgcgcgcggcgcattatttgtgcctgcccctggccgcgcccgcaccggcgtagacgacgtgcatgtgtggccggccaatttacgcgccgccacatgctctgctcgcccatcgctttcgagctttgtgtaaatggactagagcggaaggcatagcatgcataggaataggagcaactaaccaccggcctctcgctccctcgctgcgccataaggctgcgactgcgagagccagccgcacccgcaccagtccataggccggcctcctctcttaccttcccacaccccttctcgaccgtacgtagcctagttgtgcttggtagccagccagaaggtcgtcggccgatgatgggaggaagaacagtggccccgccgctcgtcctcgcgctggtgaccatcatcgccatcgcggcggccgagggggacgaggtgaagtgtggcgggtgctctccgtgcggcggcgccgactgcccggtgctgtacccgtcgccgcccccgccgccgtactactactacagccctcccccacccgcgacctaccccggggagtcctcgtcatactaccagccgccgccgccgggcgcgtacatccagatcgggagcgcgccgccgggcaagggcccgctgtacccgcaggacccagggttcatcccggccggcgcgccgggccgcgccgcgccgctcgcggtcgtcgctgcgctcgcgccggcgttggcgtgcgcatgggccttattgtgatctctatgtgcttgacttgacaagcgcaggcgagctgcttattcgtcggtaagtaacgcggcggatcgtgccggcgttccacgtacgtacgggttaattcccccagtgtatctacgcatgctccttgtgatatatataataatcttcattggccgtcatttgggctaagctgcagtagttcttggaatgtatgaatgtttttcattggccgtcatctgctagtgtaatagtgatatttttctatgtgtaatctctcaggaaacataaagaaaagtacgtaaggttcttcttctcaaaaaaaaaaaaaaaaaaaacttactcttcaatattttatattaaccatgctcgtcacctctggctagatctgctggtcacctcctgcatgagcctctccttgccaactctatggacaccactgaggcaccgacggaaaaacaaaactccctacaaccggctgcagtctgcagagaagtggccctgaagcctattcgaatttatgacacatatccaccttataaatcttaaagcaatacctcaaaagaatcttaaagcaacagaacaccaagccgtcaggcaaagaataaaaccaattaattgtttgagccgagccaaaaccaaccgcgcacaacagaaaactgaataacttccgtcccctgtgttgacctatggaaatttcaaattagggggcgttcggttctctcggaacggtgaaccggaacaattccaatccttattgttgttctaatttatgtaagttttgatcaaattgaaaaatttcaggaccatttcggaagaaacgaacggggccttaggcttccccgatggaagttagataatttccgttggatcctggttgacagagtgacactcattaaaaaataaaaattattaattttcgttgggcgcctgaggatggggccttacccttcagggcgatagcag

SEQ ID NO: 14849 - DNA, 982 bp, Zea mays
cccacgcgttcgcccacgcgtccgcccacgcgtccgcccacgcgtccgcccacgcgtccgcccacgcgtccgcccacgcgtccggaagtatcaaaaggttgatgagcaaggctcagtcgctatcaggcaaccagcaaatacattttggaccgacaaaatatgtgacaatcaaaatgaagatgtcaatcgaggtgttttgaggcaagaaaattttagccacactgccagagaaggttttaagttggtcgaaccatatggcagtaatatatcttgtgctcagcatgtatctagttctgccacccaacaaccagcatttgaattgggggatctcgaggaaagctggtacaaaagcccagaggagctcagtcaatttaaaggcacacccccatcaaacatctacagccttggggttcttctatttgagctcttttgctgttctgagacatgggaggtgcactgtgctgcaatgtcaaatcttcgccaacgcatccttcctccaaattttctttcagaaagtcccaaggaggctggcttctgcctttggttactgcatccagatccttgttcaagaccaaaagcaaaagagattcttggatgtgacttgataaatgagggtcgggatttgtccttgttagataagtcaccagtttccatcagtgaagatgacactgaatctagtttgctacttaacttcctttctcaattgaaagaagaaaaggagatgcaggctgccaagttatcggcagagcttggaagcttacaaacagatatcacagagattgacagaagacactcagcaggaatgagattgagtttaaaggatatggatgtactgccaagttctagtttgccaggagcttctgtgagtgccctacagggtgcattgctgtcaggtttgctaccggcatcgtgcaagtcgagcatatatgaggagagggtaatgaggaatttggtgcagcttgaaaatgcttactactccatg

SEQ ID NO: 14850 - DNA, 557 bp, Zea mays
gccggccgggtcggggtcgctcgctcgcctgttccctttgttcgtctgtctgtctttgacaccacaccacagcctccgtttgcactgttgcctgccgccctccttcctgctcctgctcggctcgctacggctacgggggcactggcatcgacagtgacatccccgctcgcgccgtcctccccctcttctgcctctcgctcgcgcgtgcagttgagagcggctcggcagcgcagcgtgcgcgaacacggcagcgccagttactctctctctctctactcgctgctcggcgtccaattcaatgcgctcctgcgcaacggggcagagcagcgacctccttccttctccaccattgggttgagctccgccactcaattcaatgcctgtccgctcttgaagaaacgcctcctcctctcttcgttaaccgccccgtgtcatcactcttactcgtacgtgctcgcgcacgccggtttcaatacgttccgctggcctctgcgtgcgtcgtctcgtcacgcaggcagcaaggcgtggagaggagaacagggaggggattgaattga

SEQ ID NO: 14851 - DNA, 1735 bp, Zea mays
acggcagctccagttactctctctctctgtctactcgctgctcggcgtccaattcaatgcgctcctgcgcaacggggcagagcagcgacctccttccttctccaccattgggttgagctccgccactcaattcaatgcctgcccgctcttgaagaaacgcctcctcccccctgcccggcccgccccgtgtcatcactcttactcgtacgtgctcgcgcacgccggtttcatacgtccgctggcctctgcgtgcgtcgtctcgtcacgcaggcagcaaggcgtggagaggagaagagggaggggattgaattgattgatggggttgctccgctgagctagctcctccggccgtcctttccgtcttctacctctaggtgggtattgccattgctcggtggatcgcagtgggagatgaattacctccggagccggagcctgaagcggctcctgtccctcggccgccggagcaacgccgacgagtgcgccgaggagtgcgtcgacgtcgacccgccgccgaacaagcccacctggaggtgcttctcgtacgaggagctcaaccaggccaccaatggcttccaccaagacaacatggttggcaagggcgggtacggagaggtctaccgcggggtgctggacgacggccgcgccgtcgccgtgaagcgcctggcgccgacggccgcggcggacgagaagaaggagaaggacttcctgacggagctgggcacggtgggccacgtccgccaccccaacgtgtccgcgctcctgggatgctgcgtcgaccgcggcctccacctcgtcttccacttctccacccgcggctccgtctccgccaacctccacgacctgaagctgccggccatgtcgtggaagcagcggcacgggatcgccgtcggcaccgcgcgggggctgcgctacctccacaagggctgcgcgcgccggatcatccaccgcgacatcaaggcgtccaacatcctcctcaccgccgactacgagcctcagatttcggacttcggcctcgcccggtggctgccgtcggagtggacgcaccacgccatcgcgcccatcgagggcaccttcgggtgcctggcgccggagtacttcacgcacggcatcgtggacgagaagacggacgtgtttgccttcggcgtcttcctcctcgagctcatctccggccggaagccggtggacggctcccacatgagtctcatcgcgtggggaccgattgacgcaggccaaaccttacctgagcgacggcgtggtgcaagggctcgtggacccgcggctcggcgacggctacgacggcgggcagctgaggcggctcatgttcgtcgcgtccctctgcgtcagggccgccgccgtgtggcgcccgaccatgacacaggtggtggagctactggagtccggcgagatttctcaagagcagtggcagatgcccgaggaggaggagcaagacgagctgtgggacttcgacgatctcgacgacttcgacgaggacgactacgacgacgagtccgattccccctcgatctcctcgtcggcatgcagcatccaccccgatgattagccccaaaatacttgcgcgtgtcagtagattattatcgttgttattattcaacctgctgatacggtccttgattgtatcggtgtgtacatacaccatccatccctagtagagaatagtaatatgaaaatccgggagaaaaacgagagaagaggatccaggcccgtggctttc

SEQ ID NO: 14852 - DNA, 974 bp, Zea mays
cattgggacctcgagccggcgaagtcttctccttccctgccgccgtcttgctttcccctttcctccaggaagctaacaccaaatctggtcgtgcaaccccgattcccccgcgaacttgcgaagcgatggtggacgcgtggtggtctctgttgggcgcggcgttcccggcgctggtggcgggtcagttcatccgcaccaagcgccgccgcgacgaggagcagcgcctcaaggcggcgcgcgggcgggagaagagctccgacgaggtcttcgtctgcgagcgcgtgtgcacttccaagcgtatgctcaacaaggtaggggccttctccaaggaccccataccggagacctgcgtcaccgtgtgcggcgtctctgaactcgacgcctgcgccgacgcctgcgcgcgcaccgtctgcgtcaaccagcaccaggtgcccaactggaacgacgtctgcctcaagaggtgtcagagcgagtgcctcaaactctcttcaacgctaatgtaatggccatctcgctattgtgctgcgctccttagatgccaaccgtgaggttcttctctgttccgttctgcttagatgccatctcgctattcatcatgcttgaggacagtgaatgtttctggtcaaggccgttatgtcttccattccattcgttcttgcacatttctttaatttaacaacaaaactctttttatgcacaataatttacttcatggccctaattttatttctgaattgaaacctttggggccctcgctacgccattcgtcctccccctttgattaaatccttatatgtaaatgggaatgccttagtataaagttttagagtacgtgttattggagtcatgttttaataatcatctttcctttttttaggaatttgatgctcgtaagaaaaatggactacgttctatttaactaagtaattttagtgtttgatgattaatataacatgtgaactaatgtatttgca

SEQ ID NO: 14853 - DNA, 831 bp, Zea mays
ggtaccctcggttcttggcgggacatttcccttcgtccccgcagaacagattgaagcggcgcaacctcgtcgccgtcctcgcctaaaaccttccgcctccccgcctctcgtccacgcgcgacgacgcgtcagcaagcaatcagttcaccccaaggtgctaaccccaattccccacctgttgcttcccgttttcgcctcacagttcccctctgtggctcctgtgagtcgaccaaatctagtcgtgcaaccccgattcccccgcgaacttgcgaagcgatggtggacgcgtggtggcctctgttgggcgcggcgttcccggcgctggtggcgggtcagttcatccgcaccaagcgccgccgcgacgaggagcagcgcctcaaggcggcgcgcgggcgggagaagagctccgacgaggtcttcgtctgcgagcgcgtgtgcacttccaagcgtatgctcaacaaggtaggggccttctccaaggaccccataccggagacctgcgtcaccgtgtgcggcgtctctgaactcgacgcctgcgccgacgcctgcgcgcgcaccgtctgcgtcaaccagcaccaggtgcccaactggaacgacgtctgcctcaagaggtgtcagagcgagtgcctcaaactctcttcaacgctaatgtaatggccatctcgctattgtgctgcgctccttagatgccaaccgtgaggttcttctctgttccgttctgcttctatccatatcatgcatcatgcttgaggaccttcagacactgataaccgaattggagcgagtgaatgtttctggtaaaaaaagaaaaaaaaaaaaaaaaaagcggcc

SEQ ID NO: 14854 - DNA, 974 bp, Zea mays
agggatgcgaactgaatgtcgaaacgaactttcagcccatttacagcccgacaccgtctccaggactccagccgacaccgtcttcagccaccatcatctccttcgccgcagaagagattggagctgaagagaggaagcagcgcgtcctcgcctaaagccctcgccgccctctttcggctcctcgcctctcgtccacgcgcgacgacgtgtcggcaaacactcagtccatcccaagactcgcgaggcgatggtggacgcgtggtggcctctgctgggcgcggcgatcccggcgctggtggcgggtcagtttgtccgcatcaagcgccgccgcgacgaggagcagcgcctcaaggcggcgcgcgggcgggagaagagctccgacgaggtattcgtctgcgagcgcgtgtgcacctccaagcgtatgctcaagaaggtaggggccttctccaaggaccccataccggagacctgcgtcaccgtctgcggcgtctctgaactcgacgcctgcgccgacgcttgcgcgcgcaccgtctgcgtcaaccagcaccaggtgcccaattggaacgacgtctgcctcaagaggtgccagagcgagtgcctcaaactctcctcaaacctcatgtaatgaccatctcgctattgtgctgcgctccttatataccaccccgtcaggttcttctctgcttctatccatatcatggttgaggaacttcagacgtcgataaccgtaatttatatatctcaaggaattggagtgagtgaatgtagctggtcaaggcggttatgtctttcattacattggctcttgcacatttctcttcggcagaatttgtttccctaccgaagatttgtttctctttggcagaatttgtttccaactaattgtgagtactaggtaccatatcctgtttttttgagtcaaaacaggacctctgagttctcccggatgaatgctgatttcgacattgattttt

SEQ ID NO: 14855 - DNA, 2834 bp, Zea mays
tataaattgactgattaacaagcatgacaagatcgaaaggcagagctccactttgttaaaaaaaggcatgacaaacatggtaaccaaggaatccacagtttttttacaaaatgaactacatgaatgtatgtgactcctaaccatgttcttttggagagattcttaaaatgtgtacatagacacgagctgttatttcttagacctttttttgttgctagagcattttacacatgcatgtaggcatgtacagataaaacttgggggatgtaactacattttattttttgttgcagagagtataatgatattacatagtgaattaaagcgtcagaggaagctcgtgaaaaatctgaagaagaaatccttgtggtctaggaccttggaagaggtaaattttcaaccatactcactcagttgttttatagtttatactgtaactgtatcctcgttagtctttgctaatatttacatgctaacaagacattttttggtggacatgctacacatattgttccttaccctcgaacatcttttgaagaatgctgatattgcatttgttatcctaataactgcagattgtggagaaacttgtggacatcgtaatatttttgcacaaacaaatccgagattcatttaacgaaactggtaaatagtagtactactagcttgtcgttttgttatttttaaatgtatctaacgataaacctaacacctcaggaactgacttctgcgcttccgagcaaactcagaacaaaaggctaggttcctgtggtctggcgctacattacgctaacattatcaaccaaattgaaaatatagtaagttgttctgatagcctacccaatgtctatttatgtctgcgtggtgtcccactttcattatattgtcatggcagcaatttccatatgggtcatccagaatacgtttcctgtcaatttgtcaaaccatggtctatccgttttctgtcccgtaccgtgtagagttgtgtactgtaaagtagtacgtgtgcttatatgtctgttgtatcgtagcagcagagcactagttaagaaagcattgtgcataccctgtatcaccggagtctacatttccaaacggctcgtgttgatgtgatgctttcattgattggagaggatggcattctcaaagtaccatttttgccatgcaggtttcccggcccctctctcttcctcctagtgcaagggacaatctgtaccatggtctcccaacaacagtgaagtcagctctgcgatcacgattgcaaacatataaccccgaagaagaggtttgtcttcttgcacaacacaacctcgcagagctcaaatgtttcatttcctccatgcgttttggcatgcattcaatgacttgtttatttaaattttcaaagtggcatacaaggacctgatttgactgctaattttggtgcatcctttcttgcacgctaacaagtggtgttccattgctgcagccctccgtagctcaaataaaagccgaaatgcagaaaactcttcgctggcttctgccgatagcagagaatacaataaggtgggctgagctttttttttttttaaaaaaaagttgtactctgacgatctgacttagactatagtgctaatgcgctaacagttgtttccttctgattcattcaccagggcacaccaaggttttggatgggtcggcgagtgggcaaatcttgggtgagtaccgaattgagaaaccatgattcttttttttttttttttgaaccttattatgatctccccatcgacaatgtagcgtaacatgttatgcttgcaccaccacctaacatgcatccaccttgctcgcaggagcgacatgagcaagaaatcaggctcccagcacagcgtcacccgcatccagacgctccatcacgccgacaaggcgaaaaccgagcactacatgctggagctggtggcgctcctccaccacctggtgatccaggtgaagaacagaggctacgggaccagcaaatcgtcgaggcacgacgcgtcgtcccggtcccgcaaggcggcggcgccggacctccgaccggagacggagactcggcacaacacgtcgccggtgaaacagccgcacggcctcgagcccgctgtcggactgcgagcgcgcggcgctggaccacctgagcttcaggaggacggcctacggcaggagccagagctgcgagcctccgcctggccaccgacggagcaaggcccacaggagctgggacccgtgccggagccacggcagctccccggcgacggagttcggcaggacccccgccgtgctgcagcgcggccggggcagggatcttgacgtgattgatggcctagatagactgccttcctactcgcacccgccctcccctacgttttgctagatgttaatttttcgattaggatgttctaggtaatggtctcgtgccacgcgtgatatgtccatatgtacatataccatagtcttgttatagcgtgtggtgattgaatcaaagtatatagagcgagatcacaagtggtgttccgatcatctggcctttggagagaaaaaaaatatcgatttgtctgaattctttttttcttcttctgaatttaacgaccaaatgatttgaacattgtaagttttcttcttcttctttctgttcagctttgttaggaagatacttggattgtcgaagcttagtttggaaggtactagtactgctaagcggtgaactgttcagcaaccccacaagctcccttttattagctccaaacattaatttagagatgataacactagaactgttgagcaacacggctcctccccaatcaaccctcaagagacacactcct

SEQ ID NO: 14856 - DNA, 1560 bp, Zea mays
  misc_feature (1494)..(1494): n is a, c, g, or t
cccccccgcctctatgcgttatccaaagagctgcatagcagcgcttctcccagccacgtcttcatcacacacggtcgcggcgcgaagcaatggcgaccacggcgccgctgctctcgccccagcgcgcttgccctacccatctccggcgccgcctctcgcccctacatctcgtattccccctcgacgcgtcagcgaggcggctgcgccttcgccgggcgccgccaccttgttcggccaagttcggcaagttcgacgcctccgacgccccggcggaggccgaggaggcggggggcgcgacggatggtgggctggcgcagcccgtggaggaggacgacagttgcttgccatcggatttggagggcgcgattcggcagtcagggaaggcgagcgcagatttcgtaaactccggaggcatgcgagctatcgcagaactgctgatccctcagttggaattcctcaacgaggaaggagcacaggctgaactctgggcgttgtcaaagattttcctggacacacttgtacaagagacaggacagaaagttactgccattttccctgacgctggagcagctgcccttctcaagcatcaatggaaagatgcacaattcaagtgtgccagtttaggtgaccggaagccagttggtcctgaagatgaggtcgcagttatgattatccctgatcatcagatgctggaagctgttgaacgcatcacatctcaactctctgatgatcctataagacctcttgtcatgtggaacccacggcttgttagtggagatgttggagtaggctttaatgtacggaatctgcggagaaatttcttaagcacttttaccactgtttactcgatgaggccattgccaactggtgcagtctttagatgctttccagggcagtggaaagtgttttatgatgatccaaataggccaaatcggtatttgcttgcccgagaactcacaagtaggcccgatgcaactgatattgagagaatatttggtggtgccgatgagcaatctgaagaggcaccatcgttgatgaacaatgtcatgggcgtgttcagttccgtgagtcggtttatgagggtcatctccaagtgagagtcgaagcaaacattgttcacacttgaagccatcaacaaccatcatgatgcttgagttatacaagaagattattttagtgcatccatgttgttttcagtctgtaattactccatggtactgctattcggaacagtatagtttggcgttccggcacatgccaccaaatgtgtgcacataccataccgtggattcctggagtcatctgctgatcctacaccgtgaggtcaattatgtaagtgtgacttagaaaaaaaatgtagatagatcctcattctggaaaaagccgggtatttgattgtaattcaatactgtgcttgatatatcacaatcagctcgcattttgtaattcaatactggacgaatataaattcaatcctttgttttactgctcccnttgaaatatgataaaaaaaaaaaatattaaaatgtaataatggtaatttgatttaaggggggggtt

SEQ ID NO: 14857 - DNA, 1345 bp, Zea mays
gcacgagaccattacctagaacatcctaatcgaaaacccacactcccctgcacacccaacccatccacatccactcgcccaagccggccttcgtccctgcccaacgctgcttcactctctccagcgatagatagcatcatcctctccacctgcacaggagacgacgaagcagcaccatcgtccgcggtcctttgcttcttctggcgccatgacgtcgccggtgccggagacgttcagcctgcaggaccagcagccgccgccgccgccgccagcggagcaggagcagatctgctacgtgcactgcagctactgcgacaccatcctcgcggtgggcgtgccgtgcagcagcctgttccagacggtcaccgtgcggtgcggccactgcgccaacctgctctacgtcaacctccgcgccctcctgctgccgccggcgacggcgcccgcggccgccaaccatctaccgcccttcggccaggctctcctctccccgacctcaccgcacggtctactcgatgctgagacgatgtcgtcgtcgtcgttccaagcgccgagcctgccgagcgctgaaccgccgagcgccgcctgcgtgagcggcatcacgagcatcaacaacaccgcctgcggtggcaacaacgccgcgtcggccatggcgccgccaccggccaaacctgcactgcacgagccgccgcagctgcccaggagcgcagcgtcagcgaacaagacttcagagaagcggcagagagttccttccgcatacaaccgtttcatcaaagatgagatccagcgcattaaggccagcaatcccgacatcactcacagggaagctttcagcgcggctgccaagaattgggcccatttcccacacatccatttcggcctcatgcccgatcagggtctgaagaagcaccccatgcaaactcaggagggagctgaatgcatgcttttcaaggacggtctatacgccgccgccgccgccgccacagcggcgtccagcatgggcatctctccattctgatgacttcagctccaccgcggaatggtctatagcgttctgcctctctgtgcgcgcctagccgcttagggttctgatgtctcagttccctcgttatctcccggttgcttgagtgagagatagcttcaatgtctatcccagccggagaatctcgaaatgtctctcagtacccatatatctctaatagttctcctcagtttccagcttcttactttgttaatttgttattatgcaacctctagagaggttgttatgtgtatgacgatgtgcggcctcttatctttatatggacataattcgagctggatattcggctgaaaaaaaaaaaaaaaa

SEQ ID NO: 14858 - DNA, 1443 bp, Zea mays
gcacgagaccattacctagaacatcctaatcgaaaataacacggaagctgacctgaatcctgctggtgccgctggtacacgagcccacacgatcgacgtctcaggttttgcgttcaatagctctattttgtgggatcctgagcggtggggacggccaacgtcattaccagacacttcacaggttagtccaaccccgcctttgtggacagagtgttagtgaccgagcaagtctagttcaattaaattttgctttggcatgatacaacgtactccctccgattttttttatttgacgtttgttagtataaagttgaactatctcaaataaaaaaatggagatagtacttagcatttagcaagctatggtatgtggttgactcagtgaagggactggttctcagatattagcaatctttggctgtccatctcttgagaatgtcgtcgtataaaaactctgaattgagattattaatttgaagatgaaatgttaagccattggcattagtaatttgaagtgttatgtcaaggaatggtttcatactctgaattgttttccttctgttacttgaaaaatgaaaggcatcagtttctaatataacagtgtctacgatgtgggctgtgattggcttgtatgtgttacaaggtcctgtaaaatcttcctttttcttgataaaaaacgtgctaaacacaatctcaaagaaaaaaaaaaaaaggcaagcggttggaacagactggatgctgaccttgtcaatggttcaagtcaatcgctgcaggtcaagcatgtccactcatgttccttctgaacaaggttcgggtatagtagataaattgtctggattcaattcatgatctttttttatctagaataatcactctcaacatatctcatgatctacttgtcatgtgcaagcaataagctaccaacagttagttactgatgtgattgcaggactcgatcaagttcgtgcaagaagtgctacttgaagaccgagctaagctgaaggggatcccctccgactgctcccagatcatggtgtggcagtacagcgtgcccagctcgcgatagagggcagccgagaggacgcacaagaggcgtcgcaacctcgcaggcaggggaagaactgcagggggttggatcggagtcgctgtaaatgtggtgggcgatggtaacggcaaggaaagcaagaaggctgattactaagggttctttttctctctctctcctttttgtgttccctttttctttcccctcagttttagttttcaggtttgggaggggggccatgaatgatgaactgtccgtgggagcaaaagaattgcgatagtatttattcagattcatttgtgattctttagcctggtcggttggtcctgttgtgtttgggttaaaaaaaatggcagtggcgtgaggaatggagaaagtttttattgtgttatggcctg

SEQ ID NO: 14859 - DNA, 3460 bp, Zea mays
  misc_feature (895)..(895): n is a, c, g, or t
ttgcaattccagctcataaattccggttctttttttttccccaccgactaggactacgactagggactcctcataactaatcatcgtttcttaattcagtaccataagttattttatttactcgtctaaataaatgctttattagccgtgtagtttggtacataaataaataattaaaaacataagctatcattagcgggggaataagggtgggacaatgtgtgtctcgcatgtacttaccaaactattcttcttaatgctctgaagggggaaaaaagggaggaggcactgtagattctcagagaacttcaactattctctccatttctctgatgcgaggagtcaattattggatctagcttatcactttcctgagtccctttcgcccccaccaaacaatgcttcttttaatctttcgcttttgctcacccccaaggccccaacggacaaatgtgttcatgccaaccaccccaactagtttaatttagactttaaacacgtatcatgagcaaagccacaattattttatgtggtagtggtagcactgctgttagtcactgacaaatgggcctgtaagagtgtcggtggcacctaacagattggaaagtcagtgagaacatgacatccttgaattgactcctgagatgttgttactcctatactggggaagcaacatgctggggggaaatagctacagcctacaaaagatagcaggcagggagaaaaatagtagtaaccgttatgccatggccattgaaactgattgaactaaagtggagagaaggtcctagttctatccacaccattaatttcttcctccaaccccataatgtccatctgatatacaccgcagaaagttgcccacgtattcggtgcagttttcctatactggtgnacacagcaccacctgtgatctagatcttctggagcccgcaagaaactccaaaaagaacttcgtttgcaaaatggcagtatgaatcttcatttctgtgcagaccaccagttgtctttggagatttttctcatgaggagtttggaaagtcttgcaaaaatgagatttcacatttcattttaccaacatttgatgttgattattgggtttcttacttgcatgaccatgaattctcatcagagtatgaaatccagtatttccaccagagcatgacactagtatagcatctgaagtttgtccggaccgcccctttaacccctttgcttatccatctgaacattgttagcggatgctgttacaagtttagatgcttatagatataaagcaatctacatttcaaaaaaaaaaatacatgcataaagcaatcttactcagcatcaaattccgaaaccttttgcctcttaacttgaaaacacatcaacatttgactcaccttttgcattcacttttcccgatggtagcgttctttcattgatgggtgcttgctttcataaagagaggggatcagaccttggtttagtacaatggtactagtagatcactactacagtagtgctcatgccacgtggtagcacagtggcgatcttccctggaagaacagtctttttcgcttagaggaacatgatggggtaaaaacagcctcttttcctcaagcaagattttacctgcacctgggcaccaaaacatctgtgcttgtttttctagtttgccttctcttttttgtgtgtgtgtcccttttaatctttacagtcctcgagatgcgtgcacatctgcctttgtggcccctgatgctttttgtggggctccagcataataatgcaacagaggtaggagcatcaattatgccttgtcgcacgtaggtcatagcatgcctgtcctagaactaccagccaccagaaacaaatgagtgcaggtgaacactacagtgactataagtgtggtttactatactaattggctgggttttgaccgcagttaatgtttcttgcgtctggttgagatttagcattggattcttttaatcctaggaggctgaaatttggttacggtttaccttaatgtttgaataagctcgtttgttccagttgagttttactatacctatgtagttgtgtttgactgcatattgggaacacgtctgcttactcaagtttccattgatcgtgaaccgttgcatcatcccgtagtttgtttgatctggatttgtcaagattattcaaactctggaattggtagtggaacaaattaggcatctgcatgtgcagccgtgcaggcaagtggagggtgtagctgtactgtatagtttacatgcaataactcagtctattccttgtatgaaatgatttggatgagcggtcaaaactatagtagtcagcatgttaaagatgtgtcaatggaggtatcccctcctatcacatgttctttcgagttgaggaaaatcagatgcgtctgtttttttcttccttcgaattaaaatcaattggctgatgtgtggttagtggtgccattctagtcaaggtttggtggcacaatgcttttcaattccataatccataattcttctgacccagtcaagatgagacacatagatcacaggcaaagctacctcttgtgtcacacatgttttggtgcatgttgcatggttcttgttgaatttcatctcagatgttggtgcctttagatgtttttttttctaacatttcaaaatgcgcgcgtcctttggtacatggcctgtggcaacaatgtcggcgggcgagaagaaagtggtagtggagggtccactgtgcagtgcctcaaaggtcgtcggttggttctcaagggacttcaacgacgggaccacccgttcagtgacgtataacacggaagctgacctgaatcctgctggtgccgctggtacacgagcccacacgatcgacgtctcaggttttgcgttcaatagctctattttgtgggatcctgagcggtggggacggccaacgtcattaccagacacttcacaggactcgatcaagttcgtgcaagaagtgctacttgaagaccgagctaagctgaaggggatcccctccgactgctcccagatcatggtgtggcagtacagcgtgcccagctcgcgatagagggcagccgagaggacgcacaagaggcgtcgcaacctcgcaggcaggggaagaactgcagggggttggatcggagtcgctgtaaatgtggtgggcgatggtaacggcaaggaaagcaagaaggctgattactaagggttctttttctctctctctcctttttgtgttccctttttctttcccctcagttttagttttcaggtttgggaggggggccatgaatgatgaactgtccgtgggagcaaaagaattgcgatagtatttattcagattcatttgtgattctttagcctggtcggttggtcctgttgtgtttgggttaaaaaaaatggcagtggcgtgaggaatggagaaagtttttattgtgttatggcaaaaaaaaaaagcggcc

SEQ ID NO: 14860 - DNA, 3120 bp, Zea mays
  misc_feature (16)..(16): n is a, c, g, or t
gcacgagaccattacntagaacatcctaatcgaaaagcctagcacccacctgtcccccgcagattcgctcgggaatccgtccaagactccaagtagccaaccatatcgcaactgctgctccccgccggcagcgtcagcggcgacttctccctccgctcccctctctctttcgctcgccttatcgcccttctctcgcccgcgacggggaggtccgccgttccgatcactaccccttcgcgccgctgacctcagaggaggaggcatgaggctgctgccgagggaggcggacaaattggcgctgcacaatgccggcttcctcgcgcagaagcgccttgcccggggcctccgcctcaactacaccgaggccgtcgcgctcatcgccgcgcagattcttgagcttattcgcgatggagacaaaaccgtgacagacctcatggacctggggaaacaactattgggcaggagacaagttcttccagctgttccataccttttacatactgtgcaggttgaaggaacatttgtggatggaacaaaactagttactgtacacgaccctatctccttggatgacggaaatttggagctagcattgcatggttcttttctcccagtgccttcacctgaaaagttttccagcgatgatgttgaagaatatcctggtgaaatacattacagttctagtcgcatagtcctaaaccttcatcgcagggctttatctctgaaggttgttaacaaggcagacagacccattcagattggaagccattaccattttatagagaccaatccttatctggtttttgataggaaaagggcctatggcatgaggttgaacatacttgctggaacagctgttcggtttgagccaggggatgcaaaaagtgttatacttgtaagcatcggaggtcataagttaatcaaaggtggaaatggcattgctgatggtcctattgacagttcaagtcttaatgtggtgatgcagaaggttaatgcaaatagttttggacatgaagattatccagatgcaagggaaggtattattggtgatggttcatttgactgtactgttgatcatgagaagtatgcgagcatttatggacctaccaccggtgataagattaggcttggtgataccaatctttatgctgagattgaaaaggacttcgccttttatggtgatgagtgcatatttggcggtggaaaagttctgcgtgatggcatgggacaagcttcagggtacccagaatctttctgcctagatacagttataacaaatgctgttgtgattgattataccggaatatacaaggctgatatcggtataaaaggtggacttatagttgctattggaaaggctggaaaccctgatgtcatggatggtgtccataacaacatgattgttggggtcaatactgaagttattgcatctgaaggcatgattgtcactgctggtggcatagattgccatgtccactttatatgtcctcagttggcagaagaggcaattgcaagcggcatcacgacattggtgggtggtggaaccggaccagcacatggaacttgtgccacaacttgcactccagcaccatctcaattgaaattaatgttgcagtccactgatcaattgccaattaacatgggattcacaggcaagggaaatacttcaaaacctgaaggattggctgaaatcattaaagctggagcaatgggtttgaagctgcatgaagattggggaactaccccatccgcgatagataattgtttatctgttgcagaagattttgatattcaggtcaatatacacacagataccttaaatgaatcaggctgcgtggagcatacaatcgcagcttttaaaggtagagccatacatacatatcacagtgaaggtgctggtggcggtcatgctccagacatcatcaaagtttgtggggtaaaaaatgtgttgccctcttcaacaaatcctacccggccatttacttcgaacactgtagacgagcaccttgatatgctgatggtttgtcaccaccttgataaaaacattccagaagatgtagcatttgccgagtctagaattcgagctgaaacaattgctgctgaggacatattgcatgacatgggagccataagtattatatcatctgattcacaggccatggggcgcgttggagaggtgataacacgaacatggcaaactgcaaacaagatgaaggtacaaagaggtagtttacctggatctggtgacgctaatgccgccccggacagtgacaacctccgtataagaagatacatagcaaaatacacaataaatccagcaatagtgaacgggttttcagactttgttggttctgttgaggtgggaaaattagctgaccttgttctttggaaaccatctttcttcggcgctaaaccagaactggttgtaaagggaggtgcaattgcatgggctaacatgggtgatcccaatgctagcattccaacacctgaacctgttgtgatgcgacctatgtttggtgcatttggaaaggctggaagttccaattcaattgcatttgtgagcaaggctgctaaagaagctggtgtcgcaacggagtacagactagaaaagagggtggaagctgtaggccgtgttcgaggcctgacaaagcttgacatgaagctcaacgacgccctcccgaaaatagaggtcgacccggagacctacacagtgaccgctgatggagaggttttgacatgccaaccagcacccacactgccactgtctcggaattacttcctgttctagaaagccactgcatcagcaaaccaccaccactactcacgccctatgcatgcacatcgtcatatacgagtataaaagatgcaagttcaattctgtacgctaccctctttttaataatatggccaatgagcaaattctttggcagcaaaaaaaaaaaaaaaactgctatctgcagatgctcgcatatttgtgcggaataaaacttggaacggtgtagatttctgttccctgctccaaatgtggctatacatactgttgtatttgccgagttgttatcttctcccatgttgtcaaggttgccacgtaaaaaaaaaaaaaaaaaaagaaattaaaaa

SEQ ID NO: 14861 - DNA, 1527 bp, Zea mays
  misc_feature (1453)..(1453): n is a, c, g, or t
cttcggtatgtgttcgttgattctcatctcagtgactcagtgcacatatcttcagtagaagatgcacatgcatgtacagctggaacaatggttccaaagattgccgacccagctccaagatttcgcggcgagcggtgcctgcctacctaccgtgacgggcgcgcatgcacgcatgccgataaggtagcgcacgtcactgaccgacctcctcgccctagcggagtcgtgctcgtgtgtgtcccagactcccagtctccctttcaaagcctcgcacacacgacgctagtcgtactgtgtacatacacatacaccacttgcccgagagtcgaaggtgccaagccaacgcaggtgcagatggcggccgagcaccacctcccgccggagcacgcggaccaccacagaggcgggaggaagggggtccgcgccgacgacctgaagccgggctggtggcgccgcagcccccggtacagctactactacggcgggggcgagggcgggggcgcggtccgcgccctctgcttcgccgtcctcgtcctgctcctggccgcggggatcaccctgctggtgctctacgtcgtgtaccgcccgtcccaccccaccttcgccgtcacctcggccgccgtgctggcgctgtacaacgccaccgccaacgtcgccgcgggcgcgggcgcgggcccggcgccggccaccgcgctggccgcgtcgttccagttcacgctggtgctcggcaacccgagcgggcggtcggcggcgcggtacgaccggctggcggcgtacgtggcgtaccgcggggaggccgtgacggcgccgacgcccatgcccccgctggcgcaggacgccggcaccgccgtggcggcggcgcccgtgctgggggcgggcgtcgcggcgcccgtgcccgtgtcgcccgacgccgcggcggcgctggcggcggacgtggccaacgccgtgctgccgctccgggtggtgctgctcggccgcgtccggttcgtgcacgaaccgttccaccgggggtggcgctcgctctacgcccgctgcgacctcctcatcggcgtccgcaagatcgggatcgggaacggcggcgccgccggcggtgtgcccctggcgccgcttcttggtgacccgagctgcaacgtcgacatgtgaatgtgtgatggatcccgtcgtgtagcaatctacgtgcatggtatatatgcgtgaatgttcgtctctgcgtatgtgatctgtgtatgcaaaggcaagattacatgtacgacgcgccagaaacaaataacgagtggtaatgtaatgcttcatagcagtggtatgcagactgccaagacctttctattctgtcacttattaatatgcgtatatgtacatgtacatactcgtgtactcgcccctctgttggcctgggaaagatttaggaccgtgcaggaattgacccccccaaataaaaataaacccccccatnaaagggcggccgccgactagagggcacgtcgccccggcaataattccggccggaacctcccgcgcccagctttc

SEQ ID NO: 14862 - DNA, 1294 bp, Zea mays
gcacgagcccacagttcggatcccggaggaggtgcaccgcggccggggcggcaccgcggcacacgagccggctagccgcgactgtctagtatgactgtacgagacacggcggtagtggcagctggcaggaagggagatgattaaaaataccgtggccacgctgatggtgcgcctccaccacctgcccctgccccgcgccgcgcccgctcccacctaccgttgcggccgccacctcgccctcgcgccccctctccctcggctgcgggcatcggccgccgtcatgtcaacggcggcggaacagacgatcgccgaccagaagcgcacgctgcgcgccgaggtgcgcagggcgctgaaggccctctctgccgaccagcgcgccagcgaagatctggctattcaaactacaatactggattcctcttggttcaaagcaagcaaacggttgtgcgcttatataagctgtcagcagttgcgagaagttgatacatcaaaaatactagcagagtgtctaccgtcgaatcctggacaagaggaactggcaaaggatctttatgttcctcgagtggaggataagaaccgtaacatgaggatgctcaaaatcaccaccactggatgatttagttaagaattcaatgaacattctggaaccatcgcctgtggatgctactgggaacaatcgtgaagatgtattgtcatcattgtctcctgttgatctttttttattgccgggacaagcttttgatagaactggtcgaagactggggcgtggtggagggtactatgacacattcttgctgaagtaccaagaacttgcaaaagagaaagggtggaaccagcctctcttagttgctctttcgtactcggtgcaaattatggacgagggcatcatcccagtcaattcaactgatgttcctattgatgctctggtctcatcctctggtgttattccaataagtgatgcggcgttgcagaggatgcaatgaagttgattggcctctgtagccatgctttgacaagaagcaccttcttctgatccctggttgcactagcaaatacaccagcagatctgggaaactgtctctttttttcccctcgtggctcctctcttgtattgtatcatcttttacgttttaacagggtgaactggacgtctacatcttattccagccacttcagatttatagattttataatgtaaaccgtcgagctgaccttttgttgaggcatctgtagacaaatcttatttaggctttgttcggttaatcctgttaccccggttaaaacggacgcgtgg

SEQ ID NO: 14863 - DNA, 1325 bp, Zea mays
atcccggaggaggtgcaccgcggccggggcggcaccgcggcacacgagccggctagccgcgactgtctagtacgactgtacgagacacggcggtagtggcagctggcaggaagggagatgattaaaaataccgtggccacgctgatggtgcgcctccaccacctgcccctgcccctgccccgcgccgcgcccgctcccacctaccgttgccgccgccacctcgccctcgcgccccctctccctcggctgcgggcatcggccgccgtcatgtcaacggcggcggaacagacgatcgccgaccagaagcgcacgctgcgcgccgaggtgcgcagggcgctgaaggccctctctgccgaccagcgcgccagcgaagatctggctattcaaactacaatactggattcctcttggttcaaagcaagcaaacggttgtgcgcttatataagctgtcagcagttgcgagaagttgatacatcaaaaatactagcagagtgtctaccgtcgaatcctggacaagaggaactggcaaaggatctttatgttcctcgagtggaggataagaaccgtaatatgaggatgctcaaaatcaccaccatggatgatttagttaagaattcaatgaacattctggaaccatcgcctgtggatgctactgggaacaatcgtgaagatgtattgtcatcattgtctcctgttgatctttttttattgccgggacaagcttttgatagaactggtcgaagactggggcgtggtggagggtactatgacacattcttgctgaagtaccaagaacttgcaaaagagaaagggtggaaccagcctctcttagttgctctttcgtactcggtgcaaattatggacgagggcatcatcccagtcaattcaactgatgttcctattgatgctctggtctcatcctctggtgttattacaataagtgctgcggcgttgcagaggatgcaatgaagttgattggccctctgtagccatgctttgacaagaagcaccttcttctggtccctggttgcactagcaaatacaccagcagatcagggaaactgtctcttttttccccctcgtggctcctgtcttgtatcatcttttacgttttaacagggtgaactggacgtctacgtcttattccagccacttcagatttatagatttataatgtaaaccgtcgagctgaccaaaacagtcagtagacttgacatgggattcggagtttggtcgtcttgtatcttgaaagcttacgtcttcaggggactagccagtcgcctcaaaaggagataaataacaaaacttcatccgattttttgttg

SEQ ID NO: 14864 - DNA, 2240 bp, Zea mays
  misc_feature (1089)..(1089): n is a, c, g, or t
acttcaaaaaaagatagatatatacatcaacttttggctaaccctgaacctttgattgtattacctctgcaattggagagaaacctgacactatccattagccatccaatgatgatctgccacacaaaaaacaaacctattacatgaacttgcccctacgcctccgcctccaaacttgcttggtctccatgatcttctcaacctatgccttcttatttgatgactagagcacaacagctgccacaacaaaaaaatgaattgcatagcacaatgataagagataaaaaagcagcggtaacatacctgcatttcgtctagctatatgtccataaacaaggtctgcaaaaacaaattcaaaaaaaagtcataacatgcatggcctcttaaaaaaagctcctcttgcatcaccccaaaaaagtggtctactgcctttgctgcaaaaaacatcatatagaacaaagccatgggcacctaaatttatgtgccaatgcaaaaaaacaactgatcataattttgtttcccttttgcaggttcatgaagatgacactaccaagactgtcagagaaaataacatattctcgcaagatgaaatcaacaattttcaacagtatatattgcgaataattggaagtagtcaggtagctatatctcaattctagaaattacagttgaaaaagataatctattcacatgtttaaaaactgacttttgtgatttttatgaatgcataaacaaaaatatagatggctggaacctctttgactcagagtggaacaacacaatcaccaggcagtcagatgtgcacacaaatgtcgttcccatatgtgtcaaaccaggtaataaaaaatgcacgaaaaccccagccaccctacacacacaaaaaataatatgcacctatcacagaaaatataatatgaatatttgattgagccttgatgattatgcaggggggatacatggacctgatgatggaacagatacgtaactcacaaggagaatcagcaagtgatgaatgcaatgaaatgcatagtggcatggacacacaaaatgaaaccatgaacaacaccacactagaaaagccatgggagncatacacacaaatgattcttgagagcgacaccctgcttgcagatgcaatccggtccacccgggggcggggcccggcggcggaacccaataaacatatgcagcataactcagaggagaatacatacaagaattttgaagtggatggatgttcaagtgcatacgctgaggtacgaaatcatccatctcgaaaactccaaatgatctgatcatgcagacaaatacacatttgagaacaaaacaaaacaaaaaaaaataaactaacaactaacaaaaataacgggtatttatgtaggagacatttgggggatgcattgaagccggtgcatctaaatatggtgaagcagtataccacagagatctctttgaaggaatgcatgtagaacaactacctgattgtgcaccaaatgtagatggaagggcagttgaaacatcaagtgctcgtgaaaactttgatgctgcagaatttaaaaaaacagatggaagtgaagaagagttaacagaggatcagatcgatgccttcattatgagtgagcagatagctgcatcagaagggaacaatgcaccaatagacagcaaatacacacctcaagttgggatggaatttaagaccaggggagatgcagagcacttcttattcttctatgggtttttggctggttttaaaccagcaatcacccacactttcaggacttccaacaaaaaaagaagcaatgaagtaacaaaggtggagctgaaatgtaacaaacatggcaaaacaaaaaagacaaaccagcaggaacaagatatttgcatagaaaaaaagcgctgcgagaaagggccaaaaaggaatacaaatgtccaagttaaaacagattgcagagtattcatggttataaaggaacatggacaaaaatgggtgatcgataagttagacttggaacacaatcatgagctcagaccagcagacaacaacaacatgtttagtgggcataagtacatgacagatatggaaaaaggaattataagaacattgaactacaacaacatacctacacggaagatgattgctatattgtcttatctgagaggaggtatgaaaacattgccgtaaaaaaaagatgttagcaactacagaactaaaataaacaaggaagtaacaggaatgatatgac

SEQ ID NO: 14865 - DNA, 3878 bp, Zea mays
gcactttacataggatattattcttcatttagttttgttcttgtctcatcaccttacctcaaaaagtcctttcttttattcccttcccagtaactaagcacaaaatcattttgacaaaatgtcatacccgcaaacaaactaaagaaaaaaaatgatggaaaacatgatgactgcatgttcattcactccacgtatggacagcgtccaaaaccctggcagcacatgcaggatccactgctttacaatccctgaacctgaacactagcttatgtgaccaaagaaaaaaaaggaagagtaaaaaggaaaagtagaacatggtcggatctggatgaaaagaatgctcagcacatcagcctcatcgccagaccaacaggacataaacatccagaatgctacggcatcatggctcgtaagaaaccgaagacagctgaccagcatggagtcatggacaagtcccccaaatcccccacttatccttccaccagcctaggggcttccagcaattgttatgcagctgtatagcaagaagcccctgaatatctatggtctaaaataaatagattgtccaaccttttcctgagtgccccctgcaatccactatagagcacctggtgagatatggttatttcgataccgcaggggttccaaaaaataaactattctagcgtttcaacgtttggatttgaagctatctgtgaccctcctcagtctttccaccaagacaggaatgtcctcctcactcaatgttgtgaagcaacacctgaaccatccaggctcaatgcaatggcaagaagaacctggggtaacgttgacctttgcttcctccaacagcctatcccagagcttgcgctctcctttctcgctgtaagatcggatgtacctgctcatgtctgcccagcaatagaacccgccgctgctcttgaagcattctatcccaagttgtttcaaagcatcagaaaacagaaggtacattttccggagcctctctctgttaacctttatgtattctgaaataaacttttgatctgaaagcatggaaacaagcaaacgttgtgttggacttgagacagatgaaaatcgagcaatcttagcagcagccgatacaatgtgttcattgtaggaatatatcactccaactcgaaacccggcaagagataggtcttttgagagcccatatatgatatgaactctgcctttatcaaagtcctctagttcatccacaacatctgccacgctaacaaacttgtcacttccatatgttgaaccagcaaatatttcatcagaaattaagtgtatgttcttctctgcagcaaactgtagaaggtcatgcagtatttcttttggcacaatgcctcctgttgggttggaagggttagatatgagaaccccacgaactcttattcctcgcttttttgcctgtttgtaagctatttcaagagcagtgacactgacattaaagttatcagtactacgacaaggaacaggtatcaactcaacaccagttcgccattttatgtccctatcccaactgcaaaaacaaagtgacgaagtcagttcatcactttaaaatcaaaatcatgaacagaaatgtatcaacagagcaagagagacaaaattaccccgggtagtaaggtgatggcacaagaaatgcatttcctggatcagcaatacagaaactcagtatttccattgcaggagttgccccacatgtaatcaccatttgagatggatcaaaggatactgatccatgcatggtctgccgcatgaatccagcaagagcctgaaagagaaattgagttcatatttggaaattaccacaccataagataatactcgtcggaatccatggaagttgatcactaatccgcacatgtacttgctccagttttccatgaaactttcacagaacaggtcaattagttcactgaaggatccaacttgaattaagttcactagataacaatgataaaaaaaatggaaaataagctaagagggaaatataaaacggcaggcctgatgcagttatgagagctgtctcactgaatcggactcaaaacagtctctcctcgtttgcatagagaaggctgcctaggtttatcccttttttaaacccaacatatttgggagccttgggcatcgggtctaccctttaagctaaaagagaaatataaatggttccgatacagtaaacagaatcatattgaccagcttcagttgggaagtaggtgctttagcagcatagcactcaacattagacaatttcatacgaagcagaataatacaacgtaaaatctattgtcaaattcaaaaaaataaaaggagtggaagccacacacaatttcattttcctgataccggcttctactgtttctataatgtttttgtctctatggattgcagcagtccaaacagctggctttaatcgaaaaggtctactaaggagattcaagctcggtcccctgacgcaattccagccaccgtggatccatatgcctgcctaaaatggtgactatttgtcgtgtctggttgggataacacatgtatggctaggaaaaatctgaaggacgaagaaacaaacaaaattacacggtagcatgggagttgagtacaataatacccaacctcgggtttagatgctgacttcactttgatattttctccaattcaattattaactgatactgttgtctggttgaggtacctctgcctaggatgatcccctaaacgaaaacagcaccctaaaaagtgccaatacaacagacactgcttgtcggagaggaaaggaacaatccatcatattactccacaggatgaatgaagcagtatcgcatcctaaagtagtgaagattggcaaactttttcatggtcgatgtaaccgaggcgtcggcagcacagcaagaataggggatgtgtgtgtttttttagggacgggggatcaaacaaaaagaaagaaaaagggcgattcagagcgggatccgttagcctaccatcttcaaggcaagtatcccatcgtagggctggtaggttgcgagccccctgatggtgaggtccctgacctcgtccccggctgccgcgaggccgtccagcatcgccgcccccgcgtgctcctccatccaccgccccaccaaatccagcgacagctgcgcgcgcgcgcgcggagtcaggcgggccatccatcagtacagaaaaatcagggaagcggataacaaaatagagtatccatgagacgatccgtacgtggttctcggcgaggccgaggttgacgacaccgtcggggttggacgcggggtggtaagggtcggcggcgcaccgacggagaccggcgtagtagagcgagtcctcgtccccggcccgcacgacggccccgcgcgcggagagcgacggcagcgcggcgcgcggcgtgaggaggccccgcgagtgggagcggaggatcggggaggcggccgcgggcggcggggagcccggcgccggcgccggcgccggcgccggcgcggggcggttgcgcttgatgtagagctggaagaagtagaagagcgcgcaggggatgagggagccgagcaccaggccgccccggccctgcaccaccccctgcagcggcaccacgatgcgcatcccgccgtcggcgcgcggccgcggccgcgggtcgcgtgacggcttcctcttcgtcctcgtcgcgcgggatgtcgcgtggccgtcgtcgtcgccgtcgccgccgtccctcatgggcgcggcggcagcccgtgccgcggcgtcgtggtgtggagcgcgcgccggcgccggggcggcggcagcataggcgggtggtgggagggaggcgggattgggttggcgcgggcggggggatttgcgggtttgggtgggggccaattcgcgcgggg

SEQ ID NO: 14866 - DNA, 3324 bp, Zea mays
aataacactattaaaattggtaagacatttttttcatgctcattgtcttatggccgtagtttgttgtacaacctggcttcttatatttttttgtgtatttggtacctagcctagcctgtaaaaatattgaacaattaatttagcttactttatcttggcaatggaacacctttctttacttgttcgactgaggttgctttgtctgatgattgttgcatgcatcttctgctgttgcttgtttagctcaaggatatggctgaaagactacctccagatcagggagcctatgatggtagcgaagcaaaacaagcacatgttccaaatggcattgagatgtatgcttctatttacactagcatgaatggtattcatcagccacgaaatgagtctgtcagtgccctaagcacgcctggcctgcatattggacgatcatcgcacccaaatggaatctcaaatcatcatcaatcaccaggaagtattactgaaaacagtgaagtgagtgctcacacccatagggtttcaggtcctcccgacgttgaaaatccgaatcgaaggggacatagcagtagtgacgagatgctcagtgcaagtagtagagcagacgatagtagcagcagggacgctagatcccttttgaatggtgaggatggttacaaatctcggagtgcagtatctttgcccagcaaccaagttcaggctgagtggattgagcagtatgaaccaggtgtatacataacactgacaactcttcgtgatgggacccgagatctaaagcgtgtacgcttcaggtaacttgtttcctgtcgtcttccttttcccctgtttgtgtttattttttaattaaaaacattaatagtgactaaaatagaaaaggtagttttttttctttccaaattgagctacaaggtcacctctggcatagaccatattggcatattgtaagacacggcatagaagccagtgtgtttctacaagagtaatattatatcataatttgtgctcaatgctttatgcaatatattttcaataatgaatcatcaaagctgtacaagattgcttatactgaatcatgccatagaccatgaaaggatcttgtcatgatccatgcaagggttctttgcttatgtgttcatctgttggcacaaagaagcatctgattttaccagcgttatttgcctattgttccaagttaccggtgtcattgtttcgtctcaaattctgtgcagtcgaaggcgttttggggagcatcaggcggagagctggtggaacgagaaccgcgacaaggtctatgagaagtacaatgtaaggagctccgaacgagtctcgtcggcatcatcgatccggtcaggtcgatgacccctccctcctccgtaccacactaccctgcagtggtcatcagaaaacttcaagtgggagcgcagagccaaagtcagagtggcaagggtgccgaggaattcttttttgtccgtgtaatgtcgataattcttgttactgttgttgtgaaattgagtcagtgggacttgttaggttgtcttgttcagatgtaatgcacatagagttgtggaacaccgaaacatgttgtagggggtggggcggtagcagagggtggacagtaacagtagcgcgcccagccctctacggcctaccctttgaaagccttggttgtagccaatgcagctagctgtaaagaagtggcatttttttttgtctccaaaaggtgtcactcatcacattttggctatattacatttgatgacattcaaaatattcggatccagtagcacctcatattcccaccccacatcatctgagttcccctcttcaaactagtggttgtagatgctgagctgaaactgacgttgaagagagtgtagatgctggagctgaaactgaaattgttaagatgatcacatactgatagagctgtaaatgttatggatattatctgtctgtatttgaatttaagttccgtctaaaagagctgagataatcaactagataagataatcagtggtcgtacgtacacagttacacacagcgctcgagtgctcaatttatcaaacgtacaagcacaacacacggaccaagtgctaaactgattaaactataattaacctttcagcattcgacaataagctagccaataactaatacgcacaagttcaatcatgtgctggatgtggcacatgggctcagcggggaggcaggggcttgagtgcttcaccagatgcaagacagtgcctgccgaggcaatgaccgcaaaccggcgatcgaagatattgtttttgacacattgaacctaaagcaaaaaacctctaatatagcaggttagagacgtataagacctatggacgtgttcttaatagactccaacgtaatatacggtccaacaaaacaaaacatggtaacatagtatcagagtagaatctggatgttgtattgtttcgacaatttccattggttccaaaggagttttaaagtgagactagttaggttaaaaagtatatccccttatctttccatcgatataaaaatcgttgaaacaaagtctatatgcatcataagcatcaattttggtgagaactagtcctgaagttcgaagtcgagttgggtttgactctcgcgtgatgtagctgtcctatccaaccctcctcaaccttctgatctttacaagtttgtgtcggtccacttaggtttttaatcaacaaaaatgctctccactaacactaagattagaaaaataattaactagaaaagaatatacctagagattcaaatgacatgctcgcactattgtaattggaccttgaaatgtttctataccactatataatccaccggtttaaattttgcaaaacacacctaatcaaatcatccatgcacccataacctccactaaatccacaaaacaaattgcacccagtcttaacacacatcaaaaccaacgattcagatcgctgcataatccctatctcttacccactcaaatttaatgaacaatattatttgtattatctctcgtccctctccctcccccacgacccgtcacccactcgtgatgtcgccatcaacctctcccctcgcaccgtggtcgatcccttccctcatctctctaggattgtaacgtcagtacaggctatatgctaatttaagaaagtgatcctcgacaccatattatagcctcattcttacgaagaaatctccactctctatagcctcaattttagaatacctatcatccttccaaaaaatagtggagacaatccatctacctcctcaatgtgagtttaaaagttttcgccaaagtagaccaaaaaatagact

SEQ ID NO: 14867 - DNA, 2342 bp, Zea mays
gcacgagagagagctcactagtccccccccccccccttcacctgaggatacaggtttgagtggcaaacatatatcagggttctatgaggaataccccatccttaaatcagagtatgttcagaatcttgttactgtcactgtgaggagagacattgaagcgcataaaagacttgtggaatttgacactgatattcctggagaagttatcattcattggggagtttgcagagacaatactatgacatgggagatcccaccagaaccacatccaccaaaaacgaaaatattccgacacaaagctcttcaaactttgctgcagcaaaaagctgatggagcaggaaactcaatttcattctcacttgatgcagagtattcttgtctgttttttgtgctcaaacttgacgagtatacttggttgagaaatcttgagaatggatctgatttctatgtgccacttacaagagtggggcagtatggcagcactcaggatcctgacaaggctgaggcacagaaaatagaggataagtcttcacaggctgatggcttaatcagtgatataagaaatctggtggttggcctatcgtctagaagaggtcagaaagctaagaataaagttcttcaagaggacatcctacaagaaatcgaaagacttgcagcagaagcttatagcattttcaggagccccactattgattccgtagatgaatctgtacagctcgatgacacattaagcgcaaagccagcatgttctggcactggatctggttttgagatattgtgccaaggatttaactgggaatctcataaatcagggaaatggtatgttgagcttggcacaaaggccaaggagttgtcgtccttgggtttcaccattgtctggtcaccaccaccaactgattctgtgtcacctgaaggatacatgccaagggatctatataatctaaactcacgatatgggtccatggatgagctgaaggaacttgtgaagattttccatgaagctggtatcaaggttcttggcgacgctgttctaaatcataggtgtgctcagtttcagaacaacaatggtgtctggaatatatttggtggtcgtatgaactgggatgatcgagcagttgttgctgatgatccacatttccagggaagaggaaacaagagcagtggagataatttccatgcagcaccaaacattgatcactcccaagagtttgtgaggaatgatcttaaagaatggctttgctggatgagaaaggaagtcggctacgatggatggagacttgactttgttcgtggtttctggggtggatatgtcaaggactatttggaagcaagtgaaccatactttgcagtaggagagtactgggactccctcagttatacttatggtgaaatggactacaatcaggatgcccacaggcagagaattgttgattggataaatgctacaaatggaactgctggcgcatttgatgttaccactaaaggaatacttcatgcggcgcttgaaagatcagagtattggcgcctgtccgatgaaaaagggaaaccccctggagtattgggttggtggccttcaagagcagtcacatttatagagaatcatgatactggttctactcagggccattggaggttcccctatggtatggaactgcaaggatacgcctacatcctgacacaccctggcactcccgcagtcttctatgaccacatattttcacacttacaaccagagatcgctaaatttatttccattcgacaccgtcaaaagattcattgccgcagcaagatcaagatactaaaggcagagaggagtttatatgcggctgaaattgatgagaaggtaacaatgaaaatcggatcagaacattttgagccaagcggtccccagaactggattgttgctgctgagggtcaagattacaaaatctgggaagcgtcttcatagacttggcgggctgcgagtgccatataactgctcaaagactaaaaaggaagctacaagaaagcataatgctaggagatggcgcctcagaatggtcagctggcgggagctgctgccgctgccgccatggagcagcaaaattcaacaacataagctatggaagcacttgccacggcgataggattatctaataggactactgttgaacattcgatatatccagaaccacccatcatttgcaggcacattggccattaaaatttagcttcgtcctctattttggagctatgtaaaagcatgcacaactctatttatgtgtgaaataaaatttgaatcttcatcaaagaaaaaaaaaaaaaaaaaaactcgagggggggcccggtgctgattctacatt

SEQ ID NO: 14868 - DNA, 785 bp, Zea mays
ggaataagcaaagcattgttcatttgttcatcgcacatactcacaaagttgaagtgctgtacactatcacagcaaagctgtaaggatcaagaatgtttgtctcagatgtcagaacactagaagagttatcggacaacatacagtaatgtaccaaaagttcaccccgagttatctatccatgtcgtgttcaaaaacagtgttcgattgctacttactattgcctcaaacaaatcatagtgttacataagccaaaactttcattgccaaagaatggtcaatcaccagcatatcctcttctcttttccttaatacgcaatattccgatttcaatcatttagcagctgatttcactcgtattgctcttggcatgctgccatcaccagtagcttccacagtttggcaaaccagcttatctaggacaggcacatgaagagctggatcacagaaaagccagtgaccaggggagttttcctgtccttgacatcttatccaatgctctctcaacatcatcaatctgaactttagtggctacctgctccttgactttcttcttatcagcctttttttgtgcacgctttattgccttttgcattttttctgcgatttccgctctcttcttctccagcttcaactcagcgcttctcatcttctgcctggcctttatggtcttcttcctctgccaatcatcaatatcggcttctttctttttcagcttttctatgagctttgcatctgcgcatccttccaggcaaccaacttagcatggactaaattgccggggggtt

SEQ ID NO: 14869 - DNA, 590 bp, Zea mays
gacccgcgacctcgggcccggccgggaagacttgcagtcctgtcaataccaaaaccatcctattcctcccaagccaagaaaccaagaccatggctggcacggccaagacccccgtcctcggcttcctccttgctcttgtggccacctcgacgccggctgcggccaccacgctgacgctccacaacctgtgtccgtaccccgtatggccgctggtgagcccgaacaccgggttccccgccatctccgagaacacgggccgcctcgacggcggcgggcgcgggctggtctccttccgcttcccggacagcttctgggcgggccgcgtggtggcgcgcacgggatgcagctccgggcattcccggtgcgagacgggaagcgttgcgccggcgacggtggtgcagctggtggtgcacgcggaggggcaagacctggcgtcgtacagcgtgagcctggtggacgggttcaacgtgcccgctgtggtgagcccgcaggcggtgggcggcgggcagtgcccggccctggggtgcgcggcggacctcaacgccgggtgcccgccctcgcagcgcgtgctgggggccgggggggcgcgt

SEQ ID NO: 14870 - DNA, 4189 bp, Zea mays
  misc_feature (3246)..(3246): n is a, c, g, or t
cttttattatctgtataaattacaactgcaccagaaaaaagagaaactgtttcagatgtgcaacctgaatacagtcacggcgttcaagttggtcgcagcatttcatttcactgccgaacgggcccaccaaccaacacatcattcagtaggcagcagcagcaccaacccccgattctgacacctcctcttcccaacaactcccttcctatagatctcgccgcccccccgcccccgatttccgcaccacgcccagtcgcccacgcagccggcccaagcccaaaaacctttctccatcctctactctcatccccacgatggccgccgccgccaccacgccgcactccctcctcctccagcgcgccgcgatcccggccgcgccgtcgagggcgtccgccgccgcctctcccgtccgcctcccggtccgcgccgccaggatctcgtgcgcggcggtggcggcgccgtccccggccgcagccgccgcggcggacgaggtggagcgcggcgtctacaacttcgcggcgggtcccgcgacgctccctctctccgtgctcaagcgggcgcaggcggagctggtggactaccacggctccgggatgagcatcatggagatgagccaccgcgggaaggagttcgacgccgccatcaagaaggccgagtccgacctgcgcgcgctcctcgcggtgcccgacacccacgccgtgctcttcctccagggcggcgccaccacgcagttcgccgccgtcccgctcaacctctgcacggggccctccgacccggccgacttcgtcgtgtccggatcctggagcgacaaggccttcaaggaggccaagaagttctccgccgcctccgtcgcctggtcgggtaaagacggcaagtacacggccctcccaccgttcgacgccatcgcccagaaccccgaggccaggttcctccacatctgctccaacgagaccatccacggcgtggagttcaaggactacccggagccccgcaacaggtcgggcatcctcgtcgccgacatgtcctccaacttctgctccaagcccgtcgacgtctcccgcttcggcgtcatctacgccggcgcacagaagaacgtcgggccctccggcgtcaccatcgccatcgtgcgcaaggacctcatcggcgccgctcagcccatcacgcccgtcatgctcgacttcaagacgcacgccgacaacgcctccctctacaacaccccgccctgcttcgccatctacgtctgcggtctcgtcttcgaggacctgctcgcgcagggcggcctcgccgaggtcgagaagaagaacgcgcgcaaggccggcgccctctacgacaccatcgacgccagcggagggtactacgtctgccccgtcgacaagtccgtgcgctcgcacatgaacgtgcccttcaccctggccaagggcccggacttcgagaagcagttcatcgccgaggcggccaaggagggcatggtgcagctcaaggggcacaggtctgtcggcggcgtccgcgcctccatctacaatgccatgccgctcgccggcgtcgagaagctcgtcgccttcatgaaggacttccaagccaggaacccttgattgccttgtgcttatggtcatttggtattgctactcagtctttcttcctagcataagtgagctcgtgcaagagctgtctcgcgttgcgcactgggatctatctgtagtattagtaccataacgtaacggctactgtattttgcaatgttttttttcctctctcgcttttgttaggtgttcatggaatttcatttctatgtatcaccattgcagttgtaatgtgtttttgctggaaataaggaataaggtagatggccggttgcctcgcctcgaaaaaaaaaaaaaaaacgggcggcgctgctatatcggcccggggtcccttgtcgaagcttatataaaacattaatacgaaggttgcttggtttttgcctcttcaaaaaaaaggagcaaattttgttggtttctaattttctatcatcttcagagatagaattcactttgctaagattctcatggaaattctttatgtcgggtgaatctatccattgctattattgttttcatataggttggaccatatcattgatgactaagcacagacccttgtatttgtatgtgatggtagttgcatccatccctaaagaatgaagattcattttgggctaatttagaaactctatttttttcgaatttctattttttcaatagaaaatgaattaattttcagatccgcttgtttcatcacaatcgaattcattctaataattataatttaaacataaactaattaagttcatatatttgtatatataatatattttaatattatcctaaatcgtatgagagagagtctacacttacgctataaaaaagtaagtataaaagtgtgttataagttgtacattagaagattattattatgtaaatctatagaatcaatttatatctttcaccgcgtgaatttaaaatagacttatatataaattttgcaaatgtatgtaatgtcacgttctaaaaaaatagcttactctattagttagattacaatttcacaaaataatggaataaacagaactttaggaaaatataaatctttgggataatggagcttccaaactacccctcaaggttagttctggtgagcactcctgggtttggtgaggtatttttgctggttattgtgtcattgtcttgactgactcatcactaaagctgataccaaaacagatgtgcattgtgacgtgtttcaaattgcaccttgggtaaatattgtgtggcatagggcaaagcaagaggccaactgttggtatttccaaatggttgataagatattttctcttgatcagtctaaattcgcaaagcagcaaacgttcttttcccaaatactgcaaaatctcttttttgtttcctttctaattcgagttactacaatcaagttgagctgttagtttgtatattattctcttttaactagccatcaggatttgaaggtcagccatagtacacttcagtttctttctgattctatgggtggaccatcactaaacgtgaagattatgtattactatatcatggttcatggagacagccactaggatgccgttattatgtcatccgtgaccacccctggtaacggattgtgatctaaatagttcttcacaaaatgtcaaggcgctaaataaattatagttcaaaaatgactagaaataaagcncgatcctaacccgcttcgatccttaaatcttatagtgcaaaaattatagcccattgtcagccctagaccgtgactcgtcgtcggaatggagtcttcgtctggaattgctaatctattctgccgagtgggagacagctctctggtcttcagaagatgaagtgtgtttgcactttgcccctgcaactcagaagctgaagtgtgtttgcactttacaccgcgaattgctgagactgccgatattctccttggcattataatgcattctgcctctgcagttcgactttcatgtttgtagcattttggattcctgattaaaaatgaggaaacccacacaacactgtatgttagtctgtcccgaaatataatttgttttaaattatatatacgttatcatttatttgaacgtggacaggaaaaaagatcttggaagaactatattttaggacaaagtaagtaattttaaaagatttatttatagtgtgtttggtttgtggagtcgtccaatacttcatgagatgatgtatcataagtttattttatcaattttggtggaatcaaccaactcctcatatatatactaaaggaatggggtggtgatggatcaaatcattctattcttcaaaccaaataaaaacgtgaagagtgagaagaagatgagtcacttcattccttaaaccaaacacactcttagagtcccaacaggttctctaagccgataccaaaaacacacgaacatatatgcagtgtgatcaagtttcaaattgcacgcttggtggacattacatttacatgtcacaaccacatagggcaaagcaaaagcgtaacagcgggttccgctaaagtcgacaggattatgcttgacttaataattaggacaaatcaggatagcagcatgttcttgtctgttggtaccctatatggtcattcgagaaagcgttccctt

SEQ ID NO: 14871 - DNA, 566 bp, Zea mays
cattgggtacctcgaggccggtcaataccaaaaccatcctattcctcccaaggcaagaaaccaagaccatggctggcacggccaagacccccgtcctcggcttcctccttgctcttgctcttgtggccacctcgacgccggctgcggccaccacgctgacgctccacaacctgtgtccgtaccccgtgtggccgctggtgagcccgaacaccgggttccccgccatctccgagaacacgggccgcctcgacggcggcgggcgcgggctggtctccttccgcttcccggacagcttctgggcgggccgcgtggtggcgcgcacgggatgcagctccgggcattcccggtgcgagacggggagcgcagcgccggcgacggtggtgcagctggtggtgcacgcggaggggcaggacctggcgtcgtacagcgtgagcctggtggacgggttcaacgtgcccgccgtggtgagcccgcaggcggtgggcggcgggcagtgcccggccctggggtgcgcggcggacctcaacgccgggtgcccgccctcgcagcgcgggccgggggccggg

SEQ ID NO: 14872 - DNA, 1937 bp, Zea mays
gcaattaaccctcactaaagggaacaaaagctggagctccaccgcggtggcggccgctctagaactagtggatcccccgggctgcaggaattcgcacgagaccattacctagaacatcctaatcgaaaaatttccgcaccacgcccagtcgcccacgcagccggcccaagcccaaaaacctttctccatcctctactctcatccccacgatggccgccgccgccaccacgccgcactccctcctcctccagcgcgccgcgatcccggccgcgccgtcgagggcgtccgccgccgcctctcccgtccgcctcccggtccgcgccgccaggatctcgtgcgcggcggtggcggcgccgtccccggccgcagccgccgcggcggacgaggtggagcgcggcgtctacaacttcgcggcgggtcccgcgacgctccctctctccgtgctcaagcgggcgcaggcggagctggtggactaccacggctccgggatgagcatcatggagatgagccaccgcgggaaggagttcgacgccgccatcaagaaggccgagtccgacctgcgcgcgctcctcgcggtgcccgacacccacgccgtgctcttcctccagggcggcgccaccacgcagttcgccgccgtcccgctcaacctctgcacggggccctccgacccggccgacttcgtcgtgtccggatcctggagcgacaaggccttcaaggaggccaagaagttctccgccgcctccgtcgcctggtcgggtaaagacggcaagtacacggccctcccgccgttcgacgccatcgcccagaaccccgaggccaggttcctccacatctgctccaacgagaccatccacggcgtggagttcaaggactacccggagccccgcaacaggtcgggcatcctcgtcgccgacatgtcctccaacttctgctccaagcccgtcgacgtctcccgcttcggcgtcatctacgccggcgcacagaagaacgtcgggccctccggcgtcaccatcgccatcgtgcgcaaggacctcatcggcgccgctcagcccttcacgcccgtcatgctcgacttcaagacgcacgccgacaacgcctccctctacaacaccccgccctgcttcgccatctacgtctgcggtctcgtcttcgaggacctgctcgcgcagggcggcctcgccgaggtcgagaagaagaacgcgcgcaaggccggcgccctctacgacaccatcgacgccagcggagggtactacgtctgccccgtcgacaagtccgtgcggtcgcacatgaacgtgcccttcaccctggccaagggcccggatttcgagaagcagttcatcgccgaggcggccaaggagggcatggtgcagctcaaggggcacaggtctgtcggcggtgtccgcgcctctatctacaatgccatgccgctcgccggcgtggagaagctcgtcgccttcatgaaggacttccaagccaggaacccttgattgccttgtgcttatggtcatttggtattgctactcagtctttcttcctagcataagtgggctcgtgcaagagctgtctcgcgttgcgcactgggatctatctgtagtattagtaccataacgtaacggctactgtattttgcaatgttttttttctctctctcgcttttgttaggtgttcatggaatttcatttctatggatcaccattgcagttgtaatgtgtttttgctggaaataaggaataaggtagagggccggttgcctcgcctcgatggagatcagctagctattcaggagtgacttgtcgaagcttatataaaacattaatacgaaggttgcttggtttttgcctcttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14873 - DNA, 4844 bp, Zea mays
  misc_feature (1363)..(1363): n is a, c, g, or t
ttttttttttttttttgcatgtcccagtgcgttttctattttctggcaacagtgaggttaaaaaccagcgccggcgggtcacttcatcccacccaccacacgcggtacagaacaaacatatcttacacactgcaaacactgaaacacaccacgcaggaacacatgcaaacatcacacgaccaaaaatcgtgcctgctacgcttactgagatggtaagcctgagagtctgaaaactaatcctcttcttcaaacactacattgcggtgccgcgtcctagctactgggtgctgtttctgacgtgaacgaggttcctcagctcctcgaatgcatccatggtctccggatcgaaacctccagcaaactgatgcatcctgaaggcaaatctcacagcctgaagcagcatgtactccagagctggatccttgttcagaggacccatgtactgaagctccattgcaacccttttcatgtacatcttcgctaatttcacagaagcaaactttatcttgctaataagattgttatcaagcatccagtctgtagggatattgaactccttgcactgcctcatcatagcatctcttgtccttagaaggctgtacaccccgcgttcgcccttttcagataatgcaaccattttcttcagtgcgatttcacagggcaggcgtggatcatctttgtagtttgaaacttccgactccagcttcttcaggtcctggtagccaaaagctgcctctcgtagagtgtccgcctttctctcaggccaatcaaaatgcttcaacactgctctctcatccacctggacgtaaggcaattaagttaaaagaataatttaagtggcagctccaactgaaaatgattactcagaaatcaggataaatcagtgagattgtaatgaacatactaggaagccaagttcatcatctaaccacttcacaaatgcaaccacatcttcgatatctttgtaggctgcactagtcacctccttgattaatgatttcacaaattcaccttgagtctcaacatctgccttgatctgcaaattaaataaaaagttacaaaatactgttagtgccagaaccagcccattagagctgtttgtatggtcaccagatttccaataagctagactgaactcactacttacagcttgcaaatgggaagaccggttctcgatttcaccaatcatgctactccgcacattcgcagaattagctgcttcacagattccgccaccggaagtatcctttttggagtcccttctcataagtgaatggtagagctctgcaacctgaggtgccctcttcatgaccccagtactttttgaggaaaactttggaggcggcggcggcggcggtggtcncggtggatttacagtcgatccatttgatggaccagaatttgacacagaaacagaaggtcttggtggaggattagggatgcgcaacgcacgcttttcaacatccagacactgtgatttgcatacttctggcttgctgagaacaaatcttgaactttcagatcgaccaaaatcatacttgtctacaagaagatcacgcttctccctgattgcaggatccttattaaaggcaaatgactcatctgtcgcatccgggaggctgataaaggtatcggattgccttcttttaatgatgttgaagtcttgtgcacatccctttggtccaccgagtgagtgcctacgtgtcgggcttcgtgcttctgcagcttcaatccatgccctatcaagaagggattcctttttcgatgcttggcagctcttatcattctgggaccactgcttgatgcgttctgcaatgctgaattttatatcagaactgtcctcggaagtttttgcatcaccttcgctattatcatcctcattaaaagccatgccaccattgtaatctatatccgtcgttgctctagctgcttgatctgagttacaaagctcatggcgtagacaagaattgatccaccgtagataagcaagctcctcaacctctgttagtcggctcatttgcaatccctcaacttgcttgctgaggtttgcatttgtatgcctcaacaacgatgcctcagcttgaactttggcaacaatatcactctaggtacagtattcaaagcacacaagaaaaattagttgaaacatatttcataaaaagaacaaacagaaagaataaagttcaagcaatggtacctcttcattcttctcaaggccagccaatttggattcagctgaagagagtttaattgcaagatttcgtttctgaaactgtagctctttgtttaaccggcgtagttcaacaacttcaaactccaagttttctgaaggtgcattgtccccatctacagtaagtatccgattgccgtggctatctaatcttacattttcttcatgatgttcttccatagaagatagagctgataactgttcagatatgcttgttttctcagcttctaatgaaattgtcagtcgtgcaagcctgtcaacttcatccctcatagaatcaagctccttctcaagttctgaaacttttgggttttctctgcactgtctcaactctgactgtaatgtcaattccctttctttcgactcacgaagctgctctctgagatgatccagctcaagaaaaagatcatgggatgcaggggacctaatattgtggcaatcaaagacatgggggtggacttgagcaccagcaggtgaacaagggaaatccccaataagggatcttttcaccctagagtgatacggaatctgttggttggcctgattaacattttcgacacttggaagaggtggttttttgcttgcatttgctgctgtcttcttggttttcttgtctgttgtaaaccctttgacaatttgggaaccccatgatgatccaaacttaggtttcagagaacttgaattgcttttggagtcaaccctcgatctgcatggctttgtttggttgtcaaacatgatttcctctttcatcttttcccaggattaccagtttaccacactccaaacaccattcaacactgcacacaaatgagggaagttactagtgatatatgtaccagtcaatgtcaccacaagaaaaatagaagtgaataatatagtcagctgatttgtgaaataattagaggattatgtgtccattgccaaactctccatatgtagacatacccaatagtacaacatccatcgaactcagtattcggccaaaagaactttttatcggcaactaatgcgaaacagacctatccctgggacagttaataacggaacagacctgaaccttaagttttaaccccaaaaggcttccttagggattaaattgactacacctatccctgcacactaatgcgaaacaaaaggagattgcacaggcctgaacagtcaagtttagcacttttgagtaatcatctcactgtgagtcgctggattttcttgcagcagaataaataattaaaattattgaggtaaacctatactttctaccactacgcggaaaagtaaaggaccaagagtagaacatggatactgcgactgagtcagatccgggtaaaaatagcttgcgttgaggtttgggggtgccccgttccgcacagaaggaaaggaaaagaaaggggcgagcataccaggagcgtggtcgtcggcggtgaagtgcccggcgaagggtgcgtcgccggtgaagggctcctgtcgtcgtcgggactcgggagtaaaggaaggccacaggagagggacgaaaactgcagctaaaaaagaaaaagaaataccgaaaccccccaatcccaaccctaagcagctcaaatccgacgcattccactctaccagaacgagcctcgaatcagttcgacctgggtatgcccacaaacagccccgaatcagctcaacctagctattccaacaaagaccgcagccacgaccgcggtggccgccggcgttgagaataatgaggcagagagcgactggcgctatcagtagcggcagtggcgctgtaaccactaaataaaggagatcggacagcgcccagcggaatgtggagtcgtggaggaggacggaaacaaacaaggggcagtgcttcggatgcttgcctcgccggctcgccccaggagcagagattcggccccccacgcgcggatttttctgtggattcctcccgggttccgagacgccacgcgaccgcctcgaggtctcggcctcggcctcgctcccgtggagaagagagaaggcgagtgaggaaggggacttttgaattttgaaatcggagatgggaaagaaaaaggggagtagccgtagcatagctgcagcacgctagcggggtacaggccagggaagagggggagcttactgacgtgtgcggtcatatatgtccggttgtgaatgttttttattttaacttctttgaaactacttttaaaaatatataatgaaaaaaataaaaattaatctattttagggcgttaatctcccaatgcatctaagggcatgtttgacggagttttagctcttgacttctactttgaaaaactgccaaagacgtacaaacatggcttttaaaacggcagagctattttttactagacaagagaagccacaaaatgtagcgcaactggctcaaacttctctagattttacaaaattgtacttatactaccaactcactttttatttaggtcatgtaccctttgattaaaggttgacctccaccgaagaaacacgatgccaccaaccgaccaaaatgattgtaccctagggtttctctgtcgccatgccatctccctgcaagcgtcgctcctcccatcttcgattgcatctagcccgtctccgatttcatctagcccgtctc

SEQ ID NO: 14874 - DNA, 1304 bp, Zea mays
  misc_feature (1282)..(1282): n is a, c, g, or t
ttttgcggtgctcaacaggcacttttcttttgcttgtgcatgtcgcagtgcgttttctattttctggcaacagtgaggttacaagccagcgccggcgggtcacttcatcccacccaccacacgcggtacagaacaaacatatcttacacacatgcaaacatcacacgaccaaaaaccgtgcttgctacgcttactgagatggtaagcctgagagtctgaacactaatcctcttcttcaaacactacattgcggtgccgcgtcctagctactgggtgctgtttctgacgtgaacgaggttcctcagctcctcgaatgcatccatggtctccggatcgaaacctccagcaaactgatgcatcctgaaggcaaatctcacagcctgaagcagcatgtactccagggctggatccttgttcaaaggacccatgtactgaagttccattgcaacccttttcatgtacatcttcgctaatttcacagaagcaaactttatcttgctaataagattgttattgttatcaagcatccagtctgtagggatattgaactccttgcactgcctcatcatagcatctcttgtccttagaaggctgtacacacctctctcggtcttttcagataatgtaaccattttcttcagtgcgatttcacagggcaggcgtggatcatctttgtagtttgaaacttccgactccagcttcttcaggtcctggtagccaaaagctgcctctcgtagagtgtccgcctttctctcaggccagtcaaaatgtttcaacactgctctctcatccactaggaagccaagttcatcatctagccacttcacaaatgcaaccacatcttcgatatctttgtaggctgcactagtcacctccttgattaatgatttcacaaattcaccttgagtctcaacatctgccttgatagcttgcaaatgggaagaccggttctcgatttcaccaatcatgctactccgcacattcgcagaattagctgcttcacagattccgccaccggaagtatcctttttggagtcccttctcataagtgaatggtagagctctgcaacctgaggtgccctcttcatgaccccagtgcgtcttgaggaaaactttggaggcggcggcggcggcggtggtcgcggtggatttacagtcgatccatttgatggaccagaatttgacacagaaacagaaggtcttggtggaggattagggatgcgcaacgcacgcttttcaacatccagacactgtgatttgcatacttctggcttgctgaganacaaatcttaactttcagatcg

SEQ ID NO: 14875 - DNA, 2058 bp, Zea mays
ttgggaccctcgaggccggccgggactgtattcaggcaggcaggcatcgacgtgcccacctcgttccgctctgacgtctgagatcgcgagatcgggaacccctgcccgtctgctccggaatctcgcccgcacgaaacttccccgacccatcgaccacaccagccccatcccctccgtcgctcccaagtcccaactgccgccacctctccgcgagccgacgccgacgcctacggtcaccaggacagagggacggctgctaccgcgggagtatgggggtggactactacaaggtgctgcaggtggggcgcggcgcctctgacgacgagctcaagaaggcttaccggaagctggccatgaagtggcacccggacaagaaccccagcaacaagaaagaagcggaggccaagttcaaacagatctcagaggcatatgaggtgctaagtgattcccaaaagcgggcaatctatgatcaggccggcgaagaggggcttaaggctcaggtcccacctactggagcaggtggtcccagtgggtcttccttctatggagggaatgcatcgacattccagttcaaccctcgcagtgcagatgatatttttgctgagttttttgggttctcaagcccattctcaaccatgggtggcatgggcggaggtgctgagagaggcatgaggggctccaggtttgggatgttcggcgatgacatatttgggtcccaccctcagtttcctggtgaggcatcaatgcatgttccacagcggtctcagaaggttcctccaattgagaatcggttgccatgcaaccttgctgatttgtacaaaggtaccaccaagaaaatgaagatttcacgagaggttttagatgccagcgggagaactttggttgttgaggagatcttaacgatagatataaaacctggatggaagaaagggacaaaaataacatttcctgaaaagggtaatgaggctcctcatataattcctgcagatattgttttcataattgatgagaaaccccatgatgtattcacaagagatggtaatgatctggttatgactcagaagattactttggctgaagccttgacagaatgtactgttaatataacaacattagatggtcggaatctgacagtgcagataaataatatcatctaccctggctatgaggaggttgttccccgagagggaatgccgattcagaaggattcttcaaagaagggaaatcttaggatcaaatttagcattaaattcccctcgaggctgacctcggagcagaaagcagaaatcaagaggctactaggttcataaggagcatgcacaaccttttttttttctggtgacgcaatgctgtatccagtgtacattcagatgttaaatgtgaataccagcaaagtctcggtttccttaaactgtgccagttcctttggcatatggatgttttgagatgcaaagttgaattgtttcatttatcggggaataattctaaattctactagatacttctgtgtgattttgctgggaggatgtccattatgcacctaacaaaagctttattttattttcggggttaactttttagtaaatagtaatgtacgctggctgttcgtaaacctgtttcgtggtgttatctcagtcctcaaactcattgcatgtgtacggcattttcaatggacatctgacttgtccgtaggttttcatttcgcatactctctgttgtctgttctataaacattctatttcaaaggtcgttttacttgcatttagacataacatatcatatgtctatagcaaaagttacatatctagataagctaaataaagccaaacaacgtaattagagacaggatggtaaataactaagagctagtttcgtaaccttatttttctaaaaaaaattcatttttctaagtgctaatttggaaacgtcaattttttaagaatttctattttttaagggaaaaccaactaattttccttaggaaaataaaaatctcttggaaaaataatgttccaaactagtcctaagagaaattagttcttttgaaaaatagagttt

SEQ ID NO: 14876 - DNA, 3057 bp, Zea mays
gcaataaatcccaccatataagtcaaggcaaaagactcttggccttccaatgtggtactattggtattctccaccattacacaccatagagtttattcaataaataagccaaatccataaaagatccaacagccagtctggttggaagcgtgcgttgaatggtagaagttcgaaaatgtgtttattagggaaaacaggagaaattataccataattagttactccatggtattcttaattatgtctagaacggcttgttttttgtgtgtagagaacggtgcaaatttggaaatacacagatgcaacgagcacaagttactacacagaatggccgtttcccagcaggcccaggcgtcccgaggcgaccacgcgacacatcacagccgcgcacgtcgcgggcatgcgctacacgcggccgcggattaatgccgacggctagacgcgacgcacgcacggcgtggccgggcgctgtgccaccaatagccggggctgcatagggatcaacggaatcaatccatccatcgcccccatacggcactgctaccgcgcgcgacattaactccgcgcattcaagtctcccactgcgctccaactacctcacctcacccctccccataaatgcactgtatcacccctgccttcctgctagttctccagagagagcttgactgtctgccctgtctgcaggcactcgtcttcttcctggagagaaaaagcagaagacaatacaaagatgtccaagatggcggaggagaaggcggcggcagtgggcggactcggaggagccggggcggcggacgcggcgcagcagcagcagctggcagcaggggaggccgcggcggctcgggtgcggcccgtggaaacgctgcttcgcgcggcaccgctggggctctgcgtggccgccatgaccgtcatgctacgtaaccagcagagcaacgagtatggcgccgtcgcctactccgacctgggaggcttcaagtacctcgtctacgccaacggcctctgcgccgcctactcgctggtatccgcgttctacactgccgtgccgaggcctgccaccgtgtcgcgctcctggctcgtcttcctcctcgaccaggtgttcacgtacctgatcctggcggcgggcgctagcggcacactttttcacacggttctagtagcaagttgagaatgctccaaggaatctttcttttttctttttctgccaacgtcacgtgacgaattttacgagtaatatgacggtacaaaagtttattcttcatgtgttcgttatatttctgttgttgtgacctactcctacaataatcaaggctggattactttcatgatgtgggaggatctgttcgttctacaaaactcatgcgaaactcgtgactgaagaaacaaattaacacatggaaagaaaattagctctggcagagactgtatggcagcttatgcgttggatttgttttatttctacatccattttttttcttgcttcagtgtttcagcaattaaaaaaattacataactcatataaagcaattataatatgtcgatctatatagtatacataattcataaagttacatgatttatgaaaaattacataatacatatcttaaatagttcttctgaactcttctgagctagattatgaagatacatttatatagtatagttataatatatggtggtttagtataattataatatatggtggtttagtttatagtttttgttatagaggtatatctatgcttttaaatgtttatttattcccgggggttctagtgatctaattgtgaaaaaggtttgtgtggtaggccacgtgctgcatacttgcatatttgtgctatggtcaaattttttagttttcatagaataagtatgacttagtacatgatttaaattggttgaggcttattaaacagtgtatagttaaaataaatatgcaaaaaagaaaaaatgtaactaaggcttagtaaaaaaaatacgtatgtaaaaaaagaaaaaatatggttccgtacaaatattgatatgtcttataaatatttaacatgactatgttattatagaaagacttttagacttaaactcacatattttattgtaaagaaaatttattattctattgttataacccgttaatctatagcatgtcatatttgtagagtggctatgttttgttaatatctgtcaactatataatttcttatctaaaatgtaatgtttgttctgccatcaaatatataatctattaagtgcatgtttaatcttgtgttaccaaaatataagtatatggttatgtgagcatatttgatgcttgtgctactctatatacttcataattatatgttgctcagttacattaagattttagattatgtatatgtaatctcgattaaccaaacagttgatgaaccttattgctataaatggctacatttacagttttgattaagacattatgataaaaaaaaaattcatgccagtgccacgtatatacgcggacgttttggttcttgttagaaccaacctcttaagagcttacatgaccgtactggtgaaagcatgagagagtgatccatggcatttttattctgcaggtgttcacgtacctgatcctggcggcgggcgcaccggcggcggagctgctgtacctcgcctacaacggtgacaaggaggtgacgtggagtgaagcttgcggcgttttcggcagcttctgccgtcaggcgcgcacctccgtcgccatcaccttcggcaccgtcctctgtttcatcctcctgtccctcatctcctcgtaccgccttttcagcgcctacgaggcgcccccgtcgtcggcgctcggcagcaagggcgtcgagatccccgcctacccgcgctgaagccgctggagggaggcctcgttccaaatctctgttatgcgtagtcgatcatgtaataatggcctatcgcataaatacttcgttgatagtttgctgtcacgtatgattagggcagagctgctgctgttgctgataaactgtgcttggctgggttattatatagtttgcgtcacaaaaaaaaacaaac

SEQ ID NO: 14877 - DNA, 1157 bp, Zea mays
aatccatccatcgcccccatacggcactgctaccgcgcgcgacattaactccgcgcattcaagtctcccactgcgctccaaccacctcccctcacccctccccataaatgcactgtatcacccctgccttcctgctagttctccatagagagccgggagaacttgactgtctgccctgtctgcaggcactcgtcttcttcctggagagaaaaagcagaagacaatacaaagatgtccaagatggcggaggagaaggcggcggcagtgggcggactcggaggagccggggcggcggacgcggcgcagcagcagcagctggcagcaggggaggccgcggcggcgcgggtgcggcccgtggagacgctgcttcgcgcggcaccgctggggctctgcgtggccgccatgaccgtcatgctccgtaaccagcagagcaacgagtacggcgccgtcgcctactccgacctgggaggcttcaagtacctcgtctacgccaacggcctctgcgccgcctactcgctggtatccgcgttctacactgccgtgccgaggcctgccaccgtgtcgcgctcctggctcgtcttcctcctcgaccaggtgttcacgtacctgatcctggcggcgggcgcagcggcggcggagctgctgtacctcgcctacaacggtgacaaggaggtgacgtggagtgaagcttgcggcgttttcggcagcttctgccgtcaggcgcgcacctccgtcgccatcaccttcggcaccgtcctctgtttcatcctcctgtccctcatctcctcgtaccgccttttcagcgcctacgaggcgcccccgtcgtcggcgctcggcagcaagggcgtcgagatcgccgcctacccgcgctgaagccgctggagggaggcctcgttgcaaatctctgttatgcgtagtcgatcatgtaataatggcttatcgcatatatacttcgttgatagtttgctgtcacatatgattagtacagtgctgctgctgctgctgctaaattgtgcttgactgggtaattatatagtttgcatcgttcttgtgtgtcctggatggattgagcttaaaattcttattaaaattcttactacagacgtagtttctgtgcaacaaaaaaaaaagcgccgcggccagtgggggcccggtac

SEQ ID NO: 14878 - DNA, 1361 bp, Zea mays
cattgggtacctcgagcccggccgggagttcccatctcagactcagggagagacgagagaagtggacacctcgcctgcctggactcgtctactctagtatacagaaaaaagcagaagagatacggggatgtctaagacggcgggcgtcggcagactcggaggagccggggcggcggacgcggcgcagcagcagcagctggcggcgggtgatgctgcggtggcgcgggcggcgcggcccatcgagacgctgctgcgcgcggcgccgctggtgctgtgcgtggccgccatgaccctcatgctccgtgaccagcagagcaatgagtacggcaccgtcgcctactccgacctggggggcttcaaatacctcgtctacgccaacggcctgtgcgccgcctactcgctggcgtccgcgttctacacggccgtgccgaggcccgccaccgtgtcgcgctcctgggtcgtcttcctcctcgaccaggtccgttcttgccctgcgtgtctgctctctgcctctcacacacttttgttgcagtagcatgtgaagactgcttgcaagaataaaaaatttagtctttatgtgcttgattcatcagttcatcatcatgcctaccgttaaatttagacatgaacaatgggtcccgatccccgattctccgcggtgaattcctccattagggtttgttcggttgttttcaatctatacgaattgaaggggattaatacggattataagagattttgacttactggtgagctcaattcatatggactgtggtagaatcgaacatggccttagggggtggggatagggaagtttctccccccgcgacgatgtaaacggggaaaaatcttcccccgacgggcaaacgtgggcggggacgggaaacattctccatccccgttatccgcgagacccgttaaacttatatattgttggggaccttcggcgtccgaaggtcctcaaaaacaggatttaacagtatttctgtagtacaatatgtgaacaggtaccctcagactaaagtcggcattgcagcagatcggaacaatacgaagcttgatacagagccgaaggagttgagcaggaaagcttcggcgtaacaccaaagagtggaaccgacttaaagatgaaaaggctattcagacatcgatagattgctatagagttattgtcaaatgtaaagggtatgaatgtaattttgtaagggctgtgtcccgtgtctataaataggagaacagtatccccgtactgttcacgctgacttggcattcgctttttgcgtcacgcttgtactatcatttccttccgattgaaggtacacttatagttcaataataataaatgattgttcatgtgtccg

SEQ ID NO: 14879 - DNA, 1372 bp, Zea mays
ttaagaataaaatcgaacctagggtatttttacagcacattctttataaaaaatattgtttcgatcttactaggaaccttgtttatgaaatgtgatattttatagttctcccagaaaagttgtgttatcttgagaaataaagagattttctgcacaatttctcctgggtaagctgaaaactgcgcatcgtaaatttgtagcctgcagaaaagttttcagtttagttgttttagatttaactgtacttgtccccagcgcccgcccacgcggcccgggaactgctgattctttcaaatccgggatcttcaattgtctgcaccagctgattcctttaaatctggaatcctctatctgttggcccacttgtacagtaactcgtgatttatacttccttaactgtgtctaatcattgcaggaagaggcggtcgagatcgagaactccggtcaaaaggagatagaaggcatggacagtttatccgacgagatctttgcctaaacattcctctgaaacaaccaaagacatttttgcggttctgctgttgtctatctagtgcgtcttttgctccgacaacataatggtagaacagcattcctacagtgacaaacatgaaggcgaggactggatgtaccttgatataagatgcacattgaactgtatcttgtttgatagatgagctatataactagctcacgcagctgactgtatgatctgtagttcccccgttatctgaattgttcatgtattaggccatgtactgctcagcagacctatgtagttagttgcacttgtatgacttcagcatttctgttgccagttgtttgtttgtctatgcaggattttttttccgtttcctactttttggttaaaaataaactgattcctgtgaaatctatatatgatttctctcaaattcctgccattccgaaggagaccttagtttgcaagtggaaggcaatctgctgtagtttgattctgctaagtactctgtatctagcagtatcaggttttggatgaagcattgaacgtatcttttcccctttttatatgtaaaaataatcatacttatgagtgtctgccctcgggggaggggtcagcagcgacctgtttttttttcagagggaagacagtgaaaaaggtagaaaccgggcgcagcaaaatgtgaaagcaaaacatcaacggcctgtcaatgggactagaaccaaattgtacgttatttgtagtgcagcgaaagaagttcgtgaacagtaacagcgacatatcaagattatgtcgctggactccagcatcttcatataacataccaaagaacaggatgaaaacttcaacatcgaaatggatgcagcatgcaatggagcacggaggacacagggg

SEQ ID NO: 14880 - DNA, 2732 bp, Zea mays
acaggtcgttgaacagcatgttgatattttttcctggacattttcaacttgagtatcacatggtccttatttaaattattaagctcatacttaaatcgcttgcaggatgaaattgaagcagctcgaatggcagcaatcaacaaggaaattaagcgtgtgttgactgaggtccttttgaaggttttttctttacttgatcatcatgtttactgtttacattattgtatccatccaagaggtgcaaggttatgtccattgttttaaaggcgacacctaggcgtcgaggcggtggtccaacgcctagacgccttgctcgcctatctcgcctagtcgtccaggaggcagttcaacgccttgtctcgtcatacagctttaaaaaccatggttatttctgagtgttcagtttcttaccattttttcatcacttgcaggttactgatgagctttttgatgagatagcaacaaaagttctaaatgaagacgactcagctgaatgtgagtgaatttgaatgaatatgcaattaaatagacattttactttgctgatcattgcctctggtgcagccaatgaagccactggtgttttcggatcaaaggagactggtctgggaagatcaagagccaaggcctcggctaaagttgttctccctgctaagtcaacaaatagttctgatcataaagatagtactgggttaagttcccctaaaggtgctcttctcggcctggctagttatgattcagatgatgacgacgatgctgacactgacagcaaggataagatgccaatatcaaatttatcttctaaagataatgctggtgctgtaaatactgaaggtaagctgtaaccaaatgctcacattgcattgctttcaagaattattaacttagatggatgatacaattttaggtaataaaagcactcttggtaaaagaaaggggaatcacaatgaacagaattcttcacttggaagttctccatcaggggaagatcttaaatctaataatcaaaactttcaaaggaatgcgaatgcagaacctgaacaaatgcatattcgtgatacagagaatggggagttccgtttcaaggccaagactcgtactgagccaaagggtgcatttgacagaatggatgagaaggcacatacgtatgcagaggtagatatccagaacagaaaaacctcttttggcaataatgctgaaaagcacaatgatttggaaagcagtcacagacattcagaaaagagcagcaaagaggactttgttaatgagttgaaggctgatcatacaaaagaactcgaatattctagagcagaaaaatataataacgatgacaaatacagcatgtatggaaatattgacaaaaggggtagctgcaaggagggaaaaggttctgatagtgctgcaaagcatgaatccgatacaagggagccacattacagaggtaactctaagcttgatggtgcaaagggagattggaaggatttgccgaaggatagagagagaaatagagatgatagaagggggaaaggaaaggatgaaaaggacgacaggttaaggcagatgacaagtcataacagcagaagttcacggtcacgatcaccaagggggagaagtcgtactagaaaggagaactcacatgttcgagggagtgtttcaagtgatgagccttctgatagtgtgaaaaagagaaagcattattcccataaaaccagcatgtcaccttcacccccaaaatctagaaacagacgaatttcgcggtctccacatagcaagcattctcaccgcaggcattcgccttattcatcggctggcaggaagaggcggtcgagatcgagaactccggtcaaaaggagatagaaggcatggacagtttatccgacgagatctttgcctaaacattcctctgaaacaaccaaagacatttttgcggttctgctgttgtctatctagtgcgtcttttgctccgacaacataatggtagaacagcattcctacagtgacaaacatgaaggcgaggactggatgtaccttgatataagatgcacattgaactgtatcttgtttgatagatgagctatataactagctcacgcagctggctgtatgatctgtagttcccccgttatctgaattgttcatgtattaggccatgtactgctcagcagagctatgtagttagttgcacttgtatgacttcagcatgcctgttgccagttgtttgtttgtctatgcaggattttttctccgtttcctacttttttgataaaaataaactgattcctgtgaaatctatatatgatttctctcaaattcctgccattccaaaggagaccttagtttgcaagtggaaggcaatctgctgtagtttgattctgctaagtactccgtatctagcagtatcaggttttggatgaagcattgaacgtattttttcccctttttatatgtaaaaataatcatacttagaattttatattctggctttaaaaaaaataaatttatgagtgtctgacctcgggggaggggtcagcagcgacctgttttttttcagagggaagactgtgaaaagatagaaaccgcgcgcagcaaaatgtgaaagcaaaacatcaatggcctgtcaacgacatatcaagctggattccagcatcttcatataacataccaaataacaggatgaaaacttcaacatcgaaatggatgcaggcatgcaatggaaaacggagggcacgggg

SEQ ID NO: 14881 - DNA, 2090 bp, Zea mays
  misc_feature (64)..(64): n is a, c, g, or t
  misc_feature (135)..(135): n is a, c, g, or t
  misc_feature (164)..(164): n is a, c, g, or t
  misc_feature (254)..(254): n is a, c, g, or t
taggggccttttttttttttttgctgtgagaaggtgcattcacctttactattctgtgagagcnagtaggggttaggggatagaatagcacatgggtgcaggtgttacatagaacccttctgaccgttacactgntctatcagatcacgccccagcagtatggnactacaataaattttcactgcgtcagcaccgctgcactgcgggtggggagtagaagaaatgggcctgcacgttgggccacttgaattgcntacatctgcaaaacacatgattcacaccctagcacaacacataccgaacactcttgcatttagttttttttttttttttaggattcaacgcttgcccctcatcttcttgtaacataacataacaaatagactgaaatcttatacatgagccggaatcatatgcaaaaaaacaaacctatatacagaggggagaaccatggtggtgataggatcaagtcctactggtcatccagcttccacacctcatggagaagcctgtacctcgccgtggtcgagttgccgatccgcttcagcttcgcaagcgggtctgatgaggtgttggagatgaaggtaagtggggagctcagctcatcaagctcgtcatcgctcgtgttggacttgtgaaggatggcggacccgctcttcctaggatcaccgatgacgcttagtattgccccagatacaggggcattgtacaaaattggcgatgcgctgcacgggatcgaccgtatgcccttgttaacctccaggtggtcctccaactctagtgcttgaagtaaagaaccttgaataggatctggacaaaattcatccggtaaaaagacatccaggatgttcttgatgattgatgagctaaaggtagggcaaagctgtaaaacattacatgacagtaagattttgtttaaaaaaaacgtttcaataagtcattaaaatatagagcacccttttgaacgagataggtattttaaaaaacgtttcaataagacattaaaatatagagcagtcctttgaacaagatatgatttcatgcctcttccctgctactggtatccatgagcacatccttgggaagcattaggagatcactcagtgcattcaggtgatagaatggctttacagattcaccaaagccattttcaccaccctcattgtcaagttcttgatagtcgtccatatccatgccaaacaagtcagtaagacatctagaccagctgccaatctaaaagagggaagcaggtcaatggtctttgtaacaaatgagaattaagggagacaaaaggtccatcggcggtaagttgtgtgacctcacaataactcaataagcatagttgttatttaactcacagcatttttcagttggaccccagcaccgaagctgaatttcccagatgggattggaagaactttaggatcagttatgggatcagacagcgggtctgttggaatttcatcatctgattcacgcaaaatagcattgaacattgctacatccaacctagctatgcactgctccatcaccaacttggttaacataggcagacatccacactcatgaccagctgcccttactgggcaaagccgttctgacgcttccttaaaggctttcttccatatgtccattgatatggttgcttgttgctggttgcccacaacaggaatccttccatagcctttttttggatttggagtacttctcaaaccaccagttatatcagcagattgcatatgtggtgtgaatgtctgccaccaaagggtttcaacaattcgagaaaatatccatgattcgatcttctttagtgcagctataaatgtgtcaacatcttcccagttatcaaactcaggggaaagtaattttcctttcttcctattaagtgactcccacattgatgcagagtttttcctgtatgttgttttggaattataatcaccataattgctgctatttacagtgcccgattgcctagaagtttcagtaacaattgctcgcagtacaacacagtttgacaaccagaaactcaaccttgcaatgtcatatccacattttcgattaggatgttctaggtaatggtctcgtgc

SEQ ID NO: 14882 - DNA, 1502 bp, Zea mays
ggccactgatgcacgagcccgtccaagaggcgattccttaactgacgctgcgactccgatcacccatcaccgctgccctctctcctctgcctacgccggcgccgacgccgcgggctagaccgtcggggagtcatgtcgcggtctttgagcatgagaggtagcatgaggtcgcgccgcgacctacctcctcccgggaagacaattgaaaggcttgagagtatggttgatggaggaaatttctatgaagctcaacaaatgtacaagtcaaccagcgcaaggtatattgctgtccataagtattcagaagccttggacatccttcaatcaggcgctttggtacaattgaagcatggacaggttacctgtggtggtgaacttgctgtcctctttgttgacatcctcatcacaggagagtttccatatagtgaacaattttttgatcgtatcagaaagatatatgaggcattcccaaggataaccgttccacatttccttggagaggactatgatgatgagggacataaattgtctgaagctatttctgctgccaaagtgcgcgcagagagttgttcatcattcctgaaagctgccatcaggtggtctgctgagtttggaacatcaagaaatggttctcctgaactgcacgttatgttagcagaatacatatattcagaatctccagagacggacatgactaaagtttcaagtcattttgttcgtggaaatgatccaaaaaagtttgcttctatgctggtgaactttatgagcaagtgttaccctggtgaagatgatactgcaattgcacgtggggtcctaatgtatctatctcaagggaacctgagagatgcaaatttacttatggatgagatgaaggaacaactaaaatctgttaactcggattttccgaaaacagatttgattcagttcatcatgtatcttttaccaacgcttgagagagatgcttatcctctttttaggacacttcgacagaagtataagacaagcacagatcgtgacgctgtgtttcaggagttactggacgaaatagctgcaaaattttacaatatacagcgccagaaccctttagaaggacttttcagcgaaatgttcaggatataatgcatgagaaaagaattttatgtcgatgctttcatcaaaaccattggctgaaataatacagttgctgccacggcagctcatgatcaatgaaggtgcttggctgcttgcccaactagaatgtccaaagccatacatttagcatcttactgcatgaagatatatacttgactctggaaaatcgttgattagtctcagattgttacggagcatgtgtaacttaattttgttttctattacatgttttcctttgttgcccttgccctgtccacttttagagatgtatcttgcgtgacccagagatcaaaatggtaacctatttatattcattgattttaatatacggtgtttatcggtaaacttccaaaaaaaaaaaaaaaaaagcc

SEQ ID NO: 14883 - DNA, 1595 bp, Zea mays
cccacgcgtccgcgcgagaacgatcagccagcgcccagccgtccacccaccaagagccacaggccagaggccacgccgtccccttcaccccagggttgccgacgcggcgactccgatcacccaccaccgctgccccctgtcctccctgctgccgcctgtgccggggctagcccgccgcggagccatgtcgcggtccttgagcatgagagggagcatgagggcgcgccgcgacctgcctcctcctgagaagacaattgaaaggcttgagagtatggtggatggaggaaatttctatgaagctcaacaaatgtacaagtcaaccagtgcaaggtatattgctgctcagaagtattcagaagccttggacatccttcagtcaggcgctttggttcaattgaagcatggacaggttacctgtggtggtgaacttgctgtcctctttgttgacaccctcatcacaggagagcttccatatagtgaacaaatttttgatcgtatcagaaagatgtatgaggcattcccaagggtaactgttccacatttccttggagatgactatgatgatgaggggcatcaattatctgaagctatttctgctgccaaagtgcgggcagagagttgctcatcattcatgaaagctgcaatcaggtggtctgctgagtttggaacatcaagaaatggttcttctgagcttcacgttatgttagcagaatacatatattcggaatctccagagacggacatgactaaagtctcaagtcattttgttcgtggaaatgatccaaaaaagttcgcttctatgctggtgaactttatgggcaagtgttaccctggtgaagatgatactgcaattgcacgtggggtcctaatgtacctatctcaagggaacttgagagatgcaaatttacttatggatgagatgaacgaacaactaaaatctgctaactcggaatttccgaaaacagatttgattcagttcatcaagtatcttttaccaacacttgagagagatgcttaccctctttttagaacacttcgacagaagtataagacaagtacagatcgtgatgctgtgtttcaggagttactggatgaaatagctgcaaaattttacaatatacaacgccagaaccctttagaaggccttttcagcgaaatgttcaagatataatgcacgagaaaagaattttatgtcgatgctttcatctaaaccattggctggaataatacaattggtcaacaaaggtgtttgctcaactatgaatctccaaggccatacatttagcatcatgctgcatgaagatatatacttagctctgcagcaaaatcgtcgattagtgtcagattgttactgagcatgtgtaactgaattttgttttctattacttgtttctctttgttgacttgcccttgattgttattgaccatgcataactgaattttgttttcttttacttgtttctccttgtcctgttcacttttggagatgtattttgtgtacccacagatcaaaactataacctatttaaattcattgattttaatatatggtgttatcagtaaaaaaaaaaaaaaaaaaaaaaaaaaaaaaaaag

SEQ ID NO: 14884 - DNA, 2245 bp, Zea mays
gggagtaatgtatactatagttttgggcgtctgggcccccccccgcccggccaagtgtgcgcggtcggtcgcttcccttcccttttgtccgcgatctgggctggccctcgtggcctcgtcccgtctccgattccggcgtccgaaccagattcgcccgggccttcgtgccagcgatgaaggagaagcgtgggctcgaggacgccggcgggggcgccggcgacggacgtcctgatgccaagaggtcgcggcctccggcactggccagtgttattgttgaagctttaaagatggatagtctgcagaggctctgctcatcactggaaccaattcttcgtagagtagtcagtgaagaagtggagcgcgcactgggcagacttggccctgcaacaatcgggggaaggtcttccccaaagcgaattgaaggtccagatggaagagctctgcaactccaattccggacaaggctgtcacttccccttttcaccggaggaaaagttgaaggggagcagggagctgcaattcatgttgttttgcttgatgctggcactggtggtgttgtatcatctggaccagagtcgtctgccaaacttgacattgttgttctcgaaggtgatttcaacaatgaagatgaggagggctggacaggggaagagtttgacagccatgttgtgaaagagcgcgagggaaaacggcctattttaaccggcgatctacaagtcacactaaaagaaggtgtcgggacaattggggagcttacgttcacagataactctagctggataaggagtaggaagttcaggcttggcttgaagcttgcctcaggattttgtgagggtgttcgcattcgtgaagcaaaaacggaagccttcatggttaaggaccatagaggagaattgtacaagaagcactatccacctacgctaaaagatgaggtctggaggttggaaaaaataggaaaggatggctcattccataagaggctgaacaaatctggaatatctacagttgaggatttccttaggctcgtaattcgggacccacagaaattgcgcagtatacttggaagtggtatgtccaacaaaatgtgggatgcccttgtggaacatgcaaagacttgtgtcttaagtgggaaatattacatatactattctgatgagagcagaagtattggtgctattttcaacaacatctatgcattctgtgggttgatttctggcgaacagttctattcatccgagagtcttgatgatagccaaaagctgtttgctgatgcattggtaaagaaagcatatgataactggatgtatgtcattgaatatgatggcaaaggtctattgaaccttaaaccaaagaaaaaggctgcatccactggtcaagctgagacgcatgcttctgcgggtggttcgacttcgtatcaacaacacctctcctcaacgagcatgccagggtcatcaccatcaggtggaactgattccgtagggtatggtgtcgaccaatcagcaacacatctatctcaactccagagttcatccaccaatctccagacgccatacgatgacacattttcgttcctaccacctaacctgctgacagggtctgcaaacgatgccatgggtctggaactgggccagttgcaccaagtaatttctcagggccagccaattcagccagcaaacgtgggatacgttgactggcccaggaaccgcgacagccagtacgccgacgacttcacagaggacattcgcgtgaagagccaccagatgctcgagagcgaggacatgcagcagctgctgagggtcttcagcatgggtggagcctccgggagtttgtcagacgacacgttcaacttccagccctacatgccctctcccttgcccaaccccgggttcgaaagcgagcgcagccattcatccggcaaagctgtcgtcggctggctcaagatcaaggcggcaatgaggtgggggatcttcgtcaggaagaaagctgccgagagacgggcgcagctcgtcgagctggaggattagcgtcgtcgtggctttacaacggtcaaggctgcgttgtaaattactagtagtcatctgtgcccccacataccctcttgataccccattgaaacaggtttctgaaactgttctgaaatgtacaacgagtagttctgctatcttgtacaaaaaaaaaaaaaaaaaaaaaaaaaaaaaaatcgaagtgtaacatagctctgctaagtttgacacatgactggaaa

SEQ ID NO: 14885 - DNA, 1507 bp, Zea mays
cagacattgcgcagtgtaaggtcgtatgtgggtgtgttattaactcactattattatactttcatttttatgtgtttcagcttatgactattaatgctcttctgtgatagatacttggaagtggtatgtccaacaaaatgtgggatgcccttgtggaacatgcaaagacttgtgtcttaagtgggaaatattacatattctattctgatgagagcagaagtattggtgctattttcaacaacatctatgcattctgtgggttgatttctggcgaacagctctattcatccgagagtcttgatgatagccaaaagctgtttgctgatgcattggtaaagaaagcatatgataactggatgtatgtcattgaatatgatggcaaaggtctattgaaccttaaaccaaagaaaaaggctgcatccactggtcaagctgagacgcatgcttctgcgggtggttcgacttcgtatcaacaacacctctcctcaacgagcatgccagggtcatcaccatcaggtggaactgattccgtagggtatggtgtcgaccaatcagcaactcgtcttgcgcaactccagagttcatccaccaatctccagacgccatacgatgacacattttcgttcctaccacctaacctgctgacagggtctgcaaacgatgccatgggtctggaactgggccagttgcaccaagtaatttctcagggccagccaattcagccagcaaacgtgggatacgttgactggcccaggaaccgcgacagccagtacgccgacgacttcacagaggacattcgcgtgaagagccaccagatgctcgagagcgaggacatgcagcagctgctgagggtcttcagcatgggtggagcctccgggagtttgtcagacgacacgttcaacttccagccctacatgccctctcccttgcccaaccccgggttcgaaagcgagcgcagccattcatccggcaaagctgtcgtcggctggctcaagatcaaggcggcaatgaggtgggggatcttcgtcaggaagaaagctgccgagagacgggcgcagctcgtcgagctggaggattagcgtcgtcgtggctttacaacggtcaaggctgcgttgtaaattactagtagtcatctgtgcccccacataccctcttgataccccattgaaacaggtttctgaaactgttctgaaatgtacaacgagtagttctgctatcttgtacagattacagaattctccttgcttgcttgtgttagtggtgtaacatagctctgctaagtttgacacatgactggaccagcttgtgtatctttattttttcccttccctagctcttcagtgcagaatataccgttacagtgcgaattaatccagagattgtgtgtgtgtgttgctttttctatgatagagcaaaaacactcttgctagaaacattcaggtctagtttgggtactctagtaaaaaaaaaaaaaaaaaaaaagaaaaaaaaaaaaaaaaaagcggcc

SEQ ID NO: 14886 - DNA, 1331 bp, Zea mays
agaaattacgcatatacttggaagtggtatgtccaacaaaatgtgggaaacccttgtggagcatgccccgcccggccccttaagtggaaaatattacatatactattctgatgagactagaagtattggtgctattcgcaacaacatctatgcattctgtgggttgatttctggcgagcagttttattcatctgagagtcttgatgatagccaaaagctgtttgctgatgcattggtaaagaaagcatatgataactggatgtatgtcattgaatatgatggcaaaggtcttttgaaccctaaaccaaagaaaaagtctgcatccactggtcaagtggagacacatgctctgcgggttggcccgttggactattcaaacaataccatgtcttcgatggcatgccagggccatcaccatcaggtggaactgattctgcagggtatggcgtcgaccaaagcgcaacacatccatctcagctgcagagttcatccgccaatgtccaggcaccatatgatgacacattttcgttcttaccacctaacatgctgacagggtctgcaaatgatgccatgggtctggaactgggccagttgcagcaagtaacttctcaaggccagacaattcagccagcaaacgtgggatatggtgattggcccaggaaccgtgacagtcagtatcctgatgacttcactgaggacattcgcgttaagagccaccagttgctcgagggcgaggacatgcagcagctgctgagggtcttcagcatgggtggagcttctggcagtttgccagacgacaccttcaatttccagtcctacatgccctctccgttgcccaacctcgggttcgaaactgagcgtagccattcgtctggcaaagctgttgttggctggctcaagatcaaggcggcgatgaggtggggaatcttcgtcaggaagaaagctgccgagagaagggcgcagctagtcgaactggaggattgacaccgtggctttacaatggtcaaggttgccttgtagattactagtagttatctgcccccataccttcctgttaccgtttaaacaagtttctgaaactcttttctgaaatgtacaacgagtagttctactattttcttgtacagaattcaccttgttttgattgtgttagttgtggaacattgctctgctaagtttgacacatgactggacccgtatgcttgtgtatcttattttccatagctcttcagtgcagaatgtaccgcaacgatgcgaattaatccaaagattatgtgtacatgttgatgccttgcctttaaaaggcccccagggccaaaaagtcgacgcgg

SEQ ID NO: 14887 - DNA, 1350 bp, Zea mays
attcggctcgagggaaattcagacttggtttgaagattgcctcaggattttgtgagggggttcgctttcgtgaggcaaaaacagaagcctgtatggttaaggaccatagaggagaattgtacaagaagcactatccacctacactgaaagatgaggtctggaggttggaaaaaatagggaaggatgggtcattccataagaggctgaacaaatctggaatatctacagttgaggatttccttaggcttgtggttcgggatccacagaaattacgcagtatacttggaagtggtatgtccaacaaaatgtgggaaacccttgtggagcatgcaaagacttgtaccttaagtggaaaatattacatatactattctgatgagactagaagtattggtgctattttcaacaacatctatgcattctgtgggttgatttctggcgagcagttttattcatctgagagtcttgatgatagccaaaagctgtttgctgatgcattggtaaagaaagcatacgataactggatgtatgtcattgaatatgatggcaaaggtcttttgaaccctaaaccaaagaaaaagtctgcatccactggtcaagtggagacacatgctcctgcgggtggcccgacttcatatcaacaatacctctcttcgatgagcatgccagggccatcaccatcaggtggaactgattctgcagggtatggcgtcgaccaaagcgcaacacatccatctcagctgcagagttcatccgccaatgtccaggcaccatatgatgacacattttcgttcttaccacctaacatgctgacagggtctgcaaatgatgccatgggtctggaactgggccagttgcagcaagtaacttctcaaggccagacaattcagccagcaaacgtgggatatggtgattggcccagaaaccgtgacagtcagtatcctgatgacttcactgaagacattcgcgttaagagccaccagttgctcgagggcgaggacatgcagcagctgctgagggtcttcagcatgggtggagcttctggcagtttgccagacgacaccttcaacttccagtcctacatgccctctccgttgcccaacctcgggttcgaaactgagcgtagccattcgtctggcaaagctgttgttggctggctcaagatcaaggcggcgatgaggtggggaatcttcgtcaggaagaaagctgccgagagaaaggcacaagttgtcgaacctgaagattgacaccgtggctttactatggtcaagggtggcttggagattactaggagttatctggccccatacctttctggtacacgttaaaccagtttctgaaactcttttc

SEQ ID NO: 14888 - DNA, 731 bp, Zea mays
ggagactagactggcaattcctggctatgtgactccattgaaagctggagaggttatggaatcaaccgaaggaatgatgaacaatgaactgttggcgttagctcctgcagatggaagcatgtatagggaggaggatggattgctgccacagtggtttagtgaagcaatgtctggccccctgctgagctcaggaatgtgcactgaagttttccagttcgacgtgtccccatcatcagctcatccaaatggcatcattcctgtctattccaatgccatgtcaaactcgtcacagaacttcactcaagatctcccccctgctcgtgttcgcacggtcaagaacagaaggattttgtactccgaggccattcctctgagaggttcaacatccaacgacactgagcacctcaagagctttggcagtacgaagcctgtttcgtcagtggtcgtctctgtgctggctgatcccagagaggctggcgatggggatggtgagggaaggatctcttcaaaatcattgtcccgcatcttagttgtcgttcttatagatagtgttaagtatgttacgtactcttgtgtcctgccgttcaaaagccatagccctcacctttaggtctgccgttgataaagctgacctatacattttatagcagaagaggtgtaagacagctgcctttgttcatttattcaagttttgtgtgccccatgatgtaaaaaaaaaaaaaaaaaaaaaa

SEQ ID NO: 14889 - DNA, 2622 bp, Zea mays
  misc_feature (309)..(309): n is a, c, g, or t
  misc_feature (434)..(434): n is a, c, g, or t
  misc_feature (473)..(473): n is a, c, g, or t
ttcgcccttattcagaagcatatgggttcgcactaattgaacaagagcatgtacaccatttctggacatatgaacaacaagcatattgaatcacattcaactaaaataaaaggtagagcctgcagtggttccagcaccagataaattggatctgagggtaaaaattctaggaagattgaagcatgtaccttgataaaacagtgctaacagagatgtgccgtgcatacaaattttttacttccgtcgcaacgcacgggcacatacctataagtagtagagatagtagagatatcatgtaaaatactgatntgatacactattaaatgcgcaagaaacctaccattgacaatagcctagcctccgccgccgtgccaagcagccggcgggctgcgactgtcgccatgccggtttcagcccatttaaaaatacggccnaagttttagcctgtatgcattgaggcccattctagcganccattgaaggtgccagccacctcctggcccgccacagttatgcaccgctgcacacgccacacgggcacggcgccttcgtctccaacacggcgactaattaaccccactgattccgacgaccgagctcccccacactttttcctggcaaaccctgcacgcctccgcaaccgcaaccgcgtcgtcggcgtgcgcgatcccgagaggcccagccatcagcttccttggcggggtgtgtatgcgcgtacgtcggccgtgaccagatcggctgagccaaggccatggcggaaccggccctcctcgcgccggaccccttcgcggacctccccttccccgaatttcaggcgcccatcgacggcgacagcttcgcgctcgaggacttcgatctggaggatctggacctggacgtggacttcgacctcgacctcttcgcctcggacgggcaaccctcgcaaccgcccccgctcgcgacctcgtcctcctcggccgggtctccggttggaggctcgtcctcttccggtgccgtcggggacggcggagggctgaggaatgaggagtcttcggagtcgtcttcgaggagcgcgagcggcacggatggcagcggcaaggggaagggggaggaggacgaagcgaagcggcgcgcgcggcaggtacgcaaccgcgagagcgcgcacctgtcgcggcagaggaagaagcagtacgtggaggagttagagggtaaggtgaaggccatgcaggccaccatcgccgacctctccgccaggatctcctgcgtcaccgccgagaacgccgctctcaaacagcagctgggtggcgctgctggggccgcgccgccgccgatgccgatgtaccccacgatgtattctttgccgatgccgtggatgcacccatcgtatcccatgcgtggatcgcaggtgccgctcgtgccaattcctcggctgaaacccccgcagcctgcacctgctgtagcagagccaccggccaagaaggctaggaagaccaagaaggttgcaagtgttagtctcctggggttgatttgcgttgcaatgctttgtgggtgtttgattcctgcagtaaatcggatgtatgactctgttgatgctggagaaggtgctgcatacggtccatctcatcgtgggagggtgctggctgttgaggggcctcatgataatgtttcagatggtgtcgatccaaagccgccacagcgtgccagtgagacgcttccagcactgttgtatctaccaaagaatgggaagcatgtcaagattaatgggaatcttgttattaagtcgattgttgctagtgagaaagcttcattgcagatgtctggcaatgatgggaagcgtcctcaaaaccaagaggaggagactagactggcaattcctggctatgtgactccattgaaagctggagaggttatggaatcaaccgaaggaatgatgaacaatgaactgttggcgttagctcctgcagatggaagcatgtatagggaggaggatggattgctgccacagtggtttagtgaagcaatgtctggccccctgctgagctcaggaatgtgcactgaagttttccagttcgatgtgtccccatcatctgctcatccaaatggcatcattcctgtctattccaatgccatgtcaaactcgtcacagaacttcactcaagatcttccccctgctcgtgttcgcacggtcaagaacagaaggatttcgtactccgaggccattcctctgagaggttcaacatccaacgacactgagcacctcaagagctttggcagtacgaagcctgtttcgtcagtggtcgtctctgtgctggctgatcccagagaggctggcgatggggatggtgagggaaggatctcttcaaaatcattgtcccgcatcttagttgtcgttcttatagatagtgttaagtatgttacgtactcttgtgtcctgccgttcaaaagccatagccctcacctttaggtctgggttttggacgtgagttgataaagctgacctatacattttatagcagaagaggtgtaagacagctgcatttgttcatttattcaagctttgtgtgctccaaaaaaaaaaaaaaaaagcggccgatctcgtttggccttgtgaactttgatgatgtcgcagggcttttcgtagtc

SEQ ID NO: 14890 - DNA, 1085 bp, Zea mays
agaacaaaggcaattcatgcagattttttttttttttgtctgcagaacatgtcgtgtattatatggcacgaggatagaacagattttcaggctctccagtcttacaggaaggatggctttcctttttattcaagagattttcctagcagctacagcttcctttcacagggttttttttgctgtgaggcaacaatctgaagggcagcgagcggtgtacgcaatgcatctaggtcgacttgacgatgtcgtccctggtgttgacggtgaagtcccagagctcgccgtacttctcgttgaagtcccagatgtccatggagttgtagtcggcgatgagcttgtcgcgggccgacctctccatcatgtagatctccggctcgaagttgtgcggcttgtcgggcttgcccatctcgatgacgcagaacaccacgatgaagacggccgccccgatgtacaggtactcccccggcacattgaaagccatgccgaggatgatcgcaggaggaaatgcccaggagatgagtgcttgaaagccctgaggaggctcagcttcttggtaccactcggagacatcctcccagaagcccttcttgtcttggccttcgaaataggtgtggtgtccgtcatacttcccgtactcgaagtcctccgggctgatgccgttggtgcggtacacgtcgatggcgtcctcctccaggtccggctcgatctccgacagcggcccaggcccggccctcaccaccaccgcgccgccgcccggcctcctcccgacactcgaacgccggcggccggcgtgcagcagctgtggccgcgccgccgccttcaccctcagctgctgcggcgctgcgtcatggcggcgccgagcggtgctgggcgctgcagatggcgaggcagagatgccggaggacaggctgctcattatctcgccgcggtgctgcgatcgctgctgagtggtgactggtgagtgctccagcccccgctgctggctgctgctgcacttcacgttgcggcctcgcggcacttccgcttgccgcctatctaaacggctcgtctaaccgctaccccggccggcctcgaggtacccaatg

SEQ ID NO: 14891 - DNA, 816 bp, Zea mays
  misc_feature (725)..(725): n is a, c, g, or t
  misc_feature (798)..(798): n is a, c, g, or t
cttcgcttttaaattcgagaagcaaaaccgcgacctcgccggagaacaatggccaatgcactgccaggccagaaaaccggcgaggtcacggcgacgcagaatccgttcgagttccatgtgtacggcccgcgtcacctgtcgtcccccagctggtgggatctcctccgttcgagctggaaggatcccagctaccggcggatggtgatcgcgtgcttcatccagggggtgtacctgctggagctggaccggcaggacaagcgcgacgagcgcaccgcccttgcgccgcagtggtggcgccacttcgtgtacaggctctcccagacactcgtcgacgagcgcgacggctccatctacggcgccgtgctcgagtgggaccgccgggccttgctggctggctacgcgccgttccgccccgccggcgccccggccgccgtcgtggcgctccgcggcacgctgctgagcggggccacgttccggcgcgacgtcgtggacgacctccggttcctggcctgggacagcctcaagggctccgtgcggttcgccggcgcgctggccgcgctgcggtccgcggcgcgcaggcacggcacggggaacgtgtgcgtgggcgggcactcgctgggcgccgggttcgcgctccaggtgggcaaggcgctggccaaggaaggcgtgttcgtggagtgccacgtgttcaacccgccgtcggtgtctctggccacgagcctcangggcttcgcggagacggccggcgagatgtggggctacgtgcgcgcgtggctgccctacgtgggctcggctgcngcggcggacgccggcggc

SEQ ID NO: 14892 - DNA, 796 bp, Zea mays
ggaaacacttttatcaagtgtaaactaacatgttatcttttgtgcagaccatgctaagcagtaagcacggaatcaaacgacaagctgagtgcaagaagtacctgctgccgcacgtcagttgctccaggaggtccagctgtgcacggcccgaagaagctgcaacactgggttcctgtgtagcgccttcctgccgcgcggtcgccctgcagcaaccgagtgacctctgcgcgggggcgacggaggccttgagggggaccctgccgttcttcacccccgccgccgcggcgtccaaggcatggagcctcgtggcggaggaaggcgggaagctgcatgccatggagttgatggatcgacgcgctgatggcgcgagcgcaggttgccacgaaggtaggtaaggatacagagcaacgaccgaagaacgccgaagagagtagggagagtatttagttcctcgtgtgctatatcaaatcaattccccaatttctagcgtcaccggtggcgccgcctgtctccgccacagaaaattccgtgaccggcgagcggagagttggcgcggccgcggcgcaccacatgttcgaccttccttgggatctagcggacggcggggccacaaaatatttcttttctggaacgaccaccggccttctcgattggacgccgcgtcgcgtgggcctaaaatcaacagaaaagggagcggcccaactaatatttggtcgccgctcgctcgctcgctctaggacgtcggaagccaccagcccagcccataccgacttttcttctccccccttcccccccc

SEQ ID NO: 14893 - DNA, 3660 bp, Zea mays
ggtaacgatcgtgaagattctatgcctaatgccaaaccattgggccttggccgagcaggcactacaatcgacagagatgaacacaagcgctttgtgaggtactgttttctatgtgcagtatctgcaccgacacccttatgaagttatattgcatgaagcacttttccccttaattattctatagatatagaaatcggagtaatttcagctttctcatggacagatgaagaatgaaacaaaaatggtactatattcatagcatctgagcatttagtgcataggcagacagcacaatgaatatgaattgagctttcaatataagatattgaaattttaggtgccgggttattatataccagtaggcacatgaaacggagcagccctaggctatgccagggccagcatatttttcatgctgtgaggtactgttcatggtgtttttaggattaaatttataatttaaaaataaggttagattgagttgattccttgattttagagaatgtctcttaaaagacaagttacccatccatgtgaggatggaattctggttaatcaagaaatgacaaataagtagatctagactttctatctccttatctattcctgtccttgcggtgtagctgctgggaatcggcataggtgcactgcttggattaagggccatcgaatttatgcccttgacatactatcttttatgttcagacacttcaaattaatttattagttacccgatttgagatctcaagtaaaaaaacacatgatacctattgtttgatacttgataccagttttggacaatattcatgacatggtgagatcaatgaacatcattgccagtagtgatatcaatatatcactgaacttcttggcttcagcacattttcctctctttgtaatatattattgaacttctcgactttaacaccttgatttctcgtggcgatataatatggccgctttggattttgtacaatgacgtgctgtgaccttttgattaaatttccccgacatggtacatctgcagggaagttcacgaggaagtaactgaggcaaggcagaaggcctcaacagtaagatctcgcccacgcgtccgggatgctgctcgtagagagaaactcaggcaagcttacctgaagaaacgattggagaagttgattgctgaaaaacaggcctcttcaaccagtgattgacctacccagctagctagtatatttccttgcatgttctatcaggctaccagctgtagcctgtagtagtccatggtctcatgcaaccatggaacggttactgtaaatgtcttctgatccagtacagtcgaattcaggaaatagcgtttgcatgtacaggtggtgttgcagaatattgttgtacacaattctaggcaatggcatcatgattttctgagacattcgctagacccaatccatatttcttcagctttgtcccattatatatgtttggctattttagacaatattcccattacgtttgctgtgtctccattttggacggatgtttatagtcttggttctagtagtcgtctgaaacttgaaaatgactcacaaacaagtggaggaagaagcaggttctgtattcgtattccctttgataggataaaaagttcatttgccctttctgtgattcttctccaacttgctactagccattcttgctggactgcatatcatgctgcctccaaactattcctcttcgcttttaaattcgagaagcaaaaccgcgacctcgccggagaacaatggccaatgcactgccaggccagaaaaccggcgaggtcacggcgacgcagaatccgttcgagttccatgtgtacgggccgcgacacctgtcgtcccccagctggtgggatctcctccgttcgagctggtcagttactctcaccttattttctgcgaagcgcacgacaaaagctccgtgtcactggtcttaggcttggggtttctcaggaaggatcccagctaccggcggatggtgatcgcgtgcttcatccagggggtgtacctgctggagctggaccggcaggacaagcgcgacgagcgcaccgcccttgcgccgcagtggtggcgccacttcatgtacaggctctcccagacactcgtcgacgagcgcgacggctccatctacggcgccgtgctcgagtgggaccgccgggccttgctggctggctacgcgccgttccgccccgccggcgccccggccgccgtcgtggcgctccgcggcacgctgctgagcggggccacgttccggcgcgacgtcgtggacgacctccggttcctggcctgggacagcctcaagggctccgtgcggttcgccggcgcgctggccgcgctgcggtccgcggcgcgcaggcacggcacggggaacgtgtgcgtgggcgggcactcgctgggcgccgggttcgcgctccaggtgggcaaggcgctggccaaggaaggcgtgttcgtggagtgccacgtgttcaacccgccgtcggtgtctctggccacgagcctcaggggcttcgcggagacggccggcgagatgtggggctacgtgcgcgcgtggctgccctacgtgggctcggctgcggcggcggacgcgggcggcgaggccaaggaagtgtcgctggggcgcgccgggacggccaagtggttgccgcacctgtatatcaacaccaacgactacatctgctgctactacaccgacactgcggccgggacggcgaccgtgacggccagaggagggagcgggggcagtaaggttgctggaggggacggtggcatcggcaagccggggctggcgaggatgttgacggtgtccaaggggccgaccaagttccttgatgcgcacgggctgcagcagtggtgggctgacgatgtggagctgcaggtcgccctcaaccacagcaaactcatcgaccgccagctcaggtcgctctatgccgcgcagccggcctcgccgcaagtgaaccagtaggctgtgtagctctgtagcagctcacaaaacgctgagaaaaaaacgcaacgctagcatgatgctgttgatggattggactccgctgcgtgatggtccgctgagcgcacggatgatgagcgttccaaacatttcggatttgaaacagttgtgggcttgtggcaaatttaaaaaattcaaaaagtgaatttcaaaataatacgactccgctggggatcgaaacccagaatctctggttccgtagaccagcgccttatccattgggctacggagtcatttttgttttgaattgttaaccagattttatgtccttttgcacctcatacaaatttatcacgaatttccagataaactgatttgatacagtaattcggtgtgctcagtatatagttttccgaataaatgaattcgatacgataattcggcgtgctcagtatatttgacagttgatatgtcatttgttttaggctatgtttggttcacaccatatatttgaaatctgatattcaaaatgtattattccaaacatatactaccagaattcggcactttatcgattgtttttttggcactccacaaataagctctttaccgagtgtctaacaaaaaacgcttggtaaaaacaaacactcggcaacgggttttctttgacatgtgtttaatttttgacactcgtaaaagaacttc

SEQ ID NO: 14894 - DNA, 995 bp, Zea mays
ttttttttttttttttatacataaaaaaacctgctgacccaacatacaaaaatattgctatgtgcacatatatatatatatacagtcctatattgcagagcaaaactgcaaaagcatgttcccatatgatatgacagtgtggagatagctagttaaatagcatgcagcatcttggtggtcatgggaagagctggatatacccagtgaggacaccgatagctagaatggcgagaggcgggacgagcacgaacgcgccaacggtcgcgaagaacaccgagtcgttccgcccgctgacctgggtgagcagggcctgcctcttgatgttcctcctctgcgacacggtgagggagttgagcctcttcagaccttccttcagcctcttgcccagtgggagggtgaactcgtcgaccttaccgttggctagcgttgacagctgctcgcggatggtagcacgccgacgcggttctggtggaggcatgccgttctccaggccagccgcagcgtcatcaggtgtggcggacgtcagttgctccaggaggtccagctgtgcacgggccgaagaagctgcaacactgggttcctgtgtagcgccttcctgccgcgcggtcgccctgcagcaaccgagtgacctctgcgcgggggcgacggaggccttgagggggaccctgccgttcttcacccccgccgccgcggcgtccaaggcatggagcctcgtggcggaggaaggcgggaagctgcatgccatggagttgatggatcgacgcgctgatggcgcgagcgcaggttgccacgaaggtaggtaaggatacagagcaacgaccgaagaacgccgaagagagtccgggccggcctcgggtcctcgtgtgctatatcaaatcaattccccaatttctagcgtcaccggtggcgccgcctgtctccgccacagaaaattgccgtgaccggcgagcggagagttggcgcggccgcggcgcaccacatgttcgaccttcctt

SEQ ID NO: 14895 - DNA, 926 bp, Zea mays
  misc_feature (874)..(874): n is a, c, g, or t
cctcgagccggccgggggaagcctcagcccagcccataccgacttttcttctcccccctttcccccaccaccggttggttcctcttccggtctcccctgccggcgagccgacgaacccaccctcgtggcacctacggcaccgccgcgatgtcgttgccggcagcgaccgcgccgtcctcttcgggggcgacgcagccccatccccagcccacggagcagcagggaggctcgagggagcggcgggtggagtcgctgggatggctgacggagtcggcggtgatgccgaagaagcacaaggccatcgagggggtcggcgccgcttcgatcctcgacctcaaggcccagctctaccgcacccaggaggaggcccgaaaccccaccgcccccggcgccgctgcttccggcggggagttccgccgcgcaaagatacgctccgcacccaccgaccctctcggggccaagaactccggcgttgcatcccgggcccacaaggataagctggagcttaaagccgtgaaggacggttctgcaagctatgctgctctagaaaagaaagcagagctgtatgaaaaattatccagaggcgagctacctgacgaagaagacaaagagaaatattgtgtggatttcttccaaaaaagtttcgatcgtatctatgagcctcagatgccagagattagccacagagccactgatgctgcagagccggtaaatgatcatgaagattctatgcctaatgcgaaacccgttggggcttggccgagcaggcactacaatcgacagagatgagcacaagcgctttgtgaggggggtgcttgaggaagtaactgagggacgccagacagcctcaacagtaagatctcgacgacaagancaggatgctgctcgtagagagaaactcaggcaagcttacctgaagaaacggt

SEQ ID NO: 14896 - DNA, 1583 bp, Zea mays
gtcccgcaccggcgccgagatgggcctcgccgccggccgctcctgggcgttcaatgacggcgcctacaacgccctccaggtctcccccggccacttcgacgagcgcgtcttcaaggcgctggaccgggtggtcgtggaggccgggcggcacggggtgcggctgatcctgagcctggcgaacaacctggaggcgtacggtggcaagacgcagtacgtgcggtgggcgtgggaagagggcgtcggcatgtccgcctccaacgattccttcttctacgatccagccatccgcgactacttcaaagtctacctcaagacgctgctgacgaggaagaaccacttgacaggggtggagtacagggacgaccccaccatcctcgcgtgggagctgatgaacgagccccgctgcaccacggacccctccggcgacacgctgcagcgctggatggaggagatggcggcgtacgtcaagtccatcgacaagaagcatctgctcaccgtcggcaccgaggggttctacgggccgacgagcccccaggagaagctggacgtcaatccgggcacgtggaaggacaacaactacggttcggacttcatccgcaacgccaagatcccagacatcgacttcgcttccatccacctctaccctgacacctggctgctgcagcagcacgccacggtggacgagaagctcaagttcgtgaagcggtgggtggcgtcccacatcgaggacggggacaaggagctgggcaagccggtcctcgccaccgagttcgggctgtcgcaccgcgccaagggcttccaccactcccaccgcgacgtcttctacaaggccgtctacgacaccgtctaccggtcggccgcccgcggcggcgccggcgccggcgccttcgtgtggcagctcgccgtggaggacatggaggagttccacgacgacttctccgtcgtgcccagcgagcacccctcgctgcacaggctcatcaagtcgcaatcgtgcaggctggccaagcttaggcacggggtcggggaggaggccaagcggacgctgtcggtgtgcgccgccggctcgtcctaggaacgaccgacgagcggtgctgcgcaggcagaagccatttccacgcgtccccctttcagctttgttgcgcccagtccgagggttttgtctttgtttctgtcgtccgaatggagcgagtggtgatggtgaagtgtgtcagaaatagatcggagaaaaatgaaatagaaagcagcaacagcaacaagaaaaaaaaagtgtgttacctcgtgaggctttggtaatgctgctggttagattcgtttgtggccacagcaccgacgcctcacgcagtcacgcctgcccgtggaatggcagatcggcatagataagctacagtttccgtcctgtgcaactgtacgttagatgcccttgacctttgatatatagagtcatcgtcgggtggcatccaatggtaatagtcctccatatagtgtatttctgcaatctggacattggacctatatttatatatagctgtaagcataagaggacaaaaaaacacaacatcttcgctttataaaaaaaaaaaaaa

SEQ ID NO: 14897 - DNA, 2821 bp, Zea mays
gcacgagaccattacctagaacatcctaatcgaaaaaaggtcccaagagtagagttggatctcgccttctccctgtcgtacccaacggcgttttcccctacattgtcctatcatgcttgccggaggattcgagctaccgcggcggcagcggtgacgtatcggtatcggcggcagcgatggcggcggcggagtgggacagccggagcgtggcgagccccaccggggattggccaccggcggccgccgcgtccccgataaaggggaaggcggcactgccggagtcggatggaggtgcctcggcgtccggctcatcggaggccaaggtcgacgatggcaacatccaggaggcggagtcgtcgctccgcgagggtctctccctcaactacgaggaagctagagctctcctttggagactggaatatcagagaggcaatgtggaagctgctctgcgagtatttgatggaattgaccttcaagctgctattcagcgcttccaaccttctctttctgataaaccactctcgaagcgaagtaacaaattacgggcagattcatcaaattcaggatcacagcatgctgctagccttgttcttgaagccatttacttgaaatcaatgtctcttcaaaagttgggcaaggcaatggaggctgctaaacagtgtaaaagtgtccttgatgctgttgaaagtatcttccaatgtggcatacctggtgttatggttgaacaaaaactgcaggaaactgtcagtaaatctgttgagcttctcccagaactttggaagcaagctggggcctatcaagaagcacttgcttcataccgccgtgctcttctaagtcaatggaatcttgatgatgaatgctgcacaaggattcagaagaggtttgctgttttcttgttgtacggtggtgtagaggcggcccctccaagcttggcttcacaaactgaaggttcatttgttcctaggaataacttagaagaggcaatcctactgctcatgatactattgaagaagtggttccttgggaagacacactgggatccatctgttatggagcatttaacctttgcattgtcactgtgtggccagacatctattattgccaagcacctcgaagaggttttacctggaatataccctcgaaccgagagatggtatagtctagcgttgtgctattttgcagtttctcataatgaagctgcattaaacttgttgaggaaatctttgaataagaatgagagtccaaatgacataatggccctcctgttagctgctaagatatgtagttccaataatcttctttcttctgagggtgtagagtatgcaaagagagcagtcagagatgccgaatcatcagatgggcatttaaagagtgtggccctccatgttctggggagttgcctgtccaggaagtctaaggttgcttcatctgatcaccaaaggtctgtcttgcaggctgaggctttgaagtcactcaatgaggcaatttctcttgaccgtcacaacccagaattattatttgaattggggatagagtatgctgagcagcggaatatgcatgctgccttgaaatgtgcaaaggagttcattgatgtcactggtggatctgtctctaaaggctggaggttgctattgttggttctttctgcacaacaaaggtattcagaagctgaagttgtaactgatgctgcattagatgagaccgcgaagtgggaacaagggccattgcttagaataagggctaaactgaaggttgctcaagcattgcctatggaagcagttgaagcatatcgcacccttcttgctcttgttcaggcacaacggaaggcttatggatctgtcaaaaatggcacagaggataatgaggataaagtgagggaagttgaagtttggcatggtcttgccaacctgtactctagtctttcctattggagagatgcagaaatttgcttacagaaggctaaagccctcaaaacatactctgcgacaacccttcatgtagaaggaaacaaacacgaactgcatgagaagatacaggacgcggtagctgcatacttcaatgccatctctatggaggtagagcacgtcccatccaaggtctctatcggtgctctcctctctaaacaagggcccaagttcctaccagtggcgaggtgtttcctctccgatgccctgaggcttgaacccacgaaccgcatggcctggttctaccttggggaggttcacaagcaggacggcaggctagctgatgccgccgactgcttccaggcggcctcaatgctcgaggactcggatcctgtagaaagtttcagatcactctgatgggtcatctgcaacagcgtgaggttccctttttttgtcggccggttttctcttcgtcttcccccattttcgaggcacagctgggcagagaccaggtgcccagctatctgtaacttgttgtatctacagttgtcagtgtgtaccaacagatgctgtaattggttgttgagtggcctacatgattcttcaaccgatagctccatcaggatcagagtggcactggaacagctatgcaatcatatgagccattattattacgtgtattacacagtatgaatatatgattataatgagtcatcagctaacttaaaactaccgttgctgatattgtaatgttttgtaatttttattcctgttttgtttatcaattaccagacgtgctgaacagtgagcacaccacgggtaaaaaaaataaaaaaaaaaaaaaaaaaaaaaaaaaaaaaaaaaaaaaaaaaaaaaaaaaaaaaaaaaaaaaaaaaaaaaagggcgcggacgcgtgg

SEQ ID NO: 14898 - DNA, 4106 bp, Zea mays
  misc_feature (61)..(61): n is a, c, g, or t
ctgccgggtatggatattatggcgggtagattttgtttttatgggtataaatatgagtatncaatacccgatggataagtactcgttgccatctctagatctgacccagctcaaatcttgatacccaatggagaaaccatggcctactctcgctgggtccacgggtcacggaggttgccaccatcctgtcacggaagcccatctacctatcggcccaggaatgtgcccgggatgtgggacggggtttcacgaggagaacataccaacgacatcctcaggaaccgttgacgtggcgctcctcctccgacgattcgctccctccctcgagtttcaccactccctcctctcgcggccacgcactcccccgcctccgcaacctctcaccgccggtccccgccctccgaccctccacgcgcaaacagcccgcctccatccaccaggatccccgatgaggtgaggcctgctaccgatctcttctcgtgcacgaatcccctctcgcccccctcccctggccggggactccgatgcggcgggatcccgtggccgtgcctctcgcgcgtggaagccgggagccgcggagagaatgcggaccagcggtggcgcgtgcttgcgacggcgtttcggcggctgcgggatccgtttctagcttggtttcgtgtccgtgtccgaggtatcggggcgtcggtcgggattacgatttgcgtgcctccagctgtgctgtgatccggtgatcctgagcggggaagtgattggttccctgtttttatgggattttgctccaatcggaagggggaactgggtgggtgttgtgggtggtgtcatccggtcgtggaaattgctcgtgcgctgcggtggtaggccctgaggcctgacccacttctgatccccgatgagctaggagaagtgttgatttggatattcgtggagtgtgcaatggtggactttgttcgacggctcgcctctgccctgctcaagtgctgcgaccttgacatacccaatcggccaaagggcctcgaggaccccgaacgcctggctagagaaactgtttttatgctctttttactctcgctatgcttgttttcatatctgttgccgtttattcagcagtggattttctgtattctgcagttaatgtgaatgaaatcgaggctctgtatgagctgttcaagaagattagcagtgctgtggttgatgatggcttgattaacaaggtttgtaggttctaagctcttagtgtgaagtggcagtgaatgacaactttgtttccatgaagtcattgtgtctgatctctccttggagctttgatgtattatctgcaggatgaattccaattagccttgtttaagaccaacagaaaggatagcatgtttgctgaccgggtatgcccactggatccttatatatattttgtcagtgaaaattttgttgtcatgaaaccaaagctcactgctgaaaacttcatggaattcagtctgttcttgccaaatatattgtgtttttttgctatttgggtcacattatttttctagttgtgttttatgaaaggatcaacagtatagtatttgttttatgaacattcacattaatcacattatgccaagctgtctagaacagtgataggacatcatagaccctgagccttttaagcttcaatcatatgcttacacatatgtttctgtgggcatgagttaagctgttaacacatttcaatgtttctgcatgtccgattagtagttacccacctgcaatcattggaagggggatgctcaatgtgaactgtctttttgttacaaattcgctatttcttttggagtgacctcaaataaacactaaggtatcttgttttcatttcattgacttaggtatttgacttgtttgacacgaaacacaatggaattctcgagtttgaggaatttgctcgagccctttctgtgttccatccgagtgcaccaatcgatgtcaaaattgattgtgagccttcttccttaactttattcattcattcatttattcttgattacgctacataagtgaccgattatcgagttatgggtttaatttgtgataatactaattcaagataagacgatgagtcagtgcttaatacatatcatgaaaacacttctggacatgataggcagctggggctgcaatgcatgttatggcctttcgaagactaaataatgaacattgtaaaaattgaaatatacatttcctgctgtggtacatgggttaaatggactgccacttactccattttgttgtgactagaaatagtttcttttgattttgtttctttctaaggctctgtagggagggataagctttgtagagagtatattagtgcgaggcctgcaacctgcatctttaccatgcacatacaaaatctttaggtcgggaagttttctatgatgaactatttagaacgagtatgtagttaaccaattcagtttatcctattttgggaaattatgctcgtgtcgtactaatcattcgcttccatgatcttgtttcctattaacttgcagttgctttcaaattgtatgatctcaagcaacaaggtttcattgaaaagcaggaggtaccttgcacttgcttatattcttaagtaaatcacttcttccgcgccattatttgttattgcatttgattcgtttgcatgatccatgttgcttcaattttttctacatgtgttacactagcttgtacgtgagtacaattattcaccctctcaagtcatgttctaatttagcataagtttttattcagtggaaatttatttctctagttaaattgaactaagctgatgatgttgaacatctatgaatctaaactgaggccctcatacacaaccctttttgtggaatgttcttatactttcttggacaaagtatatcccatttgatagtaattgcagccatcagcaatgaaaatgttattttgttccttcttgattgtcaggtcaagcaaatggtggtcgcaacacttgctgaatcaggaatgaatctttcagatgatattattgaaggcattattgataaggtatatctgagtacttgtagttctgcagggcgactgtcgagctcccctgggtcccgtgcttagttgctcatatttttttgatcttactagacatttgaggaagcagatacaaagcacgacggcaaaattgataaggaggaatggcgcagccttgtcttgaggcatccatctctgttaaaaaatatgaccctcccatatctccggtcagtactctttgatgagtttgccgttttcttaacaatttgagttttcttcctgaatacttgggttcctataatcctatgtaaagctcactagctcagtattgtggactctatatttgttaaacacacaaaacgtatgccatctgctccctgtatttctctatatttgtccatggtctcggaatttgctgtcattgatcctcaatgggtgaaaactatggtgctttaagtttcatattatgaatctgtgtaggtttgatggagtaacatcttttattgaaacattgttcttatcgtggattaatttttcaacagggatatcaccacaacatttccaagctttgtgttcaactctcaagtagaggatgcgtgaggtcccagcgtctacggcaccattgaagcccctggggcacagcagatcaggttctgtgggggcacttagttgtttttgtttccttgaaaatgtaaattttatgtggtggcatgtcctcctgtatagtgagtattgctattgtgcacagaattggggcatgaagcgtttcttgtcgctgtttataaaatattcttcaaacatattgctcataaaaaactactcaaagtaagaatcaaattgagtacaaaactactcaaagtaagagttcatgtgaggccacgtgatgccacaaaagatggagatgctctttgcctcctttggcgggatgagttcaatagccaaacctttgtcggagcaaaacacaaccttatttgttgtgtttggtaggtagtgtttgggttgtggagttagatagaccgagccgctctgtttcagcatatagcatgtttgatttgattccagatagattgagctgctctaaaagtgaa

SEQ ID NO: 14899 - DNA, 1420 bp, Zea mays
ataccaaccgacatcctcaggaaccgttgacgtggcgctcctcctccgacgattcgctccctccctcgagtttcaccactccctcctctcgcggccacgcactcccccgcctccgcaacctctcaccgccggtccccgccctccgaccctccacgcgcaaacagcccgcctccatccaccaggatccccgatgagctaggagaagtgttgatttggatattcgtggagtgtgcaatggtggactttgttcgacggctcgcctctgccctgctcaagtgctgcgaccttgacatacccaatcggccaaagggcctcgaggaccccgaacgcctggctagagaaactgtttttaatgtgaatgaaatcgaggctctgtatgagctgttcaagaagattagcagtgctgtggttgatgatggcttgattaacaaggatgaattccaattagccttgtttaagaccaacagaaaggatagcatgtttgctgaccgggtatttgacttgtttgacacgaaacacaatggaattctcgagtttgaggaatttgctcgagccctttctgtgttccatccgagtgcaccaatcgatgacaaaattgattttgctttcaaattgtatgatctcaagcaacaaggtttcattgaaaagcaggaggtcaagcaaatggtggtcgcaacacttgctgaatcaggaatgaatctttcagatgatattattgaaggcattattgataaaacatttgaggaagcagatacaaagcacgacggcaaaattgataaggaggaatggcgcagccttgtcttgaggcatccatctctgttaaaaaatatgaccctcccatatctccgggatatcaccacaacatttccaagctttgtgttcaactctcaagtagaggatgcgtgaggtcccagcgtctacggcaccattgaagcccctggggcacagcagatcaggttctgtgggggcacttagttgtttttgtttccttgaaaatgtaaattttatgtggtggcatgtcctcctgtatagtgagtattgctattgtgcacagaattggggcatgaagcgtttcttgtcgctgtttataaaatattcttcaaacatattgctcataaaaaactactcaaagtaagaatcaaattgagtacaaaactactcaaagtaaaaaaaaaaaaaaaaaaaagagaaaccaaaaaagatggaaatgctctttgcctcctttggcgggatgagctcaaaagccaaacctttgtcggagcataaacacaaccttatttgttgtgtttggtaggtagtgtttggttgtggagttaaatagaccgagccgctcggtatagaattgagctgctttaaaagtgaaatatttttttaatattttaaaaaaaaaaaaaaaaaaaaaaaaaaaaaaaaaaaaaaa

SEQ ID NO: 14900 - DNA, 1613 bp, Zea mays
ctcgagcccggcccgcgaccggacactcccggacctagtagctaaacaaggctgacgtgctcctcctccggcgattcgctcccttcctcttcccccggccacgcacttccccgccccccgaccccgcaacctctcaccgccggtccccgccctccgaccctccacgcgcaaatagcccgcctccatccactaggaggatccccgatgagctaggagaagtgttgatttggatattcgtggagtgtgcaatggtggactttgttcgacggctcgcctctgccctgctcaagtgctgcgaccttgacatacccaatcggccaaagggcctcgaggaccccgaacgcctggctagagaaactgtttttaatgtgaatgaaatcgaggctctgtatgagctgttcaagaagattagcagtgctgtggttgatgatggcttgattaacaaggaagaattccaattagccttgtttaagaccaacagaaaggatagcatgtttgctgaccgggtatttgacttgtttgacacgaaacacaatggaattctcgagtttgaggaatttgctcgagccctttctgtgttccatccgagtgcaccaatcgatttcaaaattgattttgctttcaaattgtatgatctcaagcaacaaggtttcattgaaaagcaggaggtcaagcaaatggtggtcgcaacacttgctgaatcaggaatgaatctttcagatgatattattgaaggcattattgataagacatttgaggaagcagatacaaagcacgatggcaaaattgataaggaggaatggcgcagccttgtcttgaggcatccatctctgttaaaaatatgaccctccctatctccgggatatcaccacaacatttccaagctttgtgttcaactctcaagtagaggatgcgtgaggtcccagcgtctacggcaccattgaagcccctggggcacagcagatcaggttctgtgggggcacttagttgtttttgtttccttgaaaatgtaaattttatgtggtggcatgtcctcctgtatagtgagtattgctattgtgcacagaattggggcatgaagcgtttcttgtctgtgtttataaaatgttcttcaaacatattgctcataaaaatctactcaaagtaagctccctctctctctcgggaaccgagggagtcgtgtctgtgcgagtgtgccatggcgggcgaggggtcagaccctgcctgcctccccgcccccggtgccgccgccaccgaagcggagaaagatcgagccgcctaggaggtttcggtgggtgtgctggcagcgggagtcgatctcgacaaaagctagaaaggcaaagagatatccgccgtccttcaagcgcagcgtgagggagatgccttggaagctacaaaggcttcggttccctctttgggaagaatcaccttgttcctgtcatcccaacgaacgactgacgaacaagaatggcaatttgtaaggctgtgaataccgagcaggatgacccttgctgtttcctttaagagcgcgacctgataccgcatactaagctatggacattaacattaaaaaaaaaaaaaaaaactcgagcccgggtcgactctaaagccct

SEQ ID NO: 14901 - DNA, 1045 bp, Zea mays
  misc_feature (60)..(60): n is a, c, g, or t
attactggacacaaaattgcttgtcctacagatacaaaatggtatccatatgctacattntgtatcttcatcaattgaatggccaacgcagggacgagtttgatgaagaaaaggagcctgacggaatggttcttgctgggtggtctggcccagttgataagcaaattaccagtaatggtgagaatagatcagttccatcttcatccaatacagaagatgttgatggtactgccgaggatatatcagtgaagcctggaatgaagcgtaaactgaacgaaatattagaggcaaaggagaatttagatgctcttgagaatccttcggatgttgattccagcggcactcaagttgttgaagacgatgacaacgatgaccttgttatgtttgatgaggacccaaggcaagacaagaagatgagattgcaatagcatcctgttgcggtgataacagctcttgactcccggcatcatggctaacacattgttcgacttcgatcataccatctttgataagtcatctatgtggtgatgtgctaggttgatgttgagacattggtagcaatgcccgggacactttttggcctcagatactggcctgtaggattgtaatttgtaggttttaggcacgagcaacggaaccactgagcaatctgtcatgttaattgttaagtacttaagtggcactgtgtctggaaatatgtaatcctgtaatcttcttagtgctacgctatatgctagaaacaacgcctgggtttagaagctatccctgatttcctgtattttggaccgctttttgaaggaatatcattcataggatatccgcatggtaaaaaaaaaaaacaaaaaaaaaaaaaaaattggttgctatttttctatgcacctagatctacgaatactagacgtcaataaaagttgtgtatctagaatagtcaaaattatcaataaattgaaagggatggagtactgtaattgttttcatcctcgcattctgttatttgtcgatagaatctgttataagataatgcattttcaacaaattactatct

SEQ ID NO: 14902 - DNA, 2011 bp, Zea mays
  misc_feature (1)..(1): n is a, c, g, or t
ngccgtccccgagagccgcttcttctttctccgtgactcggagctgtctacctcaccctcactgcctctgcgtgcgtgcgtcactgccggtctgccgtgccgctgcgcccgctcccgcaataaataaactcacctctctctgttctccgttctcacctccctcctcatccatccagggacgcgccttgacttctcacgtcgtgtcgtgtgtgagcgcagcggtgctgctgatctgcgattcctccacgccacaccctacctgaccacccgacagggaatcctactccctcttgcgcgccgcggcggcggcggcggcatcttcggtctccgtgcgggtgtttccgttcggcgtttactggccgggcgagcgcggcattggaggagtcgggaggagggagacaggaggcgtgatcgatggggaactgcgtggcgagcgggggcgcgacgacggtcacggcggcaggggaggacgggaggcggcgggggaggaggtggaaggcgccgcgggaggagcagctcggctcggtccccggccggatcttctccaacgacggccgcagccgcaccgccgccgtgttcacgcagcagggccggaagggggtcaatcaggacgccatgctcgtctgggatgggttcggcggggaggaggacgtcgtgctgtgtggggtgttcgacgggcacggcccgcatggccacctggtggcgcgcagggtccgcgacgcgctgccgctgaagctcatggccgcggtgcgcgagtccaagcctggcttggacatggccgccgccgcgtggaggaaggcctttgcgcgcgcctacaaggccatggacaaagatcttcgctcccacgccaccctagactgcttctgcagtggcagcaccgccgtcaccgtcctcaagctcggctcggatctctacatggccaacattggtgactcgcgcgccgtgctaggctcaagggacggcggcggcatggtggccgtgcaactgactgtcgacctcaaaccagatgttcccagcgaggcagaacggatcaagaagtgcaggggcagggtatttgctctgcaggacgaaccggaggtgcctcgggtctggctgccgttcgacgacgcgcctggcctggcgatggcccgggcgtttggggacttctgcctcaaggattatggtgtcatttcggttccagagttcttccactggtcgctcacggagaaggaccagttcatcatccttgcatcagatggggtgtgggatgtccttagcaaccaggaggccgttgacatcgtgtcgtcatccccaagccgatcaaaggccgcgagatccctggtcgaggccgccgctcgtgaatggaaagccaagtacccgacatcgaagaccgacgactgcgcggtggtctgcctatacttggacggcaagatggaccaggaacgcgactcgacggcgtccatggacaacatcagcctggactacgaaggctcagccgcggacccgaacgaagcgcaggagctgcaggagccggcgctgacccgcaacttcacggtcaggacggtggccggaagtgcccacgagaaggcgctgtcgggggcggcagacgcggccgtcgccgtcggcggcggcgcagcctgcgcccacgaccagagctggtcgggccttgacggggtgacgcgggtgaactcgctcgtccagctccctaggttctccgaggaaaaggcggcggttggctgatgagccgccggctgctgcatgcgattctttggttttggttgttgagttgtttgtttcctcgtttttttggaaatctagtttagtagttgccccgttgttgtttgggaggaagggacacggtagaaacagaaatatggtgttgtgattcgaaaaaaaaaaaaaaaaagctggtgtgtttgagccactgtggtggactggtggtggtggttagggtgtgagctgcgacatttagcacagcaagagatgtgctttctggaaagtacagagggttcacccaaaaaaaaaaaaaaaa

SEQ ID NO: 14903 - DNA, 2563 bp, Zea mays
ccgagggccgctgtgcctcttctttctccgtgaatgggaaaagctgtctgactcaccctcactgcctctgcgtgcgtgcgtcactgccgcgccgctcgcccgatcacgcgataaataactcgcctctctctctcctcctcaagcagtcaggctcatccagggatcaggggacccgcccgccttgacttttcacgttgcgtttgagcggtgctgctgatctgcgattcctcctctctctctctctctccactccacacctgagagggaatcctgctccctcttgctccgcgcccgcggcggcggcggcggctttggtatccgtgcgggtgtttctgtccggcgtttacttgccgggccagcgcggcattggaggagggagatcggaggcgtgatcgatggggaactgcgtggcgagcgggggcacgacgacggtcacggcggcaggtgctgcaggggaggacgggaggcggcgggggaggaggtggaaggcgccgcgggaggagcagctcggttcggtccccggccggatcttctccaacgacggccgcagccgcaccgccgccgtgttcacgcagcaggggcggaaggggatcaatcaggacgccatgctcgtctgggatgggttcggcggggaggaagacgtcgtgctttgtggggtgttcgacgggcacggcccgcatggccacctggtggcgcgcagagtccgcgatgcgatgccgctgaagctcatgtccgcggtgcgcgcgtccaaggctggcttggatatgcccgccgccgcgtggaggaaggccttcgcgcgcgcctacaagaccatggacaaggaccttcgctcccacgccaccctagattgcttctgcagtggcagcaccgccgtcaccgtactcaagctcggctcggatctctacatggccaacattggtgactcacgcgccgtccttggctcgagggatggtggcgacggcggcatggtggccttgcaactgactattgacctcaaaccggatgttcccagcgaggcagaacggatcaagaagtgcaggggcagggtatttgctctgcaggacgaaccggaggtgccgcgggtctggctgccgttcgatgacgcgccaggcctggcaatggcccgggcctttggggacttctgcctcaaggattatggtgtcatttcggttccagagttcttccactggtcgctcacagagaaggatcagtttgtcatccttgcatcagatggggtgtgggatgtcctcagcaaccaggaggctgttgacatcgtgtcgtcgtccccaagccgatcaaaggccgcaagatccctcgtcgaggccgcgacccgtgaatggaaaaccaagtacccgacatcgaagatcgatgactgcgcagtggtctgcctatatctggacggcaaaatggaccacgaacgtgactcgacggcctccatggacaacatgagcctcgacgaaggttcagccgcggacccaaacgaagcccaggagcaggagccagcgctgacccgcaacttcacggtcaggacggtcgccggaagcgcccacgagaaggcgctgtcgggggcggtggatgtggtcgttgccggcgcagcccacgaccagagttggtcaggcctcgacggggtgacgcgggtgaactcgctcgtccagcttccgaggttctccgacgagaaggcgatcggctgacgagctgtgcaattctttggttttcagttaacttattatcttttcctgcttgaaaatttagtttagtttgcccgttgtttgagagcaaagatggaaacggaatactgtatggtctttgtgatttgcatcggcgcgtaggtatagtgtgttttttgagccactgtggtcttagggtgtgacccgcgccttttaacacggccgaattgcgctttgctggagcacaaagggttcgtcctatgctgtgttctatcttcaggtatgataagcattcctgaaaggtgaaacagcaaggggcgccttttgttcagagcttgcgattttgctgtgtttaaacgaacagctcgtgctcctaagcacactggggcgcaaacgcatgctaggcgccagtcatctgggggtgaggtgatgacgctgtcgggtggcctgtaaattcgagcgccgtccatcggcacagcacttggctttgtaaaaagagaagcgtgtgtctgggcttttcccgggcgtagcttttgttgacagggcccgggacgctttgtgttgtgtgtcggctttaccgaccgacgtctggtcgatccgcatctgcaggcctgcatggtgctttgccatggcaccctgaccttggttccttgccatagtgcggcagtggtaggtagtacgccttgcatgctgtatcttgtctggaatgtatgtatgtaacctgccaaaatgtgctgtagaactgtacggcgtgcgaggcctcatggatccaatcgctcgcacgtgatttgtcagtttcttagtaccatttctgcactcccctactactactgttttagattgaactataagacattctggtttcttgagacagtaaaaaatatacggataattat

SEQ ID NO: 14904 - DNA, 2992 bp, Zea mays
  misc_feature (105)..(105): n is a, c, g, or t
cgttcttgagagcccatggcttctccatgcacttaaggatgccggggacgaagagcaggatcgctgctcgcagcaggatcgtgtcacctgaccaccatgacttgnggaaaacgtagatggccacggtgatctgggggggacatgcgataggcaagtctgtgagccatatatatatatatatacatatacacttcctcctggccagcctttctttaatttccatttttaacttctttttgtataccaacgtacctgagacaccgagagcagaaagtgccatctccaggtctcgttgtcctcgatgctataggcggtgatgccgtcctggccgccgaggtgcagcagcaagacgggcgcccagagcgtgtcgaggtgggcgagcgcggggtgcgcggcggccagcaccttgtggcggtcgaagagcgtggccagggcgtagatggccacgacgtcgccgccgtggtaggccagccagatgagcgcccggaaccagggcgggacgcggagcttgcggacgacggcggcgacgaagagaaagtactggaagaagaggctggccagcacgagccgccgcccctgccagtcctcccaccactgcacggatgctgcgaagctcatggctggccgctagctctcgatcgatcgaccctcagctctcgatctagtgctgtcgatctccatccctcccctttgtatgtatgtatatatactggtaggaggcatcggacgacggcttctgccacacgtacgtgctagatccgaactactagctagctgtacatgctgtgcctgccgtgctgtgcaacttgttcttgagtgcatatatatatgccgctctttttgtaagatgtgccggccggtctctttttttgttttacaagacttgcatgcttttcagcactgaaggcatcagctagcctaaacaaagaagaagaggctctccgatacacaccgacagtagacaagttttcagacacaaggcttcagcccagccatggatatggaaaacgtacgtacagccatttagcacgtctgacatgcacaccctcgaaggctttacaaatacagaaagaactctagctagtttccatgtcgttcatagttttcgcacaaggggcttaccacactgcacaagtaatccctacccctgtctgcagcttgacgagcgaacgcgacaggcagcggcaggcaggtccgcaggtgccttccagccagcgcgcactcggccgccactccacgacgcggctccaagtcctcgggccactgcccactggggggctcatgcctctggtgtctgatcaggacagcgtccgcttgcgaccagccaatcgccgatgccaaaggcccgcgaaagggtcagcagaatccgggaaacgcgactggtcgggctcgcctagttgtgtgtggtcaaaaacacgatcgagtcgtggagcacgcgcgaaagctgtaaagctttcccattcccagctcgactcgcggctgcggcactagctagcgcgttcgtgtgcctgtcctgtccgtgtgggtgtggcatatatataaagaggaaacggcgagtaggactctaggagaactgggacgacagcagcggcgggcgacggggaacggggaacccctgtactgtatttcgtcgacctttgccatggcgtcgatgatgagttctcgcgcgggcgcggcggcggccggaggaggagaacaccgccgtcagcacgtcaccgtggcgtgcggtgggctgacgcggccgagtaccaggcccgtgccgggcgcagctggcccacggcccgggacgccgaggccgcggggacctgctgcagctgcgggcggctcttcgtcttcgtcgccgacggggcgcgcggggccggagtgcaactggtggggcgctgccgcgcggcagcaggcgacgccgaggcggtcgaggagcggcagggccgcgggcgcgcgcgtgcccacgggcaaggggaaccgcgagctggtgagacgggcgctcacgccgcccgccgcgcgcggccgaggccgtggccgcgccggaggagccgtcctcctcaggaggtggagcttccggcccgcgcccagccgcctgcgcaacgcgtcgtcgctctcctcgcagccccctgcctcgccgcggccacgtccgtcgtgatcgaatgtcgcgaccggattctttgattcgttgttttgtgggaaagaaatctttggtctgcgctgcagtttgtaaaatgttttgtttaaacgcagtttagaattttgaccagctgtacgtagtgaaaatggtcgattgtatgacatgtaacaatcgcttcatgcaaatgcttccatccggatccgacccacgttttgtgccattgtggcatgtcatcgtgcaactagcgtgccaggtaggcagaataactaaagctattgtgatccaaatctcactttgtaagtttagtaatcaaaatgttcattttaaaagcttcaaaagctagttgacacccgagccaaattcaaaaattgaatacctcctctcgtcggaaaataataatcgttattcaagtagatcaaattttactatgtttatacaaaatatcagtaacatttgtatatttaaataagtttttttataaaaaatatatttaaagaactatttaataattataattatgtattataaatgttaatatttattttattataatggtgaaaattatgtcatatgaaatgggttgttgtctcctaaatggatcgtaaaaaaacattcaggctcatcacactgatttgccactgggccatcgcgggtcgtaccgctatacaatatactatcaaatatgattagtatatcgtcgcaaagtacgaatagtgtactagtaaacagtctatatagctcttcaaggctattacagctcacaacttttttcacaacggacaacactacttttgtgatgaagtcaaatttatctagcttgatcaagtgcttagactaatatataaaaaataaatgccctatcaagatata

SEQ ID NO: 14905 - DNA, 2838 bp, Zea mays
gtgattttctgttttccttcacataattttgttgtggctcgtatgtctatttttttgttactgcttggtgttaattctttggtttagtatgttctttaggtagttcatttcatttagtttatgacattctagttcttgtgaaaaagataatttgcaatattgtcggtgtttagaatcaacataatgatctccaaatgtttgaatgatgcctatctctataaaatagagaattattctcaacttcaatattttcagaccatttagttctaattattacattttgctgattgctggtgttaatattctattttgtattcacagtccttctgcaaacaaacatatggttgctgatggaccagctgcatcattgcaatcatcgtctgggtttcagcatggtggttggtctgggacacctggtcagttggttcctgatggctgacattgtgaaaatggggccggcctcagggaaagacttctatcaaacctgtggtcacagctgacagaggttatgctggacagtacccatctttgccaagcacaaaccagaatctgaaacaatctggaagcatggttcccccaacagagcttgacaaggggttacaacctgcccaagattcggttcaggttaaggatcatgatcattctactgctgacagcaagctcccatatggtactgactggtctccacaagatggcccgacatttgcgaaccaatcttcccttcctgagccatctggtgatccgtccttgtatgaggcatcgtttcagtcatctacattggttactgatgtagttaattcacatgaaaattcacacttggatgaaaacgacacctttgcaatgggaccagcacctgcctctgagagacacctggatcctagtgacggtatttctgagtacaatgatgtaatattgaacaactcaagttcctatcagcctcataattactcttacacagaacaacaagaagttgaggattccagtgctgatgtatcagcagcagcagcaaacttccagagtttaagcctacataatgatgagttagctgcaaaaaagtctgcagaagataaccctgcagtgataattcctgaccacttgcaagttacaaatacagaatgtgtcaagttgagctttggcagttttggatctggtgcattttctgggttactcccacaaaataccactgatagcaatgtggaattccctgctcgagaggaatctgcaccagtagatcaaatagatgccaggaatcaagattactatgaaagtggtgctgtaacttcaccagcagacgaaaatcttgaggccatgcttggagctaacatggagaatgtagatgcgccttctgtttcacaggctaatgagctcaggcaggacgtacttgatccttctgaacttcaatatgacgtcccatcagttccaagtcatgcttattccaacacggacactttacagcctagcacaattgaggagccacaagcattcggccccgcgcggccgcgcccccatttgtcatacttaatgcaagcaaatcctttgagcaccagcagcctattggggtcaaatcaaaatcatgcaactcttcatggcttagagtttgatttaccgccttatctgggagcaaaatataacgcaggctcaactacaaatcctagaccacccatatccatgcagcaggaggcactgaaagcaggggttttctccaacgcccagtctacacagagtcttccaagtactagcattcagacggggcttcctctgccacagcaattagcacatcacccttactctcagccaactttaccaatcacacattttccaaatatggttgggtatccgtatttgccacaaaactatgctacttacctatcttcaggcaccttccagcaagcatacccgagtagcggaccattccatcagtctgctgctgctgctttgctggcatctggtatgaagtactcgactccagagtataagaacaacctgtctgccacaggcttacaacagcaacatcagccacaaccacaaccactttcatcagtcatctctggttatggaggctttggaagctcaagtaatatacaaggaaattttacccttagtcagagtaccggctctgcatcagctcttgggtttgatgaagcattgagcagacagtacaaaaacaccagtcaatacatggctctccagcagggcgacaactctggaatgtgggttcatggctctggttcaagagcggcctcgacgcttccgcctaaccacttctatggttaccagggacagagtcagctgggtggctttgctcgggcgcagcagccacagccttcccaatttggaggccatgggtacccaactgtctaccagtctcagggacaggagcacccccagaaccttgctgagggcagcctgaacggcttccaggtcacaccgtctcagccatctcatccgagctggcagcatcagcacacgtactgagccctcctgtactccctggttagggtggctcttgtgctgtcacaagccaagtttcgcgtgcttgtgccctcactcgatgcagagtatgctgctcggattcagtgagcgctgagagggtcccaggcatacaacagttagagcgttttaacatgttgcgtgtgttgccagactgatgcattgcggtttgttttcgatagtgagttatatgtgcggaggcgcagtcctgtataactgagacatgataacctaacaagcagtcgtttctgtttcccaagagttggctgctcttagcttgagctgatgattgactgtttgcttgcagttttggtcatgattttactgcttctaaaaaaaaaaaaaaaa

SEQ ID NO: 14906 - DNA, 3088 bp, Zea mays
  misc_feature (3084)..(3084): n is a, c, g, or t
ggtcgacccccccgcccggttttggaattaggccgccggacgccgttgcgtgggagagagcaaagtgaaccaggccgaaaccgaagctaccgccacgaccaccacccgcgcccactgcagcaacgccggaccctcgtctccctgtccccgactaccaggaggagatcccggcggcgaggatgagcggcggcggtgccggagggaagggggcggcggcgcccgtcccggccgggtcgaggaaactggtgcagtgtctcaaggagatcgtgaaccgacccgaggcggagatctacgccgcactgcgcgagtgcggcatggaccccgacgaggcggtcagccgcctcctctcccaagatactttccaagaggtaaagagcaagcgcgacaagaagaaagagattaaagaggttcctgagacaagatatcgatcggcaaatagttctactaatcgaagccttagaagtggtgcagatcgtggtggacgtagcaattctgtgcactccagctctactgataacatgacctcaaggccaccagtctcagggtcttgtacggcatcagttaattccaatcaaatgcagacaattgcaagttcctctgcaaacaaacatatggttactgatggactagctgtatcattgcaatcatcgtctgggtttcagcatggtggttggtctgggacacctggtcagttgtcgatggttgacattgtgaaaatgggtcgccctcagggaaaggcttctagcaaacctgtggtcacagctgacagaggttatgctggacagtacccatctttgccaagcacaaaccagaacctcaaacaatctggaagcatggtttccccagcagagcttgacaaggggttacaacctgcccacaatttggttcaggttaagaatcatggtcattttactgctgatagcaagctcccatatggtactgattggtctccacaagacgacccaacatctgagaaccaatcttcccagcctgagacgtctggtgatccatctttgtatgaatcatcatttcagtcatctacattggttactgatgtagttaattcacatgaaaattcacacttggagttggatgaaaacagcacctttgcaatgagatcaacacctgcctctgagagacacttggaacctagtgacagtattcctgaatacaatgatggaatattgaacaactcaagttcatatcagcctcataattactcttacacagaacaagatgttgaggattccagtgctgatgtatcagcagcagcagaaaatttccagagtttaagcctacataatgatgagttagctgcaaaaaagactgctgaagataaccctgcagtgataattcctgatcatttgcaagttaccaatacagaatgtgttagtttgagctttggcagttttggatctggtgcattttctgggctactcccacaaaagaccactgatagcaatgtggaattccttgttcgagaggattctgcaacagtagatccaatagatgccaggaatcaagattactatgaaagtggtgcagtaacttcaccagcagaagaaaatcttgaggccatgctaggaactaacatggagaatgtcgatgcaccttctgtttcacaggctaatgagctcagccaggacgtacttgatccttctgtacttaaatatgacgtgccatcagtttcaagtcatgcttattcgaacatgaacactccacaacctagcaaaatagaggacccacaaggaaacaaccaagcacatacactttcccatttgtcaaacatgatgcaagcaaatcctttgagcactagcagcctattggcgtcaaatcaaaatcatccatctcttcatggcatagagtttgatttgccttatcttgaagcaaaatataacgcaggctcgactacaaatcctagaccagccatatccatgcaggaggccctgaaagcaggggttttctccaacgctcggtctacgcagtctcttccaagtactagcattccgacggggcatcctctccctcagcaattagcacatcacccttactctcagccgactttagcacccatcacacatttcccaaatatcgttggctatccgccgtatttgccacaaaactatgctgcttacctatcttcgggcaccttccagcaagcatacccgagcaatggagcattccatcagtctgctgccgctttgctcggatctggtatgaagtactcggcccccgagtataagaacaacctgtctgccacaggcttacaacagcaacatcagccacaaccgcaaccaccttcatcagtcatctctggttatggaggctttggaagctcaagcaatatacaaggaaattttacccttaatcagagtaccggcactggatcaactcttgtgtttgatgatgcattgggcagacagtacaaagacaccagtcaacacatagctctccagcagcccgacaactctggaatgtggcttcatggctctggttcaagagcggcgacgcttccgcctaaccacttttatggttaccagggacagagtcagctgggtggctttggtcaggcgcagcagcaacagccttcccaattcggaggccacgggtacccgactttctaccagtctcagggtgggctgacacaggagcaccacccccagaaccttgctgagggcagcctgaatggcttccaggtcgcaccgtctcagccgtctcatccgagctggcagcatcagcacacctactgagcattgttctcccttgttatggtctgtctctttcgccgtcacaagccaagtttcgcgtgcttgtgcccttactcgatgcagagtaagctgctcggattttagctgagcttgtaccttcagcgctgagaagggtcccaggcatacaacagtcagagcgttttaacatgctgcgtgcgtgcgtgtgtgtgttgccagaccgatgccttgtggtttttcgatagcgagttatatgtgtggaggcgcagtcatgtattactgagacatgataacataacaaccaatcgtttcgcttgcgcttttttggtcatgcactcatgcggttatcgcttcaggnaggg

SEQ ID NO: 14907 - DNA, 1664 bp, Zea mays
tacaaatacagaatgtgtcaagttgagctttggcagttttggcccggccccggtttctcgggttactcccacaaaataccactgatagcaatgtggaattccctgctcgagaggaatctgcaccagtagatcaaatagatgccaggaatcaagattactatgaaagtggtgcagtaacttcaccagcagacgaaaatcttgaggccatgcttggagctaacatggagaatgtagatgcgccttctgtttcacaggctaatgagctcaggcaggacgtacttgatccttctgaacttcaatatgacgtcccatcagttccaagtcatgcttattcaaacacggacactttacagcctagcacaattgaggagccacaaggaaacaaccaagcacatactctttcccatttgtcaaacttaatgcaagcaaatcctttgagcaccagcagcctattggggtcaaatcaaaatcatgcaactcttcatggcttagagtttgatttaccgccttatctgggagcaaaatataacgcaggctcaactacaaatcctagaccacccatatccatgcaggaggcactgaaagcaggggttttctccaacgcccagtctacacagagtcttccaagtactagcattcagacggggcttcctctgccacagcaattagcacatcacccttactctcagccaactttaccaatcacacattttccaaatatggttgggtatccgtatttgccacaaaactatgctacttacctatcttcaggcaccttccagcaagcatacccgagtagcggaccattccatcagtctgctgctgctgctttgctggcatctggtatgaagtactcgactccagagtataagaacaacctgtctgccacaggcttacaacagcaacatcagccacaaccacaaccactttcatcagtcatctctggttatggaggctttggaagctcaagtaatatacaaggaaattttacccttagtcagagtaccggctctgcatcagctcttgggtttgatgaagcattgagcagacagtacaaaaacaccagtcaatacatggctctccagcagggcgacaactctggaatgtgggttcatggctctggttcaagagcggcctcgacgcttccgcctaaccacttctatggttaccagggacagagtcagctgggtggctttgctcgggcgcagcagccacagccttcccaatttggaggccatgggtacccaactgtctaccagtctcagggacaggagcatccccagaaccttgctgagggcagcctgaacggcttccaggtcacaccgtctcagccatctcatccgagctggcagcatcagcacacgtactgagccctcctgtactccttggttagggtggctcttgtgctgtcacaagccaagtttcgcgtgcttgtgccctcactcgatgcagagtaagctgctccgattcagttgagcctttaccttgagcgctgagagggtcccaggcatacaacagttagagcgttgcgttttaacatgttgcgtgtgttgccagactgatgcattgtggtttgttttcgatagtgagttatatgtgcggaggcgcagtcctgtataactgagacatgataacctaacaagcagtcgtttctcctttccccc

SEQ ID NO: 14908 - DNA, 3607 bp, Zea mays
gtaggtttaaaacacagcctaggcaggctgctgtgtgcagcactttccgctcccatttcgaaactcctgatcggccgaccgttgcttccaaccagccccgcctcaggcccccaacggctaccaaatcgccatcgccactttagagagagggagcgagggagctaggatggcgtccagagatgcgggcgccagccccagatccgcgccgcatcgccctggagcggtggcgcccaaggacggcgccgacctgctcagcccgcggttccgttcagccgccgcgctggccgggtgggacgaggagtccgtccttctcgccgcgatggtcgtcgaggacactcccgtccgcgagtcccgtcgcaagaggcgggcctccacctcctccgccggcggcagcgccggatccagcaccaggtacgcagcctcccgcccccggcctaattctccgtccttatgcttttcttactctcgggttcatcatcccattcgtctgaatgccgccttctcgtaggaagatgaggccgcgtaggcagtctccggccaagatcccgccggtggttctcgcgctcgacgatgacgacgacgacgacgcggcaggtttttccctcagttcgattcgattttcttgggcaaattcatggcacgagtacaaccttcgtagacgtttttctgtctctcgttgatttggaaatttgctagatggcaaatcgatagtgaatgctgccaccaaggaggaagagaaagttgtcgttgtgggcgacaaggaggcgtccggatctggcgacaaggcggcgtccggatctggcgacaaggcggtggccacgggaaacctgccgtgcatggatcgcctccgggaggagctctcttgcgctgtacttgcacttcttttctttttctatatgctatatgaggttacatctgtggtttcatactagatggtatcgggggttgatttgggagttgcattttctgcagatttgcctggagatctgctttgagccgaccaccacgtcttgtgggcacaggtaatttctaactgtgcttctggaaaagtggttgcttcaattctgaaaatgtgtatgcaaaagagaagaaatggaaagctttccacggttcattttgttggtgccgcgtgcaaccgtaggatgtcagttgcttcccgtgagtggcacagttcattttgtatgctgattgcctgtcgaaagcgattccttctgttgtcaaaattgcagtttaacgaataatcctgaaatttggtaaattttgttggaagtgtcggataagcatgtttggtttaaggatagaggtagtctattatcttcttagtcctcacttttttgtttgttttgtgaaatggaatgagttgatccatcattatttcatttccaccagatttgtggaatgaactcatgatgcaccacctcatctataatagattgatttttcaaaccaaacaaccccttaattaacctaggcaaatgggcttacttgcaatgcccatgtgcacttcctgcgcattttgcaattccttttgtttcctgattttctttatataaaagacttgacttgagtattgtcactttcatcgctactgtgacaatgctttgagtacttgaattcagaaatcatgtatcccgcagggagcatagcaagaatcgctgtatagctcattttagttgccgtaaccatacaatgcagttgctttctcaacatatttattcgttttggttgctgcctgctattctgctaaggaatgacaatagatgatagcttaaactatttggagcgttcttgcttcaaacaaagattagtctcagtttcacagcaaatatggggcactgaaagcttgtttaccgtgtagatgttcagttcaacacaaatcttgtttttctgattctccctatatataggactatggaatactattctcattgttaggctggacgctggagtggtcataaattattattttactaaagacgggcttatttttattcctgaggtttatcattttcaaattaatgttatctcaactgagtggtgattatctgtacattgtccaccaacctaaaattttgatcagtgttacctgaaacttttttgaattgaactaacttttgatgcaattatgttattgaatattctaaaccagtttcttcgttgacctttctgaaactcgtcctactgctactctgtttaacagcttctgcatgaaatgcttaatacatgctgcatccaagtgtggaaaacggtgtccaaaatgcaggcaattcatcaggcaagtcttagctgtgcaatctcgacaagcgatgtgtaaaggctttgactaaattattgtatctctctctgcagcaactcaagatcgtgcaccatcaacacagtgctctggaacaccattcagctgttgtttcccggtgaagttgaggcaagaaagaattcgacctcaccatgcgataaggacgcgagccgcagcccactcagagcgcgggggctatcacaaggtggcaatggtatgagaactagaactaggagcaggagcagcagcaccgaagctagaacaagaagcagctacaggagcttcatggaacccggcagtacaacaagcaccaacactggtgcgaacttcatcagcgcacaagtcaacacaagaagcaggaggggcttcgtccaggcctcgcagctgctgttgccgaggaggagcgcagtaaggttggaccaatccgaagatgctgcgttggcttacaggttgcaacaggaggagttcatgaatgcctttgaggagcctgagcaggagaggcagcagccacggaacgccgtgtccacagcacgagacactctgagagccatcgcctcccgagccgtccgcctccgtgctcgaggctggcatgtttaatattattctttcgtcaactactttacacaaacctcttgtttgttattctactgtgtaattttttttaaagtaggctgacccaaatttggatggccataatcataatcctttggcgcatggaacatttgctgttgtacacagtactgttcaacacatagccatttgtcccatttttttgtatttttgccctttttctagaaaaaaatctaacgtttagactccaaaacggaaaaaacttaattctgtttttagaccctttgcttgacggcgtagccatggcgtcaaagtaccgagactctttggcatgtgagggctgacgtgacatctagctcggcgtcatagatcttagcgccgagccaagattcaggcgccggtcgatcttctttccccattctttctcttgcttgtcacgctcgccacctgctcgccgtcgtcgccacagatcgtgtcgcccctgcgcctactcggtgccgccgcgcccgaaggccagagaccggccgccgaccacagcccgccagttcgtcgccctccgctcccattcggtatttatttagtgttttgatattaatttagtatttatttagttagtatttgattagtttattagctagtagctagtggttagttagtattaatttagtttagtatttagttagtattaatttagtttattagttagtagctagtggttagttagtattaatttagtttagtatt

SEQ ID NO: 14909 - DNA, 2663 bp, Zea mays
  misc_feature (104)..(104): n is a, c, g, or t
atcccaagaaatttccatgaccactattgagcaacctatagctattgatcaagttgaacctgtcaacctgaatgtagatgaacttgtggttgatgatgatcaancctggttttgctccaaggtgtgaatctgctaggctggataaacctggatgtacttccaaaaaggatgattcaaatgagattgttgaagatagcaaatcactggaaaatcagttagaaatttgcaatgcagctactatgtctgatgagtgttcctccagaaatgcaaatgaagatccctctccaattaatatgtctgctgagtgttcctccagaactgcaaatgaaggtttctctccaattaatggggcttctcatctagctgaggagtcttgcctttcagacaagtcatacaatgctatcagttatgaaaatggaaatgggcctgctaaatcttctgaggagcctgacaagtcatgcaatgctatcatttgtgaaaatgaaaatgagcctgctaaatcttctgatgtggttgaaaccagatgcgtggaagcattagcgccttcatctgttggcacggttgtcacggcagaacagaaggacaatggacaccgtgcttctggtgagtggcatggagataatgtgcaagtcattggacaacaacagaagatctacataattaaagttccaaagtttgccggtgatgatctctggaataagatccaggctgcacaggctcacttagaccacctgacccaggaaagagatgcaattaaccgtcgtaggcaaaagcaaaaggctgtatgtgatcaatacagggagaagcttgaggcagcacgtagagaagagcgggaagctaggactgcacatggagataagaagaatgatttaaataatgtacgttcggtactagggaaattgcaccaagcaaattcagctgaagaacttgatgagctgattgcgaagaaagagaggactatgcaacatgagaccatttctttgaaagaagaaaaacttttaattaaagagattaatgaattaaaagcccaacggaagcagctatccaccactatgggctcaaaggctgaaatcaatgaggcatttgaccaaaaagatcacattcatgaaaggcataaggtgttaaagaaggattctgatgttttattgaccaacctgaaattcctagaggaaaacacaagaaagattcaaaagtctttcgaagatgaaagaacagctctcagaaaattaacagaggaacaccgagcagctaatgaaatacgtcaaaaggcctacattgaatggactgagcttagatcagagccctccaagaagaatgaatacttcttcaggtacagggatgaccggaatgcagcagaaattttcagagctaatggcgatataaatggacttaaatcacactgtaatagtcagattgagggagtcatggaaatgtggaacaaaaacgaggaattccgcaagcagtatgttgagtcaaacaaggttagcacactaaagagattagggacccatgatggacggaaacttggccctgatgaggaccctccagtcatatcaagcagaagaccaagcagcatctatccattgtctgcctcaagcccgggagtggccactttagcttcaataccagcacctgtggtagctgctccagctgcagtctctgccaaagaggactcctttcctgttttggaagccccccagaccagcaagcgcaccaagtcaaaagcatctgatatctgtgcccagaccgagaacaactctgttatagtatcggaggcagaggctttggaacagactttgaaagagaaagctcgtctattggaggaacaattggagttagctaggaaggcagaggagttggcacggaaggaggaggaattaagcaaagagagggctgccgctgagaaggagcggcttaggatggagcagaaggctaaggccaaggaggccgaggagaggaagaggcggaaagccgagaaggacaaggagaaagccgagttcaaagcgcgcaaggaagctgaggagagggagaagaagaaagccaagaaagacaaaaggagaggcacggcaccagcagattctagcctcactggtgacgggcacgccgcggccttggccacagcagacactgacagcaacgcatcggacaacccgagggaagctgaggctcctcaaccggcggcggctcccaagaggctgtctaggcccgcagcggcaatcaagcagctgaacagggtgcagcccatgccggcgccgctacgtaacaggggcagaaggagactgcggcagtacatcctgatcgcggcggccgtgctatcggggcttgcgttgttcgtggcaggcaactatattcccaggctcaagtcggttcactcctaagtttatctgtaggaaaggggtgctaatctgtcgcggtgaacctgggtgtgattcgtattatttcgattattctccggttggtttgtactattttttttttacctcatataggttggttgtgaaagatgggggtgcattgtgttaaaagttgttttacaggatggtggtgaaatcttcgttagaacatggataataattagtactatagattctttcttgtagtagccttagcgtatatgatatttactggatatgtcgttcgccctaagaaaaaaaaaaaaaaaa

SEQ ID NO: 14910 - DNA, 5461 bp, Zea mays
  misc_feature (3353)..(3353): n is a, c, g, or t
cactctctctctctctctctctctctctctatatatatatatatatatatgctaaatgaagataaatgcattccaacgtaggaaggcatgtgcaaaagcagtcataggctagctattttcttcaaacataagactattctccacgcttaaaataggagcacatatcaccattctcatgggccgaaaaagtataaaagaaaagcgcaaaaggccatgatgagcttctagaactgcttgacctgagtacggtcccaatcccaacttccccaggcctccaaaaatctcacggcgacgacgtcacccgagccccgagcctgacgcagcaggagacgccggccgtttcgagaccgagactgtcggtggtgtggctcgtgctgtgccgtacccgtatccaaactaattccgtggccgcggtcgctactatcccggacgcgggattctacggcaagcttatcgtagcgcgaatataaatccagatcccatctgggttaaaggccaaaaaatcgcgtcctcgaaaacctctagtctagttccgaaagcgcgcacacaacgactacaggagaagacacgcgcgacggccacggccaggtagagacagatccatctctcacctcgccccaccgccctcgccgatcggggtccgccgacccccagatcgcttcttcgcttcggtaggtggccgagtgtacgcgtacgaggagcctcccggatcccgcctcgccgtcgtctgtaagatcttctcgcacatctcgatctctctattggagctttgggtttcgtctgtctgtctgtctgtctctctctttgcgaggtttgggttttgtgtcgtggagcggtggaggtgccgtgggagcctttggttaatccagggtgatctctgatctgcgatctgtgttggggcgtatggctctggcgtcttaacagatgacgtgtttttgctgtggcgtgcaggatcggggcgcgatccgcggggaaacagcaatgacggcggaggggacggcgtgcaacggcgccggcgaggcgccgaaggcggaattcgtgcccgagaaggtggtcaccgcgtcgctggaggagaaggcggccggggagcgcgagggcgaggacgtcggcgggccttttgtggtcgtgaacggcggcgattctgacgggcactccgaccgtggctcagatctgggcaaggcgtccggcgaggagtcgtcgtccgaggaggaggacgtgcccggctccaatgtagctccggacttggccgtgggcggagatcacgggtccgcccgaggggaagtgagtgctcagggtgcggcactcggtgcttcgtcggcggacggcggtggtcgtgcttccgacggcgctgagggtggcgcggatgagggcaaaggcgaaccaagttccgattttgatgctgaagcggcgccgcaggaggacgttggtgaagaggacggtggggcagctgctctggcgtccagcgggtgcgaacctgccatcaccggtgctgattctgaggcggcaccagctgtggatgatgaggttgaaggcaaggagggcacggtggatggaagtgctgttgctgatgtcgctgaagcggtggtgcatcaggaagttagcacagagcatgatgatgccctaacgcttcccaagtcttctgcttccatggagtccgaggttattagagaggataacaaagaacagagcaccgctgatattgtggggccacatgagcagggtacatgtggggcaagtgctttggtggagaatgagcatctttgtgctgacatgagggctgattcatttgtagctgttactgagcctgacagtcaagaggattatgctgtggagtcctgcatgcgcgatgatgtcctaatttgtaccgagtctggttctgccgacatcgagtctgaggttaatggaaaggatagcaaacaaaaaaaaaaaaaaaatgatgtcgtggaggtcatagggcagggtgtagttagggcagatgcgctgatggcaaatgggcatctttgtgccgacatccaagcagattcttctgaagctgctactaagcctgataacattgctaatgagagcaaactgactgaagttgcagaatcaggagaggatgctgctgccagtggagaactggatgccatcgatgcatcatcacaaaccaatgggcatatttatgttgcctcgggtgctgattcttttataattgcttctgagtccaagtctcattcctttgagacggatggacaagaaactgatcagcaagaagaggaagttccacaaactgaagctgaactattggatggagtgctaaaaccaactgaaaggaactgtgcacgcagtgttgaggaactcataggagaggaagttgacacagatgggcatcccagtgtagacggtacagctgatgcttctggggagcaagaagccaagcccatgcaggtagaaggtgaggccacatgtggtattctcgaatttgaagaagtggataaggatggtgaggatagtttgtgtaatgactgcatggttgggtgttgtttcctctaatgaggaaacagagcttcctatgaaggaaagaacagatgaagctgtccccagtgttaatgttggcgagccagagcaagtaactgaggatacaagccaagatatcatgcagggggtggattggccaggggagtttttataggcacaatttttgttaagccagtatcagatcctcatgttgaatcaagcctcgtacatgccggccaggcagaagttcatttagttgatgaaatcacagcagcagatttgaaagctgaaaatatggtcgaagtgaaaagaacagatcgtgaagttgacgaaatagaggtaaaagcgccaggtactcacgaaattgggaattcttcagaagtagaaccgaaggaagagtttgagatggaggttgatgatgctgtttcattgcatgaagctgcagcttctgcatcagaaaatggttctgaagaaaaatctagcaacattgctgttgatcaagttgaacctgtcaacctgaatgtagatgaactcgcggtagatgatgatcaacccagttttaatccaggttatggatctgctaaatcttctgatgtggccgaaacaaaaaatgtggaagcacaagtgacagaacagaagggcaatgcacaccatgcttcaggtgagtggcatggagatcatacgcaagtcattggaccacagaggatctacataattaaagttccaaaatttgccggtgatgatctctgggataagatccaggctgcacaggctcacttagaccaactgacccaggaaagagacgcaattaaccgccgtaggcaaaaacaaaaggctatatgtgatgaatacagggnagaagtttgaggcagcacgtcaagaagagcgggaagcaagggctgcccatggagataagaagaatgatttaaacagtgtgcgctcagtattagagaaattgcaccaagcaaattcagttgaagaacttgatgagcttattgcacaagaaagagaggattatgcaacatgagaccatttctttgaaagaagaaaagcttttaattaaggagattaatgaattaaaatcccaacggaagcagctgtccgccaccatgggctcaaaggctgaaatcaatgaggcatttgaccaaaaagatcacattcatgagcggcataaggtgttaaagaaggattctgatgtttccccccccccccccgaagtcctagaggagaacacaagaaagattcaaaaatcttttgctgatgaaagaacagctctcagaaaattaacagaggaacaccgagcagctaatgaaatacgtcaaaaggcctacagcgattggactgagcttagatcagagcccagcaagaagaatgaatactttttcaagtacagggacgcccgaaatgcagcagaaactttcagagccaatggagatataaatggacttatatcacactgtaatagtcagattgagagagttatggaaatatggaacaaaaacgaggacttccgcaagcagtatgttgaatcgaacaaggttagcacactaaagagattagggacccatgacggacgaaaacttggccctggtgaggatcctccggtcattccaagccgaagaccaagcaacatttatccattgtctgcctcaagcccggaagtgatcaccttagcttcaacaccagcacctgtattggctgctgcagctgcagtcccttccaaagagaactcctttcctgctttggcagcccctcagaccagtaagcgcgccaaatcaaaagcatctggtagctctgcccagattaagaacaaatctgttatagtatcagaggaagaagatttggaacagactttaaaggagaaggctcatcaattggagttagctaggaaggcagaggagttagataggaaggcagaggagttggcgcggaaggaggaggaactaagaaaagagagggatgcagctgaaaaggagcggcttaggatggagcagaaggctaaggctaaggaggctgaggagaggaagaggcggaaagcagagaaggacaaggaaagagccgagttcaaagcacgcaaggaagctgaggagagagagaagaagaaagcaaagagagacaaaaagaaaggcgcagcaccagcagattcgagcgccattggtgacagccatgctgctgcttcggctacagcagatactgacagtaatgcatcagacaacccaagggaagctgacgtttctcaaccagcggtggctcccaggaggccggctagaccagcggcggcaatcaagcaactgaacaggttgcagcccatgccagcgcccctgcgtaacaggggcaggaggaaactgcggcagtacatcctgatcgcagcggcggtgctaacggtgctggcgctgttcgtggcaggcaactacattcccaggctgaggtcgcactcctaattttatcgttaggaaaggagtgccagttctgtcgcggtgaacctggtggtggttctacctagaggattcttcttttttcgactgttcgggttggtttgtatttagcttcccttattataggtttgtgataaaagttattaccggatggtggtgaaatattcgttagaacatgataataatgactatagattcttttttgtacataaaaaaaaaaagctaaccttagcgtatatgattgttatttaatcatattctatggcgttggctgtctccggtgtgaacgatgtcgttcactatgttcggcagagacgagttgaatgtatcttctgcgcgctgcgtacaacccaaaaaagacgagagagagtatgtttaggatttagagtatgttagttgttaggtttagggtttagagttagggtttagggtttttttttgattatttttgtaccgacaaccaatcacctaaggccagcaagcctacgatcttggaggttgatattatataggctataatacctatcacg

SEQ ID NO: 14911 - DNA, 1487 bp, Zea mays
gggtacctcgaggccgcccggccggccgggtctgacatcatcacatcgcaccgagggcgaggaggcaaaggaataacctgtgaagctgctgccatccactcatctttctgccttgattgcagtcattcctcccccaagtccatagagtgatagagaatggaggataatctaccagttaatgtccgggaatatcaagaacttgctaagaaagcactaccaaagatgcactatgattatatcaacggaggagcagaagatgaatatacactgagggagaatattgcagcatatggaagaattctgttacggccacgagtccttatagatgtgagcaagatagacatgtcaacaagcttattaggatataatatgccatcgccaataattgtcgcacctacaggggcacacaaattagccaatcccgaaggggaggtggccacagcaagagctgccgcagcatgtaacaccataatgatgctttccttctcatcaagctgcaggatcgaggaggttgcctccagttgcgacgctattcgcttttatcagttatatgtgtacaagagaagggatgtttcggcaacattggtacggcgggctgaaagtttaggattcagggcaattgttttgacagttgacacgcctgtgcttggcaggcgtgaagctgatatcagaaataagatgattgctccacctctgtcaaaccttgaaggtttaatgtcattagacgactttgacgatgctgaaggcggctccaagctggaacgattctcacgggagacgctggatccatcattgtcatggaaggacgtggagtggctcaagtccatcaccagcctgccgattctgctcaagggcatcgtcaccgcggaagacgcgaggaaggccgtggaggcgggggcggccggcttgatcgtgtccaaccacggcgcccggcagctggactatgcgccggccaccatctcggcgctcgaagaggtggttaaggcggtggcgggggctgtgccggtgctggtggacggcggcgtccggcgcggcaccgacgtgttgaaggcgctggcgctcggcgccaaggcagtcatggtgggcaggccggtgttctttgggctggcggcgcgcggggaagccggcgcgaggcacgtgatcgagatgttgaacaaggagctggagttggccatggcgctctgcggctgccgtagcgtcgcggaggtcaccagggcgcacgtccagaccgagggcgaccggatcagggccctgctgtgacttataaataagcgaccatatccgaggccgaccaccgtgctgtctgggttgcgatatgatttatatgatacgtgagggcatgtgatcgattgttgcctccacacagataagcttactattgccagagcctgggctggactatgctttcagtgattatctaaatcaaatagactgaatgctaaagggaacatccaatggtgtccatctatatagcatttgttggagtc

SEQ ID NO: 14912 - DNA, 2726 bp, Zea mays
cattgggtaccctcgaggccggccggggggacgaccctttttccggccgtccgtggtcccttcaatctctctgcgcaatcaaactgcggtggccaaccccggaagcggcggcgggcaaagcgcgcgacgcagagaagcgtaacttcaggccgccggtcgctctacgcatcctgctccccgttctcgtcggagatccaccggggcagcctttctttccccttcctcaatcaagtcgatccaatttcgcgcgcgggtcgggctcgccttctcctccagtctccacctccaccagcgctcgaggtcgacggacgctactcgcagcagttcttctttgcggtgcggccgagaagaagctaaggctcaggcatgagcttccgggaccaggagagtggcggggaggatgggggcaggacgtcctccgcctccgacctgcggaagccgctcatcaacaccgggagctggtaccgcatgccgccggcgggtggcgtgatgggctcgcggcaatctagcctcatggagcgattgggctcctctgcgttctctctccgcgacgtcgctatctcggcgacgctctgcacgctcattgtcgcgctaggtcccatccagttcggtttcacatgtggctactcctcacccacgcaggacgccatcattgctgaccttggcctctccctctctgagttctccctcttcggttcattatctaatgtaggggcgatggtaggcgccatctccagtgggcaacttgcagagtatatcggccgcaaggggtctctcatgatcgctgcgattccaaacataattgggtggctcgcgatatcattcgcaaaagattcctctttcttgtttatgggtcggctgctagaaggatttggagtcggtgtaatatcgtatacagtaccggtttatattgcagaaatcgctcctcaggatcagaggggagctcttggttctgtcaatcagctctccgtcacgattggtatattgcttgcctacttgtttggcatgtttgttccctggagaattcttgctgttctaggcattttaccttgttcaatcctgattcctggactgttctttgtgcctgaatccccaaggtggttggcaaaaatggggaagatggaggattttgaatattcattgcaagttctgagaggatttcagacagatatcacagcagaagtaaatgaaataaagagatcattagcatcatcgaggaggaggacaaccataaggttcgctgatatcaaacagaagagatacagtgttccccttgtgataggaatcggtctccttgtcctgcagcagctaagtggtgtcaatggcattctattttatgctgcgagcatcttcaaagctgctggtattacaaacagtaatctagcaacatttggtttaggggctgttcaggtgattgctactggagtgacaacctggttgactgacaaagctggtcgaaggcttcttctcattatttccaccacaggaatggtcattactcttgttattgtttctgtgtcattttttgtgaaggacaacatagctgctggttcgcacttatactctgtaatgagtatgctttcactggctggacttgtggcatttgtgattgcattttctcttggcttgggagcgattccgtggatcattatgtctgagatccttcctgttaacatcaagagccttgctggaagtgttgcgaccctggcgaactggctgacagcatgggccattacaatgacggcaagcctgatgttgaactggagcagtggaggaacatttgctatctacgccgtcgtgtctaccatggccctcattttcgtgtgcttgtgggtgcctgagaccaagggaagaacgctagaggaaatcgccttctcattccgctgacacgtcgtcatgatctaggtatgggaagccacaccacaccatgtgtccttgagtctgccgcggtgcgttcagttcatgaatcccgcagggatcttgcagccattctcttgcttggatgtaccaccatcttcagtgttcataccaatgtacattgtacaatatgacgacgacgccatagcagaaaggcaagtgggtttatgtttgtacgatggactagtagcagaaagcactcaacccctgtacgggttgcggaggagagcaatttatttgctgtatttgcctggttcaataccggacacaagttagaattttgaaaaataaaaatctgagcaaatttatccaacaggtaaagccagctccatgcgtttgcctgcatgcggtcatgaagtagaagacattggagcctaaatatctaggaacggttttgatttagaaagaaaaaggaaggaattttattctgaaacctgggcatggttgtgcagcggcaaacttgactgctgaaggggctgatcggaattaggtaccttgtggttttgaagcgttgtttgaaatcggcgtcagcctcgccccaccatcctcttctaatcttctgaaacgggggctgcaagatctccgtggacctcggcggtgatggccgccgcgtctgccttcccatgcggcattagcgccttcatgcgacgtcggaggcccggagatcaggaaaccgtggcatgtgagaaggatcatttccatggacctcaacggcggacgccggatggcaggggcatcatctgatgatcatccgcctgctgcgtgcgccgccggagatcaggaagccgtgcccagtcaacactctgcag

SEQ ID NO: 14913 - DNA, 2120 bp, Zea mays
gcacgagaccattacctagaacatcctaatcaaaaaacgccgcgtactcctctctactctctgccccgccaccaagctcgaccgaccgatgatcctcagccgcctgcatgtccgcgtcacccgccgatcccccgcgtccgccgccctccgcgatgcggcaacgcgcgccttggcctccgcgggcctcttccgtggcctccacggcggcgcctcctccgagcacggccgcgaacccgcaggtcctcttacgctctacaggaagctagtgagccaagggaagctcacgcatgatagttaccaggaaaatgtagcttccgaattagacaacctacttagtaggcttcaacggtacgagatggaaatggaggattatcatgacaagctgtacttctgggagaatagcagggagaaagagcggcgcatgcttcttgtcgaagaagctgaagataagcagcgtggtggtgtatggattgatgagagaaggggatttcttgacaagttggttgcgcggagaagaagaggaagcatagaacctggagttggtaagtgggtctcgtacctgaaccgagagaagaaactagatacattggtaggccatagaccagtcgctcctgttgctcctaaaggattgtatctctatggaaatgttggaagtgggaagacaatgttgatggacatgttctatggggccactgaaggtgtcatcaaacacaggaggaggtttcactttcatgaggccatgcttgaaatacatgatcatatgcatgatgtatggaagagacgtgatgatgacaaatctattcactcaagtgctttcagttggatatcaagccttccttttgacacgaaaattaaggagtggttgattggcgaagataagtacaaacaacagacacaggaaaagcacatccttttggcagttgctgacaagtttttggttgatagacaggcaaataaaactggagcaagcattctatgctttgatgagatacagaccattgatgtttttgctgtggtagcactttctggcattctaagcaggctgttaagcacggggacagtacttgtagcaaccagtaataaagcaccagaagatctgaatcaggatgggatgcaaagggacatcttccttgagttattatcaaaattggatgaaaactgcaatgagattcttgtgggtactgaaaaggattatcgccgcctaattccgacagaaggctcaactgaggttcactatttttggcctgccacttctgatgctcgcagcatgtatgaggctatgtggcatgacataactgaccaatcaggaggaaatattgtttctgtcaccattcctgtaatgtttgggaggtctattgagattcctcaaagctgtaatggtgtcgcaaggtttgacttcgagtatctatgtggtcgcccagttggagcagcagattatatagcactagctaggaactaccatacaattttcatatcagaaattccagcgatgagtatgaagattcgtgacaaggcaagaaggtttatcactcttatcgatgagttgtacaaccaccactgccgccttatatgcctagctgcctcatccattgatgatctttttcaaggaactgaggaaggacctctttttgatttagagagttttcagtttgaaaccgagtccgaagggacaaagctgaggagggatgttttggcggaaggcaatgctggctcaggaccatctactaccggccttgtggcgatattgtctggtcaagaagagatgtttgcgttccgcagggcgatatcacggcttatcgagatgcagaccccgctgtatctggagcgtgtgcaggctgtacatccttcgttccgtcgtcctggtcttgcaagcaataacaggcctgcagttcctcagcctgctccggtggtttgacagcctcgcgctgtaccattgctttatttcgagtttcgtgtgagaaggcaataaaaccaaccagagatggtaacagtgagacattgtaaatgattgtagaaaggttgtgattattaataagttaaaatttcctattttaaacttcaaaaggttactcatcttatctctcatttcatctcctaatttaaacttcactctacgaata

SEQ ID NO: 14914 - DNA, 2426 bp, Zea mays
cattgggtacctcgaggccagaaaccgaatattccacggagatgagaaggccgtaggatttttgcgacgtacaggcgtcctccttccgcttccgcacggaaggggaagatactgtcggaatcggcatcttcccctccagtccctcgctctaccaccagcagcgaccgctgtcggaggagggcgtggttggggggaagtgccgcagcgggaggagataaagcgttctccaatcttccaatccccttcggctgccacttgttctagtatctagttagtcgtgaaccttaaaataggttaaataaatacatgggagtccaagaagattctaggccttctggggccctgggtggcctatacagggtacagtttgtgggccggtcaatatacagtgatgacgaagcagtcaagactagcattatggattcttcaacttgtgaaccacaagaggataatggctccggccggcgtttgctaatctggagattatggcagcaaagacccccatgcttgaagcccatacactgtagcctctcatgcgataaacatgttggtgaaactattgcaaatgttgttacctcacttcctttcattgttcttggactgcaaacaccaagttgtgcagaaagaacttgaatacaacactttatgctaactcattgattggagttggaatagcttctagcttgtatcatacttcacggggagacatcagaaaatatttgagatgggcagactatacaatgattgccacttcaactctatgcttatcaagagcccttcgggatgagaatccaaaatttctgatggcagcatcaaccttgctcctaccatttcaacccctgatggtttcagctgtccacactgggataatggaggtttcatttgctaaacgagcatcaatagatccagagctcaagacggcacataacctacacaagatatcgtctctcctgggaggtgcgctattcgtcgctgatgatgtcttcccacaaacttcctacctccatgcagcatggcatttagctgcagcgctgggtgtcggcacatgcaacaagctgcttgagtgacaaaggaggcaagatgcaagacgagtccgtgaaggccttcaaccttgctgctactgctgttatcaacaagctgttgatactgatttatcagcatgtcctcactaaatgcagaatacggtgcagttccattgttttacgttgacccgaacattggaggaatcctcgagacagattaatgcaccagatattagattacctggcatcagtttgttgcctgtatttgttgtatgctattgtattgtttgtgccaacataaactaaatactgtttgagaatcagatgtgtatatatatagatagaaacttcggaacgtcgtttggattttattctgcagaaatcaattgaagtttagcatcatatttatactttaaaaaaaaaaaaaaaaacagtggtttcgatttgacagatactagtagtgctatatatctatcctgatggtggctttgccttgtaagtggtttggatcagcacatgtccatgagagttctccatggcattgcagttcacgctggaccagcaacaagcaatactcatggtgttagagtgtaggttcgattcctatattatccatgtatgtgtagatgggctggcatcattgttaggctgtcagtccattaaggttaatattttcctgtgtctatatatctaaccatcctctatgcaatagatgtggagtctcattctcttagatggtatcttgcagctaggtttcctctgccacccacagaagccgaccacctctgtccatgccgtcggccaccacttgcttccacgccgtcattgttggggcggagaccgacttgacctcgatcaatgacgcgaaggctcgacaccttgttttcaacgaaccacacttacacaggagtacaggaccatgggcggatccaagggatgaaaacgggacgagaaattcccgtaccgtcccgtttcgaatactgtttttccctgatcgttttcgaattgtttaggaaccgattagaaacggtagtttttcgaccgttttcgtatttttcgtttccgagtcgtgctgataccattttctaccgttttatataatatgagatagatctagcatataatttatttaagttatagacttttgttgtgttcaagtgaatgtataagcgaaaaacaaatgttataattactctaactaatatgaatgatgaaaaagagttgtttgtgtatttctaaatcttaaaaaataggcaatgcatcactttattatgtttttgattaaactacaaaatagttatctttccgactatagtttgtcgttttcgatcgttttcggataaccgacaattccgatctcgtatttcgacccgttgattttcgttttcgttttcgtcccgacca

SEQ ID NO: 14915 - DNA, 1398 bp, Zea mays
gaaattacattagcccaatctactatagcccaaacatccatacagctgcaggtggaagtcgtccggcccggcccaaattggcgctgccatggcccaccggcctcaccgaaagcgaacgacgaggcccggccgctccggagagaagcaagaagaggaccgtcaaagaacccagaaaccgaatattccacggagatgagaaggacgtaggatttttgcgacgtacaggcgtcctccttccgcttccgcacggaaggggaagatactgtcggaatcggcatcttcccctccagtccctcgctctaccaccagcagcaaccgctgtcggaggagggcgtggtttggggaagtgccgcagcgggaggagataaagcgttctccaatcttccaatccccttcgtaagtttcttctggtagatgaacacctttcttcaggcgaagcacacgtggtctagtgacaagcgaaagaaccgcttcgatttcgtcacgattttccgtgttcataggctccatgagtagaataaagcgtttatcccgctggacggaaatttgggcgtgaaacgaaccgccgagctttgttgccatggaacagtggagagtggactgaatcgattcacttttccctctgttgtttttgtgacgcgagctgctgagcgagcaaaagaggtgctacttgtgctgcctcatctgttaggatggcatggaatttgtagccatttcctggttgtggaaatccactgcagcaagcaatggggaattgttaacagtttttcatcttgtgtgcagtgtcagaatagcatatatatagctgagcacataacctcataatcaaatcaatgcacccaggaattcgtttctgcatgcctaggagctatataaacttataaatctatatagaataaaattctttcatatggttcggtgctttgtgtcgtttgtatcaaccgctgctgctagttcaacgctacagtgacatgtgaggaggcagatagccatagcagcagctagaactgcctgccgaattgggcccacgtgtgttcatgtagactaagattctggacttgtgccatttatgcaataatgctgaagaatgacatttgtttttcccaacagggctgccacttgttctagtatctagttagtcgtgaaccttaaaataggttaaataaatacatgggagtccaagaagattctaggccttctggggccctgggtggcctatacagggtacagttcgtgggccggtcaatatacagtgatgacgaagcagtcaagactagcattatggattcttcaacttgtgaaccacaagaggataatggctccggccggcgtttgctaatctggtatgtttgttgcacatacacaaaggagactgttcagaatctttgtaactcatgc

SEQ ID NO: 14916 - DNA, 1975 bp, Zea mays
gcacgaggcattaaccgcgctccccacacgccctaaccattcccggctcccggcagagacggccgctcgcctccagaagagcaacccaagtcgccgagagtgactcccacacgacccacctaccccgccgccgccgccgccgcatccccctcgattccgtctggcgatcgggggctcccagacacatcacagatacaccacgccaagccaaatcgagcaacgtctatcatcatattataatttcccctcattcatctcacagtcccaggcctcccctccctcctcccccgtcgccaaccaacctccaacccccagccgatcgcgtcggagatgctgggcgtcgcgcggaggcggctcggatccggatgcgtgctcgcccagctggcgcaggccctccgccccgccgccgctcccgccaggacctactccgccgcggccaaggagataactgtacgggaagcattgaataccgcattagatgaagaaatgtcggcagacccttctgttttcttgatgggagaagaggttggcgagtaccaaggtgcatacaagatatccaagggtttgcttgacaagtatggccccgatagggttctcgatactccgatcactgaggcgggcttcactggcattggtgttggtgccgcttaccatggtcttcgacctattgtagagttcatgacatttaacttttcgatgcaggcaattgatcacataattaattcagctgccaagtcgaactacatgtctgctgggcagatatctgttcctattgtctttaggggtccaaatggtgctgctgctggagttggtgcccaacactcacagtgctatgcagcttggtatgcacatgttcccggattgaaagttctagctccatattctgcagaagatgctcgaggtttgctgaaagcagcaatcagggatccagatcctgttgtgttccttgaaaatgaacttctttatggtgaatcatttcctgtatctgctgaggtacttgattctagcttctgccttccgattggaaaggctaagatagagcgacaagggaaagatgtcactatcactgcattctccaaaatggtgggatatgcccttcaggccgctgatatactggccaaggaaggtatcagtgccgaggtaatcaatcttcgctcaattagaccgctggatagagctactattaatgcatctgtgaggaaaaccaatagattggtaaccgtagaagaaggcttccctcaacatgggattggtgcggaaatatgcatgtctgttgtagaggacagctttgagtatcttgatgcaccagtcgagaggattgctggagctgatgtgcccatgccgtacgctgccaaccttgagaggatggctgttccacaggtcgatgacatcgtccgggcagccaagcgtgcttgctacagggcagcagtaccgatggcagcaaccgcctagtccagcagaaccctgcatgttgcatttctttgtctaattttaatgtccgtgctgcagaaagacgtgtcacataatggtgtgacgagtacccactgccgctgcaactcaactatagcatgagctgagtttttgtagagccaccgagaggtgttcagtactccagttccagttccgcttatcttcgccgccgcagccggaaggctgcgcatgactctgcgtctgttttatggttcacgaatgattgcagatttgcagcagagcctctggagatgagaattttacttgtggcgagatgttgtgagtaacttgtattcagaagggggaactctcaagagatcctcaagtcgtgattccagttgcggctttcttgatagtaacgtactccctccgttttttagttgtcgctggatagtttaattttgcattatccagtgataactaaaacaaaacggatggagtacgtatttaccatgctagtgctagaggatcttttgttcctctgcagggtgcagcagtcactgcg

SEQ ID NO: 14917 - DNA, 781 bp, Zea mays
gtcgtctccacgcgtccgcggacgcgtggggcagtcaactcgctgctgggcgcgggatcccggccgagcaccatgcgaggaaataacatgccgcggcacacgtcgccgttcctttttgccttgttggcgaccctgctcagcgtcggcgacgcgttggtcgtcgacggcctgcaggtggggttctatggcaagacgtgcccggcggccgaaggcgtcatcagcgacatcgtcaacaacgaaatcgctatggaccggggcatctcccctggcctcattcgcctcttcttccacgactgcttcatcacgggttgcgacgcttccattctcctggacgagtcgcccgccggcgacgtcccagagaaggagtcgtccgccaacggcttcaccctggtcgggctcagaaccatcgacatcgccaagtccaccgtagagggcatgtgccccggcaaggtctcgtgcgcagacatcctggccttcgcggcccgcgacgccgccgtggccgcgggcctcccgagatacgaggtcgcggcggggcgccgcgacggcatgcgctcgaacatggacgacctcccgggcaacttccccgtgccgggccaccacgtgccgcgcctcaccgagctcttcagccagcgggggctctcccaggaggacctcggtccggctcttcggcgcgcactccatcggcggcgcgcactgcttcatgttctccaaccgcatctacaacttctcccaggacgccgacgtcgaccccacgctggacccggagtacgccaagtggctg

SEQ ID NO: 14918 - DNA, 3540 bp, Zea mays
  misc_feature (3143)..(3143): n is a, c, g, or t
  misc_feature (3309)..(3309): n is a, c, g, or t
gtgaagaggcctaaataatgtgaggccctcgtctctcgtccctgcaatcaagctcgtcgttaagctttgcctctaccacgacgccatgcgagctaataaacacacgcagtcaactcgttgctgggggtgggatcccggccgagcaccatgcgaggaaataacatgccgcggcacacgtcgccgttcctttttgccttgttggcgtcggcggcgaccctgctcagcgtcggcgacgcgttggtcgtcgccggcctgcaggtggggttctatggcaagacgtgcccggcggccgaaggcgtcatcagcgacatcgtcaacaacgaaatcgctatggaccggggcatctcccctggcctcattcgcctcttctttcacgactgcttcatcacggtaactagctagctagttagcactcacatttgctcatgcctatgctgcaatgcaaccgcaccgtgagctggttctcgtgcagggttgcgacgcttccattctcctggacgagtcgcccgccggcgacgtcccagagaaggagtcgtccgccaacggcttcaccctggtcgggctcagaaccatcgacatcgccaagtccaccgtagagggcatgtgccccggcaaggtctcgtgcgcagacatcctggccttcgcggcgcgcgacgccgccgtggccgcgggcctcccgagatacgaggtcgcggcggggcgccgcgacggcatgcgctcgaacatggacgacctcccgggcaacttccccgtgccgggccaccacgtgccgcgcctcaccgagctcttcagccagcgggggctctcccaggaggacctcgtcctgctctccggcgcgcactccatcggcggcgcgcactgcttcatgttctccaaccgcatctacaacttctcccaggacgccgacgtcgaccccacgctggacccggagtacgccaagtggctgcgccagatgtgcccgccgcggcagcccggcgacgaccccgagcaagcgcccaaggtgaagttcgacgcgcagacgggggagcggctcgacgtcgcgtactactccgagctgctcgcccgccgcggcctgctcacctcggacaacgccctcatcgaggacccgcagacgagggcgatggtggagaacttcgcccggaacgagccactgtggcagcagaagttttcccaggcgatgcagaaggtcgggatgcttgacgtgctcatcggcgagggcaagggccaggtaaggaagcagtgccgcctggtgaacgggcaggagaaggaggagaagcagcagcagccgcaggaggagcaggaggagcagcagccaccggagctggaggaggaggagcagcagcagccgcatcagccacagcttccatggttcctgcagaggcagcgcccgcccgttcttcttccatggctccggccccatccacggccgcgtcgaccgttccggaaacatccggtggccgacctggttaacggatttttccgtggttttcactgaaggcgagcactatgctcgggacgtagacctccaaaatatgcaatgctacggtacatatcaatggacgtaaaccggtgtatccatgagcttaattaacatgaacaatcctgctttgcttactcctttgttttagaaaaaaaatgttggtgccatcgtatgacaacatatgctacgacatgtcatacatgcctgtttttattttctttggcaaggtacagtatcgtttcgattgctgaaatcaatgaacatgtggaaagtagcaaatctgcacatccggttgccatccgaacataatcaccggtgtcctccgttgtgagttgtgaccttatattagcgtatgtataacccgtctcttggcgtgagtctattaaggcgtctctaaggcacttttggattctttgaattgaatttcattctaataatcataatttaggcatagattaattaagttgacctaattttctatcgaataaatttgtgatggctacccagaaacggggtacccaaattaagcctataacttacgacgacccacctaggtcgactaggtcttgccgagcaaatctgtgaggcgaatcgactgagcaggtcctaccgctgggcaggaccggctgaccaggtcctaccgagcagcccaacgaggtagaccggccgacaaggttctatcgagcaactctgcgagacggactaaccgaccaagtcctgccgagcaactctgcaaggtggaccggtcgagcaactctataaggcgggacgaccgaccaggtcctaccgaacaacccagcgaggcgaagaggcacatgcctacaacggtggccagtacacctgtggcccatgacatgccctcctgtcacgcgcacgataggagcacacatgtaccccctgacgtagaggtagggcaggcacgattaccccacgtcagccacagttagacacgtcaccaccacacattgtctcggatgacgccacgacacgccggagggggggtgatagagtgtctggcaatgagtgtctcgcaatgggatgagacatcgccacatacggtctcagtatcacttggctctgtccaatgggtcttgtcaggcattgctacagatgacgtcagcactggagtcactacaggaaaaaggaaaaatgtcagtcacattaagaatgtcggtaccgacgttcttaatcccattaagaacgccggtttctgcggccgacatactaatcaatatgcacgtcggctatgccgcggccgacgttcttaattaagtaagaacgtcggtcaaatcctggctgacgtacttattcagttagagtaatcagactaacggttggcttattaaaagcaatgctcagccttaatcctcacttgttgataagtcttacacttcacatgagcccccaccgtaagtgagctcatgcagattattccccacaacttgttgagcgatgaacgtatgtgagcttacccttgctagactcacctaggtcaagaacaggtactgccaagatgaggatcatgaaggatgctacgatgaatttgtgagaggtctaggtcgtcgtctcccaatcaactatagttgcagaggatcgttatcgtcatatgatgtaattatatatctattttgtatggaactcctattttatataaagatgtganattgattcctgtaccatgagtcattatatgtgtgagacttgatcctaacacacatatgattcatgctcgggtttgcccataaatccgggtgtgacaatcgtgctaacgtcctagtcttacagggcctcaagccacagatcttcgacagattgaagaaacttgtcgnacattgggtagaagaatcatcggtcgtccttaggagcctacgtactacctttcttcccgacgttcagcgcagaggcggtgccccccccacgaagttggaatacgggtcaccaagggtccaagccccaacttgccaccgacctcctcgatgaagcgtgggacatggtcgtcatctgctccgccaagtactagtaggacctacgatgctacccagaccgacaagtccatagca

SEQ ID NO: 14919 - DNA, 952 bp, Zea mays
cactcctatgggcgattgggttcctcgcggccggccggggggggtgggatcccggccgagcaccatgcgaggaaataacatgccgcggcacacgtcgccgttcctttttgccttgttggcgtcggcggcgaccctgctcagcgtcggcgacgcgttggtcgtcgacggcctgcaggtggggttctatggcaagacgtgcccggcggccgaaggcgtcatcagcgacatcgtcaacaacgaaatcgctatggaccggggcatctcccctggcctcattcgcctcttctttcacgactgcttcatcacgggttgcgacgcttccattctcctggacgagtcgcccgccggcgacgtcccagagaaggagtcgtccgccaacggcttcaccctggtcgggctcagaaccatcgacatcgccaagtccaccgtagagggcatgtgccccggcaaggtctcgtgcgcagacatcctggccttcgcggcgcgcgacgccgccgtggccgcgggcctcccgagatacgaggttcgcggcggggcgccgcgacggcatgcgctcgaacatggacgacctcccgggcaacttccccgtgccgggccaccacgtgccgcgcctcaccgagctcttcagccagcgggggctctcccaggaggacctcgtcctgctctccggcgcgcactccatcggcggcgcgcactgcttcatgttctccaaccgcatctacaacttctcccaggacgccgacgtcgaccccacgctggacccggagtacgccaagtggctgcgccagatgtgcccgccgcggcagcccggcgacgaccccgagcaagcgcccaaggtgaagttcgacgcgcagacgggggagcggctcgacgtcgcgtactactccgagctgctcgcccgccgcggcctgctcacctcggacaacgccctcatcgaggacccgcagacgag

SEQ ID NO: 14920 - DNA, 1744 bp, Zea mays
actcctatgggcgattgggtcccccggccccggccggcgtctcgcatacccggttcaagcatccgatctgcgaatctcacgttcatcacaaacgtacacacaaaccatccacaaccgtcaaaatgggtaaggaggagaagactcaccttaacgtcgtcgtcatcggccacgtcgactctggcaagtcgaccactaccggtcacttgatctaccagtgcggtggtatcgacaagcgaaccatcgagaagttcgagaaggaagccgccgagctcggtaagggttccttcaagtacgcctgggttcttgacaagctcaaagccgagcgtgagcgtggtatcaccattgatatcgccctctggaagttcgagactcctcgctactatgtcaccgtcattgacgctcccggtcaccgtgatttcatcaagaacatgatcactggtacttcccaggccgattgcgccattctcatcattgccgccggtactggtgagttcgaggctggtatctccaaggatggccagacccgtgagcacgctctccttgcctacacccttggtgtcaagaacctcattgttgccatcaacaagatggacaccaccaagtggtctgaggcccgttaccaggagatcatcaaggagacctcttctttcatcaagaaggtcggctacaaccccaaggctgtcgctttcgtccccatctccggtttcaacggtgacaacatgcttactgcctccaccaactgcccctggtacaagggttgggagcgtgagatcaagtctggcaagctctccggaaagaccctccttgaggccattgactccatcgagccccccaagcgtcccaacgacaagcccctccgacttcccctccaggatgtctacaagattggcggtattggaacggttcctgtcggccgtatcgagactggtatcatcaagcccggtatggtcgttaccttcgctccttccaacgtcaccactgaagtcaagtccgttgagatgcaccacgagcagctcactgagggacagcccggtgacaacgttggtttcaacgtgaagaacgtttccgtcaaggacatccgacgtggtaacgtcgctggtgactccaagaacgacccccccatgggtgccgcttctttcaccgcccaggtcatcgtcctcaaccaccccggtcaggtcggtgctggttacgctcccgtcctcgattgccacactgcccacattgcctgcaagttcgccgagatccaggagaagatcgaccgccgaaccggtaaggctactgaggccgcccccaagttcatcaagtctggtgactccgccatcgtcaagatggttccctccaagcccatgtgtgttgaggctttcaccgactaccctcctctgggtcgtttcgccgtccgtgacatgcgacagaccgtcgccgtcggtgtcatcaaggccgtcgagaagtccactggcgctgctggcaaggtcaccaagtccgctgccaaggctggtaagaaataagcgcattatttctgaaatgacaaccttcggtgggatcttacgactccccccccccccccaagggctgatgtactcgcttctacgacgaaatgatcatgttggcatgagcactcggcttatgtctgggggcacgagatgaggcgaaaataaaagcctgggatcttgtgcaaatcaaaaataggaatagagagtctagccccgctccccccccccaaaaaaaaaaaaaacccgccgccgcc

SEQ ID NO: 14921 - DNA, 995 bp, Zea mays
  misc_feature (11)..(11): n is a, c, g, or t
  misc_feature (33)..(34): n is a, c, g, or t
  misc_feature (47)..(47): n is a, c, g, or t
aaaaaaaaaanaaaaaaaaaaaaaaaaaaaaannattttattttccnccactgactttactgttccattggtccattcatatttttttacctcagcctcacacagatcgcaatcacacagatagcaagctaaagtcatagtttcttgcttcaacacctcgctaccaccactcagctctcctaactaggcctatcatgtcgttacgggtgacaacaccatgtgatgtatgtaaccaagggtgcacgcaacatgcacctgtcccaatacatacagtccaagtgcaaggtgcactcttcttccttggccgaacgaacagactcgtcttctgccttccagattccaacaccagcaacagccctcctcatcagtggtggagtaccccagcagtccggttcggccattgatggatggaccaaacgacctactttttttttttttttttgtttgaaatagaaactactttttagaaatgctaggaattgaagttctgcgccgcagctgtcgcagtagaaacctaaccggaaccaaagctaaaactaacctggcctaattgagactcctaaactctctaattaacccaaccgggactacaacgaccacactaggatgagtgaggggaggagagttcaggtacggtacagggccattatggcaagaaaaaaaaaatgtacagccaccgctgggtggccagcgtccttgctgacagcgagtgcagctcagaacgacgccacggccggcgcggcggtggcgaccatgtcgccctccttcttgcggcgcatctcgaggaccttgcgatgggagttggagtggatgctgctcacgaaggtggggctgcacgccgggcggtactcgggcaggagccggcccgacttgtagcggacgccgcacgcattgcacagcgtctttgcgccctcgggccccgcgcgccactgcggggtcttctgcacgccacagtggctgcagcgtcggtcgctcggcccgggctgcgacgcggc

SEQ ID NO: 14922 - DNA, 1832 bp, Zea mays
tgaaatcgtccctccacggcggcagcaaaaacagtgggaccgggattcggctcgtgcgacagagaatccatggcggcggcggcgtggtgggagacgctggtggtggcagcggcggcggatggaaccggtgggagcagcaccacggtggtgtccatctgcatgttcacgacggtgctgtgcctgtgcctcgtcgcgggccacctcctcgaggagaacaagtgggtcaatgagtccatcaccgccctcgtcatcgggtgcatcataggagtgatcgtatttctgctgaccaaggggaagcactcacacatcctgcggttcgatgagcagctcttcttcatctacgtgcttccaccgataatcttcaacgccgggtttcaggtcaagaaaaagcagttcttccacaacttcatgaccatcatgtccttcggcgtgttcggcgttttcatctcaggtgcaatagtttcggcaggctgctattggctcttcccgaaagtcgggtttggagaacttggtgcggtagattatttagcactgggagccatattttcttcaacagacaccgtgtgcacgttgcaggtcataaaccaagacgagacaccaaggctgtacagcctggtgtttggagaaggagttgtcaacgatgcaacggcggtcgttcttttcaatgccatcaaggatctcgatatcagtcagctcaagggtggggttgtgctaaaagtgatatttgacttcctctatctctttgcaaccagcactgtcctcggaatctcaatcggtctagtaactgcatatgttctcaaagctctgtattttggtaggcattcgaccgatagagaggttgccttgatggctctcatggcctatctatcgtatatgctggcagagttgctagagctgagtggaattttgaccgtgttcttttgcggcattgtcatgtcccattatgcatggcacaacgtgacagagagctcaaggattacaacaaagcatatatttgcaacattatctttcattgccgagacattcatcttcctttacgtcggtatggatgctcttgacattgataagtggaggacatcaaaggaaagcttcaagacatccatcggtatctttggcatcctcatattgctcatactactgggacgagtggcatttgttttccctatatccattttgtcaaatatcatgagtggaagttctgaaagaaccccgatcacattcaagcaccaggttgttatttggtgggctgggctcatgagaggtgctgtttccattgcactagcatacaatcagttcacattctcaggtgtaacatcggatccagttcatgccaccatcatcaccagcacaataatcgtcgtcttcttcaccactctggtgtttggcttcttgaccaggcccctgatcagtggcatgctcccgcaccagtcgagggcgctgtccagaggccatagcacaggcagcaactccccgaaggatgacttcaccctgccgttcctgtcgggcgatgaaggcgcgtcaggcagcggtatcgtcttggagcaagccaagaggagcttgtctatgatgctggagaggcccgtccacacggttcacatctactggaggaagttcgatgacaggttcatgaggccaatctttggtggaccgcggtcgcactgactgcaggtgcatataagaggagttagtttctctgaattctgtcagcatagttcgcccatggcactgtaaagttgataacactgaatgctttcaagcaactctttattatttttagtacttatattacatcaacaaaatcttacaaacataatttttttttaaaaaaaaaa

SEQ ID NO: 14923 - DNA, 3029 bp, Zea mays
  misc_feature (2997)..(2997): n is a, c, g, or t
aaaattaggtttaacccgtacaaaggacctgtccgacccaacctaaaaatggatatccgacccacgttgttacagaatcaaacacacgctaaattagccccctcaaatagaaattctagggtgcctaaaatttagaagggtgacactgaaaatagcaatttaggttaggtaggctggaatagttccagaacgcgcccttggggaagctcggaaaagcgtcacctactcacctgactcgacacctaccgcgctctccgggtggtgcgagtgcgagtgccacgagccccacgaaagcaaaggaacagacgcacgcggaccgtagcgctgtcacgttgcgtcacgcggcactatctcagccagccgtccagcacagcggaccggtccatcgatcaccgatggcctcctcgctccgccatttcgcgggcctcggctgtttctccgccgcggcgtctagctctgcctccaccagcttcctgcccggctacgcccccgacttctgcgtattcgtggcgctccgtccgatcaagccgcccgccaccgccgtagcgaaccctcccgcctctccatctccgctggaggaggagcaccggcggcaggccgccgttccatggcacagcgacgacccgccagcaccatccgttcctgcgccgctgcgggtggggatcgtcgggttcggcaactttggacagttcatcgcgggcggcgtgcagcggcagggccacaccgtgctcgcggcctccagatccgactactctgcctactgcgcccagcatggaattcgcttcttcaggagcgtggacgcgctgtgcgaggagcagccggacgtgctgctcatctgcagctccatcctgtccacggagagcgtcgtccgagccatccccttccacaagctccgccccgacaccatcgtcgccgacgtgctctccgtcaaggagttcccccgcaatctcctcctcgaggtaaccaggcttttcaatacccacctaccgttcccgaccaataatcattaatgcacctgctcctgctggctgttcgttgttgtggacttatagtagctaatcaaccccatttctattttggcatccgaaactcaggactaagttttagctctacgtatccaacacccacacccttacgcctactctgtggtccagaatccgtcacttgatttcctctgaatttcctggtgatgacgaagacgtacgcttatgctggaccggccaactgcactgcactgcacttacaagggaatggtgcattgccgtgtctggaatccggaacgaggatcgttgatacactgatgaacacatcgccaatctgtcaggttctcccaccaggattcgggatcatctgcacacacccgatgttcgggccggagagtggcaaacacggctggggcaagcttcccttcgtcttcgacaaggtccgtgtcgcggacgacggggatcaggcggcaacgtgcgaccggttcttgagcatatttgagcaggaggtaactctaccagaactcatgatctctttgatttgatgttcatccacactggggcatttaatttgtaggagctactgaacatgtggaatttttgtggtgtgtttcatttcattctagacaattcttgtagggttgtaggatggtggagatgtcgtgtcccgagcatgatcgctacgccgcgggggagccagttcatcacgcacacaattgggaggtcagcaacattgcatatatctggaacgtttttgcagctatcactccagatcgttttcgatctgcctgcttaattaacgcgatgttataaatgactcacgttgtttggcgcagggttctgtcacagctgaacctcagttcaaccccaatcaacaccaagggctacgagaccctgctgcaacttgtaagtggtcttgtccattcttgattgctgagacgaatgctggctcttatcgcctacgaaccttgcagacccagaacaccgtaagcgacagtttcgacctgtactacgggctcttcatgtacaatatcaatgccacagagcaggcaagtgctctccacccggcctctcaacacatcatgcattagtttagttgcataagctggttttggttagcccgtgggtcagcgattgttgtaacgcatgcagcgcaattgtttgctaacatgtactatatatgcctaaagttaagcgcggacaacaacctaatgtttcactgctgcttcacgcgcagctcgacaggctggaaatggcatttgagaaggtgagacagatgttgtctggcaggctccacgacttcataagaaagcagattgtggagagggcggacccttcaggaaaattggcaaatggcaggtccagttctcctgcagcgcaccacttatcgacattaacagaagaaaataagacacgtgtatcccccgctcttactctagcctctcctacgctttagttaaacttgtataaatttgaccatgttttgttaataaaaaaatattgatatatacagatctaaatgaattctgcgtcgaaatatactgggcaatcgtattgcacgaaaaatctaggaaaacaaatataatgttgtatgttggtggatttttctacaaatttaatcaaaggtaaaaaaatatgtttaccttagaacaaaaacaaagtgaaatagaattttaaacagtgagggtatgctgttgtagatgtgcagttttcatagttgtcaatattcactagaccaataagagtataaagcctatttggatcttcctagctaattgtttaccattggctaacaattagctagtaaataattagttcgcaacaattagccagaatatgtttggagtcttcgctaattgatgtctaaaatatagtacatagtttgtttatccttgcatggcaaacaattaaccaagagaaaaaggaaaggaaccgacagagatagggatagtcgtttttctctttttatgatctattagcacatgttagcaatgtcaaatgctaatggacaaanaatttatcagcactctgactagtaattactca

SEQ ID NO: 14924 - DNA, 1576 bp, Zea mays
acagagaatagcaatttaggtaggcaggaatagtttcagaacgcgcccttgggaagctcggaaaagcgtcacctactcacctgacccgacacctaccgcgctctccgggtggtgcgagtgccacgagccccacgaaagcaaaggaacagacgcacgcggaccgtagcgctgtcacgatgcgtcacgcggcattttgtcatccagccgtccagcacagcggaccggtccatcgatcaccgatggcctcctcgctccgccatttcgcgggcctcggctgtttctccgccgcggcgtctagctctgcctccaccagcttcctgcccggctacgcccccgacttctgcgtattcgtggcgctccgtccgatcaagccgcccgccaccgccgtagcgaaccctcccgcctctccatctccgctggaggaggagcaccggcggcaggccgccgttccatggcacagcgacgacccgccagcaccatccgttcctgcgccgctgcgggtggggatcgtcgggttcggcaactttggacagttcatcgcgggcggcgtgcagcggcagggccacaccgtgctcgcggcctccagatccgactactctgcctactgcgcccagcatggaattcgcttcttcaggagcgtggacgcgctgtgcgaggagcagccggacgtgctgctcatctgcagctccatcctgtccacggagagcgtcgtccgagccatccccttccacaagctgcgccccgacaccatcgtcgccgacgtgctctccgtcaaggagttcccccgcaacctcctcctcgaggttctcccaccaggattcgggatcatctgcacacacccgatgttcgggccggagagtggcaaacacggctggggcaagcttcccttcgtcttcgacaaggtccgtgtcgcggacgacggggatcaggcggcaacgtgcgaccggttcttgagcatatttgagcaggagggttgtaggatggtggagatgtcgtgtgccgagcatgatcgctacgccgcggggagccagttcatcacgcacacaattgggagggttctgtcacagctgaacctcaggtcaaccccaatcaacaccaagggttacgagaccctgctgcaacttgtaagtggtcttgtccattcttgattgctgagacgaggggggctcttatggcctacgaaccttgcagacccagaacaccgtaagcgacagtttcgacctgtactacgggctcttcatgtacaatatcaatgccacagagcagctggacaggctggaaatggcatttgagaaggtgagacagatgctgtctggcaggctccacgacttcataagaaagcagatcgtggagagggcggacccttcataaaaattggcaaatggcaggtccagttctcctgcagcgcaccacttatcgacattaactgaagaaaataagacacgtgtatcccccgctcttactctaacctctcctacgctttaagataaacttgtataaatttgaccatgttttgtttataaaaaatatattgatatctacagatctattcatgcccgaaaaaaaaaaaaaaaaa

SEQ ID NO: 14925 - DNA, 1343 bp, Zea mays
gcacgagaccattacctagaacatcctaatcgaaaaatcgatcaccgatggcctcctcgctccgccatttcgcgggcctcggctgtttctccgccgcggcgtctagctctgcctccaccagcttcctgcccggctacgcccccgacttctgcgtattcgtggcgctccgtccgatcaagccgcccgccaccgccgtagcgaaccctcccgcctctccatctccgctggaggaggagcaccggcggcaggccgccgttccatggcacagcgacgacccgccagcaccatccgttcctgcgccgctgcggggtggggatcgtcgggttcggcaactttggacagttcatcgcgggcggcgtgcagcggcagggccacaccgtgctcgcggcctccagatccgactactctgcctactgcgcccagcatggaattcgcttcttcaggagcgtggacgcgctgtgcgaggagcagccggacgtgctgctcatctgcagctccatcctgtccacggagagcgtcgtccgagccatccccttccacaagctccgccccgacaccatcgtcgccgacgtgctctccgtcaaggagttcccccgcaacctcctcctcgaggttctcccaccaggattcgggatcatctgcacacacccgatgttcgggccggagagtggcaaacacggctggggcaagcttcccttcgtcttcgacaaggtccgtgtcgcggacgacggggatcaggcggcaacgtgcgaccggttcttgagcatatttgagcaggagggttgtaggatggtggagatgtcgtgtgccgagcatgatcgctacgccgcggggagccagttcatcacgcacacaattgggagggttctgtcacagctgaacctcaggtcaaccccaatcaacaccaagggttacgagaccctgctgcaacttacccagaacaccgtaagcgacagtttcgacctgtactacgggctcttcatgtacaatatcaatgccacagagcagctggacaggctggaaatggcatttgagaaggtgagacagatgctgtctggcaggctccacgacttcataagaaagcagatcgtggagagggcggacccttcatgaaaattggcaaatggcaggtccagttctcctgcagcgcaccacttatcgacattaactgaagaaaataagacacgtgtatcccccgctcttactctaacctctcctacgctttaagataaacttgtataaatttgaccatgttttgtttataaaaaatatattgatatctacagatctattcatgccctaaaaccatgctttcattttccaaaaaaaaaaaaaaaaaaaat

SEQ ID NO: 14926 - DNA, 1688 bp, Zea mays
cattgggtacctcgaggccggccgggaacaaagcctgggcctggccgcctggacctgaaaaagtcgttcgggattcaaacccttcgatcccaaatctgccctgcacgcctcgccgccggccacacccccggcggtcgtcgccctacccgcccttctccttacctctaaccccgccggagcccaacacctccccaccatgccgcgaaacttccgcaagcggggcatcgagcaggacactgacgaccgctccgacgacgaggacactcgccgcatcgccctcgaggagatcaagtacatgcagaagctccgggagaggaagctgggtatccccgccgacctcgccgccgcatccactaacgggtcctccgcccgtggtctattgggcaccggggcagcggtcgccggtgaggccgagaaggaggacctcgtcctccaggacaccttcgctcaggagaccgccgtcactatcgaggaccccaacatgttgaggtacgtggagaccgagctggcgaagaagaggggtaagatggttgatgtgggacacaaggaagagatggaccatgtggacgagctctataccgtgccagaccacctcaaggtaaagaagaagaactcagaggagagctcgacacaatggacaactggcattgctgaagttcagctgcctattgagtacaaattaagaaacatcgaagaaaccgaggcggctaaaaagttgctgcaagagaaaaggcttgcaagaaaaccaaaaccagatgcaaacattccatcaagttatagtgctgattatttccaccgtggcaaagaatatgatgaaaaactgcgaagagagaatcctgggttgtacaaagataatgattctcggccaagtggaaatccaggaggcaaagcaacagatactaaaaatccagatggtgttggtgcaggacggagagaagctgcgagtgatgaactcatgcttcagcgtttccgcaaacgagaaaaattccgcgcccttcgaagataagccagagctgacaggttgctagattgtgccagttgcctttgaagctcaaaaatatagttgtggctgcataaagtcccaacatatcatgtccttttagtgagaaacttactgtaaaatgcatccttggttattgagtctgcttctgcagctgctaagggcaaggagcagattaaccttattacagaggcgatttggggcaatatatttgagctgagggatatctgaattttgtgtcagctctgaggctcatatattaagaggggccgcagtggttcaggacataggagctcataactttccagatgctcagatcgtgccatgttcatctgcaatggaagaaaggaaggtgtgttctccgtacaaatataaatgaactgcttcgacatcttgagcaaactccaaggggtagtgcgaatgtctgatctcattttctttggagtgaatggcaaagcctgcaaattcatctttctagtctagaatgtattgtttctctgaattatttgcagtttgctgcagtagcatcagttatctagatttctagggacgagcaatctgtgagttgtttttgttgcactattgctgcttgctttgcctttactagttcaagtatcaattctttataagaaaaaaaaaaaaaaaagcggccgttttgagtttcatatcaattttgaggttttggccg

SEQ ID NO: 14927 - DNA, 1849 bp, Zea mays
cattgggtacctcgaggacgggcaaaaaaaggaaaaggagccgaggaagccctcccctctcgccgcagccgcaccaccagaccgacaaccggccggcttccctcgcccccggcgaggagtgaagacaagccgacaaggcaaaaccatcgcctgtacggtatccaaccgccgtcccgccgcacaaccaaggatagggcgggagagggggatctcgctttcgctccgctgccgcatgcgcaccgcccctcctcatgacaccaactagggcaccaccagcccccttctcgtcgacctccgcgcggtgactctgctgagcatcatacccttatagggcccgacccatggatgtaacttcgaccgctgccgcctccgcctcaggcgggggtaggtggtacacgggcatgtccgcggataacatcaagggcctggtgctcgcgctctcctccagcctcttcatcggcgccagcttcattatcaagaagaagggactcaagaaggccgcatcctccggcgtcagagcgggggttggtggctattcttatttatatgagcctctttggtgggttggcatgataacaatgattgttggagaagttgcaaatttcgcagcttatgcatttgcaccggctattttggtcactcctctcggtgctcttagcattattatcagcgctgtgcttgcacatgtaatgctgcgggagaagctgcacatatttggaattcttggatgcgcgctatgtgttgtgggatccaccacaattgtccttcatgctccaccagagcgtgaaatcgagtcagtgacagaagtgtgggatctggctacggaaccagccttcatgtgttatgcagcagtggtaattgctatagctgccatacttgtttatcggtttgtcccactttatgggcagacacatgtcatggtctacataggtgtttgctctctcgttggttccatctcggtcatgagcgtgaaagctcttggtatagcattgaagctgaccttttcaggaacgaaccagcttatttacccacagacttgggcttttagtctggttgtcatctcatgtatcattacccaaatgaattacttgaacaaggcacttgacacgtttaatacagcagttgtgtcacccatttattataccatgttcacatctttaactatcttggcaagtgtcatcatgttcaaggtatgtgtctcaattactgtagcttatcgtttcagctttcatactttggttgtgaaatttgagcagggcactaaatagtgattgagccagtgttccaaatccaatttcaaatggagatttccttggattgcattagactaaactgtaaaagaagcagtatgagcctgagcttcagctttcaggactgggacaggcaaaatcctacgcaaattgtgactgagatgtgtggctttgttacgatcctttctggaacttttcttctacataaaacaaaggacatggctgatggtgggctttcgatgtcatcctccttccgtcttcctacatcttcttcggtgcgcttctccaaacaaacagatgaagatggtgaaggaattcctctaagatcgtccgaatcattccggtcaccacattaacgcatgtttgctaatcattaatttgcacagagttaggggtgggtattatatagataatgctatcagtgagcttgtactaagggtacgatggatggaccctcttttgctttggcagaattgtatatgtatgcccaacatcttgtggaactcccaatatatttctcttggctgtcgtgtgtgacaaaaaaaaaaaaaaaaccgccctggctgccatcagccatcaggaacattgagtgctgtgga

SEQ ID NO: 14928 - DNA, 3748 bp, Zea mays
gcccatccagtatctgagatcgtcgacgctggtagcaagaagaagccaaatccggcgttcgaggagtgggatgctcgggaccaataggtcctcaagtacctgctttcatccatctccaaggaaatcctggtccatgtctcaagatctgagacggcagccgatgcgtggaaaaaattcaggcaatgttcgcctcgtagacctgagcccaagttgtgaatctctgcattgctctctcgatgaccaagaagggtaacatgaatgttgctgaatactttgcaaaaatgatggggtacgctgatgatatggaagccacgggacaccccctcgaagacgacgaattagtcaaatatatcattactgagttggaccgtgagtttacctcgcttgtctctgtcctcattgcaaaggtgagggcaatatctttgaagaattatattcttagatgctaaactatgaaacatgaatggatttaatccaggaagaagagcagtttgcatcagctaaccttgcaggatgtgaaggctgttctcgaggaccgagtcgtggtcgtgggcgtgcccggccacctgctcacagccacaacaactatacaggcatgagcagctcctctgcctgtagctatagtgctgcaagcggagagtacaacataatagtgacggggaggcagcgtcgctaaagtaaccgacgctccaatccaagtagtgaaccatgccaagtctgcttcaagaaaggacacacagttgtcaactgttggcatcgatacaatgaaaactatgtccctaaagaacgccatgctgctgctgtggtaagctcttacacaatagacacaaactggtatactgacagcggagctactgatcatattaccagtgagctagagaaactgtccatccgagataaatacaacggggaagatcagatccacaccgccaacggcaaaggtatgaaaatcagccacattggtgattcctctgttagcacctctagtcgtaatcttcatttgaaaaatattttatatgttcctgaagccaagaaaaatcttgtttctgtccatcgattaaccacagataattctgccttcatagaatttcacccagattttttttgattaaggatcaggcaactagacgcactctccttagagggccatgtcgccatggactgtaccctcttcctccatcaccatcaataaagcgtcatgcctatggagtcagtcgtccatcgatctctcggtggcatgatcgtcttggacatccttcatccactacagttcaacgtattgttagaagtaataaactcccttgtttagatgagtctaataatgagtctgtatgcgatgcttgtcagcaagcaaaagcacaccagctgccatatcctgtttcatctagtaagtccagctctcctttagagctcatattttctgatgtctggggtcctgcaattgagtctgtaggcagaaaacaatattatgtcagcttcattgatgattacagcaaatttacctggatttaccttatcaaactgaaatctgaggtgttccaaaaatttattgaatttcaacaacttattgaaaggcagtttgatagaaaaatccgcgccattcaaacagactggggaggagaatatcaaaagttaaatccattttttactaaaattggcatatctcatttggtctcctgccctcatacgcaccagcaaaatggggcagctgaacgaaagcatcgacacattgtcgaagttggcctctccttactatctcatgcttctatgccgctaaaatttgggatgaagcttttctatcggccacatatcttattaatagactacctagcccggttattaataatcaaactcctatagaacgtctttttcaccaaaagccatattattcttccttacgaatttttggctgtgcttgttggcctaatctgcgcccctataatactcacaaactccaattcagatcaaagcagtgtgcttttcttggctatagtcctcttcacaagggttttaaatgtctcgatatctctactggacgtgtttacatctctagagatgccatatttgatgagactgttttccccttctctacactccattctaatgctggggctagattacgatctgaagttcttttgttgccatcttttacgactaaaaaaggtgctgatagatgtgatcctgatgtccctgattttctccatgttgatactaacatgcctaataagaatattgcagtacaacatcattatgcaggaggtactattcaccgaaatgacaactctctaccaactgttgcaagcctgccaccaggggagggagaatcacgtgataaccactcgcatgggcatgggtgccaagtagctacagagggagaatcgcatggagaatctcatgatgaccactcgcatgggcatgggcgccaagtagctacagtacctgctacagtagccgatcagcatagggagcctgccactactattcacgctactatgacagatgaacagttacctgacggattccatgcaccatctcctgagcaacctacaacatctactgaggcgcgtgcacctgctttgaccatacaagaggtgtccggggaagcagctgctgaacctgttcaagtggctgctccgcgtccctgtacaagactgaggagtggcattcggaaggaaaaagtatacactgatggcacgatcaggtatggctgctttacgtcctctggtgaacccagtgtcttgaggaagcacttagtaattccaactagaaaaatgctatggatctggaatacactgctctcataaataataagacatggcggctagttccaccaacaaaaggcacgaatgtaataggatgtaaatgggtgtataaaattaaaagaaaagcggatggaagcttagatagatataaagcccgactagttgcaaaaggttttaaacaacattatggtatagattatgaagacacattcagtccagtcattaaacctactacaatacgcattattttgtctgttgccatttctcgaggatggagtcttagacaacttgatgttcagaatgccttccttcatggctttctcgaagaagaagtttatatgcagcagccaccaggttttgaggatccatccaagaaagattatgtgtgtaagcttgacaaggctctttatgggcttaaacaagcaccaagagcatggtactctcgtcttagctcaaaattaataagtcttggcttctcaccatcaaaggctgattcatccttattcttctataacaagggtaacactataatttttgtgcttgtttatgttgatgatataattgttgcaagttctacagaagcagccaccgcaacattgttgaaagacctagaggaagaatttgcacttaaagatcttggtgaccttcactatttcttgggaatagaggtaaacaaggtacgtgatggagttattctcacccaagacaagtatgcttcagatttattgaaaaaggtagggatgtcagattgcaaaccagtcagctcgccactatccaccagtgagaagctatccttgcatgatggatctttactaggcaacaatgatgcaactcagtataggagcatagttggggccctacaatatttaactctcactaggcctgacattaccttctcagttaataaggtatgtcagtttctacatgctcctacaactgttcactgggctgcagtaaaaagaattctcagaatatatcaaacaagg

SEQ ID NO: 14929 - DNA, 1801 bp, Zea mays
cgggcacgacggtaagagatatgggttgagagctaagccaactacattgctggaacttccttttggttggcaaactggaatacaagagacagcagctacatgggatgaagaatgggacagatttggagatgaaggattctccatcataaaggaactaacagttgaagtagagcctcccgttgtaccaaagagtcagcctactgttgaagatgtcaaagtgtctacaaatggggcatcaacagagaaagaagacaataagtttgctaaatctactgctgctgctgctgtggagcaggcagttgaacctgaagcaataccatccaatagcaaactagagtcaacaaaaagtcctccagttagtcctgtcaagaacagagacgatggttctaccgatgagcttgatacaaagcaatctggaccaaatgacgtcttaccacgtgccactgagagcgtcagtaaccgtggaatggattcctctgcccatggagataaaacttatgatggacattcatgggccccatcatttgatcatggcactgacaatgactccctatggaactttggtcataaggatggtgagaatggtgattcagatctcttctttgggccacaaggtcttccaccgataaggactggaggttcctcatctaatagtttgtttgtcaaggaacagaaaccatcttttgattctgttcctggtactccaatggagaaacctttctttgattccatcccaggcacaccagttcagaagtccgtcttcgattactccgtccctagtacaccgatgcaaaactcagtctttgattattccatccccagcacaccgatgcaaaagtctctctttgattccgtccctggtacaccagtgcagaaatcagtatttgattctggtccgagtacactgatgcagaaatcagtatttgattctgctccaagtacgccaacgcagaaaccattctttgactcttttccaagcaccccaatgcagagatccatgtttgattctggcccaagcagagcagaatctcctactgctggcagcgtgtacggcaaagagcaaaagggattctttgattcttcagttccgagtacaccaatgtacaactcaaacctcacgcccagatacagtgaagcaggagatgattcatttgacacaatgtctcaatacagctccttcggcatgcacgacaacaattcttttggacagatagacagcttctcaagatttgattccttccggagcaatgctgataatggcggtaatgacgcctttgcgagatttgattctttccgcagcacttcagatcaaggcgggggcaacagcttcatgaggtacgattccatgaacagccccgccggcccgggcagaacggatacattttgcgaggtttgattccatgaagaacagtgacttcaacaaccaggagctactcatttgatgacgacgacccctttggaactgggccgttcaaatcaacagagaaatcgaacagcccgacgagacatgggacggatgcgtggagtgcattttgacaggtattgtattatagaggtcatgttcttgtgcaccttactgcagatatacatacacgtacaagggcaagacattttttttttgcatgggcctctgctctgcacaccttttggacgggacggggcttgcttgtgtgtttaattttgtacctaggctgggaacatgtgtttggagggatggtgctgcttataaacattctttataccttgtattgtacaagtacgggcctgtttggtttgtggctaaatgtgacacactttgtct

SEQ ID NO: 14930 - DNA, 3883 bp, Zea mays
cttcccaaccatcagtcaatgactccaaggcgttggtgccattgggtaatggattgtcgtcaaactcaacttttggtgctgaccctttctctgcaactccacgaccagaacagggttcaccttttccccccaacgttccagacaatctgctcagctgctacccctcctgcctcagctgctggacatcatctccctcctaagccaatgcaggctggtcctgtgcagagtatatcctcgctttctcctcatactagccagttgccacacaatcagccacctccgaggcaacaacaatttaatgctacaccaagtgctccaggaccagtgagttcaaatattcccactggacaaattccttcaagcccaagccagcctcaggcaccatggccgaaaatcactcaagtagatgtcagaaaatacatgattgtatttatcaaggtagacagggatcgtgatgggaaaatcactggtgaagaggcaaggaatctatttttaagttggaggcttccaagagatgtcttaaggaaggtgtgggatttgtccgaccaggataaggatgggatgctatctttcaaggaattttgtattgctgtgtacttaatggagagacatcgagagcaccgtcctcttcctgacacagtaacagatgctatttgggctgagggcaccgcactaccctctactggacagtttgcagaaaatcctagtgcccccgctcctcaagcaggggccggatatacaagtggaacaatgcaaggaccacatcatgggatgcttccctcatccatgaagccaccatctcggaggcctcttcctttagatgctgacgatactattaagccagagcaacaaaagccaaaggtccctgtcttggaggaacatctagttggccaactaagcaaggaggaacaagatacactggatgcaaagtttaatgaagcttcagtcgctgataagaaagtccaagagttggagaaggagatccttgattctagagagaagaccgagttttatcgcacgaagatgcaggagcttattctttacaaaagtaggtgcgacaataggtttaatgaagtctcagaaagtatgtctgctgataaacgtgaggtccaatctctttctgcaaaatatgatgagagatgcaagaaggttggagatgtggcatcaaagctaacaatggatgaggctactttccgtgagatccaggagaagaagttggaaatttataacgccatagttaagctgcaaaaaggggatgatagcgatgagaagtttcaggagcgggctaataagatacagtcagatcttgaggagcttgtgaaatcattgaatgagcaatgcaagagatatgggttgagagctaagccaactactttagtggagcttccttttggttggcaacctggaattcaagagacagcttatgcatgggatgaagaatgggataattttggagatgaaggattctctataataaaggaactaacagttgaagtggagcctcccgttgtagcaaagagtcagcctactgaggatgttaaagcatcttcaaatggggcatcaacagaaaaagaagacaacaagggtgataaatctgctgctgctgtggagcaggttgtcaaacctgaaacagcaccttcgaatatcaaaccagagtcagcaaaaagtcctccagttagtcctgtcaagaacaaagaggatggtcccgatgaacatgataaaaagcaatctggaacaaatgatgtctcaccacgtgagagtatcagcaaccgtggagcaatggattcccctactcatggagataaaacccatgatggacactcatggggcatggataatgactccctatggaactttgatcataaggagggtgagaatggtgattcagatctcttctttgggccacaaggccttcccccgataagaactggaggttcctcatctggtaattcagttgtcaaggaacagaagccgttctttgattctgttcctggtaccccagtggagaaatccgtctttgattccatcccaggcacgccatttcagaaatccgtctttgattctatcccaggcacgccagttcagaaatccgtgtttgattactctgtccctagcacaccgatgcagaactcagtctttgattattctgtcccaagcacgccgatgcagaagtcactctttgattctgtccctggtacaccggtgcagagatcagttttcgactctgttccgagcacaccaatgcagagatcagtttttgactctgttccgagcacgccgacgcagaaaccattcttcgactcctttccaagcacaccaatgcagagatcactgttcgattctgggccaagcagagcagaatctcctaccgccagcagcatgtatggcaaagagcagaagggattcttcgattcttcagtcccgagtactccaatgtacaactcaagcttcacgccaaggtatagcgaagcaggagacgattcattcgacaccatgtcccaatacagctcatttggcatgcacgagagcaattcctttggacagcgcgacagcttatcgagattcgattctttcagcagcaatgctgacaacggtgggaatgacacttttgcgaggtttgattctttccgcagcacttcagatcagggtgggggcaacagcttcatgaggtacgattccatgaacagcagcagcgaccatgacgggatcggcacgtttgcgaggtttgattcgatgaagagcagtaactacaacagccggggctactcgttcgacgacgaggacccctttgggacagggccgtttaaatcgacagagaccacgagccacagcccgacaaaacatgggacggacacatggagcgcgttttgacaggcaggggctgtatcatatattcaatagaggtcatgcgcttgtgcaccttactgcagatatatacacacgtacaggggcaagacaattttttgttgtgtgcatgggcctctgctccaacacacctggggaaggggaagggatgggacggggatttgcttgtgtgcttgctttgtgtttaattttgtacgtaggctgggaacatgtgtttggtgggatgatgatgatgatgctgctgctgctgcttataaactcaacattctttataccttgtattgtacaagtgcatgtacaagatgtgagtcgacccgtttgggttgagtaactctcgagtgttttttcttccatggtgtagcgttttcctgtttctccagaattttctgagcaatgtacagacagacaaacttttgtgtgaaacacctgttgtcccatactgagacccttccattcgttgtctgaaggatccactcacgatgtagtattgtatctcgagtacggtagtgcatctacgtcgttgtttggtcgcatcgcatgtagcaaccatcgcgtgcacatcactaagaggttcacaaaatgtttggtctagtctgtcttcattttattctagcagatggtgaggactgggcattgttagagtggtgaacgcactaactagtttaacaaaaaagttaaataattgttagaagatagacaatctgtttatacactataacacccgcactcactacattgcagtgagagagaaatgtgcaaacatgtaaataaagaaatggaggtttgatcatattagagtgtacactaaccagtgctagagtagacacactaaccagttccacgtaagtttaaaaatttaagccgttagaaaaaagataagaaaaagataagcaatccacttgtatacttcaacaggcattacaaactaacccatgatggcagcaacaccaacaggaagaggaggtagggatagcacggcatcatcggcagcagcacaagccctcacgaagttaccacc

SEQ ID NO: 14931 - DNA, 1323 bp, Zea mays
aaggacccggcccttcctcgttccttcgtttctcctccccgcatttgctggtcgctgtcatacgacggcgccggaattccggtgggacagggccatcctctccgcttgtcccccagttctgcatttccctcttcgcagacattcgagttgggcctgccgccagttcttcagatggccggagcgggcgacgcggccaaggagtacgtcgccggatccgccgccggcgtcgctcaggtcgtagtcggccacccgttcgacacggtcaaggttaaactgcaagctcataataccacggctcatggaaaggtgtacaagaatgccttccactgcaccagtaggatactgcttgacgaaggaattacagggctgtacaaaggtgcgtcatcttcatttattggtatagctgttgaaagctcccttttctttggcacatattcccaagccaaacagttattacagggaagctatgaggttggtaggccgcatcttcaggtaattatcccttctgctgcatgcagtggagctctgattagctgcatcctcactccaactgagctgaccaagtgcagaatgcaagttcaagggaaggatgtaatccatggcgccaggtactccagccctctagattgtgctgtgaaaacattggaaagtgaaggggttaagggtatattccgtggtggtttggcaacattattcagagaggcgatcggcaatgctgtcttcttctgcacttatgagtacagtcgatactggatgcacaactatttggattcctcgagattttctggtagcagtcatttcgtggcggcaaaagatattgggataggggttgtaagtggtggcgttagtggaatggcattctggacagctaccctaccgttggatgtggcaaaaaccataatacagactgatccggaccctcatgtgagccgaaaccccttgcagattttgagcatggtttataagagagctgggttgggtggctgttatgctggacttggaccaactctagcaagagcattccctgccaatgcagcagcaattgttgcttgggagtacagcgctaagattctcggtataaagcgaggctagtattacggtactgctaatatatgaacacggaatcacttagcatttaaccctctttttgtttgttctgctccgttttggttcattgtcatatttcgccgaaatgtcatctgatgggcatttgtttgtgccattagactatagcacttcgtgcttatcccggaattggactggaaaatacactgaatcaaaacttccttttggttcaaaaaaaaaaaaaaaaaaaaaaaaaag

SEQ ID NO: 14932 - DNA, 4432 bp, Zea mays
tgccgagtgccagggccagcacactcggcaaaggtaacttctttgccgagtgtctcctaatacactcggcaaagacgccgtctctgtcaccccggcgccgtgacagcgacttttctttgccgagtactgcttggcactcggcaaagtctgtgccgagtgtcgaaaaaaattactcggcaaagaagactttgccgatgtactgttcgccgaaccctcattgctgagtgcgacacccggcaaagcctttaccgagtgtttttcaggcaggcacttggcaaagcggtcgattccggtagtgatatatatacgacgctagacatgcaccatgcattaccacaagcaagtaaacacaaattaagtgccgaaacagtgtgttgttaatggagtcatgatgggcacgctacgagatcgatgattgagctccgcacattgtagcccctgcttgcattgtcttgcaagccacgtactgcgcgcaccaccgaaacgcttgtacatgtggacgacgacgacgacatcacgtattcacgtacgtacgcgacgcgaactagctataacacagcgcgtagaagcgcatgtgcagtgcagtttcacgcgcgtgggtggtacacgcagtctgtagtagtgtagtgtaagcagctgaccctgacctctcgcatgtgaaacgatggaagaacactcgaatacaacagctcactcgacgatcatggtgccgtacgctttccgggtaccacaccacgcgctgcggagtacagacgcggagagagagaggggctagacacaggaggggtgacgccggcgtgacgctgagagtgagtgagcgcgcgcgcgctgttcttccggcagttcttggcggcaacgctgctggaagcaaagcaagcaagccccccaccccgtgtgatcccgctcaataacgtactacgctgtgattgttggaacgtgcacgcattatattacagagaccggcaaatcaaaacccgtggccgtgtgtctgcatcccaaaggccaaagctaagctaaaaacatttctatagagagagagcacactgaagttagtttcaaaggtaagcgattttcgggtacagtacagtacagcgcactccaactccaacaagctagcgcgggcgcgaacaaaatggtcggtcggatcccgtgccgaggacgtcgtcgtcgtcgacgaatagttattgaccgccgtattgccacaagctgacctgagcgtctgacggacggtggtcggtcggtcgtgatccacaatccacacaaaagctaattactgaaattaagaaggtagctagcactctcagcatgacgtgatcatgaagcatgcatgcatcgggacgatcgacgacgattatacaggtaacctatgttgcttccagttaattacatgcgactgatcggctagcggccggcctaatcatgtcgcaccccgcacccaagggaaaataacacaaaacacgcgcacccttccgcgcggcggcataacgtcgaaaaggcgacggcaaattaagcgtagggcgcaacagcgtagagtatatctggagtaggagagtagctagcttattagctagtagatgatgtgcggaattccacctcccaccaacccccggccgcgcggcccagcgaacaccgccactaagcacgctgatcgcgctaatggcgcaccaatgcaagcaatggccagccttgtgttttcacgccaatgcaagtgggtgtcgctttaaccgaaaactacgtcgtcgtcgtcgccggccgatcgatcgtgtgatccggagccaacgacttggcccggcacgtcaccccttttttcttcttccagcgagctctctcctgccatggaggagcggtcaactttgcgacatcattacgcgcgcgtcctcctgactggtgatcaagcaagtccagcagcccggccacctgagcctgatgcaggctatatatatatatacaccgtcccatgccattgcccgccacaaacacaaccgaacgacgaagcgtccgacgatccaatagggccggctagcaagtgcatgcacacgcgtagcagctaataactgcctgtgtgacatatagagaggcagctaccgactaccgtacggtcgagagagagatagcttagatcgatggaggcgaggaggagcagcgcggcgctcgtatccgtggccgccgccgccgccgccgtcgcgctgctgctggtgctcgccgccgagccgtcccgagcggagcggttcgtcgtcggcgacgcggcgcggtggacgtgggggtacaactacacggactgggtcatcaggaaggggcccttcttccagaacgacacccttggtgagtttgagagcaccaacgttcttcccctgctgtgtaataagtttattgtggtatgctacctgcccggcacacacacacacatatacatatgcagtgttcatgtacgacccgccgaacgcgacggtgcacgcgcacagcgtgtacctgatgcgcaccgccgcggactaccagtcgtgcaacctcaaggcggccaagctggtggccagcgtcacgcagggcgccggctccggcttcgagttcgtgctccggaagcgcaagcagcactacttcgtgtgcggcgagcgcggcggcatccactgcaccatgggccagatgaagttcgtcgtcaagcccaagagctctgcctgccgcgacgactgactgacacgccgccggacgccgatgtcggtgcgcgtacgtgtggcctcgatctcgtcctgtctttgttcgatctctgcatgccgccttctcagtcagatcattcctcctgtccaattgttgcgccctgcttgtaagttattattactatcagtcggtgtggatttactcagtgtgttgacgtatgattcgtgctgtctgatacaccagtgtttatggatgaaaaggttggttcaataaattagtgagtctttgtttctgaagtctcaagtgtcgttacccgccaagagctagtaatttcacaactccattttttcaagagatttttattttcctaggagaaaataaattaatttcctctcggaaaatagaaactgtcaaaagaagtcaggcacacttcctacaaatacaagtcgctagagaggactccctgaaaatggttgcgggtttcagccaaacttttttttagcagaaatggttctgctgaaggtcaccggacccagctgattctgaagtctgtttgccaaagcctaggcacgctctccgtcatcctgcactacctctacaatgacaactctcaagcaggtccatcgcttccactatccgtccatgtgacggcatcagctctacaccccttcttcatctccaaaacaagattcatgcccccatccacacttccatgcctgcagaggcagccgatcagcgcagtgtagtgtagctcacagcatctagcaccacaccagcattcctcatctcctgaaacaccgacctcgctgcctcaatgtctgctagtgcccattaaccagcgcgacataattgaaggcactgagctcacattcgttcttcctcaaaattccaaagattgtgcgagacttatccacctgccggagtctacagaacccaccgatgatcacattgtacagcagctgatcagggacaaatgcggtccttggcgataatctcctccaataagctcaaagccttccattatcttaccccccacggcagagcccaccgatcagtgtttaatatgtgaccaggctcggcgggtgtcctcgcgcatttcgtcgagcactttgaagacgggctccaactcgccgtttttggcacagtgcctgatgaggatgttgtagacgcatctcgcctgtgttcttggagcctgtcgagggcaccgtggcagcagccgcggaggagacgaggcggtcggtcgaggcagactgcgccttgtgtgacacgcggctcgtcagtcgtcactcgtacgaatcagcgcggcagcaagcggaggagggcgagcgcgtggtcgggcgggaggcggcggacgagcggaagcaactgcagctccaggaaccggcagggctcggaggcggcggcgcgcgaggcggacgaggagcgccgagaagatggccggcgtctgggagaagccgcgctgggaggaggccgcgttgaagaggtcgagcgcgcgctccggggagggggaggacgcgatgaggtgcgcaagttccgagtggtggaggtaccgcaatgttagcgtagtgggtactgggtagagaggaagaggattggagacgaagaaggcgaacgagatgcagagaagagagatagtatgtgacggaatcagctttctgttctttgttatcttcctcccgtatcgtaatgccccttgtatggaaacgttgctgcctagtacagcccaggtccacctagagatgttagcgtgtgtttggtttgaggttaaaatgaaatgagtgga

SEQ ID NO: 14933 - DNA, 892 bp, Zea mays
acaaacacaaccgaacgacgaagcgtccgatccaatagggccggctagcaagtgcatgcacacgcgtagcagctaataactgcccggtgcctgcctgtgtgacatatagagaggcagctgctaccgtacggtcgagagagatatagatcgatggaggcgaggaggaggagcagcgcggcgctcgtatcggtggccgccgccgccgccgccgtcgcgctgctgctggtgctcgccgccgagccgtcccgcgcggagcggttcgtcgtcggcgacgcggcgcggtggacgtgggggtacaactacacggactgggtcatcaggaaggggcccttcttccagaacgacacccttgtgttcatgtacgacccgccgaacgcgacggtgcacgcgcacagcgtgtacctgatgcgcaccgccgcggactaccagtcctgcaacctcaaggcggccaagctggtggccagcgtcacgcagggcgccggctccggcttcgagttcgtgctccggaagcgcaagcagcactacttcgtgtgcggcgagcgcggcggcatccactgcaccatgggccagatgaagttcgtcgtcaagcccaagagctctgcctgccgcgacgactgactgacacgccgccggacgccgatgtcggtgcgcgtacgtgtggcctcgatctcgtcctgtctttgttcgatctctgcatgccgccttctcagtcagatcattcctcctgtccaattgttgcgccctgcttgtaagttattattactatcagtcggtgtggatttactcagtgtgttgacgtatgattcgtgctgtctgatacaccagtgtttatggatgaaaaggttggttcaataaattagtgagtctttgtttccaaaaaaaaaaaaaaaaa

SEQ ID NO: 14934 - DNA, 2951 bp, Zea mays
  misc_feature (422)..(422): n is a, c, g, or t
ccaccaaggagcacgagtttaggcaaagggctggtacaaggtataataggggtggtggatgtggatctagcatgagttctagctagtaactacacctgtgttctcaagttttcgctaaacgattaacggaggcacaacttaattatgctcgtgtctattaatctttgttcagtgtctcacaaatttatctgaatttgtagaaacagtaaaacataaaataaatttttgttgtttttcataaatatttgatattttatgtaatgtaccgacatattttctaattctaatttggaaagaagagtaaaaatatgtccataaatatctctgacagttgcaataatggaggtagccaagattttcaatacgactactataaacaactatttcgtttttagtgaggttgaagggaaaatgtgacctangaccatttccagttgtttttgtgattaaatgctcaacacatctctttctctttgagctaacactctttatgagcataaacacatgtgtagcaaaagcaaattgaagacaagaagtccaaatgagtggaattagaaggccaaaagtgcaactttgggtaaagctacaaaaacatgaggtttaagtacctgaataagttgcacatacataacactatgtttcttgcacctttgcttggctgttaactcttttgtgcaagaaaagtggcatttggatttagttgtggacatattgtaaatcctggagaaaaggggtgaaagaggtatgatcccaacacctagcaaattgttttagttactaactatgttttgtctaagtgctaaggaacctctcaagaagagccaaaagaagttggagaaaagtttggctcaaaagaaccaaacttggaccagtctaagaccaccggactgtccaataatgcatgtctggtgatgcgtacggtcgatgactccactctcaggaattttatttataaaattcactagacagtgaacagtgcactgtacggtgcattagacaaggacttcaatggctctttccacaagcaggcaccagccgccaacaactggctgacgtgactgttgtccggtgccatgtcaaaaaaggaattatttgtttagttgatttagttgattttgtattcggtggcattgtagtgcgttgtcgagctatattgttcattattcttgtatgcaagacgtagccgtcgtctataaccagtggccaaaatttggattatttgttttatttttattgatatacgtcgaaacaaatataatgatagaatcttgaaaaccagtacaaaacactcaatcgaacccgtatcccccgcccctagcccgccagcctccgaactgctccccactcgtgggccgtgaccgaagcgggccggaatcccaccgcgtccatcgtcacacgtgacgatccacaagcgatgccaacgtccttcccgtgcttctcctttccacaaggttccgtgttccgaggcgattcctgtatgcgcctctatggctctatccctatgaccctatccacctatgcctgtgcctcgacccgtatataaatgggtctagataaatagatacgtcacgacggcacccgttcccatctcaattgataacgcatctccaatctccaagcgcagacgccggaggaagaaagcttgaagcagccacggcaatggcgtcccggcagttcttcacctacgacccctacgagttcgcgtacgaccagtactacaacctttacgaaccttactacctgcggcagtccgcgcccacccatcgagctagggacatctttgcgggtgccgagccggcggccgcgaaagcgagatccgcgcccagggcaaaggagtcggagacgcagacgtcgttctcaatcccagtcaacgggcctgactcgccggagagggctccctctccggtggcggaagctcgcgcgggaccgatggcgccggcgatgtcggcagaggacgccgcggcgcggatgcaggcagtggtgcgagggttcctcgcgaggaagtcggtgcgggcggtacgccaggtggatcaggaggcggagcaagtcgcgggaaagatggcgtgcgaggcggaggccctgctagcggaccccagggcacgcgtcgccgtctgggaggcgctcatgaggatgctgctgcgtctcgacgcggtgcgcggagcgcgggactaccggaggagggtcaccaagcgggtcgtcgcgctgcaggacgccgtcgacgcgctcgtcgctaagccggcaccggcaaccgtcgagattgctgaggagatcgccatagcgccggagctgccggacgctgaagatgaaaaggaagacgaagaggcagagacacacgaggcggcggccgtcgagatagcagaggagagcaataccaatgttggtgtcgacgagccatgagggttcggagatattggctgaagaaaacgaacacacctcaccggccctgactgcagttgctggcgccgcctccgacgttgtggacgcgaggaagttgatgcagatggtggcgacgctgtgcgagcagagcgcgcagcagtgcgcgttgatcgaagtgctggccgagcgtgtggacatgctggagcgtaccgtgcggcggatgcaagacgccgacagcgccggcggcggccagccaagaagctgagcacggagggcaactgaaggagcaacagcaagctttacagcggttgacgacgaaatctattaatagagatttaaatagttatgtatttttccattgcttttaatctcgagatttattattatagacactagattatttatattcattattttataataaagttcctcgtatttattgttaaaaaaaaaaaaaaaacccgcgtggcccggcccctacacactattttagcgcttaagctgagacgtcgctcagcatttaatttatccttctccaaatcagaattactttatgctaagggtccgtttgtttc

SEQ ID NO: 14935 - DNA, 1818 bp, Zea mays
gcagcacaagcacagcagcagcagcagcagcagcaggcaagaagaatccaaagcggaagggtctctccccccatctctgttccaccaggtgcggcgggcggcgatgggggcgcggaggcggctgcaggcagacgcgccgccggggcatcgccacaggcagggcgcgccggcgccggactcggagcgccgggtacctcaacgggtggctgtcgcagccgacgcccgtcttcggcctccgcctctgggtgctcatcggcatcgccgtcggcgccgccatcgtgctcgtgctcctcctcatcttcgtctgcctctcccgccgccgccgccgccgccgcctcgccgccaacccctactaccccgccgacaccaagctgctcaagaagcacctgcagcagcaggccacgcccacgcccacgcccaccaaggacatccaggagatcgtccgccgccagcaggagcccgcggtgcagctcgccaaggccgtgccgcagccgcagccgcagccgcagactcctccgccgccgccgcctccgcagcacaggccaccggcgcggaagacgcccggcagcggcgtgtcggccacgactagcggcgggagcgagcgggacggcgccacgcctaggagcaccggcagcggcgcggggctgccggaggtctcgcacctcgggtggggccactggttcacgctccgcgagctggaggaggccaccggcgggctcgccgaggagaatgtgatcggcgagggcgggtacgggatcgtgtacaagggcaccttgcacgactccactttggtcgccgtcaagaacctgctcaataatagggggcaggccgagaaggagttcaaggtggaggtggaagcaatcggtcgtgttcggcacaaaaatctcgtcaggttgctcggctactgcgtagagggtgcttacaggatgctcgtgtatgagtatgtggacaatggtaatcttgaccagtggcttcatggtgatgttggcgaagtgagcccactgacatgggacatcaggatgaacattatgcttgccacagctaaagggctggcctacctccacgaggggctggaaccgaaggtggtccaccgcgacatcaaggctagcaacatccttcttgaccagcagtggaacgccaaagtatcggatttcgggctcgcaaagctgttgtgctcggagagaagctacgttacgacccgtgtcatgggaaccttcggttacgtggcgcctgagtacgccagcaccggcatgctgaacgagaggagcgatgtgtatagcttcggcgtgctgataatggagatcatcaccggcagatgtcctgtggattacacaagggcggctggagaggtgcagctggtggagtggctcaagaacatggtggccgagaggaaagcggaggaggtagtggacagtaagatggccgagaggcctcctcccaagacgctgaagcgggcgctcctggtggcgctccgctgcgtggaccctgacgcgaacaagcggcctaagatggggcatgtgatccacatgctcgaaatggacgatctccagttccgagacgataagaggcccggggccgggagagatggtcgtcgtccccagggtccggataggtacagctccaagctaggtggaggaagggagcctcagcaagcgcgagcaccagcgtcggtacagatgagatgattgtcattagagagtagcgatattaaccatgttatttttttcccgtcagtaaatacattctttcccgaaaaaaaaaaaaaaaaatcaatggtcttcgattgtattatatatgtggagcaaccatcattctgtg

SEQ ID NO: 14936 - DNA, 1906 bp, Zea mays
atcgaagccgcagcagcaggaggaggcaggggaatcccaagcggaagggtctcctcgctctcctatctcccttccatcagctgcggcgggcggcgatgggggcgcggaggaggctgctggcggacacgccgccgccgccggagcatcgccacaggcagggcgcgccggcgtcggactggagcgaggggtacctcaacgggtggctgtcgcagccgacgccgatcttcggcctccgcctctgggttctcgtcggcatcgccgtcggcgccgccatcgtgctcgtgctcctcctcatcttcgtctgcctctcccaccgccgccgccgccgcggcggcgacctgctcgccgccaacctctaccccgccgccgacaccaagctgctcaagcagcacctccagcaccaggccacgcccaccaaggacatccaggagattgtccgccgccagcaggcggagacgccgcctccgccggcggtgcagctcgccaaggccgtggcggagccgaagacgcctcctccgccgccgccgcagcagcacaggcagccggcgcggaagacgcccggcagcggcgccacgaccagcggcgggagcgaacgggacggggccacgcctaggagcacgggaagcgcggggatgcccgaggtttcgcatctcgggtggggccactggttcacgctccgtgagctggaggaggccaccgacggcctcaccgaggagaatgtcatcggggagggtggctacgggatcgtgtacaagggcaccctgcacgactccactttgatcgccgtcaagaacctcctcaataataggggccaggccgagaaggagttcaaggtggaggtcgaagcaattggtcgtgttcggcacaaaaatctcgtcaggttgcttggctactgcgtagaaggtgcttacaggatgcttgtgtacgagtatgtggacaatggtaatcttgaccagtggcttcatggtgatgttggagaagtaagcccactaacatgggacgtcaggatgaacattatgcttggaaccgccaaagggttggcttatcttcacgaggggctggaaccgaaggttgttcaccgtgacatcaaagctagcaacattcttcttgaccagcagtggaacgctagagtatcagattttgggcttgcaaagctattgtggtcagagaaaagctatgttacaacccgtgttatgggaacctttggttacgtggcgcctgaatatgccagcaccggaatgctgaacgagaggagtgatgtatatagctttggcgtactcataatggagatcatcactggtagatctcctgtagactacacaagagcagctggagaggtcaacttggttgagtggctcaagaccatggttgccgagaggaaagcggaggaagttctggacccaaagatggctgaaaagccttctcccaaaacgctgaaacgggcgctcctggtcgcgcttcgctgtgtcgaccctgatgcgaacaagaggcctaaaatggggcatgtgattcacatgctcgagatggacgatctcctcttccgagatgataagaagcccgggagagacgttcatccccatggttcagacagatacagctccaaggaggaagggagcatcagcaagcgcgaacaccaccaccaccaccaccatcggcacagatgatacacagcaagcgcgagcatctgaggattgccattagagagtagcgacattaaccatgttccccgcttctttcccctcccgttcaatctcactggtctttgattgtattatatgtgagcatccatcattctgtgacgatacttgatacttcaatcgcacacacagacacacaatgacacgcaagtgtagggggaaaaaataggcatggtgtttgtgactgactaacatgcccagaccaggcc

SEQ ID NO: 14937 - DNA, 778 bp, Zea mays
tggcgcctgaatatgccagcccggaatgctgaacgagaggagtgatgtatatagctttggcgtactcataatggagatcatcactggtagatctcctgtagactacacaagagcagctggagaggtcaacttggttgagtggctcaagaccatggttgccgagaggaaagcggaggaagtagtcgacccaaagatggctgaaaagccttctcccaaaacgctgaagcgggcgctcctggtcgcgcttcgctgcgtcgaccctgatgcgaacaagaggcctaaaatggggcatgtgattcacatgctcgagatggacgatctcctcttccgagatgataagaagcccgggagagacgttcatccccatggttcagacagatacagctccaaggaggaagggagcatcagcaagcgcgagcaccaccaccaccatcggcacagatgatacacacagcaagcgcgagcatatgaggattgccattagagagtagcgacattaaccatgttccccccttctttcccctcccgttcaatctcactggtctttgattgtattatatgtgagcatccatcattctgtgacgatacttgatacttgaatcgcacacacagacacaatgacacgcgagtgtaggggaaaagataggcatgatgttgtgactgactaacatgcccaggccaggccaaaaccctgcagattttcaatgcaaggaatccagcaaacgcgagtatagtacggggtttttttctcgggggcactctagagcgaaaaaaaaaa

SEQ ID NO: 14938 - DNA, 1449 bp, Zea mays
ggccggggccttgactctctatttatcccccgatcgccaagaacaactccactccgctcccccattgttttctcacctcccgtggcagcagccggccaacacccgcaccgcagtccacagcaagaaccaagccacagcgaagaaaagatccaatggtgatggcgccggcggcggcgcagcagcagcggcgccgcgacgcggaggcggagctgaacctgcccccgggcttccggttccacccgacggacgaggagctggtggcgcactacctctgcgcgcgcgccgcgggtcgccgccccccggtgtccatcatcgccgaggtcgacctctaccgcttcgacccctgggacctgcccgagcgcgccctcttcggccgccgcgagtggtacttcttcacgccgcgggaccgcaagtaccccaatggctcccgccccaaccgcgccgccgggtcggggtactggaaggccacgggagcggacaagcccgtggagcacggtggcaggacggtcggcgtcaagaaggcgctcgtgttctaccacggcaagccgccgcgcggggtcaagacggagtggatcatgcacgagtaccgcctcgccgacgccggcgcccgcgcccgcgccaggaagcccggcaccggcacgctcaggttggatgactgggtgctctgccggctgtacaacaagaagaacgagtgggagaagacgcagcagcagcaggagaagaagcagaatcagaagcaaatggagtcggaggcctcgctctcgcactcccactcagacacgcggacgccggagtcggagatcgacgacgacccgttcccggagctggcctcgctgccggcactcgacgacatgatgggcccagcagcagcagcgcctgccggcgccatcttgcccaaggaggaggtggaagacttgggcggcctcggcggcgacgactggctcgcgggcatcaacctcgacgacctgcagatcccgggcgaggccgacttttatggctccatgctcgtgtcgccgatggccgccaagatggagcaggacgccgccggcttcccgttcttctgagaccttctgcgcaacgcaaactgtgtatagttcagatttcttcaggattcggagaaaaaaacagttctgctgatatctggttgtagtggtttagtgcacaagcagcagtatgccggtcagttaagattgaagtccattgtagttcatcaccacttgagctgtgactgtgataagtgacagcattctttcatttctggtctgctaattcttcaatggtcagaatatagtttgtggccttcccagagtggtcacaccactgtggagccttgagatggagtaaattttttcttcaaggtttacggtttacctctttaaaatatcttagtactgtttctatttggtggttcaaaaaaaaaaaaaaaaaaaaaaaaaaaaaaaagtccac

SEQ ID NO: 14939 - DNA, 4270 bp, Zea mays
  misc_feature (2419)..(2419): n is a, c, g, or t
acagcatggttctcatttatctctcggtcagctttcgtcgacatcagcatccaccatagcggccgaccgccacacccaaccatcgcggcccctgccccttccccgttcgtccccttcccctggccgccgccgcccccaatcccacctcctcgcgctcgcccccctccctttgaccccacccgctcccgagaagcttcgtcgccttgactctctatttatcccccgatcgccaagaacaactccactccgctcccccatttttttctcacctcccgtggcagcagccggccaacacccgcaccgcagtccacagcaagaaccaagccacagcgaagaaaagatccaatggtgatggcgccggcggcggcgcagcagcagcggcgccgcgacgcggaggcggagctgaacctgcccccgggcttccggttccacccgacggacgaggagctggtggcgcactacctctgcgcgcgcgccgcgggtcgccgccccccggtgtccatcatcgccgaggtcgacctctaccgcttcgacccctgggacctgcccgagcgcgccctcttcggccgccgcgagtggtacttcttcacgccgcgggaccgcaagtaccccaatggctcccgccccaaccgcgccgccgggtcggggtactggaaggccacgggagcggacaagcccgtggagcacggtggcaggacggtcggcgtcaagaaggcgctcgtgttctaccacggcaagccgccgcgcggggtcaagacggagtggatcatgcacgagtaccgcctcgccgacgccggcgcccgcgcccgcgccaggaagcccggcaccggcacgctcagggtaagcggcgagcacctcgcagtctcgcgccgaattttcttccttggtttcatctcctcgttataaggaatcaccaccggccaccgggatgctgacgcgctgttcgatcgactctcctgcagttggatgactgggtgctctgccggctgtacaacaagaagaacgagtgggagaagacgcagcagcagcaggagaagaagcagaatcagaagcaaatggagtcggaggcctcgctctcgcactcccactcagacacgcggacgccggagtcggagatcgacgacgacccgttcccggagctggcctcgctgccggcactcgacgacatgatgggcccagcagcagcagcgcctgccggcgccatcttgcccaaggaggaggtggaagacttgggcggcctcggcggcgacgactggctcgcgggcatcaacctcgacgacctgcagatcccgggcgaggccgacttttatggctccatgctcgtgtcgccgatggccgccaagatggagcaggacgccgccggcttcccgttcttctgagaccttctgcgcaacgcaaactgtgtatagttcagatttcttcaggattcggagaaaaaaacagttctgctgatatctggttgtagtggtttagtgcacaagcagcagtatgccggtcagttaagattgaagtccattgtagttcatcaccacttgagctgtgactgtgataagtgacagcattctttcatttctggtctgctaattcttcaatggtcagaatatagtttgtggccttcccagagtggtcacaccactgtggagccttgagatggaaaaaaaaaaaaaaaaaaggtttacggtttacctctttaaaatatcttagtactgtttctatttggtggttcagatggctacttcctcagttttaaattgacgttttttttatttttagatatcatgtttgattttgttttattcagtttttttaaataataaaacaagcaactcagtatatcagtctctgaagaatcttcgtttagtcatcgcaaggcatctttcagataagtataaagaagaccgcggcatttagatattccttagccttgatggacaaactatgtcagtagcattgtgtatctatcaagtttttctcaccctattcgctttaactctacctgtttctacattattttgtttctataaattacagttacaacattacaaacaactgacttaatccaaagcgaacaatccgacgtagactactcgtgcaaacagttaaaagatttgttactaaagcttcacgctaaaattatggacgatgagacaacaataataaattgaaggactgtaagtacttagtctgcatcgtttaatagtttgtagtagattttagtgatcagaagctgaaataagcagggtctatgtcttatgtgcgtgtatgtatggatagtaactgttgatcactaccttgcacgtccgcgttgcggctgccctcagatggatagacattcacttgtgcttttgttaaatattgtattaaaatgcctatacttaaaattagatatcaaagtcaggatggccgagtggtctaaggngccagactcaagttctggtcctctaacaagggcgtgggttcaaatcccacttctgacatttttttctttttaaacttgtcttttttattttttttgtttttacttttcaaattactctttcctattctcttccccctttttaaattcttccattttcatattttcttttttaaaatcgtttttgggtccatcccatgtttatgtgggtccattttaaaaaaaatttctttccttttttctttttagaatcctttctgggtctatatggctacttaagtcatctcatgtttctatttaaacaagattcattgtctacttaaacaagattcacttgggatgggatagtatatatggctacttaagtcatatcatgcttctatttcacagtgagatcgtgcttctgttttttttaaaaagatagtatgcacactttatcaacgataacgtagaaacatttactgcttaattttaaaatcatagatattttttacaaaagaatcgtttctgggtcccatgtttcatgtttccattttacactgagaccgccacacagattaaaaaagacaatggacgatagcattgaaacttttactgctcgaactaattaacgatgttttcattgctttagcaatcatacacaaagagagaacctgctgctaagtgtttaacgctgagattgtacaagttccctaaaactatctccactagcttacctatcttcatccccatattgaaactttattctgcgaacagtgctgtctacagactacagtgtaaaacaatgttttgtgtaaccatataggtaatttgctggatggcctaaggccatgttcgtttcatccataaaccatggggattgagaaagattgaaatggattgagcaggattttagcgtgtagaggatttaatcccctcaatccctatagatttatagaaaacaaacataccttaaggcctgttcgcttagaggtgcatcatagaggatcgaagggtattgttgaacacacttttgggtagtcggaccgtccgcggtctggacggtccacgcatgcgcagattcaattacggttcctcgtttcttgcgggattagttcgggaaccgaccatgtattgggttcagatctcccccattatatagatgaaggggtacgaccgattgaacccccacaattgatccaatcaattctatttatcatttttaccttatgcattaggagtggccctagtttagccttggatagctggaggaagcaagttgtgacattaggttgtttgatggtcgactaaaagtgtatgatccagattacaacctattgatcagtgcaccttgtactggcaacaaactctgtatggtgaaactgggagtggtgtcacctgtgagtttgctaacaaagactaatgatgttgcttgaatgtggcactcaaggtctggaaatctaaatttcaaagctcttcgagacttgggagtaaaaagatggtacaagggatgccaaagtggatcgggttgaacatgtatgtgatgtatgtaccctaggaaaacaacttcttacactgtttcctaagtcttcatcttatagagccaaaaaggctttagaattgtttcatgctgatctatgtggtcagatcataccatccccgccggctgcgagggctcccttcttgttggtactggatgattttagcagatacatgtggtttgaactgttgaaatccaaatatgagactttgtacttcctaaaaaaacatacagagagctgaggttgaatgtgagggcaggttgaaggccgtgagaacagacagaggaggtgagtactactctagatatgttcactcgcattttgtgtagaacaa

SEQ ID NO: 14940 - DNA, 1433 bp, Zea mays
ctgtgcggcgcgcgcgccggcccaagaccaagaccaacaccactccactccctccatttccctcacctcccgcagcagctagccgccagccaacaaccgaaccaaccaaccaacccacaggccacagcgagcgagtaaagcgtccaatggtagcgatggcggccgtgcagcagcagcagcagcagcagcgccgcgacgcggaggcggagctcaacctgcccccgggcttccggttccacccgacggacgaggagctggtggcgcactacctctgcgcgcgcgccgcggggcgccgcccgccggtgtccatcatcgccgaggtcgacctgtaccgcttcgacccctgggacctgccggagcgcgccctcttcgggcgccgcgagtggtacttcttcacgccgcgggaccgcaagtaccccaacggctcccgccccaaccgcgccgccgggtcgggctactggaaggccacgggcgcggacaagcccgtggagcacgagggccggacggcggggatcaagaaggcgctcgtgttctaccacggcaagccgccgcgcggggtcaagacggagtggatcatgcacgagtaccgcctcgccgaagccggcggcgcccgcgccaagaagtccggcgccggcacgctcaggctggatgactgggtgctgtgccgcctgtacaacaagaagaacgagtgggagaagatgcagcagcagaaggagaaggagaagaaggcgatggagtcggaggcgtcgctctcgcactcccactccgacacgcggacgccggaatcggagatcgacgacgacccgttcccggagctgggctctctaccggcgttcgacgacatgggcgcagccccagcccctgccggcgtcgtcctgcccaaggaggaggtggaggacttcggcgacctcggcggcgacgactggctcgcgggcatcaacctcgacgacctgcagatgccgggggacgccgccgatttctacggctccatgctcgtctcgccgatggccgccaagatggagccggacggcggcttccccttcttctgagatccttcggcgactccggggacgaccggatgcagcgcaacgcaaactgtgtatagttcagattttcttcatggaaccaacaacaacaaaaaaagttcttgctaatatcttgttctagtggtgtagtgcagaagtagcagcaacatgattgaagttccattgtagtactgatgttcatcgccacttgagctgtgacaagtgacggcattctttcgtttcttggctgcaaattcttcgttgtccagaatataatttcagatgggtaatgccaattcgggacgtgttgaaaacataaaaaaaaaaaaaaatacaatagcttgttgtgctaaaaaaaaaaaaaaaaaaaaaaaaaaaaaaaaaaaaaaaaaaaaaaaaaaaaaaaag

SEQ ID NO: 14941 - DNA, 1380 bp, Zea mays
aacaccactccactccctccatttccctcacctcccgcagcagctagccgccagccaacaaccgaaccaaccaaccaacccacaggccacagcgagcgagtaaagcgtccaatggtagcgatggcggccgtgcagcagcagcagcagcagcagcgccgcgacgcggaggcggagctcaacctgcccccgggcttccggttccacccgacggacgaggagctggtggcgcactacctctgcgcgcgcgccgcggggcgccgcccgccggtgtccatcatcgccgaggtcgacctgtaccgcttcgacccctgggacctgccggagcgcgccctcttcggccgccgcgagtggtacttcttcacgccgcgggaccgcaagtaccccaacggctcccgccccaaccgcgccgccgggtcgggctactggaaggccacgggcgcggacaagcccgtggagcacgggggccggacggcggggatcaagaaggcgctcgtgttctaccacggcaagccgccgcgcggggtcaagacggagtggatcatgcacgagtaccgcctcgccggcgacgcgaagaagtccggcgccggcacgctcaggctggatgactgggtgctgtgccgcctgtacaacaagaagaacgagtgggagaagatgcagcagcagaaggagaaggagaagaaggcgatggagtcggaggcgtcgctctcgctctcgcactcccactccgacacgcggacgccggagtcggagatcgacgacgacccgttcccggagctgggctctctgccggcgttcgacgacatgggcccaggcgcagccccagcccctgccggcgtcgtcctgcccaaggaggaggtggaggacttcggcgacctcggcggcgacgactggctcgcgggcatcaacctcgacgacctgcagatgccgggggacgccgccgatttctacggctccatgctcgtctcgccgatggccgccaagatggagccggacggcggcttccccttcttctgagatccttcggcgactccggggaccggatgcagcgcaacgcaaactgtgtatagttcagattttcttcatggaaccaacaacaacaaaaaaaagttctgctaatatcttgttctagtggtgtagtggtgtagtgcagaagtagcagcaggcatgattgaagttccattgtagtgctgatgttcatcgccacttgatctgtgacaagtgacggcattctttcgtttcttggctgcaaattcttcgttgttcagaatataatttcagatgggtaatgccaattcgggccgtctttagcggtttatgtttggagccttaaaaaaaaaaaaaaaaaaaaaaaaaaaaaaaaaaaaaaaacccccccccccc

SEQ ID NO: 14942 - DNA, 1382 bp, Zea mays
cccacgcgtccgcccaaagaccaagaccaacaccactccactccctccatttccctcacctcccgcagcagctagccgccgccagccaacaaccgaaccaaccaaccaacccacagcgagcgaggaaagcgtccaatggtagcgatggcggccgtgcagcagcagcgccgcgacgcggaggcggagctcaacctgcccccgggcttccggttccacccgacggacgaggagctggtggcgcactacctctgcgcgcgcgccgcggggcgccgcccgccggtgtccatcatcgccgaggtcgacctgtaccgcttcgacccgtgggacctgccggagcgcgccctcttcgggcgccgcgagtggtacttcttcacgccgcgggaccgcaagtaccccaacggctcccgccccaaccgcgccgccgggtcgggctactggaaggccacgggcgcggacaagcccgtggagcacgggggccggacggcggggatcaagaaggcgctcgtgttctaccacggcaagccgccgcgcggggtcaagacggagtggatcatgcacgagtaccgcctcgccgaagccggcggcgcccgcgccaagaagtccggcgccggcacgctcaggctggatgactgggtgctgtgccgcctgtacaacaagaagaacgagtgggagaagatgcagcagcagaaggagaaggagaaggagaagaaggcgatggagtcggaggcgtcgctctcgcactcccactccgacacgcggacgccggagtcggagatcgacgacgacacgttcccggagctgggctccctgccggcgttcgacgacatgggcccagccccagcagcagcagccactgccggcgtcgtcctgcccaaggaggaggtggaggacttcggcgacctcggcggcgacgactggctcgcgggcatcaacctcgacgacctgcagatgccgggggacgccgccgatttctacggctccatgctcgtctcgccgatggccgccaagatggagccggacggcggcttccccttcttctgagatccttcggcgactccggggacgaccggatgcagcgcaacgcaaactgtgtatagttcagattttcttcatggaaccaacaacaacaacaaaaaaagttctgctaatatcttgttctagtggtgtagtgcagaagtagcagcaggcatgattgaagttccattgtagtactgatgttcatcgccacttgatctgtgacaagtgacggcattctttcgtttcttggctgcaaattcttcgttgttcagaatataatttcagatgggtaatgccaattcgggaaaaaaaatagcggtttatgtttggagccttaaaaaaaaaaaaaaaaaaaaaaaaaaaaa

SEQ ID NO: 14943 - DNA, 2135 bp, Zea mays
  misc_feature (2106)..(2109): n is a, c, g, or t
  misc_feature (2128)..(2128): n is a, c, g, or t
  misc_feature (2131)..(2133): n is a, c, g, or t
ctgcagttatctggtgattctatcatataattatttcagttactttgaatgtgagttgattgcaatgttccagttttgtcagaatagctagatatatattctatctgtatcattgaacaaaatgagcgtccttggtcatacctttctgagactcaaaagtgtagctttttaggctcttattggattagaggtttctcatgcaattttttatttatgtttcttcttacattccttcatctctggaattcagtactcccttcttaactgtattatcaaacttgttattgcagtgggttgaagaaccgacacttctggtcactcgtttcgaatatgcgaaccttttccacacaattacggactggtacagtgcatatgttagttccagagtcacgaatttaccaaaccgtcctaatgttgtattcttggatggccattgcaaggtatgtgatgcgctgtgtattttgttactggttcacttcattctgtttgttgcttgagttatgagcaacaagtctgtttcttcagctatttactggggtaaacaacaggcggtcacatttttgtatgcttgatcttttgtttgtatcgtgcaatgataccccagcatggtgatcttcctgttttttcctcatttattctgccatattttcctcatctttggagaacaattgcattcagaagcagttcttgattgtaacccgatctgtcagtttctttgttctacatttgagtcaaatagcgccccctgttatatttttggcagctagccttgatgcttcatccattttttttgttttttttgcattgtacccatccttgaatgtatgcctggcttccagattatatttttcctccattatgccattttatttcagatttagcatgacttaatatgatattctattgctaggtagcagccaacttatttatttatacaatgatttgtgtttcttttccctctcttgaatattcttgtcaagtgacagatgtgatctgatttccacaggcacaattagaggaaacatgggaagcacttttctcaagtgtgacatatgctaagaacttcactgttcctgtttgtttccgacatgccattctttcaccattgggctatgagactgccatgtttaagggtcttagcgagagcttcagctgtgaaggtgcctccgtagattcactccgagaaaaaccagactatgaaaaaactgcacggttatctgaattcggggaaatgattgtagcttcttttgatcttctgcaggatgacatcatgtcatccaaaaaatcgaatggactcaatgttctctttgttcgacgagaagactacctggcccacccgcgccacagtggtaaggttgaatcgagactaagcaatgagcaggaggtgtatgatgctattgacaagtgggcacaaggcctgaaatgcaaagtgaatgtcgtgaacggtctttttgcccacatgaccatgaaggagcaactccgtgctatcctggaagcttcagtggtaataggggctcatggggctggtctaacacacttggtttcagcaactcctgatacaaaggttcttgagattatcagcagcatgtaccggcgcccacattttgcacttatctcacactggaagtctttagagtaccatgccataaatctccctggatcatttgcaagggtcacagatgtcatcaacgagttgagaaaaatactggaaggtctcggatgctgaaacagaaatactcttcaaggccaccacaggccatgtagaatggacatcgtgtctacttcatcacccatacttggtcacaccagttgcaaggggtcatatggattttaattcgaagacattttcacaggctattcaacattgtgccaagaaaccaatcattctcattttccagcaaagaattttattatgctgccaaatacagaaagtcaagaaagcaatcctctgtttggtttatgtcagcaaatgataacacgtaatccagagctttaggttgtccacccttattcttggacatgattttaggaccagaattttgacaaaactgtattctttgttggattatagattagtataccttttgtgtgttacatgttgatcannnnaaaaaaaaaaaaaaaaaanaannnaa

SEQ ID NO: 14944 - DNA, 2559 bp, Zea mays
  misc_feature (668)..(668): n is a, c, g, or t
cgcgtaacatgcttgtccggatcaagatgctgctgtcatggaaggtgatgctttgtacccgtaatgccagccatgccagccacacgaaacatccaggtgttagatgtcgcgggcggtagctgcatgtgctctttcaatctgttctattatattctagaacagtgtgttgccccgtttgcaccctgtttgcattgtgatttgcagttcatcagtacttgtctaaacttctcgctttgattcctggaaattccgtttttttttctttggcggatctggtcctggaagctgggaatctgaatagtgaacgagaagaatgctctggacggggggattttttttttttcttctgtattgctgtcacgtcgtttgttataggataggaaaacgatgcacaccagtgcaggacatgatgatgtgctgttcctaactgttaccgggaagaagaagagagagagaaaaagagcgttggagaaaagatcgccacccgacgttgtacgctaatactcaagtgctacccgagatgttacgacacgtcctgtgtgcagctgccttgcctagtgcccactacacgcgctcgtccgtccgggcagcaggcagcaggcgccggtcaccggagcgcgacagcggcgaggcaggtgagcacgacgacggcgctggcagcggagcangcacaggtccacgagcgcctcgcggcgcgccttgctctccttcctccccttcttgcgcttcacgaagtcgaggtaccgcctccgggcctcctccggctcccgcgcccctcccttccggggggcctccatcgccgcggcgaggagccgcagcgtgccctcgccgctgacggcggcgccgtcggcgtcctccacggccaggctgacctcgctgacgtgcccatccgccccctcggagcaggcgacggtggcctcgaacttgcaccctcccagcaccacggcgaaccgcgccagcgtctcgcccgtgtaccagtgccgggccaccgccacggggcgccggctggagacgttgaccgcgcggccgcgggccgggtccacgaccacccagctcagctcgagctccgccggcgagggcaccgcggcggcggaggccggcctcttccgctccacggcctccacgcggaacggcgagccgaggaaccacggcgaggacgcgggcgtctccaccacgcgggacagcaggggcgcgcccctgtagtagacgtccaccgcggagaccagctccccggcggggacggggtcggggtcgggacctccggctcccccggtgtccgcggacgggaacgggtgcgcgtcggcgaagagccgctgcggcgggaccgccgcgagcagccggcgctgcgccgccagcgccagcgccagcgacggccactcggcgacgcagagcgcgcgccacgtctccgggtccgtggccagcgcccggagcgcgaccgtggcgcagctggccgccgcaagcgaccgcccgtccagccgccgcagcgcgcagcccagcacgtcgccgtggaggtcctcgatcgtagtagtcaccatctcccactagtgagcctgtctgcctctcttctcttctgcttggattggagtaaactctggcgtgttttatatatataagcagaggcaactgcactgtggtagtagactccggtcaaagctctgccctgcccatcgtgttgttgttgcctcaattactgcttctggcgcctttgtttccgcaaggcgtcttcccgcgaaaacgacggggcccagccagccatagcagtgtgatagtatttgattccattttctctgcgcaattcatgccgtgtcagttcagttcagtggctcagtgcaaacgctgccgtggcgtcgacgggaaccagttggtgggggcgtgccgcgggacggcccgccttgctgtcccatagcgtggcaccacggctgcgcggccgtgcggtctgcggagccggggggacgcgtggtggtggccggggcgatcacgcgcgccctgcacacgttctgcttgccgcgcgttcctcctgccgttcagtcccctcctctctctcacgcgtcctgtgcaggaacaggacggctgtggggggcgccgggcgcgtccgcgtcgtggcgggcgtgcgacgcgggttttccaccgtgcggagggcatttcccgcactttttgcacgcgcgcctgtgccagggtccccggcggaagaggagcagagccccactgccactggtgtggtggtgcggtgcagatgacgctctcctgttggattcactgatttttcatttgtcctcgaaggcatgtgtctcgatgtaataaagagtgttagcctggtcctctaaatttcatactctaaacgaatattctttgtactttacagcactcactaaacgattctattctctatattttcttcatctccggcaacgtcccctaaatttggttatctatatctacagtgttaccagatttcaataatctacattattttttcacctatcaaaaaactgtatgtcatgaatttaaaatactttttacaacatattttcatttaatgtagaaattactcctcgatcc

SEQ ID NO: 14945 - DNA, 3282 bp, Zea mays
ttaccgaaccctggattctcaaattacaagataatcaattaaaagaaaataatgtttagacaaatgggcgcacaaaagagtgcatgagagaatcataacagatttctctattcagttcctatcagatgagcccacctcaaaatttccaagagcaagcatgttgtcaccatctggagatctcggacgcttcagggtattcttttgtatcaagaactcctcacagttctaatcagcaaaaacagaaaaaatcgaatgggatcagtgccagcataatcgataaagtagaggtggaattaattgactaatttgtggtcagttacactagcaaaccacgtgcacatgtttataataacaaaagaaatagcacaaatagttctggccagaaagagatcatagcaacatagccaatgtgtgagcaaggaaatcgaagatgcaagcaatcacgctactggacttaagccaaaaaagaagcgtggaaataagaggagaagctcaaggtttaagactgacatcgtcatcggaagaggaagtctcaggcagctcctcctggtccatgaacgatatgacgggggcagacatgggatggtgcggcggtgacgatggcgcggagacagccttgccggccatccgtgcctcgagcttggcgagcttcgacgaagacgggttggaattggacgataggtgctgcactatgtcctcccctgcggccgacgagcccgacattactaccgattgcaaccgaaccggatcgcgcgctacgaagccttcagaacaaggaaccaaaaccacgcgagccaggcacttcctctactcctccctgcagcacggcgtgcatctacacgagccggcggggcggcgggcggatctatctccaaaccctagccgtacgtgcaacagggcgacggcaaactagcggacgcagcagcgggaacgggaatgctccgggcggtcggtgcccgggcgaataggaactgctcccctcctccccctctgctacctgttgactcgccggtctccgctgctgagtacggcggtggaggcaactggagctcactcgcggagggtatgcgaaggcggagcgtgccgcttgcctagttcgccacgcctggaactggaagtctggacggaggcgcggcggtcacccacctctctcgctcttcttcagtcccttcccactcgttcccctcccctgcgagcgattccattgccactccgctttattattgctctttccgtcaggctcactgggcctttgggccaacgaggcccatgtggtaactccacaaatgctcatttcgctaaaaccattggttcgtcgtatcgaaggagtggaccagcggagtgtttgcccaattgccccgcgccgccgcccccgcagcagagtagcagaccagcggtggatgtgatggccgcgagcggtatggaggatgagagagtgagcggggaggtcagggagcaggaagacgacgacgacaacgtgcctcaactcagcgctgcggcgatggaggcgctccgggagtttctggcggaacagcatcgtccggaggagcagaatgaagctggaggaggggaagacggggtagagctggtcccggaggactggcggttgagccagttctggtatgatgagcgtaccgcgcgggagctcgtggaggaggtcgtccgccttgtctccccttctggatcaggctccgccgccggtgccgtggcctgcatcgcatgcccgacgctctacgcctacctgaagaagacggaccccggagtgcccgcgcagctgctggagtacgacgagcggttcgggcagtacggcggcgacttcaccttctacgactacaaccgaccggaggagctgccggcggcgatgaagcacgcctaccgagtcatcgttgccgaccctccctatctggtactgtttctaccctaccagagattgcctattaaaaagtgtttgatcagttcttaacatttgagatgagaggaaatatcgaggagaaatggctattattcgttggttgatgatgcagagtaaggagtgcttggaaaaggttgccaaaacagtatctttcctcgcacggcctgaaggttcattcctgctgctgctcacaggtaattgtagctcatggcaatgctctgtggagtgaaagcgattaatttgattttactttggtattttgattttgttctgcaatcaataagctatagtttggaattcctatatgatagcttcacgtttataatctagccaagagtattgataatgacttcaactttttcgagcatggttagtttaatattgctttggcaatttagcaatagtgcaaaactcctagatgatagtttcgccttataatctagctaagggtgctgatgatgacttcaagtttaatgttgtgtcaagtgaacgtgattagtttgatattgctttggtattttaatgttgtttatgcaatcaataaacattcttgttgaactcctatattgtagtttcaccttatgatgccttagacttcattgtgccttcttacttttgacagaatgatccattaattaatgtcttaatagtgcaggagttacacatttacgatggcatcatctgcttctacatgtatgcaactgtatataatgtagctaaaaccatttacgatgtgctgacagttccaaattgtactgttgttccttatcaaagtctgtttgttttcctttcaagaaaaaaggtctctccatctcatactgaaagcatagttaaaccctgtatttgtcaagcgaaaacttagttggagtcactctatgttgccaggggaagttcagatggaccgggcgttggagctgctgaatgttcgtccctgcggtttcaggcctcgccactcgaacaaactgggcaacgagttccggctgttcacgaattatgatcctgctgacagacttggtggttgggagcaaagtgatggtgcccccatttaactataaactaatacaatttttgttctagagttgttccatctttatgaacatgctgcatctttgatccacagctcactgatccctccaatttaaattgtagtgacaattacttgaggaatctgtgtgctatgatgtatggtcaatcaaacatttacattgttagtgtacctcatttttccgtgatcatgtttcggaggactataggtgttgtttggttcacatatttgtaatggataataaataacgttaaatcatgtttgtttaaaaaaaaaaaaaaaatccaaccgtaatcgtatgacatactagaaattgataccggcc

SEQ ID NO: 14946 - DNA, 1754 bp, Zea mays
gcacgagaccattacctagaacatcctaatcgaaaaaccgattgcaaccgaaccggatcgcgcgctacgaagccttcagaacaaggaaccaaaaccacgcgagccaggcacttcctctactcctccctgcagcacggcgtgcatctacacgagccggcggggcggcgggcggatctatctccaaaccctagccgtacgtgcaacagggcgacggcaaactagcggacgcagcagcgggaacgggaatgctccgggcggtcggtgcccgggcgaataggaactgctcccctcctccccctctgctacctgttgactcgccggtctccgctgctgagtacggcggtggaggcaactggagctcactcgcggagggtatgcgaaggcggagcgtgccgcttgcctagttcgccacgcctggaactggaagtctggacggaggcgcggcggtcacccacctctctcgctcttcttcagtcccttcccactcgttcccctcccctgcgagcgattccattgccactccgctttattattgctctttccgtcaggctcactgggcctttgggccaacgaggcccatgtggtaactccacaaatgctcatttcgctaaaaccattggttcgtcgtatcgaaggagtggaccagcggagtgtttgcccaattgccccgcgccgccgcccccgcagcagagtagcagaccagcggtggatgtgatggccgcgagcggtatggaggatgagagagtgagcggggaggtcagggagcaggaagacgacgacgacaacgtgcctcaactcagcgctgcggcgatggaggcgctccgggagtttctggcggaacagcatcgtccggaggagcagaatgaagctggaggaggggaagacggggtagagctggtcccggaggactggcggttgagccagttctggtatgatgagcgtaccgcgcgggagctcgtggaggaggtcgtccgccttgtctccccttctggatcaggctccgccgccggtgccgtggcctgcatcgcatgcccgacgctctacgcctacctgaagaagacggaccccggagtgcccgcgcagctgctggagtacgacgagcggttcgggcagtacggcggcgacttcaccttctacgactacaaccgaccggaggagctgccggcggcgatgaagcacgcctaccgagtcatcgttgccgaccctccctatctgagtaaggagtgcttggaaaaggttgccaaaacagtatctttcctcgcacggcctgaaggttcattcctgctgctgctcacaggggaagttcagatggaccgggcgttggagctgctgaatgttcgtccctgcggtttcaggcctcgccactcgaacaaactgggcaacgagttccggctgttcacgaattatgatcctgctgacagacttggtggttgggagcaaagtgatggtgcccccatttaactataaactaatacaatttttgttctagagttgttccatctttatgaacatgctgcatctttgatccacagctcactgatccctccaatttaaattgtagtgacaattacttgaggaatctgtgtgctatgatgtatggtcaatcaaacatttacattgttagtgtacctcatttttccgtgatcatgtttcggaggactataggtgttgtttggttcacatatttgtaatggataataaataacgttaaatcatgtttgtttaaatccaaaaaaaaaaaaaaaaaactcact

SEQ ID NO: 14947 - DNA, 3234 bp, Zea mays
gttgacatggttggatagaggatattttgataagaattttaaaacaacaattgtcgaaatatgagtttgaacagaggagttttggattttataatcataggaaaaaaaaaaaaaaaaaaaattcatcttcttcgtcttcatcgcagcatcggcgctccatcttctgctccctcccccacttcgtgctcgggttccatcttccgctccttcccccactcgcggtcggcacgcaggctcggccggcgtcagcggctccccatcccgccagtacaggaagagggccgccgcttggagctcgcgggaggtagcgtcgccgccgccgcatggaggtcccgaatggctgaatcctgaccgctgcctggagagtctcgcgcctaaatcacatcatattgagcttctcgcctttggatccgtcttattatttgctcacactgaagaattagtttgcactttggaggaaaatgagtggtgctccaaagaggttgctcgaggaaggtagtcactccacaccaacaaaacgccctttggatgacagcagcttgtattcgagtcctgggaaatttattcagtccggtggcagtgatttccatggttcttctgaacatgatggtagatttgcgaaatttcaacgtgtggagtctcgtgatgataagaggccatctgtacatcggatgcctgttggctccactaactttgctgttcaccccatctcgtctgacagcagattagagtcaaagcaaaataaagatgcacgggacagtaaggcagatgaccgcgaaacaaaagtcgatgccagggacgttcatagtggattcaaggattgaatttcaggctaataaaattgagagtgatgtaaaggtagacaatagagcagatgaaagtgaaataagggctgacaggaggggccatcctggattacagaccggacataattcggcgcgacgatagtcattctactgttccagccatcataaactggaaggacaacaaggagcacaggggtaaaagacattttgaaccgcccgctgatactgtggattggcgtttgccccgtcctagtttacaaagtatcgatgaagctcccaaaggtccaatttctgtggaaggacgtaattccaaggacgcaaatgaatctgctggtgattacaaagctgaaccaaaaaacgaagataggttcagagacaaggacaggaaaaagaaggacgagaagcatagggacttcggtgcaagagaaggcgatagaaatgatcgtcggaccggtgtaccacttggcagtagtggtgttgagcgaagagaaatgcaaagggaagatagggatgctgagaaatgggacagggaaagaaaagattccctgcgagacaaggaaggcaatgatagggagaaggattctgctaggaaagattcatctgtagtaattgcaaaggataaccctatactagaaaaagcttcatctgatggagctgttaagagtgctgagcatgagaatacgacaacagaatccaaggcacctaaggatgatgtatggaaagctcacgatagggatcctaaggacaagaaaagagagaaggatgtggatgcaggagactggcttgagcaacgaaacaaatataatgataaggaattagatgacaatgccattgaaggagatatggagaaagataaggatgtttttggaagtgtccaacgaaggaggatggtgcgaccaaggggaggtagtcaagtatctcagcgtgaacctcgattccggtccagaatgcgtgatggtgaagggtctcaaggtaagtctgaggtgtctgccattgtttataaagctggggagtgcatgcaggagcttctgaaatcatggaaagagtttgatgtaactcaggatgctacaattgctgaaagcctacaacatggtcctactcttgaaatccgaatacctgcagaatttgttacttccactaaccgtcaggtaaaaggtgctcagctctggggaacagatatttatacaaatgattcagatcttgtggctgtgctaatgcatactggttactgctcccctacatcctcccctccaccatccgccattcaagagcttcgtgcaactgttcgagttctaccaccacaagagagttatacttcaacactgaggaacaatgtgcgttcacgtgcttggggtgctgggattggttgtagctttcggattgaacgttgctgcattttcaagaaaggtggtggcaccattggtcttgagccacgccttagccacgtgtcagctgtggagcctactctcgccccagttgcagttgagcgtacaatgacgacaagagctgcagcttctaatgcattgcggcaacaaagatttgtccgtgaagtgactatacagtacaatctgtgcaatgagccatggttgaaatatagtataaacattgtggcagataagggattgaaaaagtctctttatacttctgctagactgaagaaaggagaagtcatatatttagaaacacacattaataggtatgagctttgcttcagtggagacaagccttgcattattggatcaagctccaatgcatctgaatcagaaacggagaaacaccagagcgggagtcaccattctcagaatggtgacagaggctgtgtggagcatgaactccgggatgtgttccggtggtcccgctgtaagaaggccatgcctgaaagtgccatgcgctccatcggtatcccactaccagcagaccagttagaggtattgcaggataacctcgaatgggaggatgtgcagtggtcacagaccggtgtgtgggtatctgggaaggagtatcccctcgcccgagtgcacttcctctcggcgaactagaagcagatgatgttggagctgtgttcgtggggggaaaaaagaaggtgatgttggagcaacaaaggaactaattttcttgtggacaagacagagttgggaacattgcgttttcttgtacgggtcaccatgccatgtgtacaaaagaaggatcagttggttagtgttgatatggtagccttactgtgttgacaataacactattcgttaggctggcctgctgcccatgcatgtgccaaagctatatttgctggttttaggtcctgtgtcggtacgcaaataacttgcaatatgcttgcttctcaagtaatctggccatccttattggaacactgcttcctctgtccctgaataatagattttaacaagttcaaaacagattgaattgcatt

SEQ ID NO: 14948 - DNA, 2036 bp, Zea mays
cccacgcgtccgggaaaaagaaggatgagaaacatagagactttggttcaagagaaggtgagagaaatgatcgtcggaccggtttcaccttggaggtagtggagttgaccaaaaagaattgcaaagggaagagagggttgctgaaaaatggaacagggaaagaaaagattctttgaaagacaaggaaggcattgatagggaaaaggattctgctaagaaagatccatctatggtaatggaaaaggataacacattagttgaaaaacttttatctgatggacctgttaaaaatgctgaacttgagattccaccaccagaacctaaggtgcttaaggacgatgcatggaaaggtcatgacagggttcctaaagacaggaaaggagagaaggatttggatgcggcacgccggcttgagcaaagaagcaaatataatgacaaggaatcagatgataatggcaccgaaggtgatacagaaaaagataaagatgtttttggaagtgttcaacgcaggaggatggtgcgaccaaggggaggtggtagccaagcatctcaacgtgatccccgatttcgatcccgaacgcgtgatggcgaaggggctcaaggtaaatctgaggtttctgccattctttataaagccggagagtgcatgcaggagcttctgaaatcatggaaagattttgaagcaactcaggaggctacaaatgttgaaagtctacaaaacggtcctactcttgaaattcggatacctgccgaatttgttacttccactaatcgtcaagtaaagggtgctcaactttggggaacagatatatatacaaatgattcagatcttgtggctgtgctaatgcatactggctattgctcgcctacgtcctcccctcccccatctgccatccaagagcttcatgcaactgttcaagttctaccaccacaagagagttatacttcaacattgaggaacaacgtacgctcacgtgcttggggtgctgggattggttgtagcttccgcatagaacgctgctgcatagttaagaaaggtggtggcaccattgatcttgaaccacgccttagtcacacatcagctgtggagcctacacttgctccagttgcggttgagcgcacaatgacgacaagagctgcagcttccaatgcattgcgacaacaaagatttgtccgtgaagtgacaatacagtacaatctctgcaacgagccatggttaaaatatagtataagcattgtggcagacaagggattgaaaaagtcactttatacttctgctagactgaagaaaggagaagtaatatatttggagacacattttaataggtacgagctgtgcttcagtggagagaagcctcggggtattggatcgagctctaatgcatctgatgcagaacctgagaaacaccagagcagtagtcaccattcgcaaaacggctctgtggagcatgaactccgggatgtgttccgatggtcccggtgtaagaaggccatgcctgaaagtgccatgcgctccactggtatcccactaccagcagatcagctcgaggtgttgcaggataacctagaatgggaggacgtgcagtggtcgcagaccggtgtttgggtggctgggaaggagtatcccctcgcccgagttcacttcctctcgtcgaactagcagcagctgatgttgtagccaacgaaggagctatcgtttcttgtggacaggagaggagcttgccaacactgtaggttttttttttgctactgtataatgtatgatgcaccctgtcatgtgtacaaagaaagctcaactgttgtaggctgtttgtgttgtgtggcattctactagtcttcacattaaccatatttgttagggttgcttgctcctgcccatgcctgaaagatatattgttggttttaggtcctgataaaataattggcgatttgtaacttaagattattcaaggtagtaaagaaaccataactctaattgtgcaaaaaaaaaaaaaaaactcggccccccttctgtggccctggcgaccccccgtttt

SEQ ID NO: 14949 - DNA, 862 bp, Zea mays
cgccccgccggccggcccgcccgcttggtttgttcccgtcatattaacgccaggggggggccggccgggccgctgtgaacgccaaacagtgtctcttttccagttccagacctgaagaaactccgaccggccggtgggcggtggcggcagccggcggcaggatctgtgccgcgatggcgacgtcgaacacggcgcggatggaggacggcggcggcgacctgcggagcaccatcaagaagtggaatatcatctaccctgtctacctcaactccaagaagacggtcgccgagggccgccgcatcgccgctgccaaggcctgcccggaccccacctgcatcgagatcgctgactgctgttcgcacctcaagatcccccacgccatcgagttggataaggcgtaccctcgggatttcttccaggtggggagggtcagggtgcagcttaagaaagatgacggctcccccgtcaatcctgctattaaaacgaagaagcagctgatgatccaagtagcagagctagttcccaagcatcacggaaggacaaagaagcaggagccagcgcccaatcccggtggcagttcaaagaacacaaaaggcgggaaaaagaaaaagtgatgcagtatcattgtgttgttttttattctgttcgtcatcatacactaagcttctgtgaaaaagaaaaagtcttggacgttgttgttatgttgccattatgccatttttcatgtataagaacttactaagaatcttccattgactcggtaaaatgcaacataaaaaaatggcttcgctagattaaagggccctttgacaaaaaaaaaaaaaaaaaagcgcccttgtgccctcaaaaaacggacgcgtgg

SEQ ID NO: 14950 - DNA, 821 bp, Zea mays
tttttctatcgatttgttcgcgtcatattaacgccagggagggccttttctctctcctgtgaacgccaaacagtgtctcttttccagttccagacctgaagaaactccgaccggtggcggcaggatctgtgccgcgatggcgacgtcgaacaccgctcggatggaggacggcggcggtgacctgcggagcaccatcaagaagtggaacatcatctaccctgtctacctcaactccaagaagacggtcgccgagggccgccgcatcgccgctgccaaggcctgcccggaccccacctgcatcgagatcgctgactgctgttcgcacctcaagatcccccacgccatcgagttggataaggcgtaccctcgggatttcttccaggtggggagggtcagggtgcagcttaagaaagatgacggctcccccgtcaatcctgctattaaaacaaagaagcagctgatgatccaagtagcagagctagttcccaagcatcacggaaggacaaagaagcaagagccagcgcccaatcccggtggcagttcaaagaacacaaaaggcgggaaaaagaaaaagtgatgcagtatcattgtgttgttgttttttttattattttgttcgtcatcatacactaagcttctgtgaaaatgaaaaagtcttggacgttgttgttatgttgccattatgccatttttcatgtataagaacttactaagaatcttccattgactcggtaaaatgcaacataattttttttggcttcgctagattaaagggccctttgacaaggcttcaccttctctgaataaaaaaaaaaaaaaaa

SEQ ID NO: 14951 - DNA, 878 bp, Zea mays
  misc_feature (1)..(1): n is a, c, g, or t
  misc_feature (7)..(7): n is a, c, g, or t
naaaaantttccaaaaagcgaaaaaaaaaaaaaaaaaaattacaaaaaaaaaaaaaaaaaaaaaaaaaaaaaaaaagggaccgccaggctggcggctcttttccagttccagacctgaagaaactccgaccggccggtgggcggtggcggcacggcaggatctgtgccgcgatggcgacgtcgaacacggcgcggatggaggacggcggcggcgacctgcggagcaccatcaagaagtggaatatcatctaccctgtctacctcaactccaagaagacggtcgccgagggccgccgcatcgccgctgccaaggcctgcccggaccccacctgcatcgagatcgctgactgctgttcgcacctcaagatcccccacgccatcgagttggataaggcgtaccctcgggatttcttccaggtggggagggtcagggtgcagcttaagaaagatgacggctcccccgtcaatcctgctattaaaacgaagaagcagctgatgatccaagtagcagagctagttcccaagcatcacggaaggacaaagaagcaggagccagcgcccaatcccggtggcagttcaaagaacacaaaaggcgggaaaaagaaaaagtgatgcagtatcattgtgttgttttttattctgttcgtcatcatacactaagcttctgtgaaaaagaaaaagtcttggacgttgttgttatgttgccattatgccatttttcatgtataagaacttactaagaatcttccattgactcggtaaaatgcaacataaaaaaatggcttcgctagattaaagggccctttgacaaaggttcgccttctctggctattttgtaataaaaaaaaaaaaaaagccccctagggcccccgccgctc

SEQ ID NO: 14952 - DNA, 3899 bp, Zea mays
  misc_feature (2187)..(2187): n is a, c, g, or t
  misc_feature (2326)..(2326): n is a, c, g, or t
  misc_feature (2337)..(2337): n is a, c, g, or t
  misc_feature (2428)..(2428): n is a, c, g, or t
  misc_feature (2491)..(2491): n is a, c, g, or t
  misc_feature (2563)..(2563): n is a, c, g, or t
  misc_feature (2686)..(2686): n is a, c, g, or t
  misc_feature (2702)..(2703): n is a, c, g, or t
  misc_feature (2740)..(2740): n is a, c, g, or t
  misc_feature (2774)..(2774): n is a, c, g, or t
aaccatataagaaaggcctaagataggcaaccttctcttttttttggagttgcgtggatgcggatggagttgtcaacttcggagcgcgacagaatgctattgctagttacaataaaattattgtcgttattgtttttccaaaataaactattttaaattttaactacatatataaaaatattaatatttagaatgtataactagtatttattaaatctaactttgtaataatttattaacaaatataaatagttttttaatatataaatcaactaaaaaactaaaacgaatttgatttaggacagatggagcattataatattcattaacaaatttaacattttttcaaattcagtaacgagtactctttctgaagtttctatagtgtcatactgtcatgtaagaactttttctattgatttgttcgcgtcatattaacgccagggagggccttttctctctcctgtgaacgtcaaacagtgtctcttttccagttccagacctgaagaaactccgaccggccggtgggcggtggcggcagccggcaggtgcgccaccccgaggccccgacccatccctctctctgccggaaccttcagatccgcataaaacctcgttccccatttggtttgtgccacgtgacaggatctgtgccgcgatggcgacgtcgaacacggcgcggatggaggacggcggcggcgccctgcggagcacccatcaagaagtgggaacatcatctaccccgtctacctcaactccaagaagacggtcgccgagggccgccgcatcgccgctgccaaggcctgcccggaccccacctgcatcgagatcgctgactgctgttcgcacctcaagatccccccacgccatcgaggtacccgccctgattccttctccgactgtttccttttccatttctggattgccagtatcgtttgtttgcacatctgattggccaatttttgctatgtgaagttggataaggcgtaccctcgggatttcttccaggtggggagggtcagggtgcagcttaagaaagatgacggctcccccgtcaatcctgctattaaaacgagtaagtgaatgaactgcacacttgctttcacctgagctgaatttagaatgggacctcatacatattatactctattctgaagcatgtgttcaagatatcatgaattgctagtgattcagctggaagaacaagtatgcagtattgcagcgcttccttgtgtaaacatcaaatagtttttgcttattgatgattgcatctaggaaggaagacgacaaactgttaatgggttatagttcatatttttacttcacttattagttagggaacttaacatctgaagttcaaacccatgaattttttatctctgatatagtgttttaaagtgcgagcttaagcatttagcagtgcctttgggaaaattctaagcacgttatagcccctgctataggagcgctaaggcatatagtgttttcacaaaacaaatgcaaattattgccaaaagaatttgataaaaaacagtaaaaggagacttgcaaggatggaatatacccaatgatttagccttgaataggagcaaatggaaacagctatctacatgtctgaaccttgatttgtggcttctattgggttccaaatctagcctaccccaatttggttgggactaaaaggctttgttgttgttgtattgccaaaagaagggattttcaacaggaagcaataagtaatcacatagtaggtagtagcaacaatacacataacacataggtgagtaggtgacaccgggccactcacatagtgacacaatacataagaatttattaagctaaagtttaaacaatataagtagtttaagacttgtccagctatctaggacataagcaaatagtcgaatcgccaaccaattaagtgtagaatagctaccgtaagacataagtatctactgtcacatggccacatcacattgggcagcataagtaatgatctatcacttgataattgtaatctaaaaagatctgaacaaagtcacagaagatgatgcagatggtgaatgcatgtaaaaatggtgattctcatcttctgaatctgtagagaaatcaggggattgtatttcttcgtcatcaggaatcaacttccttctctttcgaagctgggtatctctctttcttttgttntgtgttgctgctccttgtgatgatgatgcgtttgctctaacttgtactccttctgctggttctggttcagcattgggcacaataccagtgattgattcattttcctcatcctcaagaacattggtcatggggttttcancggtccctttntctttttctccctttgtttgagttagaatcatcctgtcatgaagttgtctgttacgtctctttgtgtgaacctgtaggttaagttaaagtnaacaaaattgcagaaatgttcacgttcaaggaaaatataacagtaagagatgcatgtaatttnttctaaatatttattcctttcttatagttgctcaaatgcactccaattcctctcacaatctgaggagttacntgtcaaacctagaatcccttcaaccaattccctaagctttggtgcacttgtgccacgatctagccaccatttagattcattataaaaaaacaggacaggagttaagaaagcacaggtaccacntccgcagcctccgagnnggtgaggccatcacatgcagctgccacttgcagtctnttgtggtcactcacagccaccactcacagttcanggccgttgccgcaccgctgagccgccacaataggttcagaactgagagtggtcatgaatggagaggggagaacttgaaatgatagggtttgtaagcacacttatatagcatgtatagatgggctggatttgggtggtggaaattttgttgggactcattttgtgtctggttagctggttggacatttggcgccactaagtcaccgtaaagcgtttagcggcgctaatgcatgaaatggcgcccgtagctgcagttgtggtaatacgtgcaatattgtagcggcacatgtctaaggtttttgaagtgtaattacttcctttttagggaagaatagcatggatctggttaaacttaaaataagaacaaggagccaaggtgtgagtctattctgaaatgaaaaagaagcttactcccggactattacagcttccatcagtgttatattagttccatacaaacgacccactctaataccttaggttagtaatatattttgtgttgagatttacatgttttatcattatgcccatactttgatgctgttatttatggatgcatatattccgtccttttagtttgatctgatttatgtcaaactcgtttgaatgctatcaggaaaacttattttgctgctttttctcggtgcctcaacttttatgtgtattgactatcaacaccagctttatgattgccaggaatcgccttctgcattatctatgcatgattttctttttgaaataaatcttattgctgcactttgttttgttttgtttttgcatttgttatgtttggatcacttcataaattgggaaaacctatgtgtctgcttctccctgatgcttcaatgtttattacctttctattaacctcaaaattggcttggctatattgaacactaaggttttattttacatcagacatcacaaagcttcgtccgcatatgaatgtttgtaacaatatgggcatgtttctttttcatgtatgaggttttgcatgtgtcatgtgtggtaccccctcaactagcagcctcttgttttttgttacttcgaatcaatactaaataattccctaactaaatactcggtgggtagtacatttatgtttcagtctttcagaatcatgctc

SEQ ID NO: 14953 - DNA, 781 bp, Zea mays
cactcctaaccgcccggggccgccgccggcccggccgccaccccgaggccccgacccatccctctctctgccggaaccttcagatccgcataaaacctcgctccccttttggtttgtgccacgtgacaggatctgtgccgcgatggcgacgtcgaacaccgcgcggatggaggacggcggcggcgacctgagaagcaccatcaagaagtggaacatcatctaccctgtctacctcaactccaagaagacggtcgccgagggccgccgcatcgccgctgccaaggcctgcccggaccccacctgcatcgagatcgctgactgctgttcgcacctcaagatcccccacgccatcgagttggataaggcgtaccctcgggatttcttccaggtggggagggtcagggtgcagcttaagaaagatgacggctcccccgtcaatcctgctattaaaacgaagaagcagctgatgatccaagtagcagagctagttcccaagcatcacggaaggacaaagaagcaggagccagcgcccaatcccggtggcagttcaaagaacacaaaaggcgggaaaaagaaaaagtgatgcagtatcattgtgttgttttttattctgttcgtcatcatacactaagcttctgtgaaaaaggaaaagtcttggacgttgttggtatgttgccattatgccattttttgcctgtataagaacttaccaagaacttccattgactcggtaaaatggaacttaaaaaatttggcggcgctagattaaggggcccctatt

SEQ ID NO: 14954 - DNA, 916 bp, Zea mays
  misc_feature (891)..(891): n is a, c, g, or t
ccggccgggattcactgtccagtcgtgtcgataacccctccgctccgcgacgcccgccgccctggtccacgggcgtcacggcactgctacaaaccaactacctacctccaggccggccggcagtccggctagctccataaaggctggagacggccatggagacggcctccttcctttcagtcagccagccagccatggagacggcctccttcctttcagtggcgctggccctggcggccctcgtccccgtctcgctgctccttgtgaaccggctcctctacggcaagctgcccccggggccgcggcggcggcccgtggtgggcaacctgttcgacgtgcagcccgtgcggtgccggtgctaccaggagtgggcgcgccggtacgggcccatcatgacggtgtggctgggcacgtcgcccacggtggtggtatccacgtcggagctggccaaggaggtgctcaagacccacgaccagcagctcgccgaccgctgccgggaccgctccaccgagagcttcagccgcggcggccaggacctcatctgggccgactacggcccccactacatcaaggtgcgcaagctctgcaacctcgagctcttcacgcagcgccgcctcgaggcgctcaggcccatccgcgaggacgaggtcaccgccatggtcgagtccgtctacaaggccgtcaccgcgcctggcagtgcagggaagccgttggtggtaaagaaccacctctcgatggtggccttcaacaacatcacgcggctggccttcgggaagcggttcgtggacgcggccggcgagctggacgagcaagggcggcgcgagttcaaggggatcgtccacaacggcatcaagatcggtgcgtcccctctcatcgcgcagcacataccgngggctgcgctggctggccccggtcg

SEQ ID NO: 14955 - DNA, 880 bp, Zea mays
cattgggtacctcgaggccggccgggagtccggccggccccgtaaaggctggagacggccatggccgcggcctccttcctttcagtcagccagccagccatggagacggcctccttcctttcagtggcgctggccctggcggccctcgtccccgtctcgctgctccttgtgaaccggctcctctacggcaagctgcccccggggccgcggcggcggcccgtggtgggcaacctgttcgacgtgcagcccgtgcggtgccggtgctaccaggagtgggcgcgccggtacgggcccatcatgacggtgtggctgggcacgtcgcccacggtggtggtatccacgtcggagctggccaaggaggtgctcaagacccacgaccagcagctcgccgaccgctgccgggaccgctccaccgagagcttcagccgcggcggccaggacctcatctgggccgactacggcccccactacatcaaggtgcgcaagctctgcaacctcgagctcttcacgcagcgccgcctcgaggcgctcaggcccatccgcgaggacgaggtcaccgccatggtcgagtccgtctacaaggccgtcaccgcgcctgggaagccgttggtggtaaagaaccacctctcgatggtggccttcaacaacatcacgcggctggccttcgggaagcggttcgtggacgcggccggcgagctggacgagcaagggcgcgagttcaaggggatcgtccacaacggcatcaagatcggtgcgtccctctccatcgcgcagcacataccgtggctgcgctggctggccccggtcgacgagcaggccttcaaagcccacggcgaacggcgcgaccgcctcaccgtgaagatcatggaggagcacgcca

SEQ ID NO: 14956 - DNA, 5531 bp, Zea mays
  misc_feature (3759)..(3759): n is a, c, g, or t
tggtctgttatatcatgatccatcgttgtttgttaaggggtttcttataaagctacttggctaatagtggaaggatctaagtgttaaatatgacatacaatattataatctaacagatcaagagactcacttacatgcttgtacctaaggaccaattacacaacagtcgttaccttttatgattttatcgttcttactgtctaacaagttaatttttattagatagattgttaattttatttttataataaatttatttagagatgtagatgatattaatgttttataaaaatagtcaaatatttgtaaaaatgacaagtttttcatggagacaaatataaaagaacagagggagtaggttcatgagttatctatgtaattgttgtgtgaattctatgctagatgaaatttaacgggttaagacttaattgctagtccaataataatgtgtttggttgcaaggatggaatgagacgaggtgaaatgttcccttgcataaggttgtttggtttacaattagagttggagcatgatcattcctagaataactttcctatttgatgtctctcaactttccgtgatatggacggacgagagggaacacaggttgaggctcctcttctcgtggatgcatatttcttcgacacgtcgtggccatatccctccaaccaaacaaatgatggctcaaaccaaacaaaaaatagtgatcattccatctctcaaaccaaatatgacaagaaataattccatccctcaaaccagggtctgtcccatctatcctaattaatttgtcccgtgaccaaacacatggtaatagaacaaagatgtttatctattagctaggttataacaaacaagctatataatagtgatgtcttatttatctataacaactttttaattgttttttacatacattcgatcttgtctttgaaagggaaatatgcctaaaacccatttccacacttgttttggtaattgacggccatcacaaccaatcgagaaaactagtttgctaagttacaaattcaggtactcagaaatacttcaaggaagatcaaccctcaaaatagcatatcgcggaccgtctgaggctctagtacggactgtccgggatttcccagacaataattttttgaaaataccacatgtacttcgaaccgtttgtgccttcctggcataccgtccgtgacacctcgatgaactttggataggaactatgccaaatgcacatatccactatggactgtctgaagcaaagttgagtaccatccggcactaagcgcagaccgtccggcctcatacgtggaccgtccgcccgttgaaaatcaatccaactcgaaggtgtcgggttcagtaaaatgaattatagcatccacacgaattgtctggaggcacgaccagaccatctgcgttgggctttatctgacatctgacgacacatttaatgcgattatagttgttgatatagccgctataactaacagttgtgattcggtcgttaatctttgtagaggcgggctatccggacctgcaacgcggaccgtccgcgtgtggcagaaaggtggtaacgctaggaagtggttgatggctataaataccaccccaaccacctccattcaatacatccaagctttcacaactctcattcattacaaagagcaagatttcacttcaagccacaatcaaaagcctcaaaactccaccaagtgccataattgtgatttgtaatctttagtgactagtgccttggagagactctagtgagaatgtgatcttgtgttttcttattgctcttgttgcttggttttcttgacatactttcttcctaagtgtgtggtgatccttgcggggtctaagtgaccctcgagattaataagaagcactcatccggtctgtgtgaccgtttgagatagggaaaggattgaaagagtaccatcctacgtggactcctcaacgggatgtaggttctttagaaccgaacatcgagaaacaaatcattgtgttctttgtgcttaaaatgttacttgtgatttgattgttcctttaatccctctatagttcttgttggggcctactttgccgaagatcctcaaatcaccttactttcgacttgagaaactgtgttaaagggtgctttacaaaggacagacgaagccgaccttcggctgaggcagcctgcaaagggctttgcttgagcatacacacgacgaaggtgtgtaccgaggccgttagctttggcgactaatgggattcgtgctcgaagcgacgaatgggaagaaattgaatacttgtgtagcaaggaagaaagagaaaaagacaacgatgtccttgtaatatttgtaaaccatgtgtttaaactttgtgggcatgcttgtaatttcatacgaagttgtacctttcccctataaataggtcaacagtgacatgcataaaggcacctcttggacgaccttaagttttgtcgtgcttagctttcgaagttccttcgagtcgtgtctcatgtaaagccgaaggtatgtctgtaaatttatattgtatggcagagagagatgtaatgaaaaatgctaaggcatgtgagatgagtaagatgctttgttcttcattactcttctatacattattgctttatttacattctcaatttatatcttttcccttgaattacccttcggggaagaggtaattaaagggagaaggttacaatcttctaacttgtgttgccttgtttttgataccatgtagtaatcaaggtgactaacagttctcttgcttgcgttcgttttgagttgtctcccaaagttatctgcaattgattgagcaaatcttagcaagaagaactactctttcgcactctgattcactgcagactcattctaacgctaatcctaggtgaagttttgtgttcaagtttataaacttcaggtttgatcgatccatcccctctaggcgactttcagtctttgctaatcctcctctcattcacttaaatataggtccaccactacatatgcttctgtacacatcttgttgcttgcatgagggtcaagttctcctctccttactctcttcttttctctgcaccggtatttatttgactataaattaattgttatacttgctctagaatagaaccccgtccagctagttatcttaggcactatttgcttgagttccagcttttagagtttttttaagtcgttgctagacttttgatcctaagaagccaataataactttctgatgatgttattagctttagaaacttaggaagctacagaagtacacaaaatcatttttcaccttcctgtataaactcaacctttctaggagctaaattgaaaagctaggtgtttgttttagtttttttcttttcacgctatgaagctatcctaggctcaaacaaacatggtgttcagatgtttttaacggaacatgtttcacggaaacattattccaattattttagacgcctttcaaaccaaaaatataaaataattataaaattttaaagagacgctaaggccttgtttggatgcttgatatttttgcactattgaggcaataccatggtatttgatgataccattatattagaagccaaaaggtgtttggttaatacaagtaaaacacattttttaaataccatagtttattccgtggtatttttggagttttaaaaactccactcaggaccttagttttcttctattctttttgtagatactttggttttctaatgaaaccgaacacatctcngttttaaacaaaactatgattttactacggtaaggcactataatatttgtgtcatgcataattataaattttgacattttaaaattatagtattttaaaactgcattattaaacaggccctaatccctggcagccagcgtttcaggttttcaggacaccagcttcctagtttctattggctacggcatcttgaatccctgtccgggagtcgtgtcgatgacccctccgctgcgccaaccaacccaccctggtccacgggcgtcacggcactgctacagtgctacaaaccaactacctaccaccactccggcagtccggctagctccataaaggcgcagccggccggctggccggtagcagtcagccagccagccagccatggagacggcctccttcctctcagtggcgctggccctggcggccctcgtccccgtctcgctgctccttgtgaaccggctcctctacggcaaactgcccccggggccgcggcggcgtcccgtggtgggtaacctgttcgacgtgcagcccgtgcggtgccggtgctaccaggagtgggcgcgccggtacgggcccatcatgacggtgtggctgggcacgtcgcccacggtggtggtgtccacgtcggagctggccaaggaggtgctcaagacccacgaccagcagctcgccgaccgctgccgggaccgctccaccgagagcttcagccgaggcggccaggacctcatctgggccgactacggcccccactacatcaaggtgcgcaagctctgcaacctcgagctcttcacgcagcgccgcctcgaggcgctcaggcccatccgcgaggacgaggtcaccgccatggtcgagtccgtctacaaagccgtcaccgcgcctggcagtgcagggaaaccctcgcccgctattgccttcctccgttgctggtgatttaatttccaggtggattgaaagacaactgtttgctttttagatggattattactacccgattcgtggaaactgattttttttcgaaatctagttcatttcttagaaaataggaatcttactctgtaccttactgtataactcattattaattagagtggaaacttgttctttttttcctccttactgtacaactcattattactgcaactcctttctttgtcacttgcatattatttctattttttcaaaaaaattagtttatttttatttaagaaaatgggaatatcttaaaaaatgaagttaccaaactagctctaactgttctgcctacccagttcttctccaagtgtagctatattttgatttctgagacagagttaggttatatgtattatcttggtgggaaaaacacgcaatatattgtgcttaacagataggagaactacgttatcgatttcattgaatcattgagctgtttgttctcaatgaaatccttgcactcagagagcacacccttattttccctgcttacacgcaggcagtgcagggaagccgttggttgtaaagaaccacctctcgatggtggccttcaacaacatcacgcggctggccttcgggaagcggttcgtggacgcggccggcgagctggacgagcaagggcgcgagttcaaggggatcgtccacaacggcatcaagatcggtgcgtccctctccatcgcgcagcacatcccgtggctacgctggctggccccggtcgacgagcaggccttcaaagcccacggcgaacggcgcgaccgcctcaccgtgaagatcatggaggagcacgcccagggccctcaagc

SEQ ID NO: 14957 - DNA, 1870 bp, Zea mays
ccacgcgtccgaactacctaccaccactccggaagtcctgctagctccttgggggcctcgacgccggccgggctccttcctttcagtcagccagccagccatggagacggcctccttcctttcagtggcgctggccctggcggccctcgtccccgtctcgctgctccttgtgaaccggctcctctacggcaagctgcccccggggccgcggcggcggcccgtggtgggcaacctgttcgacgtgcagcccgtgcggtgccggtgctaccaggagtgggcgcgccggtacgggcccatcatgacggtgtggctgggcacgtcgcccacggtggtggtatccacgtcggagctggccaaggaggtgctcaagacccacgaccagcagctcgccgaccgctgccgggaccgctccaccgagagcttcagccgcggcggccaggacctcatctgggccgactacggcccccactacatcaaggtgcgcaagctctgcaacctcgagctcttcacgcagcgccgcctcgaggcgctcaggcccatccgcgaggacgaggtcaccgccatggtcgagtccgtctacaaggccgtcaccgcgcctggcagtgcagggaagccgttggtggtaaagaaccacctctcgatggtggccttcaacaacatcacgcggctggccttcgggaagcggttcgtggacgcggccggcgagctggacgagcaagggcgcgagttcaaggggatcgtccacaacggcatcaagatcggtgcgtccctctccatcgcgcagcacataccgtggctgcgctggctggccccggtcgacgagcaggccttcaaagcccacggcgaacggcgcgaccgcctcaccgtgaagatcatggaggagcacgccagggccctcaagcagcgcggcgcccagcagcacttcgtcgacgcgctcttcactctcagggacaagtacgacctcagcgatgacaccgtcataggcctcctctgggacatgatcaccgccggcacggacacgacggtgatctcggtggagtgggcgatggcggagctgctgaggaaccccagagtgcaggagaagctgcaggaggagctggaccgtgtcgtcggccgcgaccgggtcctgtcggagacggacttcccgaacctgccttacctgcaggccgtcgtcaaggagtccctgcgcctgcacccgccgacgccgctgatgctcccccacagggccagcgccagcgtcaagatcgccggctacgacatccccaagggcgccaacgtcgtcgtcaacgtgtgggcggtggcgcgcgaccccgaggtgtgggacagcccgctcgagttccggccggagcggttcctccgggagaacatcgacatcaagggcgccgacttccgcgtgctgccgttcggcgccggccgccgggtgtgccccggcgcgcagctcgggatcaacctcgtggcgtccatgatcggccacatgctgcaccacttcacgtggacgctgccgagcgggacctgtcccgaggacgtgagcatgatggagtcccccgggctcgtcaccttcatggccacgccgctgcaggccgtcgccacgccgcgcctggacaaggaggaactgtacaggcgtgtcccttcggacgtgtgagccgtcggcgtcctggcatctgctgcgttccctgttttgaaacctgctgctgctgttgcgaatttgtgtaccattaactattcgctggtgatgtacgtgtcatagtcgtgtacgagcattttgtgtactgcagaacttgatcgctgagcatacacttttgcccggtagtaatttacaatttcagcattgcaaattactaaaaaaaaaaaaacaaaaaaaaaaaaaaaa

SEQ ID NO: 14958 - DNA, 2241 bp, Zea mays
tggagtttccagcatttgtttaagaaactgttagagtatacactataatttacctctaaaaatttttagcctatccctaataatattttttggggaatttttagcttcctcttggagttgctcccaagtgactccaacgtgccgtctatatggggccccccacggccggccggcccggaactcgggtccatagttcaaaacgaaaccaagcaagctttcggtcatggccccgccggcaacgaatagcccgggagaggtcgacagcggcggccgcccgcatgtcatgttcatcccaagcgctggcatgggccacctcatcccattcttccgcttcatcgcggctctcgctgggcagagcgtcgacatctctgtggtgactgtccttcctaccgtttctgccgccgaggaggactacttcaccagcctcttcgctgccctcccccgtgtccgccgcgtcgacctccacctcctgccgttcgacgcgtccaagctcccaagcaacgaccgcgacccgttcgttctccggtgggaggccctgcgccgctcagcgcacctcctgggcccgcttattgccggcgccgccccacgcgtctcggccgtcattacagacgtgaccctgacctcccacgtcatccccatcgccaaggagctcggcgtccagtgccacgtcctcttcccctccagcgccaccatgctctcgctccttgcttacacccctgtacacatcgacaagaaggccgagcaggggagtgacatcggcgacgtcgacatccccggtgtgtgtcgcataccgcagtcttgtctcccgcaggtgctgcttcacctcgacaaactcttcaccaagcagttcatcgccaacggccgcgagatcatcaacgctgacggctttctggtgaacacgttcgacgccttggagccggtggcgctcgctgccctgagagatggcaaggtcgtcccggggttcccaccggtgtacgccattggcccactcatgtcgcagcaaaactcagttgacgaaggtgggaaggaagaaggatcgggctcccccgttgcctggcttgacgagcagccagcgcggtctgtggtgtacgtcgcgttcggcaaccgctgcgccgtgagccatgaccagatcagggagatcgccgccgggctcgaggcgagcaactgtcggttcctttgggtgctcaaaaccacaacggtggatagggacgacagcgccgtgctgacggaattgctcggcgaggagttcctggagcgagtgcagggtcgcggcctcgtgaccaaggcgtgggtggaccaggaggccctgctgaagcacccggccatggggctgtttctaagccacagcgggtggaactcggtgaccgaggcggctgccgccagcgtgccgctgctggcgtggccccgcggcggcgaccaccgcgtgaacgccatggtaacggtgagcggtggggttgggatgtggatggagcactggagctgggacggggaggactggctggtgaccggggtggagatcgcgaagaaagtaaaagaggtcatgtccgacgaagcggtcagggcaaggacgacgaggaccgccgaggaagcggccaaggcagttgcagagggtggcaccagctaccggagcatggaggagtttatttccagcgtcaaagcaaccgtggcgtcttgattgcgtcgtggggttcctgatttccacaagtttgtgtcccctactcccctaccctaccttcccactgatggggagttgtgacgtcgttgtcgtgtggctggttgcagtgtcaaccaaaacagttctcacacacgtgagttgttgggaggtaggtagcctgtactatcacgtacctaccccatcaagaatagtgcgtcatctgtcatcttgtgatgtcatcttgtaatgaaataaaaatagttgcattttaaatatttgtaaaaaaaaaaagcccgtgcaacggcgccgcgccaaataaaaaaatagaggaagtaccattctattttaacaaccacttttacactcgaccgtccatactctgctactaaagaaatgcccatatgtagtgattgaaagttgtatacagtattggagtctcaaccggtatttagaaactggagctaatatatttctatctgcgtgattggttgctggactccttggtgcctggctcacgcgggcctacaccgcttgaacgcgctcgtcttacatccctgcacatacagaccaactggcatagaaagtcc

SEQ ID NO: 14959 - DNA, 2297 bp, Zea mays
ttcaaaacgaaaccaagcaagctttcggtcatggccccgccggcaacgaatagcccgggagaggtcgacagcggcggccgcccgcatgtcatgttcatcccaagcgctggcatgggccacctcatcccattcttccgcttcatcgcggctctcgctgggcagagcgtcgacatctctgtggtgactgtccttcctaccgtttctgccgccgaggaggactacttcaccagcctcttcgctgccctcccccgtgtccgccgcgtcgacctccacctcctgccgttcgacgcgtccaagctcccaagcaacgaccgcgacccgttcgttctccggtgggaggccctgcgccgctcagcgcacctcctgggcccgcttattgccggcgccgccccacgcgtctcggccgtcattacagacgtgaccctgacctcccacgtcatccccatcgccaaggagctcggcgtccagtgccacgtcctcttcccctccagcgccaccatgctctcgctccttgcttacacccctgtacacatcgacaagaaggccgagcaggggagtgacatcggcgacgtcgacatccccggtgtgtgtcgcataccgcagtcttgtctcccgcaggtgctgcttcacctcgacaaactcttcaccaagcagttcatcgccaacggccgcgagatcatcaacgctgacggctttctggtgaacacgttcgacgccttggagccggtggcgctcgctgccctgagagatggcaaggtcgtcccggggttcccaccggtgtacgccattggcccactcatgtcgcagcaacactcagttgacgaaggtgggaaggaagaaggatcgggctcccccgttgcctggcttgacgagcagccagcgcggtctgtggtgtacgtcgcgttcggcaaccgctgcgccgtgagccatgaccagatcagggagatcgccgccgggctggaggcgagcaactgtcggttcctttgggtgctcaagaccacaacggtggatagggacgacagcgccgtgctgacggaattgctcggcgaggggttcctggagcgagtgcagggtcgcggcctcgtgaccaaggcgtgggtggaccaggaggccctgctgaagcacccggccatggggctgtttctaagccacagcgggtggaactcggtgaccgaggcggctgccgccagcgtgccgctgctggcgtggccccgcggcggcgaccaccgcgtgaacgccaaggtaacggtgagcggtggggttggggtgtggatggagcactggagctgggacggggaggactggttggtgaccggggaggagatcgcgaagaaagtaaaagaggtcatgtccgacgaagcggtcagggcaaggacgacgaggaccgccgaggaagcggccaaggcagttgcagagggtggcaccagctaccggagcatggaggagtttatttccagcgtcaaagcaaccgtggcgtcttgattgcgtcgtggggctcctgatttccacaagtttgtgtcccctactcccctaccctaccttccactgatggggagtccggagttgtgacgtcgttgtcgtgtggctggttgcagtgtcaaccaaaacagttctcacacacgtgagttgttgggaggtaggtagcatgtactatcacgtacctaccccatcaagaatagtgcgtcatctgtcatcttgtgatgtcatcttgtaatgaaataaaaacagttgcattttaaataaaaaaaaaaaaggccccgccggccaaaaaaaaaaaaaaaaaaaaaaaaaaaaaaaaaaaaaaaaaaaaaaaaaaaaaaaaaaaaaaaaaaaaaaaaaaaaaaaaaaaaaacctttttaacggggggggggtttgccaaaaaaggcccaattttcaaaacccaagggggaaaaaggttttccccctgggacccaaaaaaacgggggggggcaaaatttcccccccgggaaaaaaaaccccttggaaaaatttttcaaaaaaaacttcaaaaaattggggttgggatgggggaacaaaaaaaaaaagcccccggctttcaggggggggaatttgggtttcaaaggggattttggggaacccggggggccaaaaaaaggggtggcccccccttttttggggaaaacttccccccttttggcccgggggaaaaagggggccaaaccttttacctccaccttcaaaagtttgggcagttcccccccccgggcaagggggggcccccgggggaaaacttcccccccggttggcggaaagggggggccccccccccgggggg

SEQ ID NO: 14960 - DNA, 1130 bp, Zea mays
cgacatctctgtggtgactgtccttcctaccgtttctgccgccgaggaggactacttcaccagcctcttcgctgccctcccccgtgtccgccgcgtcgacctccacctcctgccgttcgacgcgtccaagctcccaagcaacgaccgcgacccgttcgttctccggtgggaggccctgcgccgctcagcgcacctcctgggcccgcttattgccggcgccgccccacgcgtctcggccgtcattacagacgtgaccctgacctcccacgtcatccccatcgccaaggagctgggacggggaggactggctggtgaccggggtggagatcgcgaagaaagtaaaagaggtcatgtccgacgaagcggtcagggcaaggacgacgaggacccccgaggaagcggccaaggcagttgcagagggtggcaccagctaccggagcatggaggagtttatttccagcgtcaaagcaaccgtggcgtcttgattgcgtcgtggggttcctgatttccacaagtttgtgtcccctactcccctaccctaccttcccactgatggggagttgtgacgtcgttgtcgtgtggctggttgcagtgtcaaccaaaacagttctcacacacgtgagttgttgggaggtaggtagcctgtactatcacgtacctaccccatcaagaatagtgcgtcatctgtcatcttgtgatgtcatcttgtaatgaaataaaaaaagttgccttttaaaaaaaaaaaaaaaaaaaaaaaaaaaaaaaaaaaaagaaaaaaaaaaaaaaaaaaaaaaaccttcactgtggggttccaattacgagtagctgtaatccatgggtccgacctggcttccgcccgttatttggtcactaggtggaattttgatcccacttgttatcccgctagcagtccgagatgtctccgggggtctaatgtatggggtaactcttactaactgaattgcagtcggaacccctttttcacccggtggggttgccgggccatttacctgattgaatatttgtacgccggattggatgctgttttcggaaaaggcacactgccgatggctcgttcattgatgtatctgctcccggtccgtactaaagcggtcagtggcatcagctcc

SEQ ID NO: 14961 - DNA, 1303 bp, Zea mays
  misc_feature (1142)..(1142): n is a, c, g, or t
  misc_feature (1157)..(1158): n is a, c, g, or t
  misc_feature (1161)..(1161): n is a, c, g, or t
  misc_feature (1257)..(1257): n is a, c, g, or t
  misc_feature (1287)..(1287): n is a, c, g, or t
  misc_feature (1293)..(1293): n is a, c, g, or t
cattattttcatctctcctccgtctccgcccccgttattctctctctcccagctcctcctccctgtctgctcccctccacatccactgctgtggcgctctccctctcccgtctcccctcaccttctccacctcccccattccgccaccgcacaagccgacctccctcaccaagaggagaaaagaaagggagagcgaaggaggcaaaccaggtgggacagcaacgcgacgtgcttgctattctctctaggagctcatgcaaggtgtaagtcttactgcaagaagggcagctgtgaagaagggcagctgtgcatgttaagacccatacatagcctctcttgattacacagcacggggggtgaaaacttgagatacagttgatctcctggttcagagtatgggttcaaggtttgcatcgcatcagctgagcaatggcctgtatgtttctggtcgacctgagcaacctaaggagaaggccccaaccatttgttccactgcgatgccatatactgggggtgacatcaagaaatcaggagagctggggaagatgtttgatctccatgttgagaagtcaagaaaatctggtcctctaggaaatgctccttcaaggaatacttcatttggaggtgctgcttccaactctggacccgtatccaatgctggcggtcggtccaattactctggttctctttcatcttcagttcctggtgctggcggatcagccagagcaaaatcaaactctggaccgctcaataagcatggagagccaacaaagaggtcatctggtccccagtctggaggagtgaccccaatggcacgccagaattctggcccccttcctcctgtgcttccgacaactgggcttatcacatctgggcctatctcttcagggccacttaattcgtctggtgttccaaggaaagtatctgggccacttgattctgctgcgtcgatgaaaatgcgggctacttcctttgctcacaatcaagctgttactaatctcaacactgaagatggttactcaattcagggaagctttccgaagccaatactctgggctgtgattctgctctttgtgatgggtttcatagcaggtggtttcattctgggtgctgttcacaatgcaattttgctgatagttgtntgtggtcatatttgnnttntgttgctgcacttcttatctggaatgcttgctggggtagcagaggtggaattgggtttgttagtcgctaccctgatgctgatctcagaacggccanagatggacaatatgtaaaggttataggggntggtanttgtggaaat

SEQ ID NO: 14962 - DNA, 639 bp, Zea mays
ctcccagctcctcctccctgtctgctcccctccactgctgtggcgctctccctctcccgtctcccctcaccttctccacctcccccattccgccaccgcacaagccgacctccctcaccaagaggagaaaagaaagggagagcgaaggaggcaaaccaggtgggacagcaacgcgacgtgcttgctattctctcgagagagatgtcaattttataataaaaccccagcatgcgtcagctggcgaattatgacttgagctcatgcaaggtgtaagtcttactgcaagaagggcagctgtgcatgttaagacccatacatagcctctcttgattacacagcacggggggtgaaaacttgagatacagttgatctcctggttcagagtatgggttcaaggtttgcatcgcatcagctgagcaatggcctgtatgtttctggtcgacctgagcaacctaaggagaaggccccaaccattttttccactgcgatgccatatactgggggtgacatcaagaaatcaggagagctgggggaaagatgtttgatctccatgttgagaagccaagaaaatctggtcctctaggaaatgctccttccagaaatacttcatttggaagtgctgcttccaactctggaccc

SEQ ID NO: 14963 - DNA, 943 bp, Zea mays
  misc_feature (915)..(915): n is a, c, g, or t
  misc_feature (918)..(918): n is a, c, g, or t
ggtacccctccgaggtccggccgggctcatgcatcgtctacctatctttgggtacctcccggcccgccccgctccccctatattctctctctcccctcctctcctctccccagctacgccagtcctcctccctgtctgcttcggtgcttcgctcccgcactgcgcttggccgctttccctctccccgcaccttctccacctcccccattccgccaccgcacgagcagagctccctcaccaagaggaccaaaaaaaaaaaaaacgagggaggcaagccaggcgggacagcaacgcgacgcgcttgtcattcactcgaggagctcatgcaaggcgtaaatcttattgcaagaagggcagctgtgcatgttaagtctcaaatatagactcacttgataacactgcatgagaggttgaaaacttgaggtacagttgatattctggttcagagtatgggttcaaggtttgcatcacatcagctgagcaatggcctgtatgtttctggtcgacctgagcaacctaaggagaaggccccaaccatttgttccactgcgatgccatatactgggggtgacatcaagaagtctggagagcttgggaagatgtttgatctccatgttgagaaatcaagaaaatctggtcctctaggaaacgctccttcaaggaatacttcatttggaggcactgcttccaattctgggcctgtctccaatgctggtggtcggtccaactactctggttccctttcatcttcagttcctggtgctggtggctcagccagagcgaaatcaaactccggaccactcaataagcatggagagccaacaaagaggtcatctggtccccagtctggaggagtaaccccaatggcacgccagaattctggcccccttccctctgtgcttccgacaactgggnctnatcacatctgggcctatctcttcag

SEQ ID NO: 14964 - DNA, 949 bp, Zea mays
  misc_feature (909)..(909): n is a, c, g, or t
gcacgacgttcctccgccgccccccccgggactctcgctcaccccgcgcccgcccggtgtctgctcccctccacatccactgctgtggcgctctccctctcccgtctccccttaccttctccacctcccccattccgccaccgcacaagccgacctccctcaccaagaggagaaaagaaagggagagcgaaggaggcaaaccaggtgggacagcaacgcgacgtgcttgctattctctctaggagctcatgcaaggtgtaagtcttactgcaagaagggcagctgtgcatgttaagacccatacatagcttctcttgattacacagcacggggggtgaaaacttgagatacagttgatctcctggttcagagtatgggttcaaggtttgcatcgcatcagctgagcaatggcctgtatgtttctggtcgacctgaacaacctaaggagaaggccccaaccatttgttccactgcgatgccatatactgggggtgacatcaagaaatcaggagagctgggggaagatgtttgatctccatgttgagaagtcaagaaaatctggtcctctaggaaatgctccttcaaggaatacttcatttggaggtgctgcttccaactctggacccgtatccaatgctggcggtcggtccaattactctggttctctttcatcttcagttcctggtgctggcggatcagccagagcaaaatcaaactctggaccgctcaataagcatggagagccaacaaagaggtcatctggtccccagtctggaggagtgaccccaatggcacgccagaattctggcccccttcctcctgtgcttccgacaactgggcttatcacatctgggcctatctcttcagggccacttaattccgcctggtggtccaaggaaagtatctggngcacttgattctgctgcgtcgatgaaaatgcgggctactt

SEQ ID NO: 14965 - DNA, 2117 bp, Zea mays
agagagagagagctcactagtccccccccccccccggctctctctttcgccttctcttagcctaccctttttccttcctcctctccgattcttcctccgtcagtaaaagaaaatcaaaatggcttcacacattgttggatacccacgtatgggccctaagagagagctcaagtttgcattggaatctttctgggatggtaagagcactgctgaggatcttcagaaggtgtctgctgatctcaggtcatccatctggaaacagatgtctgccgctgggactaagttcatccctagcaacacctttgctcactacgaccaggttcttgacaccaccgccatgctcggtgctgttccacctaggtatggatacactggtggtgagatcggccttgatgtttacttctccatggctagaggaaatgcctctgtgcctgccatggaaatgaccaagtggttcgacaccaactaccattacatcgtccctgagttgggccctgaggtcaacttctcttacgcatcccacaaggccgtgaatgagtacaaggaggccaaggctcttggtgttgacaccgtccctgtacttgttggtccagtctcttacttgctgctttccaaggctgccaagggtgttgacaagtcattcgaacttctttctcttctccctaaaattctcccgatctacaaggaagtgattacggagcttaaggcagctggtgccacctggattcagcttgacgagcctgtccttgttatggatcttgagggtcagaaactccaggcctttactggtgcctatgctgaacttgaatcaactctttcaggtttgaatgttcttgtcgagacctacttcgctgatatccctgctgaggcatacaagaccctaacctcattgaagggtgtgaccgcctttggatttgatttggttcgtggcaccaagacccttgatttggtcaaggcaggtttccctgagggaaagtacctctttgctggtgttgttgatggaaggaacatctgggccaacgactttgctgcgtccctaagcaccttgcaggcacttgaaggcattgttggtaaagacaagcttgtggtctcaacctcctgctctcttctccacaccgctgttgatcttatcaatgagactaagcttgatgatgaaatcaagtcatggatggcgtttgctgcccagaaggtcgttgaagtgaatgcattggccaaggctttggctggtcagaaggacgaggcccttttctctgccaatgctgcggctttggcttcaaggagatcttccccaagagtcaccaacgagggtgtccagaaggctgctgctgctttgaagggatctgaccaccgtcgtgcaaccaatgttagtgctaggctagatgctcagcagaagaagctcaatctcccaatcctaccaaccacaaccatcggatccttcccacagactgtagagctcaggagagttcgtcgtgagtacaaggccaaaaaggtctctgaggaggactacgttaaggccatcaaggaagagatcaagaaagttgttgacctccaagaggaacttgacatcgatgttcttgtccacggagagccagagagaaacgacatggttgagtacttcggtgagcagttgtctggttttgccttcactgcaaacggatgggtccaatcttatggatctcgctgtgtgaagccaccagttatctatggtgatgtgagccgtcccaaggcaatgaccgtcttctggtccgcaatggctcagagcatgacctctcgcccaatgaagggtatgcttaccggtcccgtcaccattctcaactggtcctttgtcaggaacgaccagcccaggcacgaaacctgttaccagattgctttggccatcaaggacgaagtcgaggatcttgagaaaggtggaatcggtgtcattcagattgatgaggctgcacttagagaaggactaccactcaggaaatccgagcatgctttctacttggactgggccgtccactccttcagaatcaccaactgtggagtccaagacagcacccagatccacactcacatgtgctactcccacttcaatgacatcatacactccatcatcgacatggatgctgatg

SEQ ID NO: 14966 - DNA, 2098 bp, Zea mays
ataaaaaaatggcgaaatgaaattcacggtaccagggtcaaccgagcacggacgcgtaaagccaacaaggggggaccgggggagcacgaggaaaccgaggagactgacccaacccgtgcttgcggcggcgctgcgctggtgccggccacggccatgatcggcggcgggcgggcagcggatagccacccggcgtcctgctcgtcctcgtcctcgtcttcctcctcgccgtcaggcccgtcgacggggggctcccgccttcaccgcagcaagaggcgtcccgacatcctcaacatgctcatgagtgcagcatgtctcagttcatcatcttctgatactggaaaaggacaaagcaagttttcaagcaacaaagtaacacacggatttcacttagtggaaggaagatctggccatgatatggaagactaccatgtagcagagtatagatatgaaaatgatcacgaacttggtctttttgctatttatgatggacatctgggagatagtgtggccagttatttgaaagctaatctttttgacaacatactgaaagagcctctcttttggtcagaccctcaagaagcaattaaaaacgcatacagctctacaaacaaatatattctggaaaacactaggcaactaggaccaggggggtcaacagcagtcactgctattgtagttgatggtacagatatgtggattgcaaatgtaggtgattcaagagctgttttgtctgaaactggtactgccagccaggttactgttgatcacgaacctcataccactaatgaacgaaagaggatagaagaaaaaggtggttttgtctctacgttccccggtaagcatctagttgcctagctctcaggtcattgttctctccaatagctatggaatttgtcccaatgcattttctagttgctgataggtgacgttcctcgtgtaaacggccaacttgcggttgcaagagcatttggtgatcagagcctcaaggcacacttgagctcagagcctgatgttaagcatataaagataaattcaagcacagagtttgtcatacttgccagtgacgggttatggaaggtatgtgtcttccttgcgtatttcactttacgttgccgtcgccttccctatatagttcaagatttcgatatccaatctgaatcgttttctcttagttctctcttttctcgttgttcatattcactcttttaccctgtttctggtgaaggtaatgaagaaccaggaagccgttgatctggtgaagtcaaccaaggacccgcaaacagcggcgaagcgactgacgtccgaggccctgggaaggatgagcaaggacgatatctcatgcattgtcatccgttttcgatgctgactcttgggtaatccagctcatccattgccctaagctgcctgtgtgcatcagcagaactgtttcctccgtatcgtagctggtagcgtctggatctgtttgcagctcaggatcagattggtgattggactggacaggttattgaccaaagaatagaagaatgctgggtttgggtgttttcagcgtctgcaggctgttctttttttcttcttctgtgcatatatacacgttggaatcaaatatataccgtcggactggagacaagaaaaaccatatatataccgccccaagatgcaaagatgatacagattatgtaagcttgtagacatgtagtagttggattatggcttttagtgactcgtgtgtgtggtgtggtgtgaattcctgtgtgtattgaagataaagttccgttgccattcacgtacggaaccagcgatatgctatgaacgggatcaacttgaaataacattcgtctctcctttataaaacaagaactctatcagaaattgcatactgccgtcgcgtatccagtggcaacagaaagctggatagcagggttgaaggttgaaagttttcttttttggttgataagtgctagcacgagactgattcttacaaagttacatgtttgaggaacaccagactggcgagcctgtttggctagtctatctgctatcttgttgcgttgcattggaatcttgtaaaaagcaacattctgatttgatgtatctgagc

SEQ ID NO: 14967 - DNA, 1941 bp, Zea mays
acccccgggccggcccaatttcttggtgaggtctacgtgaaggtagtggaacgagatcaccttccgagacgagaaaggaatcactcgttttcctccgggcacattcctccgagttcggacggcaacgccttttatggccgccgttgcctcctccttctcgcggttctccttccgctgcgccgtctgcccctccccgctccgcgtccgcttttcgcagccccatccgcccgcgcggctccgcgtctcctccaccgtcgttgctctccacaagcgcaaccccaagcggctcaagtacgccgccgagcgccagttcacgagaggggatgccgggttgctgcgggtggaggtggagccctccggcggggacttctggaagcttgaccccattatcgacctcatcaatcgcggcgccgtcggggtgatccctactgacaccgtctactccgtcgtctgtgacctgagtaacaatgaatcgattgagcgccttcgcagactgaaaggcattggagactccaagcctctcagcatcctgtgtcgctcattacgtgacatcgatacctacacaacaggatttcctcaaggcactaaccaagggcaagctaacatttttcgtgttgtcaagcgtgcaatacctgggccttacacatttattttacctgcaagcaagcagtttcctaaacaatgtataaagcatggttcttccacaaggtatgcaaaaaggaggcaggttggcgtccgaattccagatgatcccatctgccaggcaatattgcaaaatcttgatgaacctttgatatgcacaagtgtcaaatatctatcggaggatgaatggatacttgatccagtaatcattgcagatctttatgagccactggggcttgattttattgttgatggcggacctagaattgctgacccttctaccgtagtagatatgatgggagcaaaccctactgtaattcgtcagggaaagggtctaaagttggattggatggtagcaaaagatgaagaggaggacgaggcacagtcgatgttttctttcaaatcagcttgaaatttgcttcgcctgacctgtatgggctggcactttgctatggtcccccaaccgaagcgtcttctttcaactgcatataggatgtcagttgttagctgtaagcatagatgtcgaacacgaactgcgtgctgtaaatatgcaaggcgatgtaagcgaactggcagaatttgctcagtagcaacctttgctggaggtgatggaaagtttcctgctggttttcttgaactttgccgtgtacgcctaccagaatttccgtcctggaaggttccatattattccaattcatcctgcttctgtgatgcttttaattcgagaagcataactttttgggataattatgattatatccttcgctagacttgtaattattattttaccctcgattttttaacttcgtgattgcgcccaccgtttgtcccttatgccgttagtgaaaatcattaaaaataaaaataaaatcagaattagtgattaaaaagtttaaaatatgaaaggaagtggttgaaaggtccgaactatccttcttatactagatacaacctcaatagaggtaaaatcataattacataaatataatgagggatgaaattatgataaattgtattagtatttttgtgttttcacatcaaaagatacttttatgtacgagtcacgtaacctttttataccaaatggaacctttttgagtttatctcaagtgagtagatctttttgatttttttattttatttttttgcttctatagctcaagggggaaaaccaattttggtaccgtaaatttcttcttttgaggcgatgatggctcggtcgtttggtcagatcttggggggggggggggaaggtggaaatattgatgcatagtgatgctagtggcagagatagtgagt

SEQ ID NO: 14968 - DNA, 831 bp, Zea mays
attggggccccgcgggcccggataattacacgccaccaccgctcgacctaccagccctccttcctcatccgcctgccctgcccgtcccgtccgtccacccccttcccttctttcccctttgcttgctgctgcctgcttctcgccgtcgccgcctcaattccctcctcgttgtccgtcgcctcgtccacgcgcacctcgtcctcctctccgttccctccacctcctcgaccgcaccgtcgtcgtctagctagcggagcgagctgcgaccagatcggagagccaagcacccaggaagagggggccggggaacaagaagaagccgccggaagccgggcgtggacgtgtggtggttttctgccggcggctgacaagtggtgtaggctacccgctctggccatggatccgtcgggcggcgcgttcctgccgccgctgcagcaagggagctcctccttcccgcggtcctccagcaacgcgtcgctcgccaggagcggcagcggcggcggcggcgttggcgccgggcgcgggaccaggggcaggaagatgatgcgcagggtctgccgcggcgtcatcaccttcatcttcgccatcgctgggctgttcctgggagcggtgaccggcggtctgatcgggctggcgacggagagcgggctgttccgcggcaccgggatcggcgccatcaccggcgcgctcgtctccatcgaggtcgtcgactcctccatccgcctctggcaggcgcgccgatccgggatctggagcatcctctacgtgctgaacgtgatctacagcctcctgacgggcaggctggtgcgcggatcaggatcacgatcagca

SEQ ID NO: 14969 - DNA, 3526 bp, Zea mays
ttcttttcttttctctttatctttttgaacctcaatttgaattcaagttttgtggtggatttttgtatctagatcaaatatacaaactaagaagaccagctttgaaaaaggtttatttatttatgtatacattttccttatatttcataaggtttccttttctatgttatttttttcaattttctaatttgcacattaggtcttaaatctcaatttggaccttaatgtatttctattattatgattattattttattaaatgctcacacaaagaaaccacaacatgatgcatatattatttagatgtcattagctaattaatctctttaaatatagttgttcacatgttataataaatagagggcaaaacatataagagaattatctcctttcttatgatttataaatttggttattatacgtacttgccaagcgcccaagcagtagagccacaacggagtgtaccactcactacgtgtgaggccacattattatcgaccggtatcgaccatcgctgtttgaccttgcctaatctgacgatatacacgtacgtgttactctggcacgtaggaggaggatacgctacgtctacgtatttccataggagacgactgtgcttggcggggccgggtgcgtgtactgcaactgtacacatgcatgcacgagccaaaaaaaatatctccccctacgtctacgcctacactctcaggctgccgtcgctacgtactacgtatgctagcggaagcaagcaggagcagactacagcagctgccgttccttgccctgccgctctctctcccgtcccgtctcgtcgccccgcataaatgcagcggcgacgggttggttggcgccataaattacacgccaccaccgctcgacctaccagccctccttcctcatccgcctgccctgcccgtcccgtccgtccacccccttcccttctttcccctttgcttgctgctgcctgcttctcgccgtcgccgcctcaattccctcctcctcgtccgtcgcctcgtccacgcgcacctcgtcctcctctccgttcccaccacctcctcgaccgcaccgtcgtcgtctagctagcggagcgagctgcgaccagatcggagagccaagcacccaggaagagggggccggggaacaagaagaagccgccggaagccgggcgtggacgtgtggtggttttctgccggcggctgacaagtggtgtaggctacccgctctggccatggatccgtcgggcggcgcgttcctgccgccgctgcagcaagggagctcctccttcccgcggtcctccagcaacgcgtcgctcgccaggagcggcagcggcggcggcggcgttggcgccgggcgcgggaccaggggcaggaagatgatgcgcagggtctgccgcggcgtcatcaccttcatcttcgccatcggtacgtacgtctgaaacctctcgctccccatgttgctcaccgtcctcctcctatccgtaccttctgctcgatctgaattctgatccgcgctctctctctctccctctctgctctgtccttgcttactcttctgtttctgcaagggaagaggggagagattttcttcttcagttcttcttgtttggtttctgcccccatctggcagcctgatgacaggattggggcagctcatgattctggctgggcctccaaagttttcacttcatcctgcttgctttcaatcccaacaaattttcttcatggcttgactctgtttcagcttctacattcaaaaaaaaaactctgtttcagcttttgaagtgtttgcactttgtacatcactgggaattcatcggtttgcaatttgttcagacaacctcatctatgcaaccatacatcaaacaagaaatacagaatcagccttgtgtgtgtgtcgtcttcagccaccagatctttgcgctgcgacataggatcaaatttgacttttttttctgaggtttcatttgctctaatctgaagaaagccaataagtatctgtgcacgcatgtctgatgctgcaaacttaatctgagaaggcggtgggtgcatgatgcagctgggctgttcctgggagcggtgaccggcggtctgatcgggctggcgacggagagcgggctgttccgcggcaccgggatcggcgccatcaccggcgcgctcgtctccatcgaggtcgtcgactcctccatccgcctctggcaggcgcgccgatccgggatctggagcatcctctacgtggtacgtaagcatgagcactcaccactaaagcactgcagatcgatcaggatcaggatcagggtcagcagtagctgggagtaggagaccaactcgtgggcttgcttgtgtctgtgtgcatgtcggctagcttgctgaggagctgctgaattttctcgccaatctgacttgtcgcgatgcagctgaacgtgatctacagcctcctgacgggcaggctggtgcgcgagaaggtcgacccggcggtgcagcgggtggtccgcagccaggtcggttgatttgatcgctcatgcatgcgctgtgcaaacgctcggggttcgttccatggctgacgcctgatgccttaattgttgcagatgaacgcggtggactcgtcgccgttcagggagtcgccggacctgttcgaggtggaggccaccaacggcatgccgcgggcgtccatcgacaagctccccgagtcgtggatcaccgaggagtacaggcgcgacgccgtcggcgacctctccggctgctccgtctgcctccaggtaactaccgagcgatcgatctttggcgtccatcgatctacaatctatgatccgatcccatctcagacgacgggagtcgctgttctcgttcgtgaatgtgcgcaggatttccaggtcggggagaaggtgcggagcctgccggactgctggcacgtgttccacgtgccgtgcatcgacggctggctcatcaagcacggctcctgcccgctctgcaggaggaagctgtaggcggatcgaccggacgacgccatggacgatgttcttctctgcgatcgagccgatgatgtgtgtgtgtgtgcccccgccgccgccaccaccgatagctgctgctaggatcggaggagggaggagggagaagagactgacatctatagaacccttaatttatagagagggcttttgctttgctgctacttgtacgtgctctactacgtacctattgcatctttctttctttttttgatccaccatgatcgacctccctcctcagatccatccatgcatgtaatataccctggaccggcttgtgcttcgttcgatccattccatgcatctccggactgtgatctcgatctggtgtaatatatataaaaaaaaactactagtatgtaccatcgcactttggacatctatacatgcatgctggttttggtcatatttttttagaaaatattaatattcgagcttctgttcagagttcagactcgagaaacattggattccattctccaacgaaaatctcacattcaacatagtttcacaaaattaaac

SEQ ID NO: 14970 - DNA, 1566 bp, Zea mays
ggtaaattacacgccaccaccgctcgacctaccagccctccttcctcatccgcctgccctgcccgccccccggcccccccccgtcacccccttcccttctttcccctttgcttgctgctgcctgcttctcgccgtcgccgcctcaattccctcctcgttgtccgtcgcctcgtccacgcgcacctcgtcctcctctccgttccctccacctcctcgaccgcaccgtcgtcgtctagctagcggagcgagctgcgaccagatcggagagccaagcacccaggaagagggggccggggaacaagaagaagccgccggaagccgggcgtggacgtgtggtggttttctgccggcggctgacaagtggtgtaggctacccgctctggccatggatccgtcgggcggcgcgttcctgccgccgctgcagcaagggagctcctccttcccgcggtcctccagcaacgcgtcgctcgccaggagcggcagcggcggcggcggcgttggcgccgggcgcgggaccaggggcaggaagatgatgcgcagggtctgccgcggcgtcatcaccttcatcttcgccatcgctgggctgttcctgggagcggtgaccggcggtctgatcgggctggcgacggagagcgggctgttccgcggcaccgggatcggcgccatcaccggcgcgctcgtctccatcgaggtcgtcgactcctccatccgcctctggcaggcgcgccgatccgggatctggagcatcctctacgtgctgaacgtgatctacagcctcctgacgggcaggctggtgcgcgagaaggtcgacccggcggtgcagcgggtggtccgcagccagatgaacgcggtggactcgtcgccgttcagggagtcgccggacctgttcgaggtggaggccaccaacggcatgccgcgggcgtccatcgacaagctccccgagtcgtggatcaccgaggagtacaggcgcgacgccgtcggcgacctctccggctgctccgtctgcctccaggatttccaggtcggggagaaggtgcggagcctgccggactgctggcacgtgttccacgtgccgtgcatcgacggctggctcatcaagcacggctcctgcccgctctgcaggaggaagctgtaggcggatcgaccggacgacgccatgaacgatgttcttctctgcgatcgagccgatgatgtgtgtgtgtgtgtgcccccgccgccaccaccgatagctgctgctaggatcggaggagggaggaggaagaagagactgacatctatagaacccttaatttatagagagggcttttgctttgctacttgtacgtgctctactacgtacctattgcatcttttttttttttgattcaccatgatcgacctccttcctcagatccatccatgcatgtaatataccctggaccggcttgtgcttcgttcgatccattccatgcatctccggactgtgatctcgatctggtgtaatatatataaaaaaactactagtatgtaccatcgcactttggacatctatacatgcatgctggttggtcaaaaaaaaaaaaaaaa

SEQ ID NO: 14971 - DNA, 3945 bp, Zea mays
  misc_feature (3067)..(3067): n is a, c, g, or t
cacacttaaactccctcggagacatctccaaccagtcccaggctttctcaagctctcagcaatacaactcacaaatggagtagggtattacgtttcggcgtctcaaaccactctaaactctctcgcgcgttcctgccttcttcctggcggtcatccaaaccttgggcagtcggcccgttcccaggatcagggacgacaacccccttcatttgtttgtgtgtgctcgggttgggaagttagggttagggttttggggcatttggagaaaacctggtaagggttcaatcttcccttctcctgcttgcttttctaatggatgagtttgtgtctttgaagggttttgtccaggttcatcactaaatcgaaggctttgaatatctaggattaggtccgagtccgaccgtaaaccatggctttaataccacgctaattagaccttactcataaatcctagccactagatgtgttagaacaagagcttataccttcagcattggatggtgatgccattagggcgattggagtcggctcaatgactatgaggtagatagcggcaaccttccttttactgatcgtgtagagatagatcggatctctagagttgtgtttgggagagggggtgtgacgaacgttggatcacatgttggtccgctttgtatttaatgtacgcggtgtgagggggcagcaaccataagattgttgcgccctcgatcaaaacacgtggggtgagtccagttcggccgatgagatcaacctaacaaggtgaaggagctggcttatttggtaactctatatgaatatgagtagtatgtaaggaattatctacacatcctcagatagttggacgaactgtccataaaaaaaggttttcaaacagaaatgaggaactcacctggttctggccctctcacacattacactgtatcatacttaattgggatgggtaacctggattttaaattttagcatacacttaggaaaaaatgtttcaaaatcatgtgtactgttggtttgctaactctatatgagatatgagtagtatgtaatgaattatctacacatcctcttaggggaacgagaaaggtggccaagttccacattcccggtttcatttttaccacccacttgtcttgttcggtttaaagtggattgaggaggattaaatcccctcctatacaaatttgtatagaaagggattaaatctcattcaatcctccccaatccacctctaaccaaacaaggccttaggggaaaaaatgattcaaaataaccaggactattagtggcttcgtgatataccaatatgtgacaaaatagttgatgacacgagcatctaaatggaactcaatttcatgtgttgactctttgtttacagtcatcgagaggatggtgacaatggcaagcctgatatcaggttggttggtgagcagcacgccacgcctcggcgggggggcgttccatcataatcatattacagcggctgcaactgacaggcccaatgcatcttctcttccatgttggatcaacactcttgtaatgtattatttactgtgcggatctgagaggatgtgaatgatttcatttgcgtcctcaagttcaaaagattcaggaaggcatgcttgaaataaaaatagccagaaacatgcaaggtgctccacgacgcagcacggcatttccagtgttttctttttgctgtctagttctgaatatattttaccgccagaccagcacgtaagcttgcctggcaatggtttttatttgttgctatgccatctcaaaagtcaaaaccatggatttatatcaaaagtcaaaagactttgagaagtatttataaaaaaaattggtagcctagctacaatgttcctcctctctgatgcatagcataggggatggggatggggatgagatggaagaagagaaatctgatgagtcttgggcggctgtcgtgcgtgccgtctacgacaggcgcaagccgcactaggcgacctggttccatggacgctgacgctgcccgaagaaaataggggctgcagcggcagttttctcgttgaactgaccatcagaattcagacacatccacatcatcaacagcaagagttgaactgaccaccagaattcagacacatccacatcatcaacagcaagaaatacaagccgtggcaatctgtgccaaagaaataacaagcatatttataagaatatccattttggcactggaatttggccctacttcagtttactaaattatgatctgccactgcatgtcactcctgtcctgtgtacatccatcaagaacaagaggcagaagaacgaagcttaatctatctatgtatgtaaagcctaaactcccacccaaattaacaatggatcgatcaattggagtccaaggcaatcagtggtaacagcaacagctctatatatactgtttttctatcagcatctcaaatcctcaactctataacaatggcgccagcagcacagggaggcatccatccatccatgagtctgagccatcagtcacctgggggcgatggaaatggagatgtcggtcgggactttgaacttggcggcccactcctgcgcctccaggaagagcttggacaccttggcggccacccgcgacatgtccggccgcgccagggggtccttggcgacgcagagcagcgccagcgtggtgagcgactgcgctgcgtcgacggggaacgagtccctgagcctgcggtccacccacctccgcatcccctccgcgactgcggccgccgcggtgtcgatcagcgacgtcctctcgtactcgcccgtgccccggttcagcagctcgtaccgcaccggctcctgcccagacaccagctccagcagcacgacgccgagcgcgaacacgtcggagcggcgcgacggcgggccgccggccacgagctccggcgccatgtacccgcgcgtgccctcgatccgcctcccccggcttctggtgcggcggttgtccccggagccggaggagccccttgaccctcctcctcctccgtcgtcgtcgtcgtccttgtgctcgaccgggagctcgccggcgaggtcngccgcgccgaaatgcgcgatcttggcgcgcgggaggggcccgtctccgcagacgaggacggaggacgcggagaggcggttgtggacggtgtcggcctggaggtggacgtagtatagcgcgtcgcagacgtcgacggcgagctggaggcgcgagtgccaggacgcgagcggggtgaaggacgggttcttggggttccggaggagcacggacagcggggacgcgttggggaccagctcgtaggcgaggaacagcgtggtgcgatcgggcgacgcggcggcgccgaggaggcgcgcgatggcggcgtggtggcagtggcccagcgcggcgaggcgcgcggccacgtcccgcgcgtcgcggcggagtgggcggcggaaaacggcggccgggtggccgcgcagcgcgcagcggaaggagttggaggagggcgcggccgggacgaggcggtgcgcggcggagaagttggcggtggcggcggcgaggtcctggaaggtgaagaggaggggcagctccgggagggagtcgcggaacgcggcgagggacgacgccgtgaaggaggaggaggtggagtaggaggacacctcggggaaggaggtcgaggtcgtgcgcggagaccggtggtgccgcggtgtggatgccgccatggcggaggaggaggtggaggcggcgatgtcgctcttggatttgcacatccgatccggcttcctgggcttggggccggccatgggaggccctcgtgagtccggggcgtgcttgctagtcgatacagagaaggaagcttggtcctttttcgctgtctgtctctcgctttcgccggcgtgcgtgaactgggatggatgggttgtggtgagggcagggaaacatctgaacaaatctaatat

SEQ ID NO: 14972 - DNA, 1051 bp, Zea mays
gcacgagcgaacaaatacttaatctgagtcgccccacagacgtgcctgatactggattgctctgtgaccttctttggtctgatccttctaatgaagcaacaggatgggccataaatgatcgaggtgtttcatatacatttcccccgcataaagtttctgaattccttgagaagcatgatttggacctcatctgccgagcccatcaggttgtcgaagatggatatgagtttttcgctagccgccaactcgtaacaatgttttcagcccctaactactgtggagaatttgataacgctggtgccatgatgagtgtagatgagacattgatgtgctccttccaaatactgaaacctgcgaggaaggtgttgggtggttcaactaataacaaatcaggcttcaagtcatcgagaggatggtgacaatggcaagcctgatatcaggttggttggtgagcagcacgccagtggtcgacggggggttgttccatcataatcatattacagcggctgcaactgacaggcccaatgcatcttctcttccatgttggatcaacactcttgtaatgtattatttactgtgcggatctgagaggatgtgaatgatttcatttgcgtcctcaagttcaaaagattcaggaaggcatgcttgaaataaaaatagccagaaacatgcaaggtgctccacgacgcagcacggcatttccagtgttttctttttgctgtctagttctgaatatattttaccgccagaccagcacgtaagcttgcctggcaatggtttttatttgttgctatgccatctcaaaagtcaaaaccatggatttatatcaaaagtcaaaagactttgagaagtatttaaaaaaaaaaaaaataaaaaaaaaaaaaaaatctgatgcatagcataggggatagggatggggatgagatggaagaagagaaatctgatgagtcttgggcggctgtcgtgcgtgccgtctacgacaggcgcatgccgcactaggcgacctggttccatggacgctgacgctgcccgaagaaaataggggttgcag

SEQ ID NO: 14973 - DNA, 3034 bp, Zea mays
  misc_feature (1048)..(1048): n is a, c, g, or t
  misc_feature (2787)..(2787): n is a, c, g, or t
  misc_feature (3001)..(3001): n is a, c, g, or t
  misc_feature (3007)..(3007): n is a, c, g, or t
  misc_feature (3028)..(3028): n is a, c, g, or t
tctaaaattagctgtagatattcaaacactctagctaatagttaaactattagttatttttagtaaattagttattagttagctagctaatttcactaataattttttagttaactaactattatctttattacattcaaataccgcctcagcctagaacatgactgttttagcccactcaaatcttcattttttctatgcttaatattaaataaacttatatataaaaggttataaaactctccgactgtccctgtctatagtgcatttaaacaccctttagtactctgtcagatctaattagaattgatcagctacattatttagcaattgatgtctctgaaaagccatataaggtggcggcgttctcctcttgtctgcaagcacgtgacacaaaatcgcatgcatgtcaccaattcagtgttgagtcgttctttctatcacacagtcatgattcatgcgtgtacgagaatagagagcgcatgtagtgttacctagagacgatatgcttcactggatcttcttgttgtaggacgatatgcttacacactatgacatcatgaacatcgacgtgaagctagcataggccacccgataagattaatctggaccgatctatccagaaatatcagattgggggtctgtttggtttgctatcaatccatgtagattacgtgggattaagtgagtttcaattccaaacaaattaaaatctttcatattttttttcaatcctgtttaatttatatgagacctaaataatcgaacatgaccttatatggaccgagccacatcgacggacgagctgacccacgagccatcaggttgggctatgttttcgttaggatatgtatggactcgagtcggttttttctatggtccgacccgaatctgacggacccacaaatctgacccgagaaactctaaagtctaatcgcaaacagtgtgtaatgtaacgtgcgtgcttgtttgattgtatcatgcgcttatatgcaacagaacaaactcgcaaggaatctaaggatattgtaaggtcgttaggttagtntatttaggacacggcagccatggcattaattgttgctttgcttatgcaagctggttaatgtttatgttatctttttggcatcgcggcaaagggagtattgtaatcttggcatgatatatatttggctacttcggccaatcaagcatacatacatctactgaacatggacaatacctttaggtttttttagatactacactgtttttttttcgtcgagagtcccttttcgctgagagagtatatcagtttggctgatgggtctaggtctggtcatatattttatgggtctacattatattttacaaaaaaacacggcccaagcccaaacctgccacagctcggcccaatcaacacaccaaccgatgtgagtcttggccggctggttggtgggacccggcggacagcgtcgccaggctgtgttcccccaccctccaggctgcctgactcggggtcccgggcaggttccgccgcatcgtgtcgtttcttccctttcccgtttcccccgttcagttcagcttcggttggctcgccgtactcgggtttgttcctcgcctcgcttcgcttccttcctccgcagtcctcgtctcgaattcgctcgcggtgggagaaatcggggcgcgaggatgaccgtgatcgacatcctcacccgggtggacgcgatctgccagaagtacgacaggtacgacgtcgacaagctcaacggcgcgaacgtcgccggcgacgacccgttcgcccgcctctacgcgtccgtcgacgcggacatcaaccaatgcgtcgatcccgtcctctcgctctgcgtcagcggcccggagccctggatctgaatctgacgacggtctgtttggcgtttggaacagaaagcggaaacggcgaagcaagagaagaaccgggccgcggtagtggcgcttaacgccgagatccggcgcaccgaggccaagctcctcgaggaggacctccccaagctgcagcgcctcgccgttaagaaggttgccgctctagtacccgcattgcctccgctgagttataggtgaagtgtgctcgatcggcgagctctgtaacttgagggtttgtcttcgtgtttgccagtaactaaacttgcttggactgttgctggctaaaattaggctgtgcggctagagatattagattcttaggtagtttcgacacttgggaaatgatttaccaggccattttgtgaattttaaggttgttgatgacttggtggttggtgctagcatgtatgccagaatttgggggataacctctggtctggatcagtagtttgcgtattgtgtggattgggagtgagccatataggagaatttcataagattacttgcatggtgactacgtgcagactgggcagggcatgcatgggtgaaatttttaatggcttgtcagcttgtgttttgccatgttgattagaatttatacatatgttaattggttgattgtggccttcatctggttcctttgtgggcggtataggcactaacctgcactgcagttagacaatcctagaacgaggttcatcgcctcttctgtccaactctcgtacaccaatttaaatactatgaggtctccctccatgttatgtttattggtttattcaaatgcgtggttatttgtttgacgatagttgagcgctgattgttgatgtcacctcttttctgatctcatggaacttcatatactcttgttattcttgggtcaatgggtctcagcatcccacttgattntggcttacatgacccgatcttttttctctagtctggattgctttgcttctcacctgcacatttgagtttagacaagcttacatacttattcacacttcacttttcgtaaagatacaaagtttcgtctgagtgctgagcaaacaatcacttgtttggtttacttgttcttgattgaactgcttacagtttaatttagcatacctttttatatggntatatntgacggtaatacgacatgcanacattt

SEQ ID NO: 14974 - DNA, 795 bp, Zea mays
cctcgaggccggccgggccgggtcgtccaccagctgagctgcgcccgtttttagcgagcgagacaggtccgcgcgcgtgcgccggcgaggattggattggaaccgtcggtcgtcgatggggatccacctggtggcgttcgtggcggcgaggggcttcctgcaggtgttccaggtgtcggcgccgctgctgtggccgctcaacctctggctgccgctcgcgcgccacctgcccgaggcctgcgccgccttctacgacgccctcgtctcgcacgccgcccgcctgcgcgccaccgtccggcgccgccgccgcgacagcggggacgccctcgacgagtacctccgcagcgccatcatgctaaccctctccgactgagactcttgagccgagcgcgcggccaccggccagtgccaggcaacggccagtaccggaggggaggctggcgtgcacaggccggccggccggccggcgcgcgctgtgatgtgagtagccatagctaggatctgtgttatctcgtttgtttgtttgtttgtttttccttggctcgctcttcttttgctgcttttcgatcggtgcctaatctagctatctactactagcactagctagctagcatctcaagactgagcattgaggagctccgtatggtcaatctgtaactgaactgatgaccgagcccattttaatcggcttcttgcttccacaacaacatctactatgttctacacatgtaaacgtctgcctgtgcagtgtgtgtacgtaggagtgccttacatcactgtttcagattgttttct

SEQ ID NO: 14975 - DNA, 1399 bp, Zea mays
gggcaacacaccaaccgatgtgagtcttggccggctggttggtgggatccggcggacagcgtcgccaggcgctcgtccccccaccctccagcccgcctgacattggggctcggcaggttccgccgcatcgtgtcgtttcttccctttcccgtttcccccgttcagttcagcttcggttggctcgccgtactcgggtttgttcctcgcctcgcttcgcttccttcctccgcagtcctcgtctcgaattcgctcgcggtgggagaaatcggggcgcgaggatgaccgtgatcgacatcctcacccgggtggacgcgatctgccagaagtacgacaggtacgacgtcgacaagctcaacggcgcgaacgtcgccggcgacgacccgttcgcccgcctctacgcgtccgtcgacgcggacatcaaccaatgcgtcgataaagcggaaacggcgaagcaagagaagaaccgggccgcggtggtggcgcttaacgccgagatccggcgcaccaaggccaagctcctcgaggaggacctccccaagctgcagcgcctcgccgttaagaaggtgaaagggctgacaagagaagaaattgcgacccgtagtgatctggttgccgctttacctgacagaatacaatcaatcccagatggtagttctactgccacaaagaaaaatggaagttggggagcctcaggatctcgcactggaggagccataaagttcgactctactgctgatggaaactttgatgatgagtactttaaggggacagaagaatctaatcagttccgtcgggaatatgagatgcgcagaatgaaacaggatgaaggtttggacgttattggtgaaggactggaaactttgaaaaacatggcatctgatatgaatgaggaattggacagacaagtccctctgatggacgaaatggatgataaggtggatagagccaatgcagatttgaagaataccaacgtgagactgaaggagactgttcttcaacttagatcaagtcgcaacttttgcatcgacatcatccttctgtgtgtcattcttggtattgcggcctacctttacaatgttctaaaaaagtgaggtggagtcttcttgccttggaaccgctcatgtcgtggtccctttgtcaccatggttctacccagttctttgagcgatttgtggcttgttttgtcttatatctgtattattatggtgtccaagttgaaccttgactaggcttgttgaagagaacgctggtaacatgtttgctatatatctggggagtcgatttcgtagcgaggaatgattacacggcaccattcttatcgtcttatcgaaccacgggcttatgtatattcattccgtccaccaaaaaaaaaaaaaaaaaaaaaaaaaggacaggccgt

SEQ ID NO: 14976 - DNA, 1931 bp, Zea mays
cagacaaccaaacacactctaccgtatacactcagccaggccagttgtagcctggctgagctagtgcgagccaggctcgcctgtgaagcgaaacaaacgccccctacacaactttcctgttaataaaaataaagacaaaggacgaaaaaggcaggatgtggtcccaccaccagacacccgggtccacgggcggacgcaagccgtgaccgcaagtggccgtcttttacccgccgtcgccacgtcgtacgtccgtgtcgcctatctggatctctcgcgaagaacgaaagacccccttgctgtccgtcattactcattgcccaacaccaacagcagctgctcggtcgtcccgctcgcaaccggggaaggccgcacccgcgaccgcgagccgcgcagcccaacctacccgaccggcaaagtgacacagcgacgtcgccgtcctttacttaaccctccacccacagcgattcccgcctcgtctcgtccagctgagctgagctgcgcccgttttagcgagcgagacaggtccgcgcgcgtgcgccggcgaggattggattggaaccgtcgcccgtcggtcgtcgatggggatccacctggtggcgttcgtggcggcgaggggcttcctgcaggtgttccaggtgtcggcgccgctgctgtggccgctcaacctctggctgccgctcgcgcgccacctgcccgaggcctgcgccgccttctacgacgccctcgtctcgcacgccgccagcctgcgcgccaccgtccggcgccgccgacgcgacagcggggacgccctcgacgagtacctccgcagcgccatcatgctaaccctctccgactgagactcttgagccgagcgcgcggccaccggccagtgccaggcaacggccagtaccggaggcgggcgtgcacagaccggccgcccggcgcgcgctgtgatgtgagtagccatagctaggatctgtgttatctcgtttgtttgtttgtttttcccttggctcgctcttcttttgctgcttttcggtcggtgcctaatctagctatctactactagcactagctagctagcatctcaagactgagctccgtatggtcaatttgtaatgctcgtctgtgactgaactgaagaacaagaccattttaatcggcttcttgcttccagcaacaacatctactatgttctacagtctacacatgtaaacgtctgcctgtgcagtgtgtgtacgtaggagtgcctcaccatcactgtttcagattgttttctttcttgcaacgacgggatatatgccggtagtctctggagaaattatcaaaagatcacataaacggcattaatgccgtacccactcgcgattaaggagaaaacaacaagtatcaaggatgatcgtagtcgtagccgctgcgcaggcaggcgttggcgcgttttattcgtcgccaaccaagcgtgcgaatcgaaaccgtcggattagacactggtcaccactcattatcgtccactgcccgctgtctcctaccagtacgtgtactaccttcgtccaaggtcaggccactgttctctactgtctatactgtttatagatgtttatagagtttaaaatagaatgtgagatagagagatagtctaaaaagatctataaagctttttaatcaaatcttttttaaaagtttgaccagaaacagtaccaagatactagatatatacgagtagaatatgttattatttttgtctgtaactatacatatggatattattttttatggtccgaattggagataatatagtttgatttggacaagatttagaaatagattccttttttggacgatgtaggtaccggccgctggaggccagactcgcgatttctttccaacacgacgacgaccggtgcagatttcacgacttgttggccccatatattcatagctttcccgtacta

SEQ ID NO: 14977 - DNA, 1197 bp, Zea mays
gcacgagaccattacctagaacatcctaatcgaaaaatagaaggcctcttcagcttcctattctcctttctctaaaccgccgcttctgttctgatctgctccccgaaactactaaaacaaatcgaagtggggaacaaacaagagagaagggagatggcggaggcggttgcgtacgaggagcaacggcggaggcagatagaaatgaacaagcggaagctggaggagctgcagctccaccacctctccgccgccgtcagagaggccgccgccgctgccaaaccctcgtcggccaagaagcggaaggcgccggtgccgcgggacgtcgccacggagccgccaaggcggtccggccgactcgccaacctccctgagaagccaatgtaccgcgaggtcagggtgaacttgccatttccggagggcagcaagtcgaatgcgcgagtgccgctggacgctgccaactctgtggtggcggagccgctacggtggtccgaccgactcgccaacctccccaagaagcccacgtaccacgaggattcggacgaggagaggagctacgccatctctaaggccgaggagctggtgcaagagctgggctccagcttccccatcttcacccagcccatgacactgtcccatgtctccggaggcttctggctgggcctcccgaagcatttctgccgggagcacctgcctaagagtgatgagacgatcaccttggtggatgaggaggatgacgagtcagacacgttctaccttgcaatgcaggctggcctcagcactggatggaaagagttcgccatccagcacaagctgtttgatggagattgcttggtcttccaactgattgagcggacaaagttcaaggtctacataattcgagcaactttgtacttcgaaagtgatcactgatgaaactagtagcttctaatatggttattggagcacggttatgaggcagttgcgttggacaagctctcatctggaaattgctcggtatcttgaactttttgggtggcagaaagttagctgatatataaatgtttacttaacctagtatctagttatttagcagctgctaatttgtgtaattgggcttaccaattgcacggttcagaaacctgcactatgtaaggggatgttgatggccattgacctcattttataaatgattgatgtctgtccataaaaaaaaaaaaa

SEQ ID NO: 14978 - DNA, 1521 bp, Zea mays
  misc_feature (1275)..(1275): n is a, c, g, or t
  misc_feature (1409)..(1409): n is a, c, g, or t
  misc_feature (1450)..(1450): n is a, c, g, or t
  misc_feature (1483)..(1483): n is a, c, g, or t
cttagctgtgaaaagcaaaatggtcttaaacttttttctatattaattttgccatcataatcatatagactaatagtaggatcaaaagggctcgagaaaccccgccacgagcaggatctgctggacagcgaacgtgtgtgtatttccgcttgtgagtgtctattttttttaaatgctaaactattgagaagtgtggttaattggaaggtgttgaagatgtgtttttgttttaatttttatcataaattctgaactggaagaacgttttggtaactctcacagatactctaacctaatcagatggaaacgagaaattgcctttcccagagtcaaccaaatacgtagctgtttaatcatgttaatgatgtggaagcacgtccttttcatacttttatttataagtccctctaaaatagggctctagtgttagtcatagtcttataattttgttcctttaaattagtatcactattaatataactatttttgattgtaataatcgatttgtattagctgtacgcattattattactaaagttggaacttgtgtttccgttataaaaaaaaatgcatcatagcaatgcggggtcggcagaattcaaattttcaattttcgaacccttctgccgttcgtgtgcacctggatggggtccataaatatagaaggcctcttcagcttcctattctcctttctctaaaccgccgcttctgttctgatctgctccccgaaactactaaaacaaatcgaagtggggaacaaacaagagagaagggagatggcggaggcggttgcgtacgaggagcaacggcggaggcagatagaaatgaacaagcggaagctggaggagctgcagctccaccacctctccgccgccgtcagagaggccgccgccgctgccaaaccctcgtcggccaagaagcggaaggcgccggtgccgcgggacgccgccacggagccgccaaggcggtccgaccgactcgccaacctccctgagaagccaatgtaccgcgaggtcagggtgaacttgccatttccggagggcagcaagtccaatgcgcgggtgccgctggacgctgccaactccgtggtggcggagccgctacggtggtccgaccgactcgccaacctccccaagaagcccacgtaccacgaggattcggacgaggagaggagctacgccatctctaaggccgaggagctggtgcaagagctgggctccagcttccccatcttcacccagcccatgacactgtcccatggtctccggagtcttnctggctgggcctcccgaagcatttctgccgggagcacctgcctaagagtgatgagacgatcaccttggtggaatgaggaggatgacgagtcagacacgttctacctcgcaatgcaggctggcctcagcactggnatgggaaagagttcgccatccagcacagctgctttgatggnagattggctggtcttccccactgatgagcggancaaagtcaaggtctacataattcgagcactttgtactt

SEQ ID NO: 14979 - DNA, 1116 bp, Zea mays
gagcaggatctgctggacagcgaacgtgtgtgtatttccgcttgtgagtgtctattttttttaaatgctaaactattgagaagtgtggttaattggaaggtgttgaagatgtgtttttgttttaatttttatcataaattctgaactggaagaacgttttggtaactctcacagatactctaacctaatcagatggaaacgagaaattgcctttcccaaaatcaaccaaatacgtagctgtttgatcatgttaatgatgtggaagcacgtccttttcatacttttatttatacctccctctaaaatagggccaaatacaaaaattgagtatagttagtgttagtcatagtcttataattttgtttctttaagttagtatcactattcatacaactgttttcgattgtaataattaatttgtattggctgtacgtattatcattgctaaatccggaattcatattttcattataaaagatgcattctagcaatgcggggtcggcagaattcaaattttcaattttcgaacccttctgccgttcgtgtgcacctggatggggtccataaatatagaaggcctcttcatcttccctcgctcctttctctaaaccgccgcttctgttctgatctgctccccgaaactactaaaacaaatcgaagtggggaacagacaagagagaagggagatggcggaggcggtggcggtggcgtacgaggagcaacggcggaggcagatagaaatgaacaagcggaagctggaggagctgcagctccaccacctctccgccgccgtcagagaggccgccgccgctgccaaaccctcgtcggccaagaagcggaaggcgccggtgccgcgggacgccgccacggagccgccaaggcggtccgaccgactcgccaacctccctgagaagccaatgtaccgcgagtcagggtgaacttgccatttccggagggcagcaagtccaatgcgcgggtgccgctggacgctgccaactccgtggtggtggagccactacggtggtccgaccgactcgccaacctccccaagaagcccatgtaccacgaggattcggacgaggagaggagctacgccatctctaaggccgaggagct

SEQ ID NO: 14980 - DNA, 1776 bp, Zea mays
gcacgagaccattacctagaacatcctaatcgaaaaactctctcccgcgggtctcggcctcctctcctcggctcgctataagcaggctccaccgcttccgcaatggccacctaattcgctcggcgtcgggggagaagagaagcgcgcgcgatggcaccgggaagatctcttcgccctgcggggacggcggcggttctgtgggcggcgtcgctgctgctgctggcgacgtcgtgcgcgcgcgcaggtggcgcgtacgcggggccggggtgccggaagcacgtggcgagggtcacggagtacggcgcggtcggggacgggaggacgctcaacacggcggcgttcgccagggctgtggcggacctggcgcggcgcgcgcccgacggcggcgctgcgctggtggtgccgccggggaagtggctcacggggcccttcaacctcaccagctgcttcacgctctacctcgacgagggcgccgagatcctcgcgtcccaggacatgaagcattggcccctcatagctcccctgccgtcctacgggagaggaagggacgagcctggcccaaggtacagcaatttcatcggaggatccaatctcactgacgtcatcatcacgggcaaaaatggaacgatcaacgggcaggggcaggtctggtgggacaagttccacgccaaggagctcaagttcacccgcggccacctcctcgagctcctctactctgacaacatcatcatctccaatgtcaccttcgtcgacgcgccgtactggaacctccaccctacctattgcaccaatgtgaccatcagtggcgtcaccattctcgcgccggtgaattcgcctaataccgatggaattgacccggattcttcctcgcgtgtcaagatcgaggactgctacatcgtctccggcgacgactgcgtggccgtgaagagcgggtgggacgagtacggcatcaggttcaacatgccgagccagcacatcgtcatccggaggctgacctgcgtctcccccacgagcgccatgatcgcgctgggcagcgagatgtccggcggcatccgcgacgtgcgcgccgaggacagcgtggccatcaacacggagtcggccgtcagggtcaagtccggcgccgggaggggcggcttcgtcagggacatcttcgtgcgcggcctcagcctccacaccatgaagtgggtgttctggatgaccggcaactacgggcagcaccccgacaacacgtccgaccccaacgccatgcccgaggtcaccggcatcaactacagcgacgtgttcgccgagaacgtgaccatggccggcaggatggagggcatccctaaggacccctacaccgggatctgcatatccaacgtgaccgcccgcctcgcgccggacgccaaggagctgcagtggaactgcaccaacgtcaagggggtcacctcccacgtctcgcccaagccgtgcccggagctcgccgcggagggcaagccgtgcgccttcccggaggaagagctcgtcatcggcccacccgagctgccgaagtgtagctattgaggccgattgccaaaagagatcattgatcatataggctcttcggtgatagtctagacaagcagtatgagaaatgcagctgaaatacgtttgcattacagtgtccgtctcacattactgcttcctccgattacaatgtctggcagtggtataacttgtgactacaaattatgcatcaagaagaaatcagcaaaacggacatgatcattgcaaacctttttcataggtgcacaagtt

SEQ ID NO: 14981 - DNA, 4184 bp, Zea mays
tagtaaataatattcgataagcaacaaaatatattgttgatagcaatccattctccttaacaaactcaaaaaatatattggtatagtaaataatatccgtttctatcatatattcttattggactttgtgtgcggtggggcccctgggagatgggggcctaggtcggccgcccctcccgccctacttcaggcacggccctgtctcaaacgaacaagttcttcatggaaggtctgttcgtttttcacggattgaatacctggaacggttcttgaccggattgtttctctaatttatgtaagttttgacaagttggaatgaattctggtctaatactggacaaacgaacgggccctgagtatatctcaagctccagccgtgtactcaatcatccctgagccaccgttccagtcagaagtttctttgaaccatatcatgtcgcggacagtattggatcagtagttggggcacccagctacatccgccattcttccattatgtctcgcagttgaaggtgcaggcaggctctacgggagcagtggactgaacacgtccagcctgccgaggccgtccgtcttcctatttttttctccatcgcctcgaaggaagccggcaagccgcacgcttgcggcggaatacttcggcagccacagcgtcatgctacagctcctgctcacgggcttccgtcccatccgtcacctctggatccttccttccctcctcgctcctcggggagacgaggtccctccctgtcgctcacggctcacctctggattcggtgagctgggcgtctcggtgcgggtgcgtccgtcacacacgctagtagcctactcctagtacagtactactagtacttggaaaggggttcgttgggcagctctggtcgtcttcccggtggacaacaaacccgcgttttcccacggccaccgtccccaacattcgcggattccagccccgcctcctctcccccttccttgttcaatggtcaaaacccacacacctcccccgcacgcagtcgtcttttcctccctgacccgcgttcctttatatatatttccccccaattccaccaccaccggcctcctcttcgtcctcatcaacccctgctcccccgccgtcgcctgctgttccgtgaaggactagtaatccatcggtccactgcctcagctatgttgcagctcgcggcgcggtcgctgctgctgttcttgctcctggtctcgccagctgtggcttcagctggcatcgcgaagctcaactcctcgtcgcccctctttggcatcgagttcccgccgttcaacaccgccgtcgccgacaccggctgcgacagcaagttgggtgcagccgaggacgcggcggatgagcagaagccggcgagcccgtcctcgtcgctgaagctgcacatgacccaccgccgcggcgccgaggggggcaggacgcggaaaggttcgttcttagatttggccgagaaggatgcggtccgcgtcgaggcgatgcaccggagagcggcgtcctcgtcctcgtctccgcggcgtgggcgggcgctgtcggagtcggagcgcgtggtggcgacggtggagtccggcgtggcggtcgggtccgccgagtacctcatggacgtctacgtcggcacgccgccgcggcgcttccagatgatcatggacaccggcagcgacctcaactggctgcagtgcgcgccgtgcctggactgcttcgagcagcgcggcccggtgttcgaccccgccgcgtcctcctcctaccgcaacctcacctgcggcgacccccgctgcggccacgtggcgccgcccgaggcgccggcgccgagggcgtgccgccgccccggggaggacccctgcccgtactactactggtacggggaccagtccaacagcaccggcgacctggccctcgagtccttcacggtcaacctcacggccccgggcgcgtccagccgcgtggacggcgtggtgttcgggtgcggccaccggaaccgcggcctcttccacggcgcggcgggcctgctgggcctcggccgcggcccgctgtcgttcgcgtcccagctccgcgccgtctacggcggccacaccttctcctactgcctggtggaccacggcagcgacgtcgccagcaaggtggtgttcggggaggacgacgccctggcgctggcggcgcacccgcggctcaagtacacggcgttcgcgcccgcgtcgtcgccggcggacacgttctactacgtcaggctcacgggcgtgctggtgggcggcgagctgctgaacatcagctcggacacgtgggacgcgagcgagggcggctccggcggcacaatcatcgactccggcaccacgctgagctacttcgtggagccggcgtaccaggtgatccgccgcgcgttcatcgaccggatgagcggctcgtaccctccggtcccggacttcccggtgctcagcccgtgctacaacgtgtccggcgtggagcgacccgaggtgccggagctgtcgctgctgttcgccgacggtgccgtctgggacttccccgcggagaactacttcatccggctggacccggacggcatcatgtgcctggcggtcctgggcaccccgcgcaccggcatgtccatcatcggtaacttccagcagcagaacttccacgtcgcctacgacctgcacaacaaccgcctgggcttcgcgccgcgccggtgcgccgaggtgtagccgccgccgagagcctgcccgagaggaccaacaattccaactcggtcctcggcttgattgaatgcattgggtgtagatactttttggtcaaagtataaagttttgttttttttttctctttgcacttttcaacgaggagagaagataggaacgttgtagtgctagagcctagaggtcgttgcaacgggaaacacgggatttgaataaatggctaaaattgaggattgcaaaaacacacgaatttcatatgtggtgtttgaaacacagaatttgaaaatcgaggaccttagactaatacacagtattctttggcaaaatacgtatataattaaagatcaagtcattatgtcatccactaatttgttgtgattttttaatgcctcgtttcttgtccttttcgtcttatggagacgaggataagccgataagatggctaagctgcaaatacttgttgcctctccatgcatggttgcttctcctttcttgcatctttcttatatatctttgagcctcgtacgggtgacggctagtgtctgcaactgcaagccatggccgtgaccactgctcctccgggcatgtccacaggcggcatgtcggcgacaaccttgatgccgtacaaccacaaccagcgcacggagacggtgtggcggactggcggggcaccttgcagagcgcggggaaaggagctgctggcgcgcggtggtctatcgctgcctctagatgcagttggggaaggagatgcacgcaaggtcatcaaggtcgtcgctcgtcagtggaactagtgaagtccgtcatgaaaatggctcttcgatcgctattagcaagtgaccagtccatccttttacgtaggaaagggacgcgtggttcctatcatccaaacgcatggtgacgtgagcaaaatggaggaaagtcttgttcttttgaaatttatggctaatttagaaacaccattcttccaatagatttttatttttctaaagaaaaaagtttatttattcttgagaaaataggaatccttttaaaaatggtgttcctaaactagcctttatacagaaaaactccatttcaaaacgggacctacaccgataagacaagattccgtctctgcacatagcgctagcgcatcgagtatcgatggtaaattttagcagctcatgcaaaagaggcccgcccgttccttcttggccttctcagtggcttctctgagccattggtttcctcttgacgtcaaaattcaaaaaagatgtccgagttaagaattatggcacctatttggctattcgaacatctgcataaagaatctgtacatgatatgagaagaaaataaccttgtataaatgtagaccaaaacatacatatatgaagcctcaggcagcttttgctaatactttatcaaatgaaatttacattgtcggtagcttctcaatggagcgaggctaagctgacagctatatatggcatttagaggtttcaaactc

SEQ ID NO: 14982 - DNA, 2640 bp, Zea mays
cggtacccttgaaggtgcaggcaggctctacgggagcagtggactgaacacgtccagcctgccgaggccgtccgtcttccttttttttttctccctcgcctcgaaggaagccggcaagccgcacgcttgcggcggaatacttcggcagccacaacgtcatgctacagctcctgctcacgggcttccgtcccatccgtcacctctggatccttgcttccctcctcgctcctcggggagacgaggtccctccctgtcgctcacggctcacctctggattcggtgagctgggcgtctcggtgcgggtacgtccgtcacacacgcgagtcctagtacagtactactagtacttggaaaggggttcgttgggcagctctggtcgtcttcccggtggacaacaaacccgcgtttttccacggccaccgtcccaaaaattcgtcgattccaaccccgcatcgcctccccctgccgcgcccgcggcgaaacccacgcatctcgccccccgccggggtcttccccgacccgcgtttctttattatattttcccccaaattccacctccaccaacctcctctcccaccaccgcccccgccgtcgcctgctgttccatgaaggactaatccgtcggtccacttctcagctatggcgcagctcgcggtgcggtcgctgctgctgtccctgctcctggtctcgccagttgtggcttcacctggtattgtgaagctcaactcgtcgtcgaccctcttcggcatcgagttcccgccgttcaacaccgccgtcgccgcgaccggctgcgacagcaagctggttgcagccgacgaggcgggggatgagcagaagcagccggcgagctcgtccccgtcgctgcagctgcgcatgaagcaccggtccgcggaggggggcaggacacggaaagagtcgttcttagataaggccgagaaggatgccgtccgcatcgagacgatgcaccggagggcggcgcgctccggcgtggcccggatgccggcgtcttcgtctccgcggcgggcgctgtcggagcggatggttgcgacggtggagtccggcgtggcggtcgggtccggcgagtacctgatcgacgtctacgtcggcacgccaccgcggcgtttccggatgatcatggacaccggcagcgacctcaactggctgcagtgcgcgccgtgcctggactgcttcgagcagcgtggcccggtgttcgaccccgccgcgtcctcctcctaccgcaacgtcacctgcggcgaccagcgctgcggcctcgtggcgccgcccgaggcgccgagggcgtgccgccgccccgcggaggactcctgtccgtactactactggtacggggaccagtccaacactaccggcgacctggccctggagtccttcacggtcaacctcacggccccgggcgcgtcccgccgtgtggacggcgtagtgttcgggtgcgggcaccgaaaccgcggcctcttccacggcgcggcggggctgctggggctcggccggggcccgctgtcgttcgcgtcccagctccgcgccgtgtacgggcacaccttctcgtactgcctggtggagcacggcagcgacgccggcagcaaggtggtgttcggggaggactacttggtgctggcgcatccgcagctcaagtacacggcgttcgcgcccacgtcgtcgccggcggacacattctattacgtgaagctcaagggcgtgctggtgggcggcgacctgctgaacatcagctcggacacgtgggacgtgggcaaggacgggtccggcggcacgatcatcgactccggcacgacgctgagctacttcgtggagccggcgtaccaggtgatccggcaagcgttcgtcgatctcatgagcaggctgtaccctctgatcccggacttcccggtgctgaacccgtgctacaacgtctctggcgtggagcgaccggaggtgccggagctgtcgctgctgttcgccgacggtgccgtgtgggacttccccgcggagaactacttcgtccggctggacccggacggcatcatgtgcctggcggtccggggcaccccgcgcaccggcatgtccatcatcggtaacttccagcagcagaacttccacgtcgtgtacgacctgcagaacaaccggctgggcttcgcgccgcggcggtgcgccgaggtgtagtgtatagccgccggcgaggcctcctgagactgagaggacgaacaattcgaactcagtcctcgcttgattgattggattgggaggcaaattgggtgtagaaatttttggttgggaaggacggtggcacgtacgcaagctctaatacatagttttttttgttgcatttatctccaaggagagaaggttagggatattttattaaggaccgtgcaggtgggttgtaacgggaaaatactgattttgttcccatgtacaatacccgtttcttcactcaaattttagaaattgtaagttgtagattaagaatgagagtgcacacaatcttttttttaagtaattgctcatgaagatatgattacaactacggaatagattccatcttttagaatatcatgcacaaattattcttattctatcaaatgctatgtaaggccctatttcaatgtcaagaaaaaaaaaaaaaaaaaa

SEQ ID NO: 14983 - DNA, 2350 bp, Zea mays
gcacgagaccattacctagaacatcctgatcaaccaaagttagtattcagtttccttatcggctgctgcccatttcgccccctcccgtcttttcccttccgcgtcggtctcctcccccactcttctacttcttgctgtcgtcgtcttctctcgactccccgtcccctccctctgcctctcccacccgccgcttccggattccgccgcccgtgccctcgccaccaggaattccactcggagtaaggagtgttttcccccgctgcttgcttcgcttctccggtcccgggacccgccccgctttcgcccgacttagattccacttctgtccgttcgctcgctcgctcgctcgtttgctcttatcccccttgctttgctcgttcgttcgattggagctagccgctgcgtggattcctcggctcgccgtccggatctggcctcgctgagctgcagctgccgcgaatcccgactcgattcggccgcgctcggatctcgccggactagcggggaccgaggcctctcgattcgcctcgggggcgagatggatcatgtggtcggaggcaagttcaagctcggcaagaagatcgggagcgggtcgttcggggagctcttcctagctgtgaacgtgcagaccggagaggaggtcgccgtcaagctggaaaatgtcaagacgaagcacccgcagcttcactacgagtccaagctatacatgcttctccaaggaggaactggcattccgcacctgaagtggttcggcgttgagggggagtataacgtgatggtgatcgatcttctcggccctagccttgaggacttattcaactattgcagtagaaagttttctctcaagaccgtgctcatgcttgctgaccaaatgattaatcgggtcgagtacatgcatcaaaaggggtttctgcaccgtgatataaagcctgataattttcttatggggcttggtaggaaagccaatcaggtatatataatagactatggactcgcaaagaaatatagggatcttcaaactcataagcacatcccatacagagagaacaagaacctcactggaactgcacgatatgcgagtgtcaatacccaccttggcgttgaacaaagcaggagagatgatttagaatctcttggttacgttcttatgtacttccttaggggcagcctaccatggcaggggctgaaagcagggaccaagaagcagaaatatgacaaaatcagcgagaaaaagatgctcactcccgtggaggtactctgcaaatcgtatccatcagaatttatctcctatttccactactgtcgttcattgcggtttgaagacaagcctgattactcttacctgaagagactattccgcgatctctttattcgggaaggataccagtttgactatgtgttcgactggaccattctgaagtatcctcagataggctccaacccgcggatgagggcaggtgaaaggactagtggagctgctggaccctcaatggacaagattgagaaggccacaggagaagcagccggtagaaggaatcttagtggtcctgtgaaccagactgacagttatgcacaacgaccgcgtgagaccgtatctatgtcattaaaggaaattatgcatagcactgaccggtctggggaaaggaccatggagagaccacgtacatcctcgcgcacaggcagtgcatcccgtagagctgttgcatcaagcagcaggcaggcctcatctgtggaaccaagtgagcagcagtatagccgggcaagcagattgttctctagcaacagtggcagtcgcccatctagcacccagagggtgaacccatcgccaggcgaggcaagggctacctccctctcacgggcggcagtcgcgagaggcgcccgcgacgagccactccaccgcagcctggagcttctgtccctcggtggcggcgggaaaaggaagtagtggcaaggaaagcgagcatctgagagcgggcggaagggaagaacgcttgtttgcgactctgtaaatgacaggattcgtcaacagtttccctggggcttcccatagtttccttggtgctccggtctgttgtaccattgcttcatagatagcaacgattccttgttaaacgtgtgctgtgttgcaggttgcgttagggccaagtcctagcctttgtgatggtgattacatttaggggtggtcaagattcacttatttatgtttcttcaccctttcctggactcggcgacttttttcatgtcgaactctgaattttcttattcaacagaagttgataaaaaaggacttcctgtgtaaaaaaaaaaaaaaaaaaacccgtggggggccccactagacaaaaaaaaacaa

SEQ ID NO: 14984 - DNA, 2709 bp, Zea mays
tgtccggcgctcccccgggccggccgggaaatcatcgtccccctccggcccctcctttcccttccgcgcctccctcgtcttcttctcgtctccactccccctctcccaagtcccacccgccgctcccgcccccgtgcgctcgccgacacggtcagtagttccactcggagaaaggaacgcttccccctgcctgtctcgccggatccgttgccccgctgcagtttcgcccgccgctttcactttcgctttcactcgatttagattccatttccgttcgttcgttcctgtttcccttgctcgttcgttcgattggagctagcctccgcctggatctggcctagccgagccccgccggctctgaatcccgattcggttcggctcccttgctctgcggtcgcttccgaggcgtgctcggatctcgtcggagtagagggcctcgcggctcgcttcgggggcgagatggatcatgtggtcgggggcaagttcaagctcggcaagaagatcgggagtggatcgttcggggagctcttcctcgccgtgaatgtgcagaccggggaggaggtcgccgtcaagctggaaaatgtcaagacaaagcacccgcagcttcattacgagtccaagctatacatgcttctccaaggaggaactggcattccgcacctcaagtggttcggcgtcgagggggactacaatgtgatggtgatcgaccttctcggccctagccttgaggacttgttcaactactgcagcagaaagttctctctgaagactgtgctcatgctcgctgaccaaatgattaaccgggttgagtacatgcatcaaaaggggtttcttcaccgtgatataaagcctgataatttcctcatggggcttggtaggaaagccaatcaggtctggtcctatatatgtgcttaattcttgctgtccaactcgttatatttgaaccaaaagtttttacatgcattctgcctcttgctttgcttgtgctgcacttgaggatccccaaagatcctgcactactgatttggatgggtggggtttagtgcgttatgtgatgtattgcttacattcgatgatgatttcctttttaatgtgcctgcattttacagtctgctacccataatttatttcttttatctttggctaatgctgtatggtttccttatctatttagctgctattatgttatgttccagaaaacacctcttctctggaattgagatctcttggtactaattgttgttgaacttttactggcttttgtggcaggtatatataatagactatggactagcgaaaaaatatagggaccttcaaactcataagcacatcccgtacagagagaacaccccccgcccgggaactgcacgatatgcaagtgtcaacacccaccttggtgttgagcaaagcaggcgagatgatttagaatccctcggttatgttcttatgtacttccttaggggcagcctaccatggcaggggctgaaggcaggaaccaagaagcagaaatatgacaagatcagcgatgaaaaagatgctcactcctgtggaggtactctgcaaatcgtacccatcagagttcatctcctacttccactactgccgttcgttgcggtttgaagacaagcctgactattcttacctgaagagactattccgcgatctctttatccgggaaggataccagttcgactacgtgtttgactggaccattctaaagtatcctcaaataggctccaacccacggaccagggccggtgaaagaactagtggcgctgctggaccctcaatggataggattgagaagaccccaggagaagcgtccggtagaaggaaccctagtggtcctgtgaatcagagcgacagttacgcgcaacggccacgcgagaccgtatccatgtcgctaaaggagattatgcatagcactgaccggtctggggaaaggactgtggagagaccacgcacgtcctcacgcacaggcagcgcatcccgcagagccgttgcgtcaagcagcaggccagcaacctcgtccatggaaccaagcgagcagcagtatagccgggcgagcagactgttctctagcaacagtggcagccggccatccagcgcccagagagtcaaccctgcgccgggcgagtctagggccacctccctttcgcgggcagcggtcgcgagaggctcccgcgacgagccactccaccgcagcctggagctcctttcccttggcagcggcaagaggaaatagcgggaaggaagccgatctgatagcggaagggaaaagaatgcctgttggcgactctgtaaatgacggggcatgtcacctgttcttcgccagcagttcttcccctggggcatcccgtaatttcatggtgcccgccccggccttttaccatggctccgtagatagcaataattcgttgttgaatgtgcgtgctgtgttgcagtcgcgttagggccaagtcctagcctttgtggtgattagatttagggggtggtcaagattcacatatttatgtttcttaaccctctcctggacttggcgactcttttttttaccccctcccgagacaagtgcccgtgcgtttcttgttgaactctgaatttgcttattcaacagaagttgataatgataataaaagaagaggcatcctgtgtaaatcgatgcctcattttcttcctgcctgtcaggctgtcagcgcccgtcagcag

SEQ ID NO: 14985 - DNA, 1342 bp, Zea mays
gcacgaggggaatccctggctctaaacaagccctaaactttttacaagtgggcatattagcatataccatacagttttccataggggaccggtaccccgatcgcggccggggaacgctctggagtcgaccgtggacttcgaaaattctcttcagcggcagcgctaaaccataaggcaatggcggcggcggcgaagagcgtatgcgtgaccggcgcgggaggcttcatcgcgtcttggctcgtgaagctcctcctctcccgtggccagtacgtggtccgcggcaccgtgcgcgaccctggtgctagcaagaatgctcatctcaaggagttggagcgggctggggaaaggttgcagcttctccaggctgatttgttggactacagcagtgttgcatcagcaattgctggctgtgagggtgtcttccatgtagcttgccctgtcccttctggtcggtcctccaaccccgaggtggaggtcataggtcctgctgtagtaggaacaaccaatgtgttaaaggcttgctatgaggcaaaagttaagcgagttgtggtggtgtcttctgtttcagctgtattcagtaaccctaattggcctaaggacaaggtctttgatgaagactcttggtcagacgaggattattgcaggaagaatgaggattggtattatctttctaaaactctatccgaacgtgaggcttttgcttttgcagcaaaatcggggctggatgttgtaactatttgcccgtccttggtatttggacccttgatgcagtctatagtaaatacgagcagtaaagtactccttaattatttcaaaggagatcgtgagactgttgaaaacagactcagaaatatggtggatgttcgtgatgttgctgatgctcttgttctggcttacgaaaatccagaagcatctggacgatacatctgcagctcgcatccattaaaagtttctgatatgataaacatattgaagaccttatatccatcttacccttatcctaaacactttgtggaaacggatggcaacatcacctgcagttctgagaaacttcagaagctagggtggaccttcagggctatagaggaaaccctgcgtgatagtgttgaatcctacaaagcatttggcatccttaactgagcatccgactgggacagtgagacagcagttccaacagtccaatccctatctcgttcatataaaccgtgaaacagaacatgctgttcatgtacatttgcaataaaaaattgggaaatttgtagccctctactgaacacttgatcctagcaagaggcttgcaaggttgtgttgtctggtctgaaaaatatgctattctgaggct

SEQ ID NO: 14986 - DNA, 1559 bp, Zea mays
cctcgaggccgaaaccctcccttgccttgccggcagttgccccaaaaccccagccaccaggtaccaatggcggccaccgcgatggaccatgacggcggcgacgacgtggtcacaccaggggagcttctcggaaactcattaaccctcgcggccggacgtggcgcctacgccgacggtcgctctgtgcgcgcgtcggtcaccgggcgccgccgcatcgtgccgcccgcacctggctccgacgaccagagatccacggtggaggtggtggggcacaaggcccatggagctgtgccacagccgggaagcgtcgtcatcgcccgagtaacaaaggttatggctagaatggcctctgcagatatcatgtgtgttgactcaaaggctatcagagaaaagttcactggcatgataaggcagcaagatgttcgtgcaactgaaattgacaaggtggatatgtaccaatcatatcgtcctggggacattgttaaagctatggttctttctcttggtgatgcaagggcatattacctttccactgcgaaaaatgaacttggagtcgtttcagcacaaagcatagctggtggtacattggttccaatcagttggactgagatgcaatgtgatttgaccggtcaaattgagcaaaggaaagttgcaaaggtggaatagatgtgctgtggccctcctgataaatggtaaacatgtggtggcggtatacaaattgtggaccagtgacaccaggtccttgggcggactacccaattctgcgacgtccaacttcattacagctgcattgagcatgggtttttaaaaccctggctgaatttaactagacatgaatcgtagccatgggtcctgtaacccaaccttgggatctgaatcatagccatgggttctgtaacccagtaaccttgcccttgtgatttgttactctgtgagctaatgacattgcagttttccaccttgtgatttctacaaaaaaagttttgttgcgcattgttgagaacttgagatctgttgctgtctttctggcatgatgtcaaatggctgtaccggacttgtttcaaacggatcgggggtcagtaccactgattcatttctcgccgggaaatcaccgaattatggtgaacttacccgttttcgatgctgaccgagatgtgatttcggttctaaattcaaaaaaataaaagtcaaacttaaactttgggaaaaaaacaaaattcgctacagtaaaaacgaaacggtgaaccctggtcagtactcactttctccccaaaaaaagaatgcaactatgggttgcttgctatagttaaattgcttcatgtttgataattttctaaagaatggtgttctcatttatatccctaaattaatttattatagaaataaattacatatatactctgatggtatttattcaatattattataagtattgatattttttatttattgttgatcaaatttaagatagtaaaagcggtttggtttactatctaactcaccatagtttatctaacttttttttgtctaatgttaaggcatgtttgatactttgtttt

SEQ ID NO: 14987 - DNA, 956 bp, Zea mays
ctcgaggccggccggccggggcccccaaaccccagccaccagctataccaatggcggccaccgcgatggaccatgacggcggcgacgacgtggtcacaccaggggagcttctcggaaactcattaaccctcgcggccggacgtggcgcctacgccgacggtcgctctgtgcgcgcgtcggtcaccgggcgccgccgcatcgtgccgcccgcacctggctccgacgaccagagatccacggtggaggtggtggggcacaaggcccatggagctgtgccgcagccgggaagcgtcgtcatcgcccgagtaacaaaggttatggctagaatggcctctgcagacatcatgtgtgttgactcaaaggctatcagagaaaagttcactggcatgataaggcagcaagatgttcgtgcaactgaaattgacaaggtggatatgtaccaatcatatcgtcctggggacattgttaaagctatggttctttctcttggtgatgcaagggcatattacctttccactgcgaaaaatgaacttggagtcgtttcagcacaaagcatagctggtggtacattggttccaatcagttggactgagatgcaatgtgatttgaccggtcaaattgagcaaaggaaagttgcaaaggtggaatagatgtgctggccctcctgataaatggtggtggcggtatacaaattgtggaccagtgacaccaggtccttgggcggactacccaattctgcgacgtccaacttcattacagctgcattgagcatgggtttttaaaaccctggctgaatttaactagacatgaatcgtagccatgggtcctgtaacccaaccttgggatctgaatcatagccatgggttctgtaacccagtaaccttgcccttgtgatttgttactctgagctaatgacattgcagttttccaataaaaaaaaaaaaaaaaaagccagt

SEQ ID NO: 14988 - DNA, 2400 bp, Zea mays
taccatagaggatcccagaacattgaacaagacgttgtatctgagacctccaggaaatgtcttctcaatgaatgaattggctgacctctgggagtcaaaactcaagaaatccctgaaaaggttatatgcaacagaagagcaacttcttaaagaaatccatggtaaattgaaactgctaaaggttaagtggtagttatatttgggttgcttttgttatagctctggtgtccattgcattttcttgaagttcaatcagttcctttttcaatttaagctttaagctactgtcgtcagatacaatgtagttcaagattgatgaagttaccgatgcagttttatgatttgcgatttactgatacttcataatttagtcaatccatttcagttgttcatacgttcacctaaatagctgcaagtatatttgatcatggagcagaagtttgttgttatgtctacgaaaaagagttgaaaaaacatgaagaaagtgtgaaacctctctttcctagttgcaaactgcaagtcattttctgaaagacttctgtttcatgcataaatcatctactctcattcttcctttctcctcattgcagatgctccatttcccttgaagatggatttaatctttatatattcagcgtttgttaagggtgaccacacgtattttgaaattgacttgtcaatggaaggaactcaactgtatccccatgtaaattatacaacagtgaacgagtacttggatactctagtttaggatatttgttcggtttatatcttccttgtaataagtcaaaaataatgttttttttttgtttcgaatggagcattaaaagaaggggactgatggacacctatccatgtttgttctgacaagcgaatgtggtgatgatctgacaaatttttttatcctgtgcatacgcaatgtgatcttaggtcgcatacaaatcagtaatgggtccatatctagtgtacatctatgctctttatgaacaagctctgtgtttagcgtgatctcagaaatgataaattagaattaaggtgtactgatattttgatgaatgaattgtactgctatttggacgaatttatttttttatatattaaacgcggttagaaacggcttcccagactgtatccacgttagcttttaatttgttgtccattggatgctacatcgacacatcgacggcaaaggctaaccactagaatcgttggacttctggagacttcgatgagctccacgaagcaaacttccagcgccttcgtcctcgccaatccacatgcacagatgctcgacccgatgaaatgctgcagtgcatcctcgcgctccacgtgtccccagccgtcttgtcgtcgttgcgtcttctctggtgctccttctcacgctccgccttagcctgccaccattgtcgtctcgctcgctgctcgccaacgccctgccttgccgacggttgtaggctcctccgctcgctccaccgtctccaccacatcctcgcgatctggcaccgtgtcccttccggttccgatttcggctatgattcattatctcagtatcggtgtctccaagtgcctcttcatgatgttttgcatcgacgagtgtgacaggtcatgcaagatttctcccccttctttttcttcactggtttaattgcaacataatattcatatggagaacatgcaagtcttatagtgttcaagtagcagtggatttattgatggaattttccttttaacataatgtgctggtactgcagatggctggaatggctagagtaggagatgttgttgttggagaattatggttttctttgctatatgacccaattattcacaattcgaacaaaatcattatgccagcttctacgtacgaatcgcacagtatttgtcagtcttattcaattcaattttacagctggaacaataacaatgaacaatcttatgcaggtacagtaaccacattattcttcttaatttgctttgatgttgcatatttcagttatactcgatatgtactcttagaattttgacatagagactgaaaaggaatctgaaccaacctagttactcatttaatgagacttttcatcattatacgtatattatcttgcttaacaatgtgtaaatatcttaaggtaatcactaagccgtatgtaaggtccttgagtcatcttacctgtggcatgtatttttccttgcgttccttttttttgcccccaagacctgctcttctctgatattgtgttgatagttacctagctcatctaatactccaataatatcatttttcaaataaagctagaattatagaatttcatcaccattacttcttgcagacctcccataaaatattaaaagttcacagttctcttttccgtggacaattaagcaaccactactgctcca

SEQ ID NO: 14989 - DNA, 1161 bp, Zea mays
aatccgaacgggtttcatttctagtcatccgaacgggctgtcagctaaattctccggaacccccgttgccagccggcgatcgcgccgtgggatctcatcgaacgaagcgggcggcgacggcgatgtcaagggaggcggcgaggacgaggagccgggtcctggtggttggcgccaccggccgcctcggtggaaacatagctcaggccagcctcgccgcgggtcaccccaccttcgcgctcgttcggccccaccacttcgcacgccccgattcccccgtgctcgagccgctcgtagctgccggcgccactctgctccaggggtcactggaagattactcgagcctactcgaggcggtgcgtcaggtggacgttgtcatctgcgcggtgtccacgaagcaggtgctcgagcagaagcctctgattcgggctataaaggaagctggacgcgtgaagagatttattccggcagaatttggagcagatccaacaaaggttcaaatttgtgacatggattatggcttctatgagaagaaaattgaaatccgtcattcaatagagagtgaaggcattcctcatacttacatatgctgcaacttctttatgcgctatttgcttccttcactggtgcaacctgggctagatgctcctcctagagatgaaatcaaaatatttggtgaaggaaatactaaaggtgtttttgttaaagagaatgatgttgctaaatttacaatatgcaccatagaggatcccagaacattgaacaagacgttgtatctgagacctccaggaaatgtcttctcaatgaatgaattggctgacctctgggagtcaaaactcaagaaatccctgaaaaggttatatgcaacagaagagcaacttcttaaagaaatccatgatgctccatttcccttgaagatggatttaatctttatatattcagcgtttgttaagggtgaccacacgtattttgaaattgacttgtcaatggaaggaacccacccgtccccccacgcgtccgcggactcttcggcagtgaacgagtacttggatactcgagtttaggatgtttgttcggtttatatcttccttgtaataagtcaaaaataatgttttttttgtttcgaatggagcattaaaagaaggggactgatggccccccatc

SEQ ID NO: 14990 - DNA, 1211 bp, Zea mays
gaaaaaggttttatttctagtcatccgaaaaggctgtcagctaaattcttcggaacccccgttgccagccggcgatcgcgccgtgggatctcatcgaggcgacgacggcgatgtcaagggaggcggcgaggacgaggagccgggtcctggtggttggcgccaccggccgcctcggtggaagcatcgctcgggccagcctcgccgcgggtcaccccaccttcgcgctcgttcggccccaccacttcgcacgccccgattcccccgtgcttgggccgctcgtagccgccggcgccactctgctccaggggtcactggaagattactcgagcctgctcgaggcggtgtgtcaggtggacgttgtcatctgcgcggtgtccacgaagcaggtgctcgagcagaagcctctgattcgggctataaaggaagctggatgcgtgaagagatttattccggcagaatttggagcagatccaacaaaggttcaaatttgtggcatggattatggcttctatgagaagaaaattgaaatccgtcattcaatagagagtgaaggcattcctcatacttacatatgctgcaacttctttatgcgctatttgcttccttcactggtgcaacctgggctagatgctcctcctagagatgaaatcaaaatatttggtgaaggaaatactaaaggtgtttttgttaaagagaatgatgttgctaaatttacaatatgcaccatagaggatcccagaacattgaacaagacgttgtatctgagacctccaggaaatgtcttctcaatgaatgaattggctgacctctgggagtcaaaactcaagaaatccctgaaaaggttatatgtaacagaagagcaacttcttaaagaaatccatgatgctccatttcccttgaagatggatttaatctttatatattcagcgtttgttaagggtgaccacacgtattttgaaattgacttgtcaatggaaggaactcaactgtatccccatgtaaattatacaacagtgaacgagtacttggatactctagtttaggatatttgttcggtttatatcttccttgtaataagtcaaaaataatgttttttttttgtttcgaatggagcattaaaagaaggggactgatggacacctatccatgtttgttctgacaagcgaatgtggtgatgatctgacaaatttttttaaaaaaaaaaaaaaaaa

SEQ ID NO: 14991 - DNA, 1121 bp, Zea mays
actcctatgggcgattgggatcctcgaggccgcccggcgggatatattcgttcacagatcgattcgcaggcgggtggtcggcgtctcactatccaccaccgcgccgctccggtttaatttctcctcgaccggccagcgcaattctgtggctcgatcgatcgatcggtcataaggcaagtgagcaagctatatatatataggagattattcgagcgagctagcgagatgggttccgccgtcctcttttactgcatctgcatcgccgtcgtcgtcgcattgtcgtcgtccatggtcgccgtcgggtccgccgccccgggggaaccccccaagttcatctcggcgagcgcccttgagtgctccgctaacgtaacggaaatagcaaaggcgcgcaagctgatcgatgtccatggccacgggctgtgcccggtgcggttcgaccacacgcgcgggatcagcgcggtggccagcagctgcaaggaccgcccgctgccgtcgccggagcgctgctgcggggcgctcaagacctacgcgtgcccctacagcgagctcatcaacgacaacgccaacaacggctgcgccagcgagatgttctacgtcatcatgacacgcggcaggctgcggccgggcctcttctcgcagctgttgcgtcgaaggcccgctgggcctccagtgctgatcaacaccggcctgctgccgcccacctcccggaatctatctatctatctatctccttggaaacctatatcagacgatgccccagcgcgtgccgctgatttgatgcaagtatgcgggttttaatttgtaaatcggagtcgatccatactgagcgatacaggaacaccctgttcaattttacttgtgatgaaattgcacatgtactcatttgttgtacacacatacacacacacaaaaaacgttagaatataagaggatatatgttgctcaatcgaccgttagacaaaatgaatactcagattcctcagctcgtgtttctatgccaggtgctccttcactttcggggtcgcctttttcaaatttggatgatcggagagctctcgtagtatatattatttaaaaaaaaaaaaaaaaaaaagcggcctataggagtcgtatacgcgcgt

SEQ ID NO: 14992 - DNA, 1124 bp, Zea mays
  misc_feature (1119)..(1119): n is a, c, g, or t
acgcgcgggtcgatacagggccgcaggcgggtggtcggcgtctcactatccaccaccgcgccgctccggtttaatttctcctcgaccggccagcgcaattctgtggctcgatcgatcggtcggtcgtaaggcaagtgagcaagctatatatatatataggagattcttcgagcgagctagtagcgagatgggttccgccgtcctcttttactgcatctgcatcgccgtcgtcgtcgcattgtcgtcgtccatggtcgccgtcggggccgccgccccgggggaaacccccaagttcatctcggcgagcgcccttgagtgctccgctaacgtaacggaaatagcaaaggcgcgcaagctgatcgatgtccatggccacgggctgtgcccggtgcggttcgaccacacgcgcgggatcagcgcggtggccagcagctgcaaggaccgcccgctgccgtcgccggagcgctgctgcggggcgctcaaggcctacgcgtgcccctacagcgagctcatcaacgacaacgccaacaacggctgcgccagcgagatgttctacgtcatcatgacacgcggcaggctgcggccgggcctcttctcgcagctgtgcgtcgaaggcccgctgggcctccagtgctgatcaacactggcctgctgccgcccaccgcccggaatctatctatctatctatctccttggaaacatatatcagacgatgccccagcgcgtgccgctgatttgatgcaagtatgcggttttcatttgtaaatcggagtcgatccatactaagcgatacaggaacaccctgtatcaattttcacttgtgatgaaattgcacatgtactcatttgttgtacacacatacacacacagaaaaaaaaacgttagaatataagaggatatatgtttgtcaatcgaccgttagacaaaatgaatactcagattcctctgcttgtgtgtatatgccaggtgctccttcactttcggggtcgccttttcaattttggatgattggagagctctcgtagtatattatttacattatccaagtgttaaagttgaaaagtgtgtggggcggagtgcattcaagtttgtgttgcgcaatgatccgttatataaggngtatc

SEQ ID NO: 14993 - DNA, 1201 bp, Zea mays
actccttagggcgattgggttcctcgaggccggccgggatcagatattcgttcacagatcgattcgcaggcgggtggtcggcgtctcactatccaccaccgcgccgctccggtttaatttctcctcgaccggccagcgcaattctgtgcctcgatcgatcggtcgtaaggcaagtgagcaagctatatatatatatatatatatatatatataggagattcttcgagcgagctagtagcgagatgggttccgccgtcctcttttactgcatctgcatcgccgccgtcgtcgcattgtcgtcgtccatggtcgccgtcgggtccgccgccccgggggaaacccccaagttcatctcggcgagcgcccttgagtgctccgctaacgtaacggaaatagcaaaggcgcgcaagctgatcgatgtccatggccacgggctgtgcccggtgcggttcgaccacacgcgcgggatcagcgcggtggccagcagctgcaaggaccgcccgctgccgtcgccggagcgctgctgcggggcgctcaaggcctacgcgtgcccctacagcgagctcatcaacgacaacgccaacaacggctgcgccagcgagatgttctacgtcatcatgacacgcggcaggctgcggccgggcctcttctcgcagcggtgcgtcgaaggcccgctgggcctccagtgctgatcaacactggcctgctgccgcccaccgcccggaatctatctatctatctatctccttggaaacatatatcagacgatgccccagcgcgtgccgctgatttgatgcaagtatgcggttttcatttgtaaatcggagtcgatccatactaagcgatacccggtatcaattttcacttgtaatgaaattacacatgtactcatttgttgtacacaaacaaacaaaaaacgttagaatataagaggatgtttctcaatcgatcgttagacagaacgaatactcagattcctcagctcgtgttatttctatgccaggtgctccttcactttcggggtcgcctttttcaaatttggatgattggagagctctcgtagtaaattatttacattatccaagtgttaaagttgaaaagtgtgttcggcggagtgcattcaagtttgtgttgcacaatgatgagttatatataaggaatatcgaagaggtgttataaaaaaaaaaaaaaaaaagcggcc

SEQ ID NO: 14994 - DNA, 1125 bp, Zea mays
actagtagtgctgtgtctaatagttctagtgtcgtgccgggccggacggcagtttggccatctataactgtacatcggatacctcgaggccggccgggagtgcagacgcagcgcatgcaggtagcaatggcgggggagacgaagaagggcctggtgctgctggacttctgggtgagcccgttcgggcagcgctgccgcatcgcgctggcggagaagggcatcgcctacgagtactcggagcaggagctgctgggcggcgccaagagcgacatcctcctccgctccaacccggtgcacaagaagatccccgtgctcctccacgacggccgccccgtctgcgagtccctcgtcatcctcgagtacctcgaggaggccttcccggaggcctcccccaggctgctccccgacgccgcctacgcgcgcgcgcaggcccgcttctgggcggcctactccgacaaggtctacgaggccggcacgcggctgtggaagctcaggggcgacgcgcgggcgcaggcgcgcgccgagatcgtgcaggtggtccggaacctcgacggcgagctaggggacaaggccttcttcggcggcgaggcgttcgggttcgtggacgtggcgctcgtgcccttcgtgccgtggctccccagctacgagcggtacggggacttcagcgtggcggagatcgcgcccaggctggcggcgtgggcgcgccggtgcgcgcagcgggagagcgtggccaggacccttcacccgccggaaaaggtggacgagttcatcaacctgctcaagaagacctacggcatcgagtagtagagcggactactactagcagaggagatggtaccggccgtacgtacgtggctgccatgcagtttttgtttcggtttgtttaaacgggactccatgaatggatggaactcttcttgggctccgtgtgctacatacacatctgtaaaggtgaactaaaatcacggtaaaaactcggaaattagtttgtaaagggtccagcccccctcctttataaatagagaggtatacggctgatttgtaatcatcaatcgaatcaatacaacatctatttcgcattttaaaaaaaaaaaaaaaaaaaaaaaaagaaaaaaaaaaaaaaaa

SEQ ID NO: 14995 - DNA, 3071 bp, Zea mays
  misc_feature (1188)..(1188): n is a, c, g, or t
tacctcgaggccggcacgcaactcgatttgtgccctctccttttgcaggcaacttttgtgcagccgcccccgcttttccccccgcgaaaacccagccgccgccgccgctgccaccgccgccgccacatccagtcctgccccggggccctgaaccctagccatggcgtcctccatactctccgactgctcctcggcccgcctcctccctctccgccgctcgctcctcccgccgcgggcgccccgcctccgctcctgccccgctctagctacccccaggcgcctactcgtcgccgccaggccccagctgcttccgcgcccgcgccacatggactcggtccccgcagccaccgcctcttccgccgactcagcaaccgtctcagccgatgcgcctgccaaactgattgacgggaagctcgtggcgaagcaagtgagagaagaaatagctgtccaagtcaccaggatgaaggatgtgatcggcattgtgcccggcctggctgtcatccttgttgggtcgaggaaggattctcagacttacgtgcggaacaagaagaaggcgtgcgaagcggtcggtataaagtcgtacgaggtcaacttgcctgaggacagctctgaggaggaggttatcaagcacatagcgagtttcaacagtgacccgtccgtgcatggcatcttggggtcagtttgcccttaccaagggtgagtgtttgattttcatgactctgttgggtagtatatgtaacccatatgataggaacctagagttacaattctgcttctagtaaccaccaaccagaatatttatgttttactactttattttgcctcttaatgattaccgacctagacagtatatggcataccagggtaacatgttttgttcatgacacacccagctcagtattcttaaatggtagaattttcctatggtgcacgatatgcttctttgcttgtcttactgaataacatttcttatgtcctgaaagaagcgttaaacgtaaccctccggcaacttttgcaatggtacactgtataatatcatggattctgtggtttcctgagttggttgtcaccagtcttatgataatcattgctttatgtagatgctagaactttgttacatgcatatgtgctatccgatgctagataataagttggaacatgcaaatgctgataaagtattgattgctnttagtataaagtagtgaatggtttcttgcccaccaaacattcacatgtctgttgtgaaatcgttttgcagcatatgaatgatgagaacattctgaatgcggtcagtattgaaaaggatgttgatggctttcatccgctgaacatcggacggcttgcaatgcaaggccgagatccgttctttgtaccttgcaccccgaaaggatgcatggagttgctacaccgacacggagttgaaattaaagggaagagagctgttgtgatcggacgaagcaatattgttggaacgcctgctgcattgttgttgcaagtatgagctagctctttatttcaaatagcttaaacagccttgttaaagagtctgattaatctttctttgtatatgattatcatcagaaagcaaatgcaactgtcagcattgttcattcacaaaccaagaaccctgagcaaataacgagacaggcagatatagtcatcgcagctgttggagtcgccaacttggtcagaggggattggataaagcctggagctactattattgatgttggcatcaatccagttgatgtaagactcacttttttttcttcttcccggcatccttcttaaataaccactaccctgtagtgctatattgctattttatgttatttctatgcccccttttttggatccgtgtggctctttttgggtttcttctgtggcctgacataactttgttgaaatcaaaatgcctaattcttgttcttaacaccttcgtttttgttcagtcctgttcatttaatgctgaatgcgaccttcaaatgcaaatgtcccaatggtagatggtctctttgaatttcagtatgttagtgtgagtgtgacctacagggatactggtgtgttcctgcacaggttattaggaagttatttgtttgtcgcacatggcaccttgggtttttttattactttgtctggttcaggacctgagattcacagaactttaatcgaccaggaccatggtcccctccccaatccccagtgagaatccatttattaatactgaaaccggcttcttaaatttatgagccccatgttagagtgttccaggcgaagttttgcccagttttcattatacgcttgtgcagcaagtgatgatcaatcagacaatactcttaaacatggctctcatgttccatgagcctggttctgcatgctgtcacatccgagctgtgttctgcatatcatagtagcaagcaccgtctcttttctcctagctccttgtgtgattgtgtctccatgcaactcccttggcgatttgatttgcttaccagtgtgatttggaatgatgacgcaggacccagagagcccccgcgggtacaggctcgtcggggacgtctgctacgaggaagcctccaaggtcgccggagccatcacgccggtcccaggcggcgtcgggccgatgacgatcgcgatgcttctgtcgaacacgctcgagtcggctagacggatccacggattcaagtagccgccgcacccaccgtccgtccagcagagagaagcgaaggcgttggccctgccagccaagccagactagtgcaggggtcgtagggaaaaaataaataaataattaaataatttttgacgcagatgagatgggaaatcccagcttgacactttgttagggtattgtgcttgataaaaaatatggcaccaggtgaatctgaggtgccagtaaatcttggatgaattctgccgcacgcatccgaccggatcagcagaaacttgtctccatgccatgatctgggtacctgtgttgtgacttgtgagtgactgtggctgtgactggtgggtgccgttgtcgacgtgggataatgcctgatctgtccagttggatccccgatttcatt

SEQ ID NO: 14996 - DNA, 1699 bp, Zea mays
gggccgagcgtgcctgccacgcaacgcgatttgtgccctctccttttgcaggcaacttttgtgcagccgcccccgcttttccccccgcgaaaacccagcagccgccgccgccgccgccgctgccgccgccgccgccacatccagtcctgccccggggccctgaaccctagccatggcgtcctccatactctccgactgctcctcggcccgtctcctccctctccgccgctcgctcctcccgccgcgggcgccccgcctccgctcctgccccgctctagctacccccaggcgcctactcgtcgccgccaggccccagctgcttccgcgcccgcgccacatggactcggtccccgcagccaccgcctcttccgccgactcagcaaccgtctcagccgatgcgcctgccaaactgattgacgggaagctcgtggcgaagcaagtgagagaagaaatagctgtccaagtcaccaggatgaaggatgtgatcggcattgtgcccggcctggctgtcatccttgttgggtcgaggaaggattctcagacttacgtgcggaacaagaagaaggcgtgcgaagcggtcggtataaagtcgtacgaggtcaacttgcctgaggacagctccgaggaggaggttatcaagcacatagcgagtttcaacagtgacccgtccgtgcatggcatcttggttcagttgcccttaccaaggcatatgaacgatgagaacattctgaatgcggtcagtattgaaaaggatgttgatggctttcatccgctgaacatcggacggcttgcaatgcaaggccgagatccgttctttgtaccttgcaccccgaaaggatgcatggagttgctacaccgacacggagttgaaattaaagggaagagagctgttgtgatcggacgaagcaatattgttggaacgcccgctgcattgttgttgcaaaaagcaaatgcaactgtcagcattgttcattcacaaaccaagaaccctgagcaaataacgagacaggcagatatagtcatcgcagctgttggtgtcgccaacttggtcagaggggattggataaagcctggagctactattattgatgttggcatcaatccagttgatgacccagagagcccccgcgggtacaggctcgtcggggacgtctgctacgaggaagcctccaaggtcgccggagccatcacgccggtcccaggcggcgtcgggccgatgacgatcgcgatgcttctgtcgaacacgctcgagtcggctagacggatccacggattcaagtagccgccgcacccaccgtccgtccagcagagagaagcgaaggcggcgttggccctgccagccaagccagactagtgcaggggtcgtaggaaaaataaataaataaataatttttgacgcagatgagatgggaaatcccagcttgacactttgttagggtattgtgcttgataaaaaatatggcaccaggtgaatctgaggtgccagtgatcttggatgaattctgccgcacgcatccgaccggatcagcagaaacttgtctccatgccatgatcagggtacctgtgttgtgactgactgtggctgtgactggtgggtgccgttgtcgacgtgggataatgcctgatctgtccagttggatccccgatttcattaagaaaaaaaaaaaaaaaaaaaaaaaaaaaaaaaaaaaaaaacacg

SEQ ID NO: 14997 - DNA, 1910 bp, Zea mays
tcgggtcgaccccgcgtccgctccttcaccgtccgtccattcctccgatccgcaggaggattaggaacttaggatcggggaccggcggagcccgacgaccttctcggtccacccgcccggcgatcgaaccacggcgctcggcgagggcggggatcacggcgccgccctgcccctcatcgcggaccaggcgaaacatgccgccgccggtggcatcgtccgaagcgggagcatgtggacggcagcggcacacgtgatcacggcggtgatcgggtccggcgtgctgtcgctggcgtggagcatcgcgcagctggggtgggtggccgggccggccgccatgctcgtcttcgcggccgtgacggcgctccagtccacgctcttcgccgactgctaccggtcgccggaccccgagcacggccctcaccgcaaccgcacctacgccaaagccgtggaccgcaacctaggtagcagcagctcgtgggtgtgcatgcttctgcagcacacggccctgttcggctatggcatcgcctacaccatcacggcctccatcagctgcaggcaagaagcatacctgggcttgcggctcgctgcagtacgtgagcctgtacggctgcggcgccgcctaccatcaccaccgccactagcataagggcgatcctgaaggcgaactgctaccacgagcatgggcatgacgcgcactgcgactacgatggcaactactacatgctcatcttcggcggcgtccagctcctcctctccttcatacctgacttccacgacatggcgtggctctccgtcgtcgccgcggccatgtcgttctcgtacgccttcatcggcctcggcctcggcctcgcaagaaccattgctaacgggacgatcaaaggaagcataacaggtgttcggatgaggacgcctatgcagaaggtttggcgcgtctcgcaggccatcggcgacattgccttcgcgtacccctactccttgatcctcctggaaatacaggacaccctgaagtcaccgccggccgagaacaagacgatgaagagggcgtcgatgatctcgatcctcgtcacgacattcttctacctctgctgcggctgcttgggctacgccgccttcggcagcgacgcgccgggcaacctccttaccggcttcggcttgtacggtccgtactggctcatcgacttcgccaacgcgtgcatcatcctccacctgctgggcgggtaccaggtgtacagccagccgatattccagttcgcggagcggctcttggcggagcggttcccggacagcgggttcgtgaacggcggctcctacaccgtccggttcgcgtgcctgcgggcgtgccgggtgaacccgctgcgcgtgtgcctccggacgctgtacgtggcctccacgacggcggtggccgtggcgttaccctacttcaacgaggtgctggcgctgctgggcgcgctcagcttctggccgctggccatctacttccccgtggagatgtacttcatccagcggaacgtgcgccggtggtccgcccgctgggtcgtcctgcagaccttcagcgtcgtctgcctgctcgtcagcgccttcgcgctcgtcggctccatcgaggggctaatcagcaagaagctaggctaggctagtccgatccagtggaacaccctatctgcaggtctgtcagagagtggcagcgggctcggttattttcacagtgttgccttcctcctgcatcgggttgtaagttgtaacatatatgtcgtattgatactggcgagttcagatgttcagaagaagtagaacgcgtgtgacgattctgtgttgctgaatgccgcctatgtagtttcagttccagaatttgagggtttccatatccgcagcagtttcctctgaaaaaaaaaaaaaaaacggccgccaccgcg

SEQ ID NO: 14998 - DNA, 2548 bp, Zea mays
catttgtatgttttaatcttaaatgtatgtaaaaaacaataattcactcaattaaataaaaataaaagagaaattctatttaaaaaattggggtgttacactcgggttcaggttcttcaccgtctggaaaaatatttgttggtgtggctgaatgatttggcaacagcgcctgcatacatttcgcatacagaggagccactcacaagctctcaaacagactctacagatacctacaccgtccttatcaaggaggcaggaggaggggaaaaacattacgaaacgctaaagccactcccggctcctgccaacacaagccgttttttcctccccgagtgatctagccagacacggagccaccactcgccaggtgcctcaaatagtcgccccggacaggcaggcgcacgcaacgcaactagtctccttcaccgtccgtccattcctccgatccgcaggaggattaggaacttaggatcggggaccggcggagcccgacgaccttctcggtccacccgcccggcgatcgaaccatggcgctcggcgagggcggggatcacggcgcagccctgcccctcatcgcggaccaggcaaaacatgccgccgccggtggcatcgtccgaagcgggagcatgtggacggcagcggcacacgtgatcacggcggtgatcgggtccggcgtgctgtcgctggcgtggagcatcgcgcagctggggtgggtcgccgggccggcagccatgctcgtcttcgcggccgtgacggcgctccagtccacgctcttcgccgactgctaccggtcgccggaccccgagcacggccctcaccgcaaccgcacctacgccaaagccgtggaccgcaacctaggtagcagcagctcgtggggtgtgcatgcttctgcagcacacggccctcttcggctatggcatcgcctacaccatcacggcctccatcagctgcaggcaagaagcatacctgggcttgcggctcgctgcagtacgtgagcctgtacggctgcggcgtcgcctaccatcaccaccgccactagcataaggtagccgccgttggccggtaacaaaatttcccagtctctctctctctcaaaacttcctcacagctcaagctgcctgcagtcgtgtgcttccttccctctctttttagcgagcagggcgctgacgatggttgcttctgttgtccttctgccggttaaatttctctgaatatttttgttcttaactgcgcgtgctttgcttgtgtgttccatacgtgtcgggctgctctgctgttggatgtcgcagggcgatcctgaaggcgaactgctaccacgagcatgggcatgacgcgcactgcgactacgatggcaactactacatgctcatcttcggcggcgtccagctcctcctctccttcatacctgacttccacgacatggcgtggctctccgtcgtcgccgcggccatgtcgttctcgtacgccttcatcggcctcggcctcggcctcgcaagaaccattgctaacgggacgatcaaaggaagcataacaggtgttcggatgaggacgcctatgcagaaggtttggcgcgtctcgcaggccatcggcgacattgccttcgcgtacccctactctttgatcctcctggaaatacaggacaccctgaagtcaccgccggccgagaacaagacgatgaagagggcgtcgatgatctcgatccttgtcacgacattcttctacctctgctgcggctgcttgggctacgccgccttcggcagcgacgcgccgggcaacctccttaccggcttcggcttgtacggtccgtactggctcatcgacttcgccaacgcgtgcatcatcctccacctgctgggcgggtaccaggtgtacagccagccgatattccagttcgcggagcggctcttggcggagcggttcccggacagcgggttcgtgaacggcggctcctacaccgtccggttcgcgtgcctgcgagcgtgccgggtgaacccgctgcgcgtgtgcctccggacgctgtacgtggcctccacgacggcggtggccgtggcgttaccctacttcaacgaggtgctggcgctgctgggcgcgctcagcttctggccgctggccatctacttccccgtggagatgtacttcatccagcggaacgtgcgccggtggtccgcccgctgggtcgtcctgcagaccttcagcgtcgtctgcctgctcgtcagcgccttcgcgctcgtcggctccatcgaggggctaatcagcaagaagctaggctaggctagtccgatccagtggaacaccctatctgcaggtctgtcagagagtggcagcgggctcggttattttcacagtgttgccttcctcctgcatcgggttgtaagttgtaagatatatgtcgtattgatactggcgagttcagatgttcagaagaagtagaacgcgtgtgacgattctgtgttgctgaatgccgcctatgtagtttcagttccagaatttgagggtttccatattcgcagcaattttctctaaatatttctcctatattttactatgc

SEQ ID NO: 14999 - DNA, 1510 bp, Zea mays
tcgttcaatttctgtttgctagactgcagatgcaagtgcaataactgtcaaccaatcagcgcctagcttgaagcctggcgttacccctgtggtagagtattttcctggtacgtggaaatcatcaaaccacctcatttgttgtgtcccgcaacgcacgtacccagacctgtggacaggacgcctcggaccagccagcggtcatggccatgcacctgccagcctcatagtaatcaccttgaagcttgacatactatgctactcatcaatagactttccagtggcggctgctgtatctgaacttgttattccaggattagcagatcagatgattgtaatgaagagaattattgcttcagagataactcaacaagcacagcttcaaccattccattttattccttctggttggcatgttccagtaacagctatatacaatacaagatatggtgagactgaggagaggcaaagtgagctgcgaaaagaactgcatttaaggctaggacttcccttagatcggcctttgttgcgaatttctaatgcattgactttcggtggcatgggaaggaggaagaaaagcatgccaagaagtggttcttcgctgcttcgagacatccacagagaacttccatctagtggtgtatccggaggtgttatgtctttgattgatggttcatatgagtattatcattatcttcacgatggtattgatgacaatggatggggatgcgcatatcggtctctacaaacaattgtctcttggtacagattgcaacaatattcatcaatagatgttccttctcacagggagattcagcaagttcttgttgaaattggtgacaaggatccatcatttattggatcttgtgagtggatcggagccattgagttaagctttgtcctcgacaaactgctgggcgtgagttgtaaggttatcaatgtgaggtctggcgatgagcttcctgaaaagtgcagagaacttgccaggcattttgaaacccagggaactcctgtgatgattggtggtggagtcttggcttacacccttttgggagttgattataacgaagccagtggagactgtgcatttcttatccttgatccgcactacactggtactgacgatctcaaaaagattgtaaatggcggatggtgcggatggaagaagtctgtcgacagcaaaggccgaagcttcttcttgaaagacaagttctacaaccttctactaccccaaaggccaaacatggtgtgaaacctatggtgttcaatatgttaatagtgcagacgtgcaggttcacgaggcacagatatttatgcttgtgatagaggtttatggttgcgatagcagaagttatgatttgtaaaaaaaatttagtgagacattatattgtttttttaataaatttgtagtgagtaaattaaattaaattaacgaatttgagagttttacaggcataacactaatagctcgcgttttgcttgagacgtcatgcttaacaagtggagtctgtgt

SEQ ID NO: 15000 - DNA, 1596 bp, Zea mays
aaaacattcgatgtgataggagctaaattttagcaggggcaaaccaaacaccccctaactaataaattgactaattatttgcccactagccatttaacctctctaatatgggctaatagatcatgacaagcaaaaaatcaagactctaaatatattctaagtatttgtcgagtaattattagccactgtcaaataattataccagcaacagaccctaaaaaaacactcgtattccgtccctgctcgagctcccgatttctgaatttgttcctcgtttcgttgccagcccaatcggttcagtttcggcggtaacaagatcaactgcggtcgccagtcgattctgtgagcctgccagccatggagttgtccagttccgtctcgtccacggcggcggcggcggcgcaggcgcggctgctccggccgccgtcgtttcgccagccggggccggcgggattcgtgtcctgtaggagttacgctataaggagcaaactggtgagggcgatgcctccgatccttgctagcttccagcctgcatctcctcggtacccaagctttcaagacgcaaatggcaaaagacgaaatgttccttgttatcagagacaacaaaccccgcaggtagaagccaggtcgatggaggaggtatatgacgctttggctgaacaccttctttcggtcttgaagaatattgaacatcttgattcaaaatacattgttggtctagctggcccacctggtgctggcaagtccacagttgcctctgaagttgttcgacgtgttaatacattttggtcccagaagcacacaaagggtagtggagcaccgcttcctaccaaggaaattgctgcaatgcttccaatggatggtttccacctttatcgtgcccagcttgatgcaatggaggatccaaaagaagcacatgcaagaagaggagcaccctggacattcaatccatcactgtttctgaaatgtctacatacactaagaacagagggttcagtttatgctccatcatttgatcatggtgttggcgacccagttgagaatgacatatttgtaaagccacagcacaaaatagtgatagttgaagggaactatctgttactggaagaagatgtttggaccgaaattagagacttgtttgatgagaaatggttcattgacattgacatcgatatctccatgcaaagagtgctcaagagacatattgcaaccggaaaagagccagatgtagcagcatggaggatctcctacaacgaccgaccgaatgcagagcttatcctggaatcaaggaagaatgctgaccttgtgatcagatcagtagacttctcaagctagtgttcaattctttcaataggaaatagcattgtggttctagagttggaggttgttgtgggctgtttccgtggagattcctgtacatataataagctgaatgcctgtttcaaattttcatggtgattgtgttgcatgtaataagatattccttcactatgtaccgtggaggattgttaagtaatttattgacattttttaatagaaacacccttcagatcaaaaaaaaaaaaaaaaaacctgcagcccgggggatccactagt

SEQ ID NO: 15001 - DNA, 1712 bp, Zea mays
ctgatttctgaatttgttcctcgtttcgttgccagcccaatcggttcagtttcggcggtaacaagatcaaccgcggtcgccagtcgattctgtgagcctgccagccatggagttgtccagttccgtctcgtccacggcggcggcggcggcgcaggcgcggctgctccggccgccgtcgtttcgccagccggggccggcgggtaagatgaccttcgaccacttccctcgcgcctggattaaccccgcgctcgcgtttgcctctgccttcttcgactccatccaatccaaggaaagttgcaagtgtggcgtgccggctggaactgagcagattggacttcccggcatgctgaatcctgctgcacttggacctgcaactttgccaggatttgtgtaaccaaggcttgtagtacctcttagtgttccatgcaaatttcttgctggcagcaaaccttcagccttgcctgctagtgctaactggatgtcttctccttttgttctccaattccaaactcctgtgcttccgttgcagtttcgaggggtagcttaaaagttaaaactatgattctcctgccgctgcaggattcgtgtcctgtaggagttacgctataaggagcaaactggtgagggcgatgcctccgatccttgctagcttccagcctgcatctcctcagtacccaagctttcaagacgcaaatggcaaaagacgaaatgttccttgttatcagagacaacaaaccccgcaggtagaagtcaggtcgatggaggaggtatatgacactttggctgaacaccttctttctgtcttgaagaatattgaacatcttgattcaaaatacattgttggtctagctggcccacctggtgctggcaagtccacagttgcctctgaagttgttcgacgtgttaatacattttggtcccagaagcacacaaagggtagcgcagcactgcttcctaccaaggaaattgctgcaatgcttccaatggatggtttccacctttatcgtgcccagcttgatgcaatggaggatccaaaagaagcacatgcaagaagaggagcaccttggacattcaatccatcactgtttctgaaatgtctacatacactaagaacagagggttcagtttatgctccatcatttgatcatggtgttggcgacccagttgagaatgacatatttgtaaagccacagcacaaaatagtgatagttgaagggaactatctgttactggaagaagatgtttggaccgaaattagagacttgtttgatgagaaatggttcattgacattgacattgatatctccatgcaaagagtgctcaagagacatattgcaaccggaaaagagccagatgtagcagcatggaggatctcctacaacgaccgaccgaatgcagagcttatcctggaatcaaggaagaatgctgaccttgtgatcagatcagtagacttctcaagctagtgttcaattctttcaataggaaatagcattgtggttctagagttggaggttgttgtgggctgtttccgtggagattcctgtacatataataagctgaatgcctgtttcaaattttcatggtgattgtgttgcatgtaataagatattccttcactatgtaccgtggaggattgttaagtaatttattgacattttttaatagaaacacccttcagattaaaaaaaactcgagggggggccgggtaccca

SEQ ID NO: 15002 - DNA, 1121 bp, Zea mays
aaaatttgtttttttttttgttttttttttttttttttttttttgaatcaaatcgaagtgtccattatcaagaatgaaagcactaacttttcaatgcagacatactcatcacaaaggccatatgaaatggacatctttactcaccacaaaggcacattctacagaataaggaactttccgtgtcaaattttcctctagctaattagtatcaccggaacatgttctgaaatttccctcattcttattcgtctatggttaccaaaatgccagtgttaccttattctgagatcatccgctgcagagttacaggtcaaaccttcgccggctccggcttctccccatcgaattccgtctccacggtcggcgttatcatcagtgacggatctacgattagcgcgtcgccgccgacctcgcggcatcgctcgagcatggactctgattccgcctcccttccaagggcgaggtacagcacgccctggcagaacagagggcgatagtcggcggggtcctcccgcgcaagctcctcgaatgctgcgatcgcctcgtccaacttcccgtccacgaacagaacctgagcggctaggaggcgggcgtagctctctccacatccggctgtggacaggcgcgagcgcgcttcgtccgcgcggccgacgcgcgcgaggcaggcagtctcgattatcagcttctcgaagagtcgggaggcgtctgggatggcgtcgtcgtgggacaccgtgactgtcagaggagtgagcgggggcggaggaacggagggggtgcacgcgagtgccggggaggtggcggcgaagagaacggcggcggaggcggccatgcggagggaggagaggatgggatgtgcagaactggcgatggctttgacggcggcagggagaaaggaacggcgccgggaagaggcggctacgtagatgggggtgcggagggaagaggcggcggtcgcgggagctagatatgccatggcagcggctagggtttgcaaggcggagattgccaggggagactggaagcagggcggcggcggagtttgggaggccgtgagcaggtctggacgtctggtgaagaaaagagtttcggtctccaggccggtctcgaggttcccctcgtgt

SEQ ID NO: 15003 - DNA, 994 bp, Zea mays
acatcgccgaccaagcgcagcaccgcgcgtggaccagacgccgcccgtggcttccgtggaccagacgccgctcgtggcttccgtggacgcagcaccgtgcgtggaccagccgctgctacatcgccgaccaggtaaacatcgctggccagggagtgaatcatcttattctgagatcatccgctgcagagttacaggtcaaaccttcgccggctccggctttctccccatcgaattccgtctccacggtcggcgttatcatcactgacggatctacgattagcgcgtcgccgcagacctcgcggcatcgctcgagcatggactctgattccgcctcccttccaagggcgaggtacagcacgccctggcagaacagagggcgatagtcggcggggtcctcccgcgcaagctcctcgaatgctgcgatcgcctcgtccaacttcccgtccacgaacagaacctgagcggctaggaggcgggcgtagctctctccacatccggctgtggccaggcgcgagcgcgcctcgtccgcgcggccgacgcgcgcgaggcaggcagtctcgattatgagtttctcgaagaggcgggaggcgtctgggatggcgtcgtcgtgggacaccgtgactgtcaggggagtgagcgggggcgggggagcggagggggtgcacgcgagtgccggggaggtggcggcgaagagaacggcggcggaggcggccatgcggagggaggagaggatgggatgtgcagaactggcgatggctttgacggcggcggggagaaaggaacggcgccgggaagaggcggctacgtagatgggggtgcggagggaagaggcggcggtcgcgggagctagatatgccatggcagcggctagggtttgcaaggcggagattgccaggggagactggaagcagcagggcgggggcggcggcggagtttgggaggccgtgagcaggtctggacgtctggtcacggccggagttcccgcccggcccgc

SEQ ID NO: 15004 - DNA, 2454 bp, Zea mays
tggcacaggctttcttgtgcaggccacttttttgtgttcttagaactagttagtgaactctatttttctaaggtatttatattttttcaagagaaaataatttaatttttttttagaaaaatggggtttccaaactagcccttacaattgcaacttcagtgccttttcgtcctgtgaagttagctcacctaagaatttgtttggttgttctcattctatggaggttgaagggaatcggaagatattacacactcaatcctctccgatccatatggatcgggaggattcgattgttttcattctatggaagttgaaggaatcagaaaatattactcactcaatcctctcctatccatatagattgaaattatcaaacatgctcttaatggtacgggtttgcaggtatgaggacaggaagatcatcccgaacctatcatatccgatgggaaggtatgtttgcccgttagcatccgtgtggggtgaagttagccccatccctgatcctcaatataggaattcgccgcgaggtcctcattgccatctttagttgcactttgcatgaggccgcaacagttattattgctttaacatccctttctttttcatgttcttttgaaaaatgaattgatccacaaatagaaaatttgtacgttcaacaccaaagtgctcattcattcatgttaaaatataatataagtgaattgtccaactcctcctataaacttaacctttaggttggactagttggtgcacttaacttaatataatatcagagctagaggtcatgagttctaattctgacaagaacaattaaatataaaatgattgttgatcactattattctacgtttaagatccaaaaaagactcaccgtgaggagaagtgttggaatataatataaggggcgcgttggattataatataagtgaattgtacacctcctataaacttaacttttgagttggactggttggtgtacgcaacttaataatctataatgatcttagcgatattttcacaaccagtacgattaaactaaaaaacacaattactcatggtttctctcaaggtgaaaaacaaaaacttaattcagttttcaaccatgtgtgaaaccagtccatgcacattgctcaccatcgggacataaaaatgtcttatattgcttggtttttattaaatttcaatcaaattcacatgaaactgaaacaacaaataaccatcagaggccgcttttgtgttttcttttttctaatataaagattcaatggatgtgaatatgaatcaaatcgaagtgtccattatcaagaatgaaagcactaacttttcaatgcagacatactcatcacaaaggccatatgaaatggacatctttactcaccacaaaggcacattctacagaataaggaactttccgtgtcaaattttcctctagctaattagtatcaccggaacatgttctgaaatttccctcattcttattcgtctatggttaccaaaatgccagtgttaccttattctgagatcatccgctgcagagttacaggtcaaaccttcgccggctccggcttctccccatcgaattccgtctccacggtcggcgttatcatcagtgacggatctacgattagcgcgtcgccgccgacctcgcggcatcgctcgagcatggactctgattccgcctcccttccaagggcgaggtacagcacgccctggcagaacagagggcgatagtcggcggggtcctcccgcgcaagctcctcgaatgctgcgatcgcctcgtccaacttcccgtccacgaacagaacctgagcggctaggaggcgggcgtagctctctccacatccggctgtggacaggcgcgagcgcgcttcgtccgcgcggccgacgcgcgcgaggcaggcagtctcgattatcagcttctcgaagagtcgggaggcgtctgggatggcgtcgtcgtgggacaccgtgactgtcagaggagtgagcgggggcggaggaacggagggggtgcacgcgagtgccggggaggtggcggcgaagagaacggcggcggaggcggccatgcggagggaggagaggatgggatgtgcagaactggcgatggctttgacggcggcagggagaaaggaacggcgccgggaagaggcggctacgtagatgggggtgcggagggaagaggcggcggtcgcgggagctagatatgccatggcagcggctagggtttgcaaggcggagattgccagggcccccgggcgcccggccgcaacagggcggcggcggagtttgggaggccgtgagcaggtctggacgtctggtgaagaaaatagttgaaacttccgttggtttggtggtagagtgatacatggcatacgtgtcgctgactcatgggacccgctggtctgcctggctaaaatttagacacctgcatgcatcgcgaacacagaattttttcca

SEQ ID NO: 15005 - DNA, 691 bp, Zea mays
ctaaaaaaaaaatttgtttggtgagccacgctcccgtccggatccgcgggggaggacggcgatttcgtccccagcctcacgaggtcgggaaggggttcccgcacccacatttgtgaacctcgccgccgcccgtcccctgccttcacgaacccgtcgccgcccgtcccctactcttcctcgtgcacccaccgtcgctcgtcccctcgtcttccttgcgctctcgccgtcgccgcctcctcaccctcacgcacttgaggccagctgcggaacgaggtcggacggcggagacgaggtcgaggtctgtgacctcctcaacttgcgcaagactgccgagactgcagggacaagctctttgctgcctcgtcagctgcttctcggatactaacaaatgggttctataattgagttgataaggaaacatttgaagcagatgtgctgatccaattcagttttcagggtgatacacaagggattttcatcaacaagtggccgccagaagaactgaaacatcaagatggcgtttgcttttaggtcatgccattcaggagtacactgagactgttttattatgagactatgttttattatgatgcactgagactatgtttgtgtacactgagactatgttttattatgatgcactgagactgttttattaagcagtgtggagttctcaaaaaaaaaaaaaaaa

SEQ ID NO: 15006 - DNA, 1231 bp, Zea mays
gggtgggtttttttgtcttatattgcttggtttttattaaatttcaatcaaattcacatgaaactgaaacaacaaataaccatcagatgaaacatttgagtatacaagaaccgaatataaagattcaatggatgtgaatatgaatcaaatcgaagtgtccattatcaagaagggaggcactaacttttcaatgcagacatactcatcacaaaggccatatgaaatggacatctttactcaccacaaaggcacattctacagaataaggaactttccgtgtcaaattttcctctagctaattagtatcaccggaacatgttctgaaatttccctcattcttattcgtctatggttaccaaaatgccagtgttaccttattatgagatcatccgctgcagagttacaggtcaaaccttcgccggctccggcttctccccatcgaattccgtctccacgttcggcgttatcatcactgacggatctatgattagcgcgtcgccgccgacctcgcggcatcgctcgagcatggactctgattccgcctcccttccaagggcgaggtacagcacgccctggcagaacagagggcgatagtcggcggggtcctcccgcgcaagctcctcgaatgctgcgatcgcctcgtccaacttcccgtccacgaacagaacctgagcggctaggaggcgggcgtagctctctccacatccggctgtggacaggcgcgagcgcgcttcgtccgcgcggccgacgcgcgcgaggcaggcagtctcgattatcagcttctcgaagagtcgggaggcgtctgggatggcgtcgtcgtgggacaccgtgactgtcagaggagtgagcgggggcggaggaacggagggggtgcacgcgagtgccggggaagtggcggcgaagagaacggcggcggaggcggccatgcggagggaggagaggatgggatgtgcagaactggcgatggctttgacggcggcggggagaaaggaacggcgccgggaagaggcggctacgtagatgggggtgcggagggaagaggcggcggtcgcgggagctagatatgccatggcagcggctagggtttgcaaggcggagattgccaggggagactggaagcagcagggcggcggcggagtttgggaggccccgggcgccggccccgaggtccccacgtctggtgaagaaaagagtttttttgattaggatgttctaggtaatggtctcgtgt

SEQ ID NO: 15007 - DNA, 681 bp, Zea mays
gatcgaattcggcacgacgaacagggctttcgcccccggcctcacaaggtcgggaagggtttccccgacctctcgcgcacccgccgccgcttcctctctgtcttgcacacccgccgccgcttcctctctgtcttgcgcagccgccgtcgcctcctctccctcgcgcagtcagcagaccctcccttcgcgcgccgtcagcagatccagatccctgcgccgctgaccggcccctgcccctcgcgcgccgtcagcagatccctacgccgctgaccggccgatgacaggtctgtatgatttcatatctagcttgcatcggcgtacaaggttgatgctgacaggtgacaggttgccttgttattgatgctgagattgctgcccttcacttccttagtgcacagggaggcaatggatggagctctgccacaataaaaacaagatgttcaaaagaacgttattgttgtgttaacgttttgggcataccaactactattttttctgttatgagtctgtcaaacatatgttaaatttgtcgctcatttcttatgagctatttctgtggtcaaagaaagttgtttatttaagtggcatgaatcaaaaaatcttagcagacttctgtttgattttgttgatttttaaaagaaagttgcttcagcgtacaaaaaaaaaaaaagcggccgcccc

SEQ ID NO: 15008 - DNA, 766 bp, Zea mays
ccggccgggaatccgtggggaagagcgggctttcgcccccggcctcgtaacgtcgggtaggttttccccgactcgactgcgcttctcttcgtctccttcgcgaacccgccgtcgcccactgcctcctctccttctacctcgcgcacccgccgccgcttgctgtctcctctctcgcgcgcaccggtgttcccatcgccgtctccttatctccctcgtgcagccgctgttgtctcctctccacccttgtacccgccgccgcctcctcttcagatttcctcttcttcaccctcgctgcctcctcttcaccctcgctacggcctcctcaaatcgttgagacaactagtacagttgagacaactggtgcgaggtcggacggcggggaccatgcgaacaagctcgttgctgccttctcggctcgtgcaccctcatctcaagaagtgaatcgcctcaggtgatacacaagggattttcatcaacaagtggtcgccagaagaactgaaacatcaagatggcgtttgcttttaggtcatgccattcaggagatgatgttttattattatgcactgagactatgtttgacattggtcgtgtacactgagactgttttattatgagactatgttttattatgatgcactgagactatgtttgtgtacactgagactatgttttattatgatgcactgagactgttttattaagcagtgtgaagttcacagctgctgttctcattttaatgcaattgtgttcaatgagcagtgttgaa

SEQ ID NO: 15009 - DNA, 1753 bp, Zea mays
gtgggggtgaggcgaggttggagtttgcgtctacaaagactaatggtccaggatggttgctttgtggaatggagggacatggtagctgatgcggctagaaagggttttgctggtggagtttcccttgaatggaattcatataaaatattgagtgagcagatgcggcatgattggttggagaatcttcagaaaaggcgatcaatgccaaggccaagaggtaatagacgagcaccaaaaactcctgagcagaggagaaaaattgcagaagccattgctgcaaagtggttggatcaagaatatcgtgaacgagtttgtagtggaattgctagctatcatggatcatcttctgcaactaaaacaccgagaaagccaagacctgctggagaaccaggtgtaaagaaacagacgacaaggaaaaaacctatgcaagccaaacctgtaattttagaggatgctcatggaaaaagtgcagctcttaagagaaagaaaagcgcaactccctacaaagatccgatggcagttgaaaaattggagatgatatcaaagattcgagctcaaaggacagcacaggaaatagaaaagaaagaagctattaggagggccaggacactgattgcagaagcagaaaaggctgctgatgctctggaaactgctgcagcgatgaacccttttgcccaagcatcacttatagaggctagaaagcttgttacagaggcaagagtatcacttgaatgtgttgatgatgaagagcctcaagaaactgcttccaatgatgtgtcagggagctcagtgttactgaacttgcacgatcaccgtcatggactggagatgcagaatggaagtaatttgttgaagcaagagaataaacctgccaatgggatggaatttcctccaagcagtgtcaatggccttgctttccatcttgatgtttctgaactcagcggaacaaagcaactatatcagaggatagagaattccatggaaagggcttttcttctcccttcggcttcgtcaaagcttaaaagtgcgaacggagattatggaataatagatctacatgtgaggcagtcgatggtcgatgacacggcaaagcataaaggcatcacagctgaaacttgtcctccagggacactagagctagaagaagatcctcccagtcccaggtctgcagaaaaggctggaaccagggaagattaccctgggggaaaaccggaagaagacgcaccctcatcggaagaaaaggctaggatgaggtgggtacgtgggaggttggtcaaggtaaaaacaaacggacctggggatttagaaatctagtattaggcagcaaatctggcctagataccgttgacaggcaatcgagtttgctcacttccatttagccaccattttgtatgccattcgcatgatttggtgtttacgacctgcacctgctcgatgggaggaaccaagtataaaatgtactagcgttgacaggagtggcgtggtcctggggaactttactgatttgcagtctacagtgaacgtgcaggagcgagcacattacgatcaccctgttttcctcttctccgcgggcattgtagttgtggtaggtaataggagctggatctttttacttttttcttgtaaggccttgttagattagcttgtaattcatgtggattgagtgtgatttggtgggtttaaattccaagtaggtcaaactccttaattttttctaatcacattcaatccatgggtaacgggattaagttgt

SEQ ID NO: 15010 - DNA, 756 bp, Zea mays
gagaaaaggcctcttctgcctgtgtgcactgtgcatcgcttgccagcttccgcctttccatgaccacgccgctcctgctgtgattcctaggacgacgtgtcgcccgcctgcttctcacgccgggagggttagggaacgagcgccgccgccgccaccacgaactcgcggaagaccatgccgagatccaggggcaacgagccgccgctgcggacgtcgcagcgcgcgccgctgcacctcaagacgacggcctgctccgaggcgaatggcgcccaccaccgccccgtcgccgaccggagcagccccagggtctcgccgcgcagccctctgcccgagaagaagcgtgcggcgggaacacgtgttgcggagctggagggcaagctggggaaggtgcaggaggagctcaagaagctgcgggagcagctcgcgtccgccgaggccgccaagaaggacgcgcaggtcgcgctcgaggaggccaagaagcgcgtcggtaccaagggaagcccggcatccaccaccaccaccactcctctctctcccccttcgccgggggtcgaaatcgccaagaagaccgaggagctgaagctgcctcagccggcggccgaggaggagagcagcataaacgccccggcgaccgatgtgttcgaggtcgtccgggccgagtcgggggacaaggagaaccacagcgcggctgaggactgcgaggtcgtgagctgcgccggcggtaaggcggtgctgggccgtggccgaaaatgagga

SEQ ID NO: 15011 - DNA, 2919 bp, Zea mays
  misc_feature (2148)..(2149): n is a, c, g, or t
gatcaaccaggctcccggtcccggagacaggtcacacgcttcacaaacccatgtggccgtctcaccaactcggtactgccctgcgccggtgcgcccctgcccggtgcgcacagtcagacccagagccacagcccacagccggaatccggaaccagccgtgccgttccgttcgaaccccgagcgcgcgcgggcgcacatgccactcgccacggcgcggtgccgtgcatttacgccgacgcgggcggcatacaccaacgaaccaagtaaccaacgctcgctggataattccgcgaccgctggcttgcttttgctcgaatgaattttgaatttgaatcgcgcaccggtcggtcgcgtcggcttctgggactgggagccagtgcggtgcgtttctctcgcctcgcatagcctctcgctccgatttatttattattactactcggccaccaaattccgaccgtttcccactagaaaggcagcctcttctgcctgccagtgtccagtgtgcgccgcttgccaccttccgcctttccatgaccacgccgctcctgctgtgtgatcctaggacgacgcgcctcccgactgccctcgcacgctaggagtggggaggggaggctgagcacgagcacgacacgagcgccgccaacgccaacgccaagacgagctcgcgaaggaccatgccgagatccaggtgcgtgccgagatcaaagccgcctcctcactcagtggcggcggtgccgcgggtttccttcctttttacacatggctggtggctgggttccgtttcaggggcaacgagccgccgctgcgggcgtcgcagcgcgcgccgctgcacctcaagacgacggcctgctccgaggcgaatggcgcgcaccaccgccccgtcgccgaccggagcagccccaaggtcggcgaccggcactcgccgcgcagccctctgcccgaggtaataagtctcggtttcttccacttccggtacttttcctttcggtgccgcggctcacagtttcgccggtggcgtgtggcaaatggatccctgcagaagaagcgtgcggccgggacgcgtgtggcggagctggaggcgaagctggggaaagtgcaggacgagctcaagaagctgcgggagcagctcgcgccggattcccgcgccaagaaggacgcgcaggtcgcgctcgaggaggccaagaagcgcgtcggtaccaagggaagcccggcctcctcatccaccaccaccacttcgcctccctctcccccttcgccaggtgtcgaaagcgcgaagaagcccgaggagctgaagctgccgcagccggcggccgaggaggagagcagcgtaaacgcgccggcgaccgatgtgtttgaggtcgtccgggccgagtccggggacaaggagaaccatagcgcgacggccacgggcgctgaggactgcgaggttgtgagctgcggcgaggaggcggcgctggccgagaaggaggaggaagaggagacgaagaaaatgatcgaggaggacaacagcgcggcggcggaaaccgacggcgccgagaaggagagctgggaggtcctggagctgaaggcgaagctggcggagaaggacgcggagatcgccgccctcgcggcagaaaacgccgagctcaagaagcggtccggagaggccgcggaggcggcgaagatggtcgaagaggacgcggcggcgaaggcggcccaagccgagcgcgatctgaaggatggcgcggcgcgggaggcccggacgggcgagcagctgagggcgtcggaggccgcgcgggaggcgctggacgccgagctgcggcgcctgcgcgtgcagaccgagcagtggcgcaaggcggcggaggccggcggccgcgctgctcggcggggacaaccacctcaccgggctggcgggcagcggcaacggcaacggcaacgggtggggggaccccgccacgatgcccgacgacggcgacgacgagggcttcggtggcaagcggaagggcgccggcatccgggtgctcagcgacctgtggaggaagaaggggagcaagtgaaggcctgcctcccgcggaatgggggtgatcgtgttttggatttcgcaacggtgagcccgcgccagcttcaactccattgcctgccttgcactagctttagctccatcatttnnccgcgttttggtttggattctacttatgtttgtatgatgatgatgatgctcgtgagattgaactatgtctgtaacgactgatcccgctgctgcctgctacctcagcgtaaggagcagcaacaatgctggtttgggtgatcttctttgttattttccatagcggaattgaggaatgctcgattgcagcagcatccggaaatgcctcttgtccctcgaacgaattccaactgcaatcaccggaatgctatttcattgcgcatgttttgtccaccggctccgtctgcttgttccgtgtgtgtacccatggactcaccgtgtacccatggactcacctcgtgaagatggttgaagcaggcttcatgccgacggcagccagccgccgccgccgctgatcgattgcaatcacggtcacggacatccaagccgaatccattctggaaccgcgccattacattgggcataaagtgggcccgtttccgcatagttccggatggtagtcgtggactactggactgggcctgattcaggcagtgtactgcctttgtgttcgttgtctgattcggagcgacaattttgttacttctgcagccagttatgtaccgctaaccttatactctctccaataatcgttttagctcttagtttttacgtctatattaaaataaataataataaatctaaacagatacacaaaacacatacataaagaattgtatgaacccgctaaatccttaaaataactactattttaagacaaaagggagtagaaa

SEQ ID NO: 15012 - DNA, 1211 bp, Zea mays
caacctcgcctcgcggtcgcagcctcgccccgatttattaacaggcaaacaaatgtcccgtccgttccctcgagaaaaggccacttctgcctgtgtgcatcgcttgccagcttccgcctttccatgaccacgccgctcctgctgtgattctaggacgacgtgccgcccgggccggctgccttctcacgccgggagggttggggaacgagcgccgcagccgccgccgccaccacgaactcgcggaagaccatgccgagatccaggggcaacgagccgccgctgcggacgtcgcagcgcgcgccgctgcacctcaagacgacggcctgctccgaggcgaatggcgcgcaccaccgccccgtcgccgaccggagtagccccagggtctcgccgcgcagccctctgcccgagaagaagcgtgcggcgggaacacgtgttgcggagctggagggcaagctggggaaggtgcaggaggagctcaagaagctgcgggagcagctcgcgtccgccgaggccgccaagaaggacgcgcaggtcgcgctcgaggaggccaagaagcgcgtcggtaccaagggaagcccagcctccaccaccaccaccactcctctctcccccccttcgcctggggtcgaaatcgccaagaagaccgaggagctgaagctgcctcagccggcagccgaggaggagagcagcataaacgccccggcgaccgatgtgttcgaggtagtccgggccgagtcgggggacaaggagaaccagagcgcggccgaggactgcgaggtcgtgagctgcggcggcggtaaggcggcgctggacgtggccgagaatgaggagacggaggaagaggagactaagaaaatgatcggggaggacagcagcgcggcggtggaatctgacggcgctgacaaggagaacccggacgtcgtggagctgaaggcgaagctggcggagaaggacacggagatcgctgccctcacggcggaaaacgctgagctgaagaagcaggcagaggaggccgcggaggcggcgaagaaggccgaagaggggcccgcgtcgagggcggccaaggccgagcacgaactgaaggagggcgcagcgcgggaggcccgggtgggcgagcagctgcgggcgtcggaggccgcgcgggaggcgctggacggcgagctgcggcgcctgcgcgtgcagaccgagcagtggcgcaaggcggcagaggc

SEQ ID NO: 15013 - DNA, 3680 bp, Zea mays
  misc_feature (1670)..(1670): n is a, c, g, or t
  misc_feature (2827)..(2827): n is a, c, g, or t
  misc_feature (2895)..(2895): n is a, c, g, or t
caacagcaatgaagaaaaagcggcagggaatgttgcagagctggagctcgatctcgatccgttgcctcagctcatttctctcccagcctctcgatcgaccatgcatcatgtcgcgcgcgcgaaccatgtccacgtgtctcggaaaaacctcccggccacaccgacgatcgatgaacaccaagaaccactcccggcagcaatagcatccgtgaacgtgtatatatatctacgtgcgtgcgatcaggttatgctgcacagaccgatcacatcgtcactcactgcttcgttcgttcatccatcaactactggaaattagagagccggatctctcggtcggagaagctagaattaaaaagtacctgcgaggaaggactaaggagtctaagatggctgcggcggtgctgtccgtgcgcacgacgacgacgtcgctgctagcagcagtcatcctgtgcctctgcgtcgtctccctctccccccgcggcgccgctgccgcgcgggtctcccccggcgccagcccgatcgtggccacctgcatgacgggcccgtacccggagctgtgcgtggcggagctggggcagcggctgctggacgtgcagacgtcgatcgcgtccgcggcgcccgaccagcgcgcggccaggatcgcgggcgccccggggcaggtggacgtcagagcgctggtggccgtggcgctggaggcggcctcggaagccggcgctgtcgcggtgtccatcttcgagggcaagctccccgggttcaacaccggcgtgcccgacttccgccgctgcctcggcaactgcaccgtcaccatgcgcagcgccatgcagaagctccacggcgccaccgccgcgctgcactcgggcgacacgcaggtggccaggacgctcgcgatgcgctctgccgccgacgtctcgtcctgcaccgtcagctgcagggagctcaacggcgacgtgcgcctcatcgtcgtgcagagcctcaccgagttcaccaagatgctccagatcgccgtcagcttcatcagcaagatgaagccgcttccaccgtcagctccagcgcgaactgccacgccatgatcacctacatatgcgcagcgtggttcttctaactaagagagcgggatcgagaagaaattgaagccgctaataattagccatcgttctctagagttcctttcttcgtttgttttggtgtgtgttccttttccccgtttttttttttgttttagtgtgagttctctcttctgtaaataagatgcaggtttcatggccattgtgcctggctctggttgtgaacctgagaatgagattacatgttttctttctgatccaagaaaaaattgtgaatctgttttggcttttctagacgcatcataacaaattttgttatgtgcgtagaatttgttagagagacgagggaaatggattttatgcagtcattttgcatgcaaatgatttatagaaatcaccaccccaattcccataagtaataattagtatatacatgatgaatgagttgatttcaccaaaatttatgggatgaacttatgatgcatcaccttatgaagtataggttgattccactaaccaaacacaccataagtttactatacaaaaaatgataccgctttatggcaaagaacataaaagattttatgtagcaacagatggatcctngtcattttggcccaaacactatggggtgtttggtttgaggaatcacaccatccaaaataaggtagtgcatcgttgatccattcctcaaatttggtgggatgatctcattccccatattagtactaactaactatgaggaatgaggtggttatggttcaactcatttcattctacaaaccaaacaaaaatgaggattgagaagattatggaccaactcattcctcaaaccaaacaccctataaacgaactctcgtggcacacaggacctcggggtcctctctacgagagcgcagattgtccgcaagtgcacagagagctctgcttccctttttcatgtgcatggaccgtccgcgtgtagacggcggaccgtccgtgatggcgcagagggcttcggtaagaaccaagatctcacctctcgatagggacccagtcggggagaaaagattttagagttgctttgccgttgttaggccacccaaagctctgttagaagatgtagagtcaaaatgaggcaaatattggaggttgggagtaggggtataaatggtatgtatattatccgtccgtaatcgaattcgattagtctaagagagctgagatccgatctgtattcgagttttactattcagtatatgatctgtatccgatttatatttgtatccatatactcaaagttggatatttaagatgtcgatatccattctagttttatcccacacaactcgataatattcgtatctgatcgaaatcactagagaaaatatgaaaataaatatggtaaaaacaatatttgttcgtattcggtctaattacacttctagttgggaggctacaactaggaatagaactacttctaaggctaatgcataaaataaataagataaattgatgtttaggttcgattattgtgttcttcaatcggtcgtacccttttgtatatattggggaggtctgaacccgttcctaggtgaaatcaaacagttctcgtgagcctgttatgataaccacacacaggttaaggactctagcctaaattaaaaactgatcctggaccatccaagccgtcataccagaccgtctgaggtccgaacagtctatgccacatggtcataccattcagtcgtccaggtgctagatttggtgctccacacatgctncctacttctggcagagtttagtgagccaaaatcacctagttccttacatattttctaaaagtacaacntgatgtgagattgagaacaccagctttctaaacatcttaccatgtattaggatagtattgttttaggaaacgaccattcaatgctttatgtaacttatttccttgtaatgtttccaacatataagcattaccagggattacatgtacaaccttataagtccctttcaaacttggagaccacttgtcaaacttgtaatccttaatcttcaatggcaacattgtcttccacaccaaatctccaacctgaaatgatttagtctttaacttcttattgtagaccttggcgactataagtttgtccttttcaatttccttcaaagccatcaacctcttatcggtcacctcgtcaatattgtccatcattaaatcatggtactcatcgacatctaaattattttgcctggcaaacctaatagtggttagatttatttctataggcaagatggcttcatttccatacataagctcaaaaggagaaactttagtggcatgaagttttgatattctatgagcccataaagcctcaaacaaaactttatgtcaatgcctaggacaatcaaatatcttctttttgataaggttaatcaatttcctattccttgactcggtctggccattggcctgagcataatatatatggaggtaaattgagtaaattaatcttgtatgattcagcaaactcatgtacctctttagatataaaagaagtcccttgatctgtagtcaaagtttggggaatgctaaatctattaataatatactctataaaaacacaattacctcct

SEQ ID NO: 15014 - DNA, 3568 bp, Zea mays
  misc_feature (1726)..(1726): n is a, c, g, or t
gtgtggatctgatatctcgggggcaaataaaattaacgttgagacgtgtaacatcgttgctaataataataacattgagctgaggatttatttattgaaatgaaatttaaacttaaaaactttcggactaaaataagaaaagacggtttgtacggccatcgtaccgtaaaatcgtaatagtggcaaagaaaactgccgcaatgccgctctcctatccttcggccgcgtcagtgcgtcacgctagtagccggtaggcccctagggatgtccatggcggcgagccgccgcctcctccatctcctgccgcggctggagctgtgcctgcggtcccgtgcgcttagcatcccctcgtcttcgcggtacatctctaccctgacagccccacgccgccggcccaactccaactgatttctctgcccccccaaattcagaaacttttgcttctttgcagggcacaggggatggctcgtcggaagcttgtgacctgccgacaaggtgctttcgagcaggggaatgcaggtgaggtcttgatagtgctacataataggttttcaaatccgtactccacagaccgttttggtttaacttcgctgatttggttcttgccgcttgccgagcagcgagggataaggccgtgccgattccagataaagtgctccgtcattgcaagtacgccaatggcagggccctagacctagagcccattgaaaagaacttcgccaacgagtctatgcaattttctttcgaagaggagactgacgatatggtgtgcgaaattagcgaaagcgtggtgcgggatgtggagaaggctgcaattgaattgcttgctgccaggtgagaactgatgaatgattcccaccatgttcatggtaatgtcctgaaactctgctggtggcaacatgttcgtgctggatgtttgttctatttagtgtgatctgggtatcgagcaggaatgaataatctgctgatcgcacacttgtctgtaccaagtgaatgatcttgctgctagcaagttaatccactgatttttctcattttctgatataatgacattgtcttagcatctgtagtctaatgcaagtttctgtgctatgcattcaggccgttgcattttacttgttttcagcgtaatcttgttgtcactattgagaataaacactgaaatatgcctcgttgctgcctgagcagagctttcactgtctctgagcttaggaagaaactacgaagtaagaagtatccttttgatacaattgatgccgtgattgctaatttcaaatcaaggtaaggctggcttcgtttcgcttatggccacactattaaacttacagatcttcatttacagaatagtggtgatagaactatcattatccatttttacaaaccatgcgtaatttatgctgaatagccaccaaattttgtgaaggctgaagggctttagtttgtatttccaggttcttaaatgttagatctaaccaataccttttgctgatagagcaaggcagcacgcattaatatgtagttctaagaacatcacttattttgctatgcctatgctcatattgtttttaatatctttgtattttacttctgaaggggtttgttgaatgatggtttttatgctgaatcattttcgcgatcccggtggctaacatcaacatggggtccaaggcgaataaaacaggtcagtgttttatctatcctctcccttgttgtactgaatgaactnttggcacatgtggtcgtcctttattacaaaaccatttttcatgttctgtgaatggtgaattcctctcagttgtctccataaattcctagtgtaagatttgataatccccatatctaaaatctgtccagtgaggtgaaagaaaagttaccctgcaaaggaactttatattcttataccttcagattccatgttctgtgaaaataaattcctagggtaagatttgataatccccatatctaaaacctgtccagtgaggtaaaagaaaagttaccctgcaaaggaactttatattcttatgccttccgagataccatgttctttgaaaataaatccctatcataagatttgacaaactccatatctaaagtctgtccaatgaggtgaaagaaaatttactttgcaagggaactttacattcttatgccttctgatagtaaattttttatgcctgtttttgctcttgccattatttgattatgtgcttggtgtccccttgtttaattcataaataaatgacatcactcgcgctcgaatcaggcacttcaccaaaaaggtgtcccagaggcagaagtagatcaggcaacgagacgagtgttccaggatggcgacgactatggaaaggaggcaacgttcggcatgtccgaagcttccatggatcgtctgtttgctcaggcgtccaaacagtggcagcgtgggcaaagcttgaccctggagagccgacgtgcgcgcatggtgaggtggcttcagtaccgagggttcaactgggctgtgaccaatgccgttatcaggaagctggaggctcagcaccctccaccctgactcttctgactagatgaatggcaacaaacatatcaagttcaaactgagaagttcaggcggatgctgcctcgccttctgttcttgtgctctgttttttttagggaaactgtgaaacgaagtgtggacgaccatgttgatgggcaggtaacacagggaggaacaactgaacaagttcatacacgccgaggctttggctaacggtgagaaacataaacaaattaaacaaaaaaaaaaaaaaaatacattggtatgctaacatttcaaaactggatttgacaagttgagtgttaagaaccaattagattagagttagtagtctcagctgacagattaggaactaggcattagaactaactgtctgtttaatcatatatgcataaatgtgcaagatcgatcaatggaacatcgttcattcatttcttgttgtgagtcctctttccgttcaaacaccgatatcggcatgcagccagcccccgcgagttaagacggcaatgcggcaacaacagtgacaattttgcattcgaaaccattccagcgttgcacaacataaataaataagctaaaagcctgatcactgctcaggttagtgaacctgaaacctctactaaactgattaggagaaattactctgaaaacttatctcttaactgaagtacaacagtttctccaacaaaggggaccagaggggaaaagctaacctcaaagtatagaacatacatcactatattagagctctactatcagtgaagaggcacccagctgctgcttgatgctccggttcatctttacatcatgtctgaagttcctggacaggacacaaaaaatcaggagttctcttcaatcaccttcagcaattgcagcgttaaacttatatggctatacctgtacaattcaaccggtatacatgccagtgtgcatgttgatattcactggagtgtttatggcctccagccatgcataattatctgggttaccagctaccttcgtgcgtccagctgctgctgtcgaggagcatcaaatgac

SEQ ID NO: 15015 - DNA, 1374 bp, Zea mays
tttaaaaccgcccgccccttttttttttttttttttttttttttttttttttttttttttttttttttttttttttttttttttttttttttttttgcggcaacatcagtgacaattttgcattcaaaaccattccagcgttgcacaacataaataaataagctaaaagcctgatcactgctcaggttagtgaacctgaaacctctactaaactgattaggagaaattactctgaaaacttatctcttaactgaagtacaacagtttctccaacaaagggggccagaggggaaaagctaacctcaaagtatagaacatacatcactatattagagctctactatcagtgaagaggcacccagctgctgcttgatgctccggttcatctttacatcatgtctgaagttcctgtacagttggaccggtatacatgccagtgtgcatgttgatattcactggagtgtttatggcctccagccatgcataattatctgggttaccagctaccttcgtgcgtccagctgctgagagacttgaaaatggatagtcatgaaaataagtgcaaatccgaccagcgtcatcgttatatggtggggcaaggacatcaagaacagcacaagaagatactgaagtgaagcagtgcaggttcccaccactttggggatacaaaatggaggttggacatggagcagtacgaacatcatctgtatgtaatttggccaaccttgctggctggctacttgctaggacagtaggctctatccaatcatatgatttcacatgcatggaaccataaaggattttgctcagtacagtcattcctggatgatcatgaagaggaatgactgatgaagttggcaagcagaatattccaatagagaatgcatcacagctgtagatatgaaggtacttgatgggccgcgcccaccgaggaagccttcctgaacccttgaggaggttggagtcaaaaaatccatgccccctgtcgtcctcaagattataatctctgagcccaacatccgcaggagtgattgtatccatgagcgaggagatgctgcggacgacatcagcgggcgggggagacgatgaggcggcggaaggggaggggaaggagcgcttgcagagctcgtagagggcctgcaccgggaacgacggctgccgccgcggggatacgccccacgccatttgaatagtttcagagagaggggggcttttcccccacacggattagcgtcttggatgtatggccagtggcgcggcgagaccgacaagccggcgaggggaggagaggggatggggaaggggaagcgaaaacacaagtctactcagcggctgggttctcgtttatcccggccggcctcgaggtacccaatg

SEQ ID NO: 15016 - DNA, 1318 bp, Zea mays
gccgctctcctaatcggccgcaatgccgctctcctatccttcggccgcgtcacgctagtagccggtaggcccctagggatgtccatggcggcgagccgccgcctcctccatctcctgccgcggctggagctgtgcctgcggtcccgtgcgcttagcatcccctcgtcttcgcgggcacaggggatggctcgtcggaagcttgtgacctgccgacaaggtgctttcgaggaggggaatgcagcgagggataaggccgtgccgattccagataaagtgctccgtcattgcaagtacgccaatggcagggccctagacctagagcccattgaaaagaacttcgccaacgagtctatgcaaatttctttcgaagaggagagtgacgatatggtgtgcgaaattagcgaaagcgtggtgcgggatgtggagaaggccgcaattgaattgcttgctgccagagctttcactgtctctgagcttaggaagaaactacgaagtaagaagtatccttttgatacaattgatgccgtgattgctaatttcaagtcaaggggtttgttgaatgatggtttttatgctgaatcattttcgcgatcccggtggctaacatcaacatggggtccaaggcgaataaaacaggcacttcaccaaaaaggtgtcccagaggcagaagtagatcaggcaacgagacgagtgttccaggatggcgacgactatggaaaggaggcaacgttcggcatgtccgaagcttccatggatcgcctgtttgctcaggcgtccaaacagtggcagcgtgggcaaagcttgaccctggagagccgacgtgcgcgcatggtgaggtggcttcagtaccgagggttcaactgggctgtgaccaatgccgttatcaggaagctggaggctcagcaccctccaccctgactcttctgactagatgaatggcaacaaacatatcaagttcaaactgagaagttcaggcggatgctgcctcgccttctgttcttgtgctctgtttttttagggaaactgtgaaacgaagtgtggacgaccatgttgatgggcaggtaacacagggaggaacaactgaacaagttcatacacgccgaggctttggctaacggtgagaaacataaacaaattaaacaaaaaaaaacatgtactacattggtatgctaacttttcccacctggatttgacaagttgagtgttaagaaccaattagattagagttagtagtctcagctgacaaagtaggaactaggcattagaactaactgtctgtttaatcatatatgcataaatgtgcaagatcgatccatgg

SEQ ID NO: 15017 - DNA, 1159 bp, Zea mays
atctcctatccttcggccgcgtcagtgcgtcacgctagtagccggtaggcccctagggatgtccatggcggcgagccgccgcctcctccatctcctgccgcggctggagctgtgcctgcggtcccgtgcgcttagcatccccttgtcttcgcggtacatctctaccctgacagccccacgccgccggcccaactccaactgatttctctgcccccccaaattcagaaacttttgcttctttgcagggcacaggggatggctcgtcggaagcttgtgacctgccgacaaggtgctttcgagcaggggaatgcagcgagggataaggccgtgccgattccagataaagtgctccgtcattgcaagtacgccaatggcagggccctagacctagagcccattgaaaagaacttcgccaacgagtctatgcaattttctttcgaagaggagactgacgatatggtgtgcgaaattagcgaaagcgtggtgcgggatgtggagaaggctgcaattgaattgcttgctgccagagctttcactgtctctgagcttaggaagaaactacgaagtaagaagtatccttttgatacaattgatgccgtgattgctaatttcaaatcaaggggtttgttgaatgatggtttttatgctgaatcattttcgcgatcccggtggctaacatcaacatggggtccaaggcgaataaaacaggcacttcaccaaaaaggtgtcccagaggcagaagtagatcaggcaacgagaagagtgttccaggatggcgacgactatggaaaggaggcaacgttcggcatgtccgaagcttccatggatcatctgtttgctcaggcgtccaaacagtggcagcgtgcgcaaagcttgaccctggagagccgacgtgcgcgcatggtgaggtggcttcagtaccgagggttcaactgggctgtgaccaatgccgttatcaggaagctggaggctcagcaccctccaccctgactcttctgactagactaggtgtgtgtccgtgcgttgcaacgggtgtacgctgggatgagtatagacacatatctaatcggatcttatatttcctgggggggtctgtagaaagtttactcgaaagccaaatatgttaagaccttatgtcccatcagcatactgttcaaaa

SEQ ID NO: 15018 - DNA, 1383 bp, Zea mays
  misc_feature (34)..(34): n is a, c, g, or t
  misc_feature (879)..(879): n is a, c, g, or t
tgggtacccctcgagggcccggcccggggtaatngtggcaaagaaaactgccgccccccgaggttggccgaatgccgctctatatccttcggccgcgtcacgctagtagccccggtgcccctagggatgtccatggcggcgagccgccgcctcctccatctcctgccgcggctggagctgtgcctgcggtcccgtgcgcttagcatcccctcgtcttcgcgggcacaggggatggctcgttgccggcgcgagcctccgcgtcggaagcttgtgacctgccgacaaggtgcttttgaggaggggaatgcagcgagggataaggccgtgccgattccagataaagtgctccgtcattgcaagtacgccaatggcagggccctagacctagagcccgttgaaaagaacttcgccaacgagtctatgcaattttctttcgaagaggagagtgacgatatggtgtgcgaaattagcgaaagcgtggtgcgggatgtggagaaggctgcaattgaattgcttgctgccagagctttcactgtctctgagcttaggaagaaactacgaagtaagaagtatccttttgatacaattgatgccgtgattgctgatttcaagtcaaggggtttgttgaatgatggtttttatgctgaatcattttcgcgatcccggtggctaacatcaacatggggtccaaggcgaataaaacaggcacttcaccaaaaaggtgtcccagaggcagaagtagatcaggcaacgagacgagtgttccaggatggcgacgactatggaaaggaggcaacgttcggcatgtccgaagcttccatggatcgtctgtttgctcaggcgtccaaacagtggcagcgtgggcaaagcttgaccctnggagagccgacgtgcgcgcatggtgaggtggcttcagtaccgagggttcaactgggctgtgaccaatgccgttatcaggaagctggaggctcagcaccctccaccctgactcttctgactagatgaatggcaacaaacatatcaagttcaaactgagaagttcaggcggatgctgcctcgccttctgttcttgtgctctgtttttttagggaaactgtgaaacgaagtgtggacgaccatgttgatgggcaggtaacacagggaggaacaactgaacaagttcatacacgctgaggctttggctaacggtgagaaacataaacaaattaaaaaaaacatgtactacattggtatgctaacatttcaaaactggatttgacaagttgagtgttaagaaccaattagattagagttagtagtctcagctgacaaagtaggaactaggcattagaactaactgtctgtttaatcatatatgcataaatgtgcaagatcgatcaatgg

SEQ ID NO: 15019 - DNA, 1573 bp, Zea mays
ccatgacgcgtgcagtgcatgagatcggcatggccaactcaactagctaggacggacgacacggaagcgacgtgaagtttctgatcaaaactctccgagatttggagaagaaccgcgagatgagaaaggggggagaggggaaggaaacttcacgtcgcttccatgacgcgtgcagtgcacgagatcggcatggccaactcaactagctaggacggacgacacggagaagaaaacagatcgcgccaacacgcataagatggaaaaaagtgtatggatagatagatagatactcgtcacaccgcatgcgcacttgcgcagcatctgctcctgaattcctccgttcctgaaccagtagatcattttgtttaacagcagggtgcagggcccgtttctgttgctcggcacccgtcccatcccacccacctgctcacgacgacaggccagcacgacacggagggaggaagtagccaggccacctcgcctcgcctctactctcccgcggtcccgccccataccatgtccgactacaaccgctacggccacagctacagctacggcggcgggtacggccaagggccagcgccctcggccccgccggcaccgcacatgcccaccgctacatccgccgccccgccctcctcctcctcatacggcgcgtacgccgggtacccgcccgcctaccctccgccgccctcgcaggcggcgggcggattcggtcccgctggctccggctacggcttcgtccccgtcgcgttcccgccggggacgcacccggacgtcgagcgcgccttccgggccgccgaccgcgactgcagcggcgccatcgacgagcgcgagctgcagggagcgctctcctccgcctaccaccgcttcagcgtccgcaccgttcgcctcctcatgttcctcttcaacgacccctcctcctccacgccgtcacggatggggccaacacagttcgtatccctctgggattgccttgggcaatggcggggaatttttgacaggtacgacagggaccggagcggcaaaatcgactcccgtgagctgaccgaggctctccggagccttggatatgctgttccaccttctgtcatcgagcttcttatagcgaattacagcaatggtgtgcccagcaatggcgcgctagactttgacaactttgtggaatgtgggatgattgtgaagggtttaaccgagaaattcaaggagaaggatacgcgctacaccggctcggctactcttacatacgatggtttcttgtcaatggtgatccccttcatcgtcccttagctgtgctgtatgtagttcggtaacttgatagtagtcatcaaccatggttctagtaggagtgctctcccctagtctgtgcgaaaggttttttttttctcttcttcgtttctgagtcttgtctaccttgttcgttttgtacattaataacctcgatttgtttgtttcatgggatttacatcgttttggactatgaaatcttccaaggattgaaagtcatatgccatccttcagtattcctggatgggtccccgtaggggctgcattgctaacggggaaaaagaaa

SEQ ID NO: 15020 - DNA, 2682 bp, Zea mays
tacctcgaggccggccgccggccgcccgccgcatcccgaaacagtaaacgacgcttccctccgccgccgtcagatcggagctcgactccgtgccccgcttctccgccgcgatggcggcgccaccgcgccgctccctccttgtccttctctccgggctcctagtcttcgcctcccttgttgccctcaccacagccatctacgaggaccaggtcggcctcgcggactggcatcagaagtacattggcaaagtaaagcaagcagtttaccacagccagaagagtggaaggagacgagttgtggtcttgacagaggaaaatgtgatctcgtctcttgatctacgttctggagatatattctggcgacatgtcattgacaagaatgaccccttggatcagcttggtctatcacttggaaaatatgttctaactctttcttcggggggaactatattaagggcatggaatcttccagatggactgatgatctgggaaactaaccttcgaacttccacagcatcgaactcacagttgcatgttatgtcaaacaataaagcggccagggacaacttagttttagtttcagctgggcgatggatttatgctgtatcaagcattgatggggcaatttcatgggaaaaggagttttctcttgatgacttggaaatcaagcggattctccaatcacctgaaaatgatgttgtgtatgctttaggacttgctggttcctcgaagctagctttgtatcacttgagtgctaaaactggagagatactaaaagatatccaagagtcattccctggtggattatgtggtaaaacagtacttggttctgataatgtgtttgtagcattagataaggccagatcaagtctgttacttattgaattcaagggtgagagaattagctacaacaaggtgctggtttcagatcttgttcaagacttatcaggatcatttgagcttcaatctttgtccagtgacatcatatctttgcaaacgtcatcttctatttccctcctaaagctcaaaggtaccgatggattggaagtacttcagagatttgatcagccagctgcagtgagtgattccctgccaatcacagaaaaagaagaagcttttgctgtcgtgcaacatttgggttccgaaattgagtttatcgtaaaatttacaagtgacctaagcagtgagattattagagaaaaggttaatatagaccaaaataagggcaacgttgagagggtcttcttgaatagttatattcgaactgacaagtctcatggttttcgagctttggttgtaatggaggatcattcactcttgttaattcaacaaggtgaggttgtttggagcagagacgatgggctggcttcaattgttgatgtaacaacatcagaattgcctgttgagaaggatggtgtatcagttgccggtgtggaacacaatctctttgagtggcttaaggtaacccatagaaattgctattatgagttattcactattgcaaaatgcttcagataaatgttattttggaaaacctatcaggggctgcttggatcctttcattttagaggaaatagaatctacttaatggactaggttatttgtcttgattttgatatttcacaactttccaaagttcatatataggtctatcttaaattcatagggacgaagatggaaattgattctgttgatcaccaaaaatggatttcttttgtactctgcaacttataacacgctcttcggctcgctcctctacaatagaaatggaacacataaatatctcatatggccaacaatagtttgcaaatatattccgcttaaaaccatattagcttaattgatattgtgcataaattatgattattagaatggatttcaattccaaggatccaaacggggccttagagaatttgaaggctccaacattatggtgaatttaagatcttattgaaattctctacaattcaatgtcttggcttgtatgtttggtgcacaagttacttgcagctaatgtgttagaatgttctaataatttggtcagtgtcgatctaagatttttaattgttatcgtaagttgatacaatggtattcattcataaaatgataaaactggccacaacattagcttatgatactcacttgtggttcttacatagggacacatgctgaaactcaaaggaactctaatgcttgctaatgctgatgaagttgctgcaatccaagcattgagactaaagagctctgagaaaaataagatgacaagagaccataatggatttcgcaaactccttgttgtattgacaaaggctggcaaagtgatgactctgcacactggagatggacgtgttatctggtcaaaattgctgccatctcttcgtgcctccagatttggtggagtgccttctgcattaaggatataccaatggcaggtcccgcatcacagtgtgatgcgggaaaacccatctgtacttgttgttggtagaactggagcagaatcttcagctcctggcgtatactctattcttgattcatattctggagaagaacttaactctatgaaacttgaccattctgttttccaaattatccccttaacactgaaggattcatcagagcagcgactttatctgattcttgattccaattccaatgctcatgttatacccgaaatctgccaggc

SEQ ID NO: 15021 - DNA, 3687 bp, Zea mays
  misc_feature (1406)..(1406): n is a, c, g, or t
tgcatatttttttttggtgaaacttaacttacaatggttatccataaaatctagaagcacatcttgaagatttggacgttgggaggagagtgcaaggaaaatgttgggatgggatattttttagagaggatgtagtaattgtttgtgtgactcattatggatacaaggctgcccctttcaatagggatgacacaaatatcatcaatgaaatattttctgaactacaaatacacctaagggaactaagtaatggacccttgccatgtcaaattcaactaacagttagacgtctatgaaatgtataaaatggaataatgaacaacttatattttgatttgtgtgatggatacaagactgcccctttaaatagggttgacaaaccatcgtcagtgaaataacatagaccatcatcaaagaaataatttctgaactacaattacctcaaacacacctaagggaaccaagtaatgaacctttgatgtgtcaaattcacaactaatagttagacgtctacgaaaggtataacatggaataataaacaagttttagtttgatttgtgtggtggtttgctgataccagtaaatattcatgagacggcattcattgtattttcatttgtttgatttaacttacgctaatagctgattcacactttttctctttgtttctcccccagtcctttgtgacgcactctcatcaagtggaggccctgcgagccattgtttctattcctgcaaagttggagtccactattgttttcacatatggtgtcgatctattctacacccagcttgccccgtcaagaacctatgattccctaaccgacgaattcagctatgcgctgcttctaatcacgatcgcagtcctggttgccgccattattggtacatggatttggtctgagaaaaaggagttgagagacaagtggaggtgagcaaggtctcagtgttctgacgctgaggaaattttgggccctagtcagctaccttctcctcctctccccttttcattgtagtgctagagttcgtttcactttttgactaggactttatttatgtaaccgtttgacaacaaagcctatctgccgtgaattgtcacactgcggaggccttatagaaagccacttacgcaattaaagattcaggaaatgacatcgaagggttagcagagcgcagatggcgtgaatctgtaccactgcagccaaacacttcacagcagattttgtagctattgttgttggtagagggtttccgcttctcttgtgtaactgaaagctcgtctttatttcaatcactatacctttcttgacagaaactgtatatctcttccaatgcactgtcattacttctgctgttagcctgtgatagggtgggctacaagatgctctacgttggtgcggtttgcncaacctcagtcctccagggcatatctttattctgaaggtgatgtaacaactacatcattgaaccaatgatggttattgctacttcctgatcggatcgttcatgtgttaatgatggcagtgatcaagtcaggtaccatttaaagatttgtagcatcttttgtcaaggttatctttcttttggaatcttgatgctcgtttttttgtgtgtgtgcatattattggttgctatgctcagatctttaaacttcaatatagtacttcctgctcctgggtctgtcagcgtggcatgcaaggccgtctagcttgtctcaggttctttcatgtcacgccccatcgcccttttgcaacggacctaaggtggtagtggggctttcaggtcgcccatgcagaaattccaggtatgggttctcttttttctgtggtggtaaactggcaggggtcgcgagcttcaatcatggtaatgttgggtatgctcgcaacgatggagcgctctcaccggagtagcccagccctggcacatggcggcaggggacgagatgtgagatgtctgccatgatcgcgagaggtgagatcaggtaaagcggtggcttttgctgtacgaagcaattgcgagtagtagtagatgatgaagccgagttttcagctgaggcagcaggaggaggggtcgtgtccatccgttggggggccttcgcttttctgtgccttttttattttcttccttcttccggtgcttggttcctttgctcccttcccatgctaaaacttccaagcaatgctttgtggttttggcaaggccgatttgatccacttgtgcgctgtgtgcagtgcaccggtaaacccgtcaaatcctcagcgtcttttgcaggtagacggccttagtgcctgaagcgttgtgcatcagctagctgtggtgccgctttaccaggggggttccttttccgagttgcaagtaccccaggtgctgctggatgcagcagccaaagtggccatggtttacgatgtgaggcctcctttttaccctgatggaacggggctctggacaagcactgtggtgcggcccgcgcggcgaacgcgccgtggcgggcggcttgcctcagcccgaaatgtgtcaaccgctggcacacgcaaggagacggccagggcctagcagctaaaccgaccgatgagagccacaagccaccagacgcgacgcattttctatccctgtgtgtgtgagagagatgggaatgaatgtgacacggcgaaaatgcgtgcgtgctcatcgttccggacacgccgcaccaggttggccgggtggtggtggactggtggcgagtccaggccggcggttcccgtgaacgtgccaggccggagtgagccgctctgaaatcgtgctgtgcccggacactggtatggcatgggggtcaccacggccacggggattggtgtggtggtggccagccagctcgcgtcttggtcattatggtcagatttttctccgggaacaggttttcgccgcagggtccatggcctcgctgtctgcttgtgtcggcggtcactgcactctggtacaagcggtagcaggaggatcttctcagcggagcccctcgcgctcccatgggccggccattcattgattgagaagtacatgcgcttgttgcgtgactcgcagtgctgttttggccagcggacgtcattaaggacacatcacaaggcagatgccgctttgccccttcttggtatctagcccttcgaaaatcaagtcttaagacttaacacttggccgctaaaattagatgcacacttccacaaaacgtcccagttagccaccttttccacctatctttttcactcggtaagaagaattaacaactcagacacaataggatcaaactatgcgagaagattctaaaggatagtcttatctgtcttagctaatgactcggccaaataagcctcaagggcaaccgttaaagataggtcatgacagctggatctatgtgctcagcgacgagtccagagactcggcccacatgatcagggacataccctattcacaaggaagttcaggaagataaatatggtaaagatcctattagattagaagattagtttggcatccatgcaaatatggcaaaacccatttgataaggataaaacccatgtaccaatagagataagcaaccatgcagatgcagtacaatatagatttagctagacttggtaactatccatattatgcaaccaacccagatacatattctataagactagctccaacaaggagttctaaagggtcctg

SEQ ID NO: 15022 - DNA, 2226 bp, Zea mays
  misc_feature (2175)..(2175): n is a, c, g, or t
cgttgctgtcgcttctatttccctcctaaagctcaaaggtaccgatggattggaagtacttcagagatttgaccagccagctgcagtgagtgattccttgccaatcacagaaaaagaaaaagcttttgctgtcgtgcaacatttgggttccgaaattgagtttatcgtaaaatttacaagtgacctaagcagtgagattattagagaaaaggttaatatagaccaaaataagggcaacgttgagagggtcttcttgaatagttatattcgaactgacaagtctcatggttttcgagctttggttgtaatggaggatcattcactcttgttaattcaacaaggtgaggttgtttggagcagagacgatgggctggcttcaattgttgatgtaacaacatcagaattgcctgttgagaaggatggtgtatcagttgccggtgtggaacacaatctctttgagtggcttaagggacacatgctgaaactcaaaggaactctaatgcttgctaatgctgatgaagttgctgcaatccaagcattgagactaaagagctctgagaaaaataagatgacaagagaccataatggatttcgcaaactccttgttgtattgacaaaggctggcaaagtgatgactctgcacactggagatggacgcgttatctggtcaaaattgctgccatctcttcgtgcctccagatttggtggagtgccttctgcattaaggatataccaatggcaggtcccgcatcacagtgtgatgcgggaaaacccatctgtacttgttgttggtagaactggagcagaatcttcagctcctggcgtattctctattcttgattcatattctggagaagaacttaactctatgaaacttgaccattctgttttccaaattatccccttaacactgaaggattcatcagagcagcgactttatctgattcttgattccaattccaatgctcatttatacccgaaatctgcagacaccctcaatatatttcttcatgaaatgtcaaacctgtatttctactctgtagatattcaagcaaatgttattaaagggtattcattacagaaatcatgtgatctcaattttggtgatgactactgcttcagtacgaaggagttatggtccatcatctttccttctgattctgaaaggattgttatctctgaaacgcgaaatatgaatgaggttgttcatacccaagctaagacaattggtgatcatgatgtgatgtacaagtacttgtcaaagaatttagtttttgttgctactttgtctcctaaagctgctggtgatattggatctgtgctacctgaagaagcttcacttgttgcatatcttattgatgcagtcactggacgcatacttcatcgtgtaactcatcatggtgcacaaggccctgtacatgcagtcttgagcgagaactgggttgtttatcattattttaatctgcgagctcacagatttgaaatggcggtgattgagatatatgatcaatctagggcggacaataaagatgtcatgaagctcatacttgggaagcataatctttcagcaccaattacatcatacgcccgccctgaggtggcagtaaaatcccagtcatactttttcacccattcagtaaaagcaatggcagttacacaaacggctaaggggatcacttccaagcagcttctgattggtactattggtgaccaggttttggcacttgataagcgctatcttgatccacgccgttcagtgaacccgacacaacaagaaaaagaagagggcattataccattaacagattctttgcctataatacctcagtcctttgtgacgcactctcaccaagtggaggccctgcgagggatcgtttctattcctgcgaagctggagtccacgactcttgttttcacatacggtgtcgatctattctacacccagcttgccccgtcaaggacctacgattccctcaccgacgaattcagctacgcgctgcttctaatcacgatcgcagtcctggttgctgccatcatcgtcacatggatttggtccgagaagaaggagttgggggacaagtggaggtgagcgaggtctcgaagttgtgacgcggaagaaaatttcgggccccagtcagctagctcccttgttttggtcccccccttttttcattntagtgctagagttcacttcacctttgactataagcattttatttatgtaac

SEQ ID NO: 15023 - DNA, 1894 bp, Zea mays
aacgccgaaccgacgccgacagctgccgcctgccggacccaaccgcccgcgaccaagcctacaaaatcacaactccacgttcgtcgccgcgggaggatcgggctgggctggcctcgcctcggttggcttcagctgccacctgccgcgcggccactatccagcctccttcggtccttccccttccccagcagcaggctccggccgcagccatgcccaagccaccgccgcccacctccgacccctcgctccccaccaccaccaccacctcgacccccaagtcgtcgtcccgccctgcccccgcggggctcctcgatccgctcgccgcctccgggcgctccctcctcgcctcggcgcggcgctccccggtcaccacgctcgccggcgccttcttcctcctcgcgctcgtcatgtacggagaggacgcccgcaccatcgccgagctctccatcgacgactacctctacccggacgccgatctctacaacgtctccggcctgccgccccttgcgttgcccccgcctacctgcgacctctccagtggccgctgggtcttcgacaacgcctccgtcccggcgtacagggagaaagactgcaccttcctcaccaagcaggtcacctgcctcgccaacggccgccccgacgatatgtggcagtactggagatggcagcccagtgactgctccctccccacgttcgacgcccggagattcatggaggcgatgcgcgggaagcggctcatgttcgtgggggactcgctgaaccgcaaccagtgggagtcgctggtgtgcctggtgcagcccatcctgtccaagggcaggaagaagatcgtcaagcggggctccctcaacaccttctacgccaaggagtaccgggccacgctcgagttctactgggcgcccttcctcgtcgagtccaactctgacaaccccaacttccacagcatcaaggaacggatcatcagtcccgagaggatcgaggcgcacgccaggaactggaaggacgttgattacctcatcttcaacacctacatctggtggatgaacaccgccgacatcaaagtcaggagaccgaactcgaggtattggtctgagaacgacgaggttcccaggattgaggcgtatggtcgggtgttcaagacgtggtctgattggctcaataacaacatcgatcctgcccgcacgtccgtcttcttcatgacgatttctccaattcacatcagcccgcagaattggggaaacccgggacgggatcagatgcgtgaaggagacgcttccgtatcagaactacagccaacccctggatctttaccatgatatgcggttgtatgacctagtgatcaaggttgccagctccatggagaaggtcccggtgtcagtgatcaatatcacaaagatgtcagattaccggaaggacgcccacgcgtccgtgtacaccatccggcaagggaagctgctgacgccaaagcagaaggcagacccagagaagttcgcggactgcatccattggtgccttcccggcgtgccggacgtgtggaaccaaatactctacacgaggattctttcaaaatcaccatggcgttctaattttagtccccctccgtcccagtccctacctcttcctccccaatgattggagaatgtaggattatccattttctcttctttttttctttttaggttagattgagtataggatagcggagaaagggaaatggatgtgctgattactgatggtatgtaagaagattcagctgaagtgtaagttagttgtgagtcagccaattgaggaaacaacagcgatctagtacaaggtgcaccatggatatgatattatactataccctaggtatatgcctctgcgtcgctatggaatcattatatctatatgttcctac

SEQ ID NO: 15024 - DNA, 3165 bp, Zea mays
  misc_feature (259)..(259): n is a, c, g, or t
  misc_feature (1030)..(1030): n is a, c, g, or t
gcattatattcctttatttcctatctgtacaagcagtgtggttcgtgtggacttgatagttcctttatgagtgattgcaaatgcatccttgaactttgtgggccaatgtcgatgcaatgcaccctgaaactttgccggccactgtcgatccaatagggataccatacataggcttgatcgaaggggtttgtaagcccaaagtgccttctagagcatcaagcttcctcctctattcagcagggcacaatgtcattgcccnttcaatgtggtcaatcagtcaacgaataagacgcagctataactctataaggctggttcatggcccacaaggaaagtgatggcctagcttatggatttgatagtgaacattcttgcatggatacaaaacccaaatttagttcagttttctaaactgcactctgtgctcactagtagatttttgttggatatttctcagctttgtcgtatttccattatacaataaaagaaatgagggtactttagacttggtatcatggtacatagatgatactaatctttagagttttgaacatttgcaaaaactaaagatgaatagaccaaataaaatttaaaacttcatttggaaacctctctttgcatttcaggcgttgtgtgattaacatggtatatgaaaatcgaggtaacaagcatctgtagattaaagtacaccaaatctagcacttagggaatagggatggtgaggagactttttttatgacctgaacaaacttctatgtgggtctgattcacaataaggaaggcaaaaggctccatttggtataacagcaaaaagagtaatgtttgacatgtggtgtgggttagctgagatttttgtgctgttttttgcatcacaagcaaaaggaaaactgggatttgaaatgtaaacagcctctagagagaaaagggagcctcactgttctggaattggcttctgtatctgtcctggttcctaacagagacttagaatatgactctttgagtactgaagatagataaatatttatatatngatgcttactagaaaacatataagcctgttaaactttagtttctggtatatgatatcttgatcaaggatcagcttttgccatttcttacgtcatgccataattattaaaaaaaagtcttattgttcttctaagaaagaagtggcttcttattcagtttaaacaattaggcagttgatgctgttgtatgttgaacttgcgatattggagtatctgaaattagttgatataaaccacgctcctacaaaaccctacttttgctaggagaatttgaaatacttatctgcttcaatgttgcctccttacatgtgcttagagaaaagcaatgtgtgattatagtagtgcactagaaaagcagacgctaggttttgccacgccctaataggtccagaagtaggtataccactatttgcacatttgtgcagttggcatgcagtctacacaaatgaaaatccatgttcacaatctagatttacttcccctagcattggcgtggatagaatacacttccatattcgtatatgaaaactatctcatagaaagctgagaaagccctggatctctaaggcatgaatatgaagatgcttgtacagtgcagcattgtttgagggttcagagatgagcatacagcatgttaaaaaaaaattcgaagctcactggtttaaaattttgaaggacctcaaatatgttaaatacaatctcttttcagtggaaatgacttcagtaccatgttatcgatcaccatggtttggaagttcgataatctattttcgtgctagcaagtagcaatatcttccatgtaaagcttactccacacgcctccacagtgccatgccctagacatcataagagaaggcaggcaccttttgccgcagctgtacttgtcttgtgtcagttgggaaaggatcggaataaaatcaagagcagttgtgattaaaaaaagatgccagcatataaccaagcttcaggttttctgttgcttttggattgagaactactagcatcatatttcactcattcgtttacaaagtgccggtctcgctaacacttgtctacgttcttttctatgaaaacagcccacataactggggggaccccggacggggatcagggtgcgtggaaggagacgcttccgtaccagaactacagccagccgctggacctgtaccacgacatgcggatgcacgacctggtggtgaaggtggccagcgccatggcgaaggtgccagtgacggtgatcaacatcaccaggatgtcggactaccggaaggacgcacatacggggctgtactccatccggcaagggaagctgctgacgccggagcagaagggggacccggagaagttcgcggactgcatccactggtgcctccccggcgtgccggacgtgtggaaccagatactctacacgaggatcctttccaaaccgccttcttggggttcttctaatgttagcccctctccatcccagtccctgcctccccggtgaggatcacaagcagggaaggtagggtcttttcctaccacagcctgagcctaggaaaagtgtacggtttttcgttctctttctcctcctttttagtcggtacgtaggttgagtgaaggttagagcaaaagggaaatggagggggaggttactaatggcatggcatgtaggatctttgaggtgtagatgagctgtgagttttgccaattgagcaaacagcagctagctcgtagacagttgcgctatgcacatgtatgtatatatatatatatatataatataaagccttcttcctgctgtactgtatgctacaaaaggcgcctgtggcttcgtgacgcctttgttaattcctttttacaaatattttttcttcttcttctttcaaaacaatatctgttcctagaaaattatgcgatgcaattgcctcaagaaaaagaaatttacgcaattacaaaaaaaaataaaggagcataaaaacaacaacaacaaagagagagagagggctgagaggggctagggaccaaaacttcttgtttgtcctcgctttcaacctgtcttgaactagtgttgcgtaggaacaactctctgccttgtatacgctcatctcatctacaagccatgcttcaaaacacctcgacttttttttccctc

SEQ ID NO: 15025 - DNA, 2123 bp, Zea mays
cccacgccccgccgccccggacccaaccgacgccacacaccgcgttcgtcgccgcgagttcgggctgggcttgttggcctcgcctcggttggtgccctctctgccgccgcggacgagagtcgccaccaccaccaccatccagccagccccttcccttccccagcagcagtctccagccgcagccatggccaagccaccgccgcccacctccacctccgaccccgcgctccccaccactgctacaaccacctcgtcggcccccaagtcgtcgtctcgcccctccccccgcccccggggcctcctcgatccgctcgcagcctccgcgcgctccctcctcgcctcggcgcgccgctccccggtcaccacgctagccgccgccttcttcctcctcgcgctcgtcatgtacggcgaggacgcccgcaccatcgccgagctctccatcgacgactacctctacccggacgccgacctctacaacgtctccggcctgccgcccctcgcgctgcccccgctcacctgcgacctctccagcggcagatgggtcttcgacaacgtctccgttccggcgtaccgggagaaagactgcaccttcctcaccaagcaggtctcctgcctcgccaacggccgccccgacgacatgtggcagtactggagatggcagcccaacgagtgctccctccccacgttcgacgctcggagattcatggaggcgatgcgcgggaagcggctcatgttcgtgggggactcgctgaaccgcaaccagtgggagtcgctggtgtgcctcgtgcagcccatcctgtccaagggcaggaagaagatcgtcaagcggggctccttcaacaccttctacgctaaggagtaccgcgccacgctcgagttctactgggcgcccttcctcgtcgagtccaactctgacaaccccaacttccacagcatcaaggaacggatcatcagtcccgagcggatcgaggcgcacgccaagcactggaaggatgctgactacctcatcttcaacacctacatctggtggatgaacaacgccgacatcaaagtcaggagacccaattcgaggtactggtctgacaacgatgaggttcccaggattgaggcgtatggccgtgtgttcaagacatggtctgattggctcaatgacaacatcgatcctgcccgaacgtccgtcttcttcatgacgatttctcctcctcacctcagcccacagaattggggaaacccggacggtatcaaatgtgtaagagagacgcttccatatcagaactacagccaacacctggatctttaccatgacatgcggctgtatgacttagtggtcaatgtggccagctccatggagaaggtcccagtgacagtgatcaatatcacaaggatgtcagattaccggaaggacgcccacacgtccctgtacaccatccggcaagggaagctgctgacgcctaagcagaaggcagaccccgagaagttcgcggattgcatccactggtgccttcctggcgtgccggacgtgtggaaccaaatactctacacgaggattctttcgaaatcatcatggcattctaattttagcccccctccatcccagtctctgcctcttcctccccaatgagaatcagaagtgggggcttggtttttgtcggagaatgtatgatttttcattctttttccttcctttttgggtagattgagtaaaatgatagcacgaaaaggaaaatgaatgttctgattactgatggtatagcatgtaagaagattcagctgaagtgtaaattagttgtgagttagccaattgagaaaacaacagcgacctagtataaagtgcatatacatatactgctggttcacaggcaaaattacctatatataagccttttttcctgatggatgaaaaaaaatgtgcctatcttttttttaaatgactattgcttctttttttttttgaagtgcccattgcccctatgtgtatgggtaatgtacagtatataggacatggacatggggaagactattttgatgacagaaatatatcttgttttggagaccattttatttcagcctatggacttcaactaaaccatatttgaatgcagcagagctaatagtcaggggga

SEQ ID NO: 15026 - DNA, 1967 bp, Zea mays
cgccttttgtttaacatatcttttagaccaaaatcattgaaataatgtctaaatttatattaaattaatagactttatcatttttatgtgggtgcttaaggttatctccacgtgggaacttaaggttatctttttatagactatttattagtattgataatttttttgtatttttcggtcgatactataatattttaatgatttaattgtattttgatgattttctatgacaagaaattaataatacataaatagccttaaaaaatcgtgaaattttacggagatacaacatatgtccatatgtaaccataaaaaatgttggatcataagatctataagatgcctacgtttctttcctttcactttcacctatttgtatgagttacatgtagggctggacaaaaaactcgtggctcggtaactcgctcgactcgactcattagtgactcgactcgactcggttcgtttaaaatgagtcacgagttgaactaacaatttaactcggttcttaacgagccaaactcgagctgacttgtgagttactcgcgagccaaacgagttttacatcactgctaatctgcaatggcccagtccagtcccacccatagtcagccgagcagcccagccacacggtgacacggcccacacaagacacgcaatgacgcttgagcctcgacgccgcccggcagccgaacagacagagacaggagacggcgcttggcttctgccttctccttccctcacgctctcggtctctccctctctctccccaaaacctaaaccctagagccgccagacgccactgtccgtggagcagagcaggctgcagcaccgccgcgccggtgtgcggcgtgccggcgtgtgccctccgtcgtctgcccgtctgcccgtctgttcttcgctgtctgctcaagacacggtgaacagtctgttcttcgccgtctgctcgtcttccccgacggcgccctagccctgttcggctgtccggcctccggcgcccacttgcccatcgccggtcggcggctcgcctccatggaagcccaagaaccggatgggcacgaaggtcattcacgtccgccaataccatgaatttctggatcaatgatcaagcgcacgagcacgaggaagaagcttgtgccagcagctaagaagatttcagcggctgctagcactgcaccttcatcatccacatcttgttgtggtgctgtctctgtatctatagaaagctccaaatctgagttgctcatttatctagatgaatcaaatgtgtccataaatgagaaacactttgatctgcttaactattagaaggtgaatagtcatagatttcctatggtatcttctatggcaaagaggttcttggatgttccagctagcagtgtgtcatcagaatccacttttagcactaggggtaggatccttgatgattacaggagttcattgaagccagcaacaattcaggctttggtgtgtgcttcttggtgggttccccgggccccgaagttcacctattcttttaactgtaagtgtatggtggcaatacttgtaacttctaagtgtttacttgacatttcactatctgaatatgtgacactcactttgtacatattttgtagggagaaggtgatgatggtgacatcgagtccgtggaatttccaaagtgtgtggtggcaagtaattgtaagtgttgctgacttgtattgtatgagttatatacttatatgaatgtgtttctgatttatacgttgtccctgatttatatgagttatatgctgtccctgatttataagtggttctgatttatgtgttgctgattttctaatgacttgtagaggcacatggtcacatactcacatggaggagatggaggagagggagagataggacccgagagaggagacatgagaggcacatggtcaatatattttgttggctgtaattgtaagcctgtaattgttggttgcaac

SEQ ID NO: 15027 - DNA, 3405 bp, Zea mays
  misc_feature (2661)..(2661): n is a, c, g, or t
tgcaacaaaaagaatggtctaatataaaatgcagtaccccctcggcccccccccgacatggcctgatgggcgcgagggataaaagcccaactcccaattccccatctcgcttgctgtgtactcgcgctccagctcaccatttctcctctcccttcccttccctaagcatctcagcgaatccaatcgatccgaaggcgatggaccagcagggtgcgggcggggacgtggaggtgccggcggggctggggctgacggcggcggagtacgagcagctgcgtccgacggtggacgcgcaccaccgctacgccgtgggggagggccaatgctcctcgctgctggcgcagcgcatccacgcgccgccggccgccgtctgggccatcgtccgccgcttcgactgcccgcaggtgtacaagcacttcatccgcagctgcgcggtccggccggacccggacgccggcgacgccctccgccccggccgcctccgcgaggtgtgcgtcatctcgggcctccccgccagcaccagcaccgagcgcctggaccacctcgacgacgccgccagggtgttcggcttctccatcaccgggggcgagcaccgcctccggaactaccgctccgtcaccaccgtctccgagctcgcgggccccgggatctgcaccgtcgtgctcgagtcctacgccgtcgacgtccccgacggcaacaccgaggacgacacccgcctcttcgccgacaccgtcatcaggctcaacctccagaagctcaagtccgtcgccgaggccagcacctccagttccgcacccccgccgccgtcggagtagcgggcggccggaatcggcaaggggagaaacgcagcagcaagttttgggcgtttttctgttatttcacttctctgggaaatggtctctctgaattaaatctgatcgtggatggatttggactggacgagaggagaggaggggtcgggtcagcttgaatcaggtgtcgcgttgccagggtggcgacctgtaataacctctccttcatctcctagattccttcctttcatctcctagattcattcctttcatctctgcttcttccagaatttggttaatttcagctttatgcgagtggaatgattccttagaattgctgcttctcatatggctttgcattgcatgttcgcgttgcatgtttgcaagtagtagtaatcttcttgcatgtgatcctgatccattgcgtagtttgtttgcagtacaaatgcaaggtaaagcctagtgttgctagcgctacaggatcactgactggtcaattgtccttcatctaattagttccactcatgtcttcttagcagctgttcactggtgatgagtatgcatggttaatttcgttgctgcacctgaatttgctgagtaacttgagaatgaagaggaaaaaagaaacactgtgcggttcattcttttctcgcgtcaggattttagacgagctgctggtctggttctgtgtgttttgtttgtgcaggtgtgcatcatatatttgagcaatggttactaaatctcaggtatatcatactctcatagcagtatacgaggaaatggcaggcctcgttccggtgctacacttgacggtcgtcttgagacgcttgacctggccagggtgtttttggttgtctcttgccatgttttcctgctacgtgtacagtgtctagaaacaagcataaagctagggcgacgtactcttgttctgttttcatgcaatggatggatatggatgcccaccatctttctttcgcagctcccggaaattcttatctgtaccagaacagtgtgatgtggcgagcgtattttagttcgtcttgtacgtatttttcttgcgctttgcgtcggcttcgtcaatcagcggtgtcttcgtcacgaacttgtttccccccatctttctttcctgtttattatttcttcgtcaatcgtcgccgtcaccaactggtttagattccttctgctttgctttgctttgcagccacaactgaaatactgtacaataaaaaaacggtggtggaaaatacagaaacccattggggtgttgtcacccggagattatgtgttcagcggaagagaagagaagaaaagaaaaaggcagtggtcctagtttggcaacaattaacctaaagttcgtgcggctcaaattgaccagcaactgtactgtcatagtaagcgagatccagtgccgcattctttatgggcccccttccttttcctttcacagaatacgcatttcgtgccacagattgtgccgttgcagtgttgggcaaatcttccacgcagaggcatttgcaaaatgtcgtgcaacatgactggtggtggtggtggatgccctgccactggtgatgacgatgacagagaaaataaaaaaaaaggtaatatactgatagggggacagacggatcgatccgttcttaaatacgatctgcttctgggttgagggttcggttcagatccggtcgacctcagtataaagagggtccaaagagtcaaccacatgtccacccccaattaataactctgaaagtatccacatgcctacagaagataaatagccgtgatctaaaaataaacttttttcgcaacggattaaatcatgggtatcggtccaaaatgaaacttatggaattatccaaaaacaattctngtgaagaccaaattttcgaatctaagagaaaggttaagtaactagctacaaatcgaagtatttaaatacctgatcgagtttaccacatgtatagagttgtcgtgcaaagtcaatttaagcctcttttttttccttgttccgccacctacataccacgaagattcgaccacaacacagagttaactgtatggtacccgtggtgcaacgcaagagaagagaacataagccaccaagaggaaagtagcattttgatgttgtcaaggtcaggcatgtaaatggcaatgcttacttgctgtcatgtaatgtaaacacattttttctgtgatgattgttctgaaagtatttttaagctatttgcctcatgttcgacgtcaggtccatgtccatggcaggcttggagagcgcagcttagtagtagcgcaccatcggcaggtacgtagaaatgcgaaaggccttatggaggctcacatggtgatggtgtgctgtcttccggatccggacaatgaccgcccctcatcaacttgcccaacttgccctggtaataatcaaagcaggcaagaaaagagtcctcctcggcccataagctcagctggccggccaggggtaacgtcatgtcaggcacagctaagcacaataattttctctcaaagtccaacaggtagtgatcacccaattagggatggcagtgggtaagatacccagtgggcacatgaagccatacccatacccactaggaaaaaattg

SEQ ID NO: 15028 - DNA, 1567 bp, Zea mays
ctaaagtcagagaaggcggggaacgcgagtgggcataggtggctagcaaattagcaacagcaagacagggagcgagggatggtagaaagcacagataccaattccccattgctcgccgtgtattaaacatactcgcactccagctccccatttctctcctcccctccccttccctaatcatctcagcgaatccaatcgaggcgatggaccagcagggtgcgggcggggacgcggaggtgccggcggggctgggtctgacggcggcggagtacgagcagctgcggtcgacggtggacgcgcaccaccgctacgccgtgggggagggtcaatgctcctcgctgctggcgcagcgcatccacgcgccgccggaggccgtctgggccgtcgtccgccgcttcgactgcccgcaggtgtacaagcacttcatccggagctgcgcgctccgcccagaccccgaagccggcgacgccctctgccccggccgcctccgcgaggtcagcgtcatctcgggcctgcccgctagcaccagcaccgagcgcctcgacctactcgacgacgccgctagggtcttcggcttctccatcaccggaggcgagcaccgccttcggaactaccgctccgtcaccaccgtctccgagctcgcagaccccgcgatctgcaccgtcgtgctcgagtcctacgtcgttgacgtccccgacggcaacaccgaggacgacacccgcctcttcgccgacaccgtcatcaggctcaacctccagaagctcaagtccgtcgccgaggccaacgccgccgaggccgccgcaaccaccaattccgtccttctgccgcggccggcggagtagcggcggctgccatcggcaagggaagaaagcaacagcaagttttgtgcgtttctgttatttcaattctctgggaaagggtttctctgaattaaatctgatcatggatggatttggactggacaaggaggggccgggtcagcctaaattaggtgtgattgcaagggcgcgacctgtaataatctctctttcatctcctagattccttcttttcatctttacttcttccagaatttggttaattcctgctttatgtgattggaatcattccttaggaattgctgcttctcaaaaaaaaaaaaaaaatctttgcattgcatgtttgatgtggctatcttgaggcatgtgatccatgcctaattcgatcctcttagattgctagcgctactggatcactgatcaattgtccttaagttccagtcatgtcttagcagttgttcaccgatgatgactatgcatggctaatgtcgttgttgcagccgaacttgttgactgatttgagaatgcaaggaacattgtagtggtccatcctctttttttccaacaaggttctttgtgttttcgtgcaggtatacaccatatatttgagtaaaatataaatctcaggtagttcaagcatagtagtagacatggcaaacctcgtcgattccttaaatcgtactggtgcaatactgtcttgagatgcttaagcctggcagggtgtttttgtctcaaaaaaaaaaaaaaaa

SEQ ID NO: 15029 - DNA, 927 bp, Zea mays
ccgggaccctaattccgcaggaggccgcgccgggggagtgacgccgatgcagcgccgggtgggcatggcggacggcgaggctaggtgtcggacgctcggcgccgtcatcaaggagaaggatgaggagttcgcgctcttcctcgagatgcgccgacgcgagaaggagcgcggcgctgcgggccgccgcggcggaccagcttctgctctccggggacgtcgcggcggagaacgggatgctgctcctcgacccgccgccacccgctggtgggagcttcatttcggcctcttcttcggagcccaaaccggcggcgtacaaggtggctggcggcggatttaggagggcgcctgggggagtggacgacttcctcaatgcagacgccagcgacaagaacgattacgactggcttctgacaccaccaggaactccattattctcatctctaaaagttgagccaaaaaggtccctggtgagtcaagctggaacgccaaaggctcgtccaactgccttgaaatcaaggggagaaggtgatgatggtgacatcgagtctgtggaatttccaaagtgtgtggtggcaagtaattaggcacatggtcacatactcacattgaggagatggaggagagggagagataggacccgggagaggagacatgagaggcacatggtcattatattttgttggctgtaactgtaagcctgtaattgttggttgcaacttgtaagttgcaactgttgctaacctgacatattttgttggctccctgcaactttgtcctgaactcctgaacctgaagtcctgatctataattgttggctgcatcactgcatgtatttggttctagaactgaaactctgaaagtatggaattatggattatggaatggaatggaactattatgaacataagtcaaaaaaaaaaaaaaaaa

SEQ ID NO: 15030 - DNA, 811 bp, Zea mays
cattgggtaccctcgaacagcccccctactttcctctaccttgcagactgcacactgcctcaagatggtttcctgttcctcatctccacggccacccatccctctcctgctcctcttcctcctccacttctcctctgtcctcgccgtatcagctccttcagcctcacaacaggctggtaccgacggcggcggcggcaatgtgtcggagacggcggcatggacgccgcggctgaggaagacgttcttggacggcggcatcgagcactggcacgggcggcggctggtggggcggttccaggtgtgcgcggtgtgcacctgctgcgggggcccgcacgggatgtgcatcccggcgccgtgctgctacgccatcaactgcaacatccccaaccgtccattcggcgtctgctccttcaccccgcgcacctgcaactgcctcaattgccacctctagcctagccttgccgccaaggatgccaaggtgtggcgaactgctgctggatccatggttttgattgtttcgctttttaagttggttgccgatgcaagggattcgtggtgagagattcgttaatttagggaccaagtggaagattccatcattgcataatactagtattgttagtagtatatactcttgtcctgcattgtagttgtagccatgactcatagtaagtagcagtatggtgatggttggattaattcagcttttttgctcttgcttggtgttgttcaactgtggatagtatctatcattgcagtgtggtacttgtattatttttttcctcatggcagtaggcatgacctttgttct

SEQ ID NO: 15031 - DNA, 2689 bp, Zea mays
cggtacccctgtggtgtgtacaaataagcacagtgccatttcgatcagatcacaaattcgttcatggatacaaagcatgcctccacccgcacacccatttacatggttttggaagccagcgttgattctggtttgccttttgctattctaggttctgaagcagaagaagctgctcaatgcccctagcttggggttcggagctctggtttctccagggaaggaggtgtcacctggcccagaggttgtggagcgtgatccacgccgttgcctgaactgtggcgcctatgtgaacttgtactgtgatgtccagatcggctccgggcagtggcaatgcgtcatttgcaagaagctcaatggcagcgagggggaattcgttgtctccagcaagcaggacctgctccagtggccagagcttgcatccacgactgtggattatgtgcaggtggggaacaggcgtccaggctttgtcccagtgtctgacacgagggtgtccggccccatttttatcctcatagatgaatgcctcgatgaggcgcacctgcagcatcttcagggctccttgcatgcctttgtggattcgctccctcctaccgcaaagataggaataatcacctatgggagaactgtctcagtgtatgatttctcagagggggcagcagtgtcagcggatgtgctacctggaaacaagtcgcctacccatgagtctttgaaggccctaatctatgggacaggtgtttacctgtctcctatacatgcttcgctacctgttgcacacacaatattctcatctctgagaccctatcagctgagcgtgccagaagtgttaagggatcggtgtgttggagcagcagtagaggttgcccttggtattattcaagggccatcagtggagttgtctcgtggaatcatcaagagatctggtggaaactgtaggatcttggtgtgtgctggtggccctagcacctttggaccaggatcggtgcctcattcagctaaacatcccaactatgcttatctggagaagacagctatgaagtggatggagagtcttggtcatgaagcacagagacacagtactgttgttgatatcttttgtgctggacagtgtcctgtgagggtccctgttctgcaaccattggcaaagtgttctggaggtgtgctcttagctcatgatgactttggagaggcctttggggtcaatttgcaaagggcatcaactagagcagctggttcccatggcttatttgagatcaggtgttcagataacatgtatgttactcaagttattggccctggtgaagaggcttctcctgattctcatgaaacgttcaagcatggtagttccttctgtatccagatgcatagtgttgaggaaacacagagtttttctgtgtctatggagacaaaggctgatatcaaaagtgattttgttttctttcagtttgctgtccattattccaatatatatcaaacagaaatcactcgggtgatcactatgaggctgcagactgatgatggtttgtctgcatatctggcaagtgtgcaggaggatgttgcggcagttatcattggtaaaagaactgtattgcgtgccaggactgcctctgatgctattgatatgaggctctcaattgatgaaagagtaaaggacatagctctaaaatttggtagtcaggctcccaaatcaaagctttaccgcttcccaaaagaactagcatcactcccagagtgcttgtttcatctgaaaaggggaccacttttaggtagcataatcggacatgaagatgaaagatccgtacttaggaatttgttcctgaatgcttcgtttgacctttcgctccgtatgttggcacctcggtgcataatgcatcgtgaaggtggtacatttgaggagctgccagcatatgatcttgtcatgcaatctaatgctgcagtggtactggaccatggaacagatattttcatttggttgggtgctgagctagcagcccaagaaggacaaagtgcagcagctttagcagcatgccgtactctggcagaagagctcagcgagaaacgttttccagctcccaggatactttcattcaaacaaggaagctctcaggctagatattttgtctcacgcctgatcccagctcacaaggaccctacatatgagcaggagtcaaggtttcctcaattgcggacactcactcctgagcaaagggctaggctaaagagcagcttcatccagttcgatgactatagtttttgcgagtggatgcgcagcctcaaattggtcccaccagaaccaagctaacacaactagtctggggggtacacttccgaacggtggatagcaacagaatctatggcgtggcatctgatagagctttccctctaagatagatgtgatcttcatgaaccaaattatggcatcgccagatattcgtgagccgatcatacgtttggtttggtgggcagccatttaggtgcggtggaactgtatgattttgcataattcattttcttctccttttgaccatgatgtagtagagtaagttcataaacagttccttgtcaattgtcatacaggtggagaaatctacacaataagtttgtcaattgtcccaaatgttacatgtatacaacctttgtttgaagaggtctcactatattatttgaaattccttcaaaaaaaaaaaaaaaa

SEQ ID NO: 15032 - DNA, 740 bp, Zea mays
ctgtgcggcgctcgaggccgcccggctccgaatttcctccctccaactttgcacagtctgcgcaccctgccacgacgagatggcttcctgttcctcatcgccacggccacccaccatccctctcatcttcctcttcctcctcctccacttctcctccgtcctcgccgcaccagctcctccagccttgtcacaacaggctggtaccggcggcggcggcggcaatgcgacggattcggcggcggcgtggacgccgcggctgaggaagacgttcttggacggcggcatggagcgctggcgcgggcggcggctggtggggcggttccaggtgtgcgcggtgtgcacctgctgcgggggcccgcacgggatgtgcatcccggcgccctgctgctacgccatcaactgcaacatccccaaccgccccttcggcgtctgctccttcaccccgcgcacctgcaactgcctcacctgccacctctagctagcgctcgccgccctggatccatggttttgcttgtctagctggtcgtttcgttgtcgatggaagggatattcgtgattcgttcatttgggggacagattcgacgaagagttcatcctgccctaaaactgcttgcttgtagccatgactcacagttagtagcagtatggtgatggttggattaatccagcttttttttctgcacttgcttggtgctcttcaacttcaactgtagatattatcaagaaaaaaaaaaaaaaaa

SEQ ID NO: 15033 - DNA, 2489 bp, Zea mays
ctctcatcgcggctgcccctcggcgatctcatgagcctcggtcgcctctcttcctcagcccgctcgccccctcttcgatacccccgataaaacccccgacccgccccgtctccagctggccaccccatcctcgtcttctccaattccaaagtaagaaagccacacgcgaggccgaccgaggaagtccaatctcatggcgctctcctgcatgaggtgccccgcgggcgccggcgccgcctccgcccgacgcgccgcagcgcagccgttggccgcggaggctgcggtctccttcgccagatgccgcggcttcgggaggtccgccaccgctgcgacttccgcctggttttggcgcaaccatgccgttgcctcacagggagtgaaagctcccatggatgctgatgtcaagaatgctgtcatacctcctacctcaccaaaggtggaaagtggctctccttcagaaatcactctggatgaatttgaagacttgagcgctctatgcaagaatgatgattctactgttagcatcacagtagttggagcatctggtgaccttgccaagaagaagatatttcctgccctttttgctctctactatgaagattgccttcccaagcatttcaccatctttggctatgcacggagcaagatgacagatgctgaactgaggaacatggttagcaaaacactgacttgcagaatagataaaagggaaaattgtagcgagaaaatggaagagttcctcaaaagatgcttctatcattcaggccaatatgattcagaagagcatttcatagatctagacaagaagctaaagcaacatgagggttccagagtttctaaccgccttttctacttgtcaatacctcctaatatatttttggatgttgtaaaatgtgcaagcaaatcagcatcttcggtgaatggttggacacgagtaattgttgagaagcccttcggccgagactcagaatcctctgctgcattaacaagcggtctgaagcagtaccttgtagaggaccaaattttcaggattgaccattatttgggaaaagaactggtggagaatttgtctgtcctgcgcttctcaaatctcgtttttgagcctctctggtcaagacaatatataagaaatgtgcaacttatattctcagaagactttggtactgaaggacgtggaggatactttgatggctacggtattattcgagacataatgcagaatcatctcattcagatactagctttatttgctatggaaactcctattagtttggaagcagaggatataagaaatgagaaggttaaagttcttcgttccatgaagccgttgcagctggaagatgtggtcgtaggacagtataaaagtcacacaaaaggtggtaccacataccctgggtatactgatgataagacagtgcccaaggatagtgtgactccaacgtttgctgctgcggcgcttttcataaataatgccagatgggatggagttccctttcttatgaaagctgggaaagctttgcacacaaaacgagctgagattagggtacagttccgacatgttcctggaaatctctacaaggggagttttggcacagatcttgatagggccactaatgagcttgtgatacgtgtgcaaccggatgaagcaatttacctaaagattaacaacaagattcctggtctcggtatgcgactagataggagtaacttgaatctccattatgccgcaaggtactcaaaggagatacctgatgcttacgagagactcctgcttgatgccatcgaaggagagcgcaggcttttcatccgctcagatgagttggatgctgcatggtcactcttcacacccctcctgaaggagctggaagagaagcggatagctcctgagctctacccatatggaagccgtggacctgtcggggcccactatctcgccgccaagtacaacgtaagatggggtgacttgagtgcggagcactacaaggcatgaaacgaagatggccatatctttgtgatattcttgcttttccatttctataagtttgcacgccctggcagtgagatagatttaagagaaaaaaaagatgagaataaggcgggcagttaactaggttggaaggcatgtatccattactagactgaatagctttgttggcataattgcagctgttagggctagtttgcaaccccgtgtttccaaagaattttcattttcccaaagaaaattagtttattttccctttggaaaatgagaatctcttgggaaaattgagttgccaaacgcccttaaaaatatgtttctaggaatcagtttatttttcacaggaacaataaaggaaacggaaaaaatttgccgcatttcaaaaaaaaaaaaaaaaaaaaaaaaaaaaaaaaaaaaaaaaaaaaaaaaaaaaaaaaaaaaaaaaaaaatataaaaaaaaaaaaggggggggcccgccacttgggggcttgtccacccgggaattaat

SEQ ID NO: 15034 - DNA, 2124 bp, Zea mays
gcacgccgttttgataagtgggatggagcaaaccagctttttgtccctacaagcttcagcggttgggttctcacactctcgaatccttcgtacagttgttcagcatgcttgctcgcgattcccttctcttcttccatgcaataatgcttggaccgctttgtccagaaaactacaaccatcaaaacaagtagaagcaatccacaaaggaacatcaagacagaaggtttttgtgatcttcggaggggacacttcagaacggcaagtatcacttatgagtggtaccaatgtatggcttaatcttcaaggttttgatgatcttgacgtgacaccgtgtttgcttgcacctgcacatggatatttctcctcacatgatcaagatttcagtgacagttcaagagaagtttggacgttgccatattcattagtgttacgacataccactgaagaagttcatgctgcatgtgttgaggcaactgagccagaacgagttgaaataacaaaacgtttgcgtgatcaagtaatgaatgaacttgggtcagcattgagcaaacatgattggtttgcgggctttgacatagcttatgaacaacctatcaaatactctctgcaacagtggatcgaccatgtaaaagaaactgaagctgtagtctttatagcagtgcatggtggcattggcgaggatggtaccattcagacattgttggaatctgcaggagttccttacacaggaccaggaccaatagcgtctagaacatgcattgacaaagttgcaagttcacttgctgttgaccatcttgctagttatggaatccgtatcattccaaaggatggtagagcaacagaagaagtactgaactcatctcttgttgatatctggaatgaacttaaagcaaaactagaaacagaaacagtatgtgtgaaaccagctcgtgacgggtgctcgactggtgtagcaagattgtgctgtccaaaggacctagaagtctatacaaatgcattgaggaggaagtttcagcatctgcctgctaattgcctgtccagggcacatggtgtaattgagatgccagtcccttctccagagtcactaatatttgagccttttattgaaaccgatgaaattatcattgcaaataaattagaggatggtagtgcccgccatcttgtatggaaaggtgaaaatgactggcttgaaataaccgttggtgtagttggcaaacgtggagaaatgcactcattaaatccaagtatcacagtgaaagaaagtggtgatattttatctcttgaggagaaatttcaaggtggcactggaatcaacttgacaccacctcctgcaacaattatgggcgaggatgctctgcagaggtgcaagaagagtatcgagaccatggcaaacgctctaggtttggaaggcttctcacgcattgatgcatttgtcaacgtgcgaagcggggaggtgctgctgattgaagtcaacactgtacctgggatgactccatccaccgtgctgatccaccaagcactcgcagaggaaccgcccgtgtacccccacaggtttttccgcactcttctggatttggtgtttgcaagggcaaaatagctatctcacatttatttttctttttacggtgcgtcggtttgattctgtatcagtcgagtagtatttttatttatatttgtgggaaaaaaatcgtcttctccgtgttgatgcgatgaaaaataaacatgtatagcgttgcgcggtcgtcgtgcacatcagagcagagcagaagcaaccctccacggacgtcaagtcaaaccaacacgtccgggccacaatatggaaagctagctatacaagtatcgtggaatataaactctcaaacttaccaagttttcatcacatcattaatatagaggtttagttctcgacattgaaatcagcagtaaaaggattgggtggactgaatgatgcagcagcttatcatcagtgtgtaccacatcaaatctgtcattgagttcttgactcttagggcatctatagcctacataaataaccagtagcatgttcggttgcaaagtgtttgaaaattgaatagaaagatatttaatcttcttcaaaaaaaaaaaaaaaaaaaaaaaaaaaaa

SEQ ID NO: 15035 - DNA, 2728 bp, Zea mays
gctcggtacccctgccctgccagctcctgcccccgccgccccgcccccacacccacaccacaccacgacctccgcgacgctcgcggccgtgtttctctcgcctcgctccctcggatcgcccgttcgcccccgcccatcgctcgctcatcagaaggagggcctagccttccgcagcagcgctcgtcagactccgccgcccgcaattccccccttgccccggcttttaatgggctttccctcccaccgaaatggccggcgatccctgcacccgcgccgccggtgaccgccccacctcctccgtcgccttcttctccgccgggggcgggctcggcctcggcccctccagcctgctgctccacctgctcctcctccactccctcttatagcctccagcctcccctcgcctcccgccaccccctatggccgccgttttcttccaccacgtcgtcggcgacctcaccgtcggcaagcccgaggtcgccgagctgcacgacaccgacacgctcgacgacgccgcgcgcgccatcgccgccagccccgagggcgccgtgcccgtctggcgccccagggccgcgccggacgacccgccctcgggggccaggttcatcggcatgatctccgcgctcgacatcgctgccttcgtcgcctccgcgggggtcggggatcgctccatgcgcgccgtcgtcggcgaggtcgtgcagcccaatcctgcgctgctcagggagatcgatccgggtaccaggttgatcgatgctctggaactgatgaggcatggagtgaagcgctttcttgttcgcaagagtgggagctggaaaggcattaccaagagattttcagtgctttataatggtaagtggctgaagaacatggaatcaacatctccaagtgcagccagcagcagcagcacgcagctatccccacgttctggttctgcagaaaagttctgctgcctatcaagggaagatgttctccggtttctcattggatgccttggtgctcttgctcccatcccgctgactcagatatcttcccttggagccatcaatccgcagtacagttacgtggaagcatctgcgcctgcgatggaagcaattcagaagatccctcaagacccatgcgccgttgctgtagtggagacgatgccagatggaactcgtaacatactaggagacatctctacttacaagctgtggaaatgtgactatgtttcagctgcatgggcactggcaaacctgtcagctgggcagtttgtcatcggtgccgacgagaatgggtcaacacccatctcagtcttcccagagcctcccatcagcccatcgtcaccggtggaggagatcagtcctgggcgctcgccaagggcgaagaagttcagcagcaggagcatcgggtttctgaacaacacccagatgtcagcgtggcggacacggagcatgtaccaccggggcaggagcaccccactgatgtgcaagaccacaagcaccctcgcggcggtcatggcgcagatgctgtcccatcgggccacacacgtctgggtgacggacgcagagtcggaggaggacggcgtcgtcgtcggcgtggtgggctacaccgagatcttcaatgccgccaccaggagcacctgcccaagtccgacagcatcttgatgcaccacatcgtgctgtacagtatactgctgttggttgatccgttggtgccccggtgcacgctgttgcactgaactgtacaatgtactttgctcatttgttggtttgtctggagagtttttagtcttttagatattcttggtctgcatggagcaggacttggtggtatattgttgcattcgttgtggacggtacgaataagaattcgggcttgcctcggagtctagtccattttgcatgctcgcctgcagcagtgcagctgtcgatgtactctatgactgtatatggaaatggaatgttctctgtttcctttcacatgcttgcagccttgcctgagagtctagttgattcatgtgatgttttgaggtgtttggttgggccccaagcagctttgcctggtgctctgctagctctcaagcgtctgatttcgggcatctgctgggacggagaccacagatgtttgaaattcacttgtaatatcacagatacatatatatgtatcttgttttaattgtatatgtgccgaggcaaaactgaaatcccttacggggcgttttgttcccttcattttagaggaattagaattcactcaataaagtagcttatttagtttggaatttgacattccaccactttccacagttcagatataagtctatctcaaattcattgagtggagggtgagaaataattttatgtattaatagaatttgtttctattgtgtaacttacatgacactcttcgtctcactcctctataataaaaatgtagcacataaatatctccgatatcttgctaataatagtgtacaaatatattttgcatagaaccgaattaacttaattgatatatgtctaaattactattactagaatggaattcaattccaatgatccaaacggggcgtagaggattaattgtatatatgccacttaacttgtttatttggatgttacttcatggcatccaactgaactatctatctatctattgtagaatatttcagataagcccctttttatcttttgagagaatcgcagatacttgtctcaaatgaaagaaaaaggtgaggtcgagagcaagg

SEQ ID NO: 15036 - DNA, 1735 bp, Zea mays
cggcccagggtgccccacccgcccgggacaaaacttcatcctcaattatcctatggcgtcgtcgtcctgacgcgggggcggcgaggaggccggaggcaataaacaatcgcgccagcaaggggctctcccgtccaatcgcatcgcctgcacgagccttatcagtccacgaccatcatcatcaccactcactgcagcggcccgcactcggccgcgactgcgagcgagccgtcgccgcgagatccagcgccgtcgtcgcgcctccgccactgccgccgccgccgccgctgcccaagatgccgagcccgacgatccggaggctagacgtggcatcgccggtgccggcggacatcgacatcgccaactccgtcgagccgctcccaatcgccgacatcgcagcagagctcgggctccggcccgagcactacgacctctacggcaagtacaaggccaaggtcttgctgtcggttcttgatgagctcaaggcgcaacaggacgggtactacgtcgtggtgggcggcatcacgccaacgcccctcggggaggggaagtcaaccaccaccgtcgggctgtgtcaggctctcggcgctttccttgataaaaaggttgtcacttgcctccgtcaaccatcacaagggcctacctttggaatcaagggaggtgcagctggaggtgggtacagccaagttatacccatggatgagttcaatcttcatctgacaggcgatatccatgcaattacggccgcaaacaatcttcttgctgctgctattgatacgaggatattccatgaaaattctcagtcagataaagcactgttcaacagattgtgtccggcaaacaaggaaggcaagaggcactttgctgacataatgttccgacgtctgacaaagttgggcgtttcaaagacagaccccaatgagcttacaccagatgaaatcaggcgttttgcaaggcttgatatcgaccctgagtccattacatggagacgggtgatggatgtcaatgatcgtttcctgagaaaaattactgttggacagggccctgaagaaaaaggtatggtgagagaaacaggctttgacatatcagtagctagtgagataatggctgtattagctcttacaacttcccttgctgacatgagagaaaggcttggaagaatggtgatagggaacagcaagtcaggtgagccgataactgctgatgatcttggtgttggaggtgcattgactgtcttaatgaaagatgctattcatcccaccctcatgcaaactcttgaaggcacaccagttttagtacatgctggaccatttgctaacattgctcatggaaactcttcaattgttgctgataagattgctttgaagttggttgggaagggtggctttgttgttactgaggcaggttttggtgctgatattggaactgagaagttcatggacatcaaatgtaggtatagtggattggtgccgcagtgtgctattatcgtggccacaattagagctcttaaaatgcatggaggggggcctgaagtggtggctggaaagcctctggatcatgcatatgtgagcgaaaatgtggcccttgttgaagctggatgtattaatcttgctaaacatatatcaaacacgaggagttatggagttaatgttgtagttgcaatcaacaaatttgcatcagatactgaggcagaaatgaaggcagtgcacagtgcagctatggctgctggtgcttttga

SEQ ID NO: 15037 - DNA, 2350 bp, Zea mays
cacgcaaatgaagaaccagcacgagcggcaggagaactcgcagctgagggcggagaacgagaagctgcgcgcggagaacatgcggtacaaggaggccctcagcagcgcgtcctgccccaactgcggcgggccggccgcgctcggcgagatgtccttcgacgagcaccacctccgcgtcgagaacgcgcggctccgggaggagatcgacaggatctccgccatcgccgccaagtacgtgggcaagcccatggtgtccttccccgtgctgtccagcccgctcgctggggcgcgtccgtcgccgctggacatcgacagcggtggcgtactggggggtgctgccacttatggcggcgccgctgacatcttcggcggcggcggcggcgtcgctgcttgtggtgcggccagggattgtgacaagcctatgattgtggagctggctgtgacggccatggaggagctggttcggatggcgcagctggacgagccgctgtggaacgcgccggcaggcgggcacgacgggtctgctgagacgctgaacgaggaggagtacgcgcgcatgttcgtccctgctggagggctcgggctaaaaaagcagtacgggttcaagtcggaggcgtcgcgcgacagctccgtcgtcatcatgacccatgccagcctcgtcgagatcctcatggacgtgaatcagtatgcgacggtgttctcgagcatcgtgtcgagagctgcgacgctggaggtgctgtccaccggcgtggctgggaactacaatggcgcattgcaagtgatgtcggttgagtttcaggtgccttccccactggtgccgactagggatagctatttcgtgaggtactgcaagcagaacgcggatggaacatgggccgtcgtcgacgtctcgctggacaccagctcagtcctcaagtgccggcgccggccgtcgggatgcctgatccaggaaatgcccaatggctactcaaaggtgacctgggtggaacacgtcgaggtggatgacaggtcggtaaacggcatctacaaactgctggtggactcagggctcgccttcggtgcacgccgacgggcccggccgctggaccgccagtgcgagcgccttgccagtgtcatggccagcaacattccgaccagtgacatcggcgtgatcactagcacggaggggaggaagagcatgctgaagctggctgagaggatggtgacgagcttctgcggtggcgtgacggcctcagccgcgcaccagtggacgacgctgtccggcagtggtgctgacgacgtccgtgtcatgaccaggaagagcgtcgacgaccctggcaggccgccgggcatagtcctcaatgctgccacctctttctggctccctatcacacccaagcgtgtcttcgacttcctccgtgacgaaagctctcgcagcgagtgggacatcctctccaatggcggcgtcgttcaagaaatggctcacattgccaatggccgcgaccatggcaactgcgtctcgcttcttcgtgtcaatcagagcaccaactcgacccaaagcaacatgctgatcctgcaagagagctgcacggacgcctcgggctcgtacgtcatctatgcgccggtggacgtggtggccatgaacgtggtcctcaacggcggcgaccccgactacgtggcgctcctgccctctggcttcgccatcctgcccgacggcccgtcaggcagcagcaacatgcaaggcggtggcggtggcggcgtcggctcaggcgggtcgctcctgacggtggcgttccagatcttggtcgactccgtccccaccgccaagctctcgctggggtcggtggcgaccgtgaacagcctcatcgcccgcaccgtggagcgcatcaaggcggcggtctccggcgagagtgttacccagcagtagctagcttagtcgaatcagacactcttcttatccttgcatcattgaaggagcagcaagttttagagctttcatcagtgggaagtcaagaacgcacctcagactctccttgccatgtggtgctcatagttcgagttcttttttcgcctagtttccccaaaatttctgggtagaaatatttcagtcgcgcaacaagaaaatgagtcaccactacgcaagggttgttggttcgggtattgacttcctctacatgtcggcctctcggatgctgctacctctgaatttaggcttctttttcttctcttgtgggatacaaaaaccgtaatttagcatgtaatttgtgctgttgctgcagttgttcagatttatccagcatatatcctggattccccaaattgagatttctcggggtcccctaaaaaaaaaaaaaaaaaaaaaaaaactcga

SEQ ID NO: 15038 - DNA, 1507 bp, Zea mays
cctcgaggccggccgggccgggtaccctccacgcgggccccgcggcgggcccgggggatcgcagagtcacgcgtcagttcgttccctcctctgtgtaccggccagtaaaatccgaacccacagcgagaaatggcggcggcagcgctccgtccggcgatcctccgccgcatccgcctctccccctccccttcgctcgccctcgccgccgctgggacaggtgcatcccacccgcacgcgctggggcggtggctcgcgcggcccatgtcctcccacgacgcgcacctcacccgcgacgaagtcatcgaccggatcctcgacgtcatcaagagccaccccaagatcgacccctccaaggtgaccccggaggcgcacttcgagaaggatctggggctcgacagcctggacaccgtcgaggtggtcatggccatcgaggaggagttcaagctcgagatcccagacatggaggctgacaagatcgactcactccctctggccatcgagtacgtcgccaaccaccccatggctggctgagcctctgctcgcccgagaggaggcgagttgaggtgaggcttcgcttggttttgtttccgagggcaaataatctgctggagtggcacagaaaaacttgttcctggtgctctgcattgcttcacggtgacggatgatgatgtcgaaatggaacattaacattttcagcgttagattgttgtttttgtgtgcgtgttatatctatatatactggttgacaaactagtttggttgattgagtctgatcgttgttgggttatttgaattgggttcgtgatagtttcccatgatattttatctgttttccatgtgcttttgggaacctaaattgataagaacggcttacaaggattgatgtaggttaaaagtctcagggttcatgacagctgttagtgtggcctcttgttgtccaactcttgttcctgttaatgaggcttgagtctgttttatttgtcaacattatggttttgttggttggaagtattccacctattgcatgagaagagatcaaaggaaagtgtggcctcttgttctaacatttttgacaaaaatattttattctgttaaattgaaaaccattgcacaaaaaaaaaaaaaaacacgtagactttgagtgtcttgctctcagcagaattgagaagggctttattctgttggtttatcatattctctttatcagtttaacacaagcaaaattttaccagcaatcttcgactgatcgtgattagttggcctagccagtcccttgaattctaccatgggtaccaaggttagcttgactagatttctggtcgtctgactagtcgtcaataaatcatgattagtcatctgattatgaaggggatgaccagggtgcctgactgcctgccctctttgggcgggtctgctccactaggctctgaggcaactagtgggttaccaatttggcctggtagggttagcataccacttcccaggattcataaaaaggcagacaagg

SEQ ID NO: 15039 - DNA, 2993 bp, Zea mays
agccaggtgccagggcccaggaggccagaagccgcacacgcggtcacgcggaccgcggacgactgccgccgccgtcgtcgtcgattggctcgtgagtcctgctcgctgctccttcctacgccgtgccaccgcctgctgtttcgctcgctcgtgcttggctgctcctgactgcaccgcgccgccgccgccgcagttctgctctccatcccgacacatcgcgccgcttcaagctaaagtgccactgcgccaccatccatcccggcatctcgcgccgtttcagtctcaagagcagatacgcaggtatggagccacgcactgagggagatgcttccaggaacttgcgccaaggtcgattgctagagccgccaccggtacctgctgtgaggacttctccagaaggagtgcagaggcacacaggtcaggatgtgattgctagtagaagtcaaagtgcagcagcatctgagacgggctcttctttgccatgtgaagatggaaatgcaacggctgaaactattggcagcagcacccatcctgtgcacattggtgtgcaaaaccaagacattgaacaagagcaagttcatgagactggaaagagatacaagaggttgacatctgatgtatggaattactttaccaagaaaaaagagataatagaggagaatgggaagaagcgtgagcaaatttggggttattgcaacttcccaaattgtaagcggcgatatagagcagagggccgccaaggtacaactgcatttaagaatcatttgaggtccgcacacagcatagttcgaggccaacaacaacttaaatttgagaaggaccttggtaataacattacccatatccagcctttcatgtatgatcaagaagttagcgtgaagaaacttatcatggcaataattatgcatgattatcctttcaatatagtagagcatggatatttcgttgatttcattaaatcacttcatcctagctttccaatcaagagttgtaatgctgttggtaaagaagtaatggacggacgcgtgggagagaaggagaaattatatgcacatttaaaaactgtgcattgtcgctttagtgtaaccatggatatgtggacatcatgctcgaataaatcatacatgtgtgttactgttcattggataaatgatgattggtgtattcagaagaggattattggtttcttcaatgtcaaaggacgacacactggtaaaaagttgtcagagacctttactgaagctatggttagatggaatcttgataagaagctattttccttgaccttggataatgctagtgcgaatgaattggcagtcaaagatataatttcagatctaaaagatggccaggcttccttagtttgtgatggtctgtttttttcatgtaagatgtgcatgtcatatactaaatttagttgctagagatggcctgaaagtaatttcgaaaacaattgacaagatcaaagctcttgtactagctgtgaagggatctccattgcagtggaaggaacttatgaagtgtgctagcgagtcagaattagatacaaagaggggcatctcacttgatgtttcagcaagatggaattcaacttatttaatgctgcgggatgccttgtactacaaggatgcttttgcaaggcttaagtcttcaaatcgtcatatgtatgtaaaaaattatccatctccggatgagtgggacatggcactaaaaatctttcaatgcttgaaaaaagtttatagtctcgctgaaattctctctggcacttcatatccaacagcaaacttgttctatagaggtttttgtgacataaaagtattgctagatgactggtgttctagtgatgatgccaccatcagtgaaatggcaattgccatgagtcaaaaaattgagaaatattgggaacattctaacttggctcttgctgtggcatgctttcttgatcctcgatacaagaaaaaagttatagagtattacatgaagaaattccacggtgatgggtaccatgtggaacttgaaaaaattgttaatgtggtaagagggctctattgtttttattctagctctacacctgcaccagcaaagagtacatcaccggaaccagctaatagtgcatcagatattttaatggcaagtgtatctgatgaactggacagttttctgtatggtacaaatgaacctactctagttcggtccaatgagttggaaaagtacatggcagatccacttttgcgtcttggtggtccatttgatggcccatttgatattttagcgtggtggaagagcaagagggaagtgtatcctattctttcacaaattgttcgagatgtgatggccatacaagtatcaacggttgcatctgaatctgtttttaatgctgctggccgttttgttgatccttatcgtaatcgtcttgagccggagatggtagaggcattgatatgcaccaaagattggatagctgcagaaagaaaagattctaagattgttggttcaattgtgagtgaccttgaaattgagactttatctaccgtcatggctaacaaaataagagctgtggatgacaaggacatagaatggaaggaccaggagcatgatggtgagaacgaatatattgatagtgatcttgatgttatggatgaccacaatgaactttgagctatagctgtaggcttctagtttcagcttaatgtctactgcctttgagttactatgttatgtgtcttgggacttttataaactattatcgtgattgtgcatttgtgggtgtctgcttaattaattagacattgatgttgacttgttatatactccgtccgtcccaaaatatagctgtttctagtcaaaaaaaaaaaaaaaaagcttttcgattccgtcgtactccaccccggtcccgatacctccctcgccttatagcgccgctgtttaccccccttcccttgctcgcccttcactaccttttcattcttatctctctcctcactctactctag

SEQ ID NO: 15040 - DNA, 1816 bp, Zea mays
ggccgggaaagtcttctccaacccgccgggtggagctcaatcaatccaaagtgcgggcgaaaccgaaagcgagaggggggagactgggagagagagggacgagcggcgcggtctgctggtccgtcggcggcgaccgcgacgcctcgctgcagcggccgacgcatccgccgcgggcgtggagctcgccctctcctggctcgcaggagctcgcgagttgtttcgggtgcgagttgcttcttagtgctagctgtcgaaggcaacgaggaaaagactgccatggggatttcagctaagtggatcaaatcacttgttgggataaaaaagcacgaaaaagggcgaaatgctgaatgcagcgatgcgaggagctctgctgtccagttgctacgcaaacgggaacattctgttgatacagaaagtgttcctgcggctgaagaactcagagtacaggccgaaccattggcaggtgacacaaatacagaaacaatatcaaattctgcctcctcaccgagcacatctcttcaagcttctcagaccgaacttggtacaaaggagcatcaggctgctgtagttatccaatctgcctttcgagcattcttggctaggcgggccttgcgggcgttaaaaggactagttagactccaggcacttgttcggggtcatgctgtaagaaaacaagcagcagaaacacttcagtgcatgcaagcgctagtaagagctcaagctcgtgtcagagcgagacgagtccgtgtttctttggaaagccaagggactcaaaagaaacctcctgaagaaaatgttcatgaggatcatgttcgagatattgaggaagactggtgtggcagtataggctcggtagaagaaatgaaagctaagacattaaaaaggcaagaggctgctgctaagcgggaaagggcgatggcatatgctttaacccatcagtggcaggcaagttcaaggaaacagaaagcagcaagcctccaaggccaaggactcgccggggacgagaaccagtggggacgaaactggctcgagaggtggatggccgcgcgcccgtgggagaacaggttacttgacagcaacgccagggacagtgtcactgccggcgacgacgacgacaaaccagcggaggaaggcaaggcaaaagctccggacctgagcaaaccaaaaggaaaagctcccgttttggcctctcagtctaacgggtcgcggcaggagaaagctgcagaccacgagaagtcgcattctgatgtcagcggctgtggctcttcgtcggggcggtctgcggacgtgcagccaacggtttctctagagtcgtccaaggtggaagtgaaggtgaaggcaccgcaggaggtcgcagatgaagcgagctctggaccgtcgaatccggcttcccggtccgcaagcaatccgaaagaaaggccggcgcgaaccgatgcgccagcgaggaagcggttatcgcttcctaacaacgcaacagcagccagtcggggagtagggaagcgccctaccaacagtagtcggagtcggacgaacgtggcctcgagaccgaagaatggcagaggcgcctccagcccaggcctcgagtagtgtcgtagggtggttgtgttgtgctggtgtacattgtttacgttgctgtgtattctaccattgtgttatgtattttttgtgcgtgtgtgtgtctgtgttctgttcaaattgcgtcctttcgaactgctcagtctgtggacgtttggaaaagcatgtttctggattctgtgattcggtcttcagcaccagtgtttggttggttgggtggtggggaaaaaaaaaaaaaaaa

SEQ ID NO: 15041 - DNA, 1749 bp, Zea mays
  misc_feature (12)..(12): n is a, c, g, or t
  misc_feature (19)..(19): n is a, c, g, or t
tttctcgaggcncggcccngggaatccaaaacagtggtggagctcaatcaatccaaagtgcgggcgaaaccgaaagcgagaggggggagactgggagagagagggacgagcggcgcggtctgctggtccgtcggcggcgaccgcgacgcctcgctgcagcggccgacgcatccgccgcgggcgtggagctcgccctctcctggctcgcaggagctcgcgagttgtttcgggtgcgagtgctagctgtcgaaggcaacgaggaaaagactgccatggggatttcagctaagtggatcaaatcacttgttgggataaaaaagcacgaaaaagggcgaaatgctgaatgcagcgatgcgaggagctctgctgtccagttgctacgcaaacgggaacattctgttgatacagaaagtgttcctgcggctgaagaactcagagtacaggccgaaccattggcaggtgacacaaatacagaaacaatatcaaattctgcctcctcaccgagcacatctcttcaagcttctcagaccgaacttggtacaaaggagcatcaggctgctgtagttatccaatctgcctttcgagcattcttggctaggcgggccttgcgggcgttaaaaggactagttagactccaggcacttgttcggggtcatgctgtaagaaaacaagcagcagaaacacttcagtgcatgcaagcgctagtaagagctcaagctcgtgtcagagcgagacgagtccgtgtttctttgggaagccaagggactcaaaagaaacctcctgaagaaaatggtcatgaggatcatgttcgagatattgaggaagactggtgtggcagtataggctcggtagaagaaatgaaagctaagacattaaaaaggcaagaggctgctgctaagcgggaaagggcgatggcatatgctttaacccatcagtggcaggcaagttcaaggaaacagaaagcagcaagcctccaaggccaaggactcgccggggacgagaaccagtggggacgaaactggctcgagaggtggatggccgcgcgcccgtgggagaacaggttacttgacagcaacgccagggacagtgtcactgccggcgacgacgacgacaaaccagcggaggaaggcaaggcaaaagctccggacctgagcaaaccaaaaggaaaagctcccgttttggcctctcagtctaacgggtcgcggcaggagaaagctgcagaccacgagaagtcgcattctgatgtcagcggctgtggctcttcgtcggggcggtctgcggacgtgcagccaacggtttctctagagtcgtccaaggtggaagtgaaggtgaaggcaccgcaggaggtcgcagatgaagcgagctctggaccgtcgaatccggcttcccggtccgcaagcaatccgaaagaaaggccggcgcgaaccgatgcgccagcgaggaagcggttatcgcttcctaacaacgcaacagcagccagtcggggagtagggaagcgccctaccaacagtagtcggagtcggacgaacgtggcctcgagaccgaagaatggcagaggcgcctccagcccaggcctcgagtagtgtcgtagggtggttgtgttgtgctggtgtacattgtttacgttgctgtgtattctaccattgtgttatgtattttttgtgcgtgtgtgtgtctgtgttctgttcaaattgcgtcctttcgaactgctcagtctgtggacgtttggaaaagcatgtttctggattc

SEQ ID NO: 15042 - DNA, 1082 bp, Zea mays
  misc_feature (966)..(966): n is a, c, g, or t
atttctagccacacttccatcgctcgctctcgttcagtagctcctgggcccccgcgggcccggcgggctccgtcaccacctcgcctgctagcctcctccgtctgctcaagacgagggaggagcagagaccgaactctgccgtctcttcctcctccctctgcacccccacgagctccatggccgccaccgccatgattgggattaccaacctacgttgccgccacgacccgctctcctcccttccccgggctacgtcgtcggccgcccggtcctgtacgctgcttcctcctcgatgccgccgccattcttcttgctgctccccttcctcctccgtctctccgtgccgggcccgggtccgaccaacagcagcactgaagcgcatccctgccgccgacaccggcttcatgggtccagccaacaatgaggccaccacgcttaaacgatcatcgtcggccgaccttcgccgccgccttatcgtccccagctccaccgctggcaccggacacgccgccagtgcttccacaggagtgctgcccgccattatcggggtggcgcatctgctcgtgtcgctgggcattctgctcgccatggacaagttcctcaagcaggcattcgtcgccgcgtccatcaagttcccgagcgcccttttcggcatgttctgtgtcttctcggtgctcgtagtcttcgacacattcgtgcctcctctcgcgaaggcgttcattggcttctttgagcccgccacgctgttcatccagaggtggctgtccttgttctacgtcccgacactggtcgtgctgccgctcgccgtcggggatattcccagcggcctcaggaatcaagatccttgcaatcacttttgggtggctggtttgctaccctgacggtggcaggatatacagtgttagccatgagaaaactcgtgaagacagagcttcttgcaccatcggagcccacgaagaagccgtngccgttatacacgttcggagatctgggcatgggcagctatattcgtcgcgcctgtcggcggaacatggttcaaacccacagggtttggtaccacggcatgaacatgccttcctttt

SEQ ID NO: 15043 - DNA, 1270 bp, Zea mays
gcgaaactcgtgaagacggagcttctggcaccatcggagcccacgaagaagccgtcgccgttttccacgtcggagatctgggcatggtcagctatattcgtcgcgtcgttcggcgtcgcatgtttcaatcccacggcgtttggtaccacggcaagaacatgccttcctttcctgcttgctgctaatgtgctgggatacatggttggttctgggttaccacctggcgtcaagaaagtgctgcatccgatcatctcctgcgcactctgtgcagatttcgcggcgctagcctatgggtacatctcagggtttggacttgatgccgtgctaggtgcttacctcacaaaggtgccctctaatcctggagccggtgacgtactaatgactttccttgggtctgtgatcatatcatttgcattctcgatcttcaagcagagaaagcttgtgaagaggcacgcaacagagattttcacatcaattgccatcgcgtcgacattctctctgtactcaactgctatcatagggcgcctgattgggctagagccatcgttaaccatatcaatactgccaaggtgtattactctggcgctggctttgagcatagtgtctttctttgaaggtgtaaactcttcggtaactgctgtcgtggttgtccttaccgggctcatcggtgcgaactttgtgctagcagccatggagaaacttggtctgaacgaccccatctccagaggagtagggacagcttccagcgctcaaggactgggaacagcagcactggcggccaaggaacctgaagcgctccctttctgcgccatcgcttatagtttcacggggattttcggcacgctgatctgctcggttccggcagtcaggcaaagcctgatattcatagctggttaagagatgatctgaatttgacggtttcattctttagataaaagaagcagcttgcttcctccctccgtgttcagaaggtcaggaagcaacgccccacatgtcaggtcaggatctaatatgtgtaggggcttgaaaaaaaaaggcgaataattctgtaatcaggatgtaaccgaaatactacagttttttttttcttgtgacaaaatactactagaggaaggtagatccgttatttgtttgacagtttgtggtgtcatctttctccctccctagaaacaggagagatatagtatgattgataaaatcaacgtttttcagagaccaattatggtatgcagttggataaaaaaagaaaaaaaaaaaaaaaaaagcggcc

SEQ ID NO: 15044 - DNA, 1007 bp, Zea mays
cgtcgtcattagtagtatattaaggaaaggttaagacagaagcgtactgtctgggtaagatgatatccatggtccatgcgtctctgtcctttgtatccagttcaattactgccacggacatgtgggtcctggtgcaaaagaaccatgtggcgggtcggcatcgacgatgcaccagtagctctgcccagcgtctcaaaactttcgcttgccccgcggccggccggcagtggcgcatataaatgtgggtggcgagaaacgacgaggtcttggtgcgtgacccaatccgatcaatataatcagagtcagtgtgactgtgagcagagcaagcagtatagggcgagcttcagccatggaaaagagaagcaatggtagtgccagcctcgtcctcggccttctgatggccgcctccctgtcgtgccagtgccacggcgcgcgcgacgtccccgcggagaagcccctccggccacagaacgtgttcgggttcggcggcttctacccgggccccaccgtcaactgggtgttcccgggccccaacggcgtcaccccgcaggtcggcttcggcgggatgccgggctctagcgccttcccgggcggcggtggcgtggtcggcatccacggtggtgctggtgctggtgccggtgccggtgccgtggcgaagaagccgtgagaggaggtggccgtgtgtctgtgagcttgcgatgctttgtgagagtgttgtcagtacgtggcataagcgaagtctgtgtcttgttcttgctgcggctggctgtcgagacttcactctcgtacgtgtctcgtgtccctttttatcctgtagtatttgtgtgcgaaggacttctttctcatcatatggtagccggctgctagtgtacatctcgaaccccttttcttctcggcgtgtgtttattcagttctgtattgtatccccctatgttagcatggatgctgattagtacgtgtccttcagtaattcgctataatcaacacggtacatcattgttgcgctt

SEQ ID NO: 15045 - DNA, 1808 bp, Zea mays
cattgggtacctcgaggccggccgggactcatctccagacgcgcacgagaccgcccaacccgaaaccgtttccaaaatgcaaaactcgactccacgcgtcgcccttcttctccggagagatcgttttaatagccccgtaccaaatccaattcgtctctcctcaccggagaacagaaacgatacggttaatagatagcgaagaagggcagcaccaccagtagcagcagccatgcccgctcgcgctcgatggcgactcctcgcgctgccgctcgcgctcttactcgttgccgggtcggcgcatggcctcgtgaagccggaggcagccgcggcgcccaagccccccgtccccaaggccatatcggacctgagggacgcgatcgtgaaggggctgggattccaggccgaggggctcaaggtgtccgggttcgacgtgcgagacgcgctcgtggggcacgcggtggcgtacgagttcgacatcgaggtcggcaggaaggtcctaccggtgcgcctgctggaggacgtcagccggtgggacttcgtcgacctccccatcttccgttcccaggccgacgctgacgatacggcgctcgccgagatccggcgggccgggacggggagcatcgttgagcctaccctgccgcccttccagctcgccgggcccatggagctctggatccagaacggcgacgacgtcaggcttgccttgccgcatgatgtggacgctggtaccttgaagaaggttgttctttctgatggtgcagtcgtaacagtgaagggtgctagagctgtgagcctccggttgccgcttgaattaccacttcctctcaaccgtaccacttacaagggtcgcctctcaagcctgatatccatcgcacaagccctgcgtggtgcagcccggtctaatcagaaacccctgctctctcttcgcgttgagggtccagtttccttgtcctcgactccttccatgtctcccaaggacaagctcaagctcaaacggttggccccaggccaagtggagctctcctcacaggcgggggcaatccctgctatcaccgaagacgaggatgaaccacataaccctggattgtggcctcttttgtctctgaatggttcagatggcagcctgcaggggtttgaggagctattggcctcagtacttggaaagaaggcaggcgagaagggtaccttcaagctactgaaggcacgggcctcggctcaaacctatgtcaagatggcattcacggtggagaagaagcttgctgaaggggatgtgaactggtcaaatattccagaatggaagacgaagcccaagaggatgagagcgcactatgaagtccttgctcgagtggaggagggtcaggcgatccctgagaggatagcgcaggtacagcctttccaggccaacgaggccatgtcggagagtgtgctcaccggcaacgtcacgaggtcgaagatggaaatcgtccatccaccgccggtttacttcactctctgagtgagggaagaactggatgctgtttgatgttctcttcagagctactacacgttgggtggtgggtagtttacgctggctcgtaggcaacaaagttgtacaagcggcaagagtttgttgcctatacactgactgcgttgacatgaatattgacgttctatgtgtactgaaaggctggcaagcctttaatattatcaattggaataatgaggaataagaaaattctgtacatctttagagggccaaagggctgagttcttagtactgagccaaaaaaaaaaaaaaaaaaaaaaaaaaaaaaactcgagagggggcc

SEQ ID NO: 15046 - DNA, 1645 bp, Zea mays
cgaagcttgtattcggctcggggctcgcgcgcgccacgttcgtaccacgggccacggcaccggagccgcgtgcgtgccggtccatatctgatgtctctgtctatccactgaccagtccccatccgcctccgaacccacgacccaccgacccacttctacatcagtccaccgccaccgcgcaccgcgagtccgcgacagacatccgcgccccggcctcactctcactccccaccgtgccgccacaagcggcgcgacgcagtccacgcagggagagggaaatggccacggccgcgactgccacggcggggagtagagcagccgtgctgctgctgctctcgctggcgctggcgctggcgctgcgggcctccggcgccggcgcgggcggcgactgccacttcccggccgtgttcaacttcggcgactccaactcggacacgggcggcctgtcatcgctcttcggcgccgcaccgccgcccaacggcaggaccttcttcggcatgcccgccggccgctactgcgatggccgcctcgtcatcgacttcatcgctgaaagcctgggggctgactcacctcagtgcgtacctgaactcgattggaagcaacttcacacagggagccaattttgcaacagctggttcgtcgatcagaagacagaatacatcgctgttcctctctggcttcagccccatttccttggacgtgcagttctgggagtttgaacaattcatcaacagaagccaactcgtctacaacaacaaaggcggtatctacaaggagatcctaccaagggcggagtacttctcccaggcactttacaccttcgacatcggtcaaaacgacatcacctcaagctactttgttaacaataccaccgaagaagtcgaagccataatccctgatctgatggagaggctcacatctataatccagagcgtgtactcgcgtggaggaaggtacttctggatacacaacacagggccgctcggctgcctgccctacgcgctgctgcaccgccctgacctcgccaccccagcggacggcaccggctgctccgtcacctacaacaaggtcgcgcagcgattcaacctcaggctcaaggagactgtggcgagcctccggaagacgcaccctgatgccgcgttcacctacgtcgacgtctacaccgccaagtacaagctcatcagccaggccaagaagctcggcttcgacgaccctctgctgacctgctgcgggtacggcggcggccggtacaacttagacctgagcgtcggctgcggcgggaagaagcaggtgaacgggacgtcggtggtggtggggaagtcgtgcgagaacccctccaagagggtgagctgggacggcgtgcacttcaccgaggctgccaacaagttcgtgttcgaccagatcgtcgccggcgcgctctcggacccgcccgtggcgctcaggcaggcgtgccatagcagagggcaatgaaccggccccgtgtcgctcgccgcgatggccacgctgcagctgctgctgcagctgtttctggctgtgtaactttgcaagtgtaaatcgaaggagcaagcatgctcgaggacgaggtgcacggcttcactttgtaataagggacatgcaaatcagagatccaagagcaatgatttcc

SEQ ID NO: 15047 - DNA, 1996 bp, Zea mays
cttgcatgcctgcagaacgtttagatagatcatggtttaactgtagatgcggagctcagcagggccacgccaccgtgtgttctttctatctgggattgggatgctcgtccaggtgtgtgccgcgcgtgctccacaaacagcaggaaacgctacaggaattagcggtggcacaccgttctcccttctccgagaaaggcgagcgccgcaccgtcacgtcaccgccgtgtcttcccaccaagctcgcgcgcgcgcgcgccacgccacggaccacgggccacggcaccggagccgcgtgcgtgccggcccatatctgatgtctctatctatccactgaccagtccccatccgcctccgaacccacgaggccacgacccactactacatcagtccaccgccaccgcgcaccgcgagtccgcgacagacatccgcgccccggcctcactctcactccccagtccccaccgtgccgccacaagcgacgcgacgcagccacgcagggagagggaaatggccacggccgcgactgccacggcggggagtagagcagccgtgctgctgctgctctcgctggcgctggcgctggcgctgcggccctccgacgccggcgcgggcggcgactgccacttcccggccgtgttcaacttcggcgactccaactcggacacgggcggcctgtcatcgctcttcggcgccgcaccgccgcccaacggcaggaccttcttcggcatgcccgccggccgctactgcgatggtcgcctcgtcatcgacttcatcgctgaaagcctggggctgactcacctcagtgcgtacctgaactcgatcggaagcaacttcacacagggagccaactttgcaacagctggttcatcgatcagaagacagaatacatcgctgttcctctctggtttcagccccatttccttggacgtgcagttctgggagtttgaacaattcatcaacagaagccaactcgtctacaacaacaaaggcggtatctacagggagatcctaccaagggcggagtacttctcccaggcactttacaccttcgacatcggtcaaaacgacatcacctcaagctactttgttaacaataccaccgaagaagtcgaagccataatccctgatctgatggagaggctcacatctataatccagagcgtgtactcgcgtggaggaaggtacttctggatacacaacacagggccgctcggctgcctgccctacgcgctgctgcaccgccctgacctcgccatcccagcggacggcaccggctgctccgtcacctacaacaaggtcgcgcagctattcaacctcaggctcaaggagactgtggcgagcctccggaagacgcaccctgacgccgcgttcacctacgtcgacgtctacaccgccaagtacaagctcatcagccaggccaataagctcggcttcgacgaccctctgctgacatgctgcgggtacggcggcggccggtacaacttagacctgagcgtcggctgcggcgggaagaagcaggtgaacgggacgtcggtggtggtggggaagtcgtgcgagaacccctccaagagggtgagctgggacggcgtgcacttcaccgaggctgccaacaagttcgtgttcgaccagatcgtcgccggcgcgctctcggacccgcccgtggcgctcaggcaggcgtgccatagcagagggcaatgaaccggccccgtgtcgctcgccgcgatggccacgctgcagctgctgctgcagctgtttctggctgtgtaactttgcaagtgtaaatcgaaggagcaagcatgctcgaggacgaggtgcacggcttcactttgtaataagggacatgcaaatcagagatccaagagcaatgatttccatcaatagaggatcgatgaccacgaaaaaaaaaaaaaaattggcggccattgaaatatcgatcatcacaggcgccaatttgtaccgatacagagaatgagcaaacgaaatattttagacaggc

SEQ ID NO: 15048 - DNA, 715 bp, Zea mays
ttcgctccgaggcccggccgatcaaacaaaagcgtcgttctctcttcctggtccaagtgatcttgccaagttacgagcagcaagcagagatcagatcatccatcggcaatgtcgaacatcgggcagtccttccaggccggcaaggcggaggcccagggcgagtaccaggcggagcacgcggcgcagtgcgtcaaggacaccgccggagccgcggccgacagcgcgcagctgcagcagcaccgcgccaccggcaccgttgagcaggtggcgcagacgggccagggcgtggcggcaggcgtcaaggacacggtggcgggcgcggcggttggcgtcaccaacacggtggcgggcgtggcggcgggcgtcacgaacacggtgaccggcgcggtggcgggcgtcacgaacacggtgaccggcgcggcggcgggtgtcaaggacaccgtgaccggcggccactgatcgacgacccacccaagaatgctgcatgcatggccaagtgttgagggtttgaggccaaagatggcttgaatttccgtccttttttgctttattttttgacattattgttttaacatgtttcattcacccgtctctgattgggattgtgatcacgaccgcctgcaataaaaaaaggccatctttactatgatccaaaaaaaaaaaaaaaaaagcggccgccctcggccatactacaccatgtgtaattctttgcgtt

SEQ ID NO: 15049 - DNA, 2021 bp, Zea mays
cattgggacctcgagccggcggggactggtctccatagtgtaccaaacccacgaggccacaagcacgggactggcatatattatccatgtaaataaaatgaacgagataaataaccccataaaaagctaccattccactacctcccaaactcgcgagcgagtcgaggctccaaccccggcacatcacaggaggaggaggacgacgcgcccaccatggccatggcgacggccctccgcaagctctccgccaacgctctgcgccgccagccgctctcccgcatcacgccgctctactacatggcgtcccttccggcgacggaggagagatccggaatcacctggactaagcagttgaacgcgccgctggaagaggtcgaccccgagattgctgacatcatcgagcacgagaaggcccgccaatggaagggtctggagctcatcccgtcggagaatttcacgtcggtgtcagtgatgcaggcagtgggttccgtcatgaccaacaagtacagcgaggggtaccctggcgcaagatactacgggggaaatgagtttattgatatggcagagtccttgtgtcagaaacgtgctttggaggctttccgtttggacccggcgaaatggggagtgaatgtgcaacctctatccggttcgcccgccaacttccatgtatacactgcactcttgaagccacatgaaaggatcatggctttggatcttcctcacggtggacatctttctcatggttaccagactgacactaagaagatatctgcaacttcaatattttttgagacaatgccttacagattggatgaaagcactggattgattgattacgatcagttggagaaaagcgctgttctttttaggccaaagttgatcattgctggtgcaagtgcatatgctcggctatatgattatgaccgtatgcggaagatatgcaacaagcagaaggcaatacttctagcagacatggcacatattagtgggcttgttgcagctggtgttgttccatctccttttgattatgcagatgtagtgactaccactactcacaaatcactccgtgggccacgtggagccatgatcttttacaggaagggagtcaaagaaataaataaacaaggaaaagaggttatgtatgattttgaggacaaaatcaatgctgctgtctttcctggtctgcaaggtgggcctcataaccataccattactggcttggctgttgcgctcaaacaggcaactactccagaatacagagcttaccaagagcaagttatcagtaattgtgctaaatttgcgcagagcctgatttcaaaaggatatgaactcgtctctggtgggactgacaaccatttagttctggtgaatctcaagaataaggggatagatggttcaagggtggagaaggttttagaaagtgtgcatattgcagcaaacaagaacacagttcctggtgatgtttcagctatggtgccaggaggcatcaggatgggaaccccagcccttacgtcgagaggatttgttgaagaagatttcgctaaagttgctgacttcttcgatgcagcagtgaatctggccttgaagattaaggctgcaacgacaggtggaacaaagctgaaggactttgttgccactttgcaatctgatagcatccaagttgagattgcaaagcttcgccatgatgtagaggaatttgcaaaacaattcccaacaattggatttgagaaagagaccatgaaatacaagaactaatatctggatgacaagaagagaatgaggtcactcttcttgcagtaagcattcgaagcaagatgccacgatgattattgggagtttaaccatggtgtaatggcatcttatgttaaagagatgttggcaatttacagcatgtggaactttcgtcaatcatattgtagacacataccgcgagatgctatattgaccggacaattgcatttccatatatgtaaaaaaaaaaaattcaaaaaaaaaaaaagagtggggggaaccggtaccca

SEQ ID NO: 15050 - DNA, 1558 bp, Zea mays
gcacgagaccattacctagaacatcctaatcgaaaatctcactcagcttctcgcccgtaaaccaaattcgtttcatttggtcaacaaacaaggaagcccttagccctcccaccgtgtccatctccactcgccagtctcagcccgccggccaccccccacatctcgccatgtgcggtgggtgccgccgccgccaatgtggccccgacgggacgcccgacggcggccgccggggctgcggaaccgtgatcgccgtgctggccctggcggccgccgcggcggtcgcgttcctggagagcgcggccggcgggatctcctacgcgggggacgggtggctgcacgagtgcgccaagtgggacgccgagggcggccaggttcctggcgtccaccttcttcggcggcggcgtggcggaggtgcgcgccggcgagggcgaggccgaggagcgggtggtcgtggccgaccccgtcgcggccggccgggtcgcgctggggctcgcggtcgacgcgcccaggcggcgcctgctcctggtctacgccgaccggccgccgcgcctcggctacgccgcgctgggcgcctacgacctcggatcgtggcgccgtctcttcctcacgcgcctcgacgtgccaggcgagtctacatttcccgacgacgtcgccgccgacgaggaaggcaacgcctacgtgaccgacgccaagggaagcaagatctggaaggtcgggccggacggcgcgctgctcggcgtcatcaagaacgccacgttcgtgcagcggccgggcctgcgccacaacctcgtcggcctcaatggcattgtctaccaccctaacggctacctcctcgtcgtccacacctccggcggtgacttcttcaaggtcgacccgaagacagagaccgtgcgcgtcgtcaaggtgcgggggtcgctgaggcgaggggacggccttgagctgctctccccgacgaggctggttgtcgccggcctgccgaaccggctggtggagagctccgacgactgggagacggcgagtgtcaccgggcagtacgtcgggccggtccaccggatcgggtcgtcggctacggtgaaggacggggacgtgtacgtcaaccatattgtcgggttcgggctcggcaggaagaagacgcacgtccttgcaagggcggtgttctcgccgttggcagtgacgagttgacgggccggcgcctccgcgcgcgctccgtcgtgggatcaacagttgctttttgctaagcggcagttcatacttatggactagaactaataattagttgctaaaattagttgagatatttaaacaatctaggtaataattcaactactagctacttttcgcaaattagctatttgttaggtaactaattcgactaacaattttagtcaattaattattagatctagttcattcaaacaccccatagatgctcgtagtacttttgttcctacacttgacacgttgcccaaagatacaagattgtattgtttggtacatgcatggcggaggacccaataaaataccaatagcaaaaaaaaaaaaaaaaaaagggcggccg

SEQ ID NO: 15051 - DNA, 3260 bp, Zea mays
ccgctttcatgcgatcctgcctgctgccgtgcacatcactgttgttgtctgcaactcgatactgaaaaagatatcccaattccgaagaaccaaacggcccataaagattcggctacttaaagaggccacttttctgaggggccggcccgtaacgattgggcttgggcgctgcgcttggcacaagaagactgatcaggaagctatccgcgctccacgcaaatctccccacgtacgcggcatgcatgcactttctcctactcatcgcatctaaaactctggacggtcggcttgggttctgaagttttctatgtttagggtttatatataggactaaaaaatattcacctgttgcccgggtctcccgggccaggacccggtccatcgtgctgcagttacctagcgccatatgcgcatggtctacgtccactaattctcggtacaccgcgaagcctgtgcgccgcatctcccacatccgtggtcgccatgcagtgacacggtccatagatgacgtggcgcgtctagacctcttacagccctcctacgctgactgcgagcgaggctcaagcacataaaaaccattcgctctgcgggcgttggctcctcacagctctctctcaatcgctccctgagttagagctgtcgcaacgaagagaaataactcacacaaaaaacacaagggagcctcccgatcatctcggtggcgatctcgaataagatccggtgctgctccatgatttgaatctctcggactgatcatgacaggaatgccccctgcagtctgcagctgattgcaggggacgtctgctgcctacagctctcggtctcggatgccatagaagagttggtccccatggactgcggacaccacggcgttgttccacggcctgaacaccaggcgccgcccaattgctgcgccaccgaggtaactacaagcctgtgtcgtttggcctcgatttcctctgcgttttttacgatctccccaaggaaataacaggtcccgcagagcccgacgctctcttccgaagaattcctccagttcaagaggaaggccaccacgatcgtggaggagtacttctccacggacgacgtcgccgcgacggcgaacgagctgcgggagctccgcgtgccgtgctaccacttctacttcgtcaagaagctggtctccgtggcaatggaccgccacgacagggagaaggagaaggcggcggtcctgctgtcctcgctctacggcgacgtcgtcgaccgcccgcagctctgcaaggccttctgcaagctcaccgagtcctgcgacgacctgtccgtcgacacgcccgacgccgtcgacatcctcgccgtgttcgtcgcccgcgccgtcgtcgacgacatgctgccgccggcgttcctggccacgcagagcgcgcgcctgccccacgggtgcaagggcgccaaggtcctccgcagggcggagaagagctacctgtccgtgccgcaccacggcgagatcgtcctgcagaggtggggcggcagcaagcggatcacggtggaggaggccaaggccaagatatccgacatcctggaggagtacctcgccggcggcgataggagcgaggccctgcggtgcgtcagggacctcaagatccccttcttccaccacgacgtcgtcaagcgcgcgctcgtcctcgccgtggagcgcggccgtgcggccgagggcctcatcctggacctcctcaagtcggcgtcggaggaaggcgttatcaacgagagccagatcactaaagggtttgaccgtctgatcgactctctagacgatctggcgctcgacgtgccgaacgcgaggtgccttctgaaatcggtgatccataaggcttcgtcggagggctggctgtccgagtcgtgcctcaaaccgttgccaccggagccgaagaagggtagcgaggtcgacgacgccacggtgcggcagttcaaggagaaggccgttttgatcataaaggagtacttcttgaccggcgacatcatcgaggtcatgagctggttggaagcagagaactactcgtgttgtccctccttcaatgccatcttcgtgcagaagctggtgaacgccgcgatggaccggaagagccgcgagaaggaaatggcgtcggtgctgctctcctcgctctgcatgccgccagaggacgtcgtggcagggttccacctcctcatcgacgccgccgaggacgccgcgctggacaacccggccatagtcgaggacctgaccatgttctttgctaggtccgtggttgacgaggtgatcgcaccgtcggacctggaggcattggaggaggacgccggccgcgtcaaggcggatggctccgccggcatgctggcgcttcggaacgcccatgcgctgctcggcgcgaagctctccgcggagcggatcttgcggtgctggggcggcggcggcagcggcaaggcaggctgggagctggacgaggtgaaggacaagatcggcaagctgctgcaggagtacgactgcggcggcgacatccgggaggcgtgccgatgcatcaaggatcttggcatgcccttcttccaccacgaggtggtgaagaaggcactggtggctatcatcgagaagcgaggcagggacgagcggctctggggcctcctcagcgagtgctacggccgcggtctgatcacgccgaaccagatgaccaagggcttcgacaggatggccgactgcgtcgacgacctcgcactcgacgtgcctgacgccgcgaagcagctcggctgctgcatcgagcgcgccaagaaggatggatggcttgacccgtccttctcgatgacgacgccagggctgcctgttgcaaatggcgtttgttcgtgagcaatcggtcacattcagggtgcagcaccgcaattccatttcctggggagttcgtctgcaacttttagtacttttacatatcacactatatatacttgtactatgaatcaacaggggcaagagagagggaatatacaaatataatcgccacaacccacgacaattttggtatagaattggaagcagatcttccatcttagtttgtatggcatttagcggagaggacttgtgaattggagagtttatgtttcccaacccttttctgttgcgctgttgttatgatttgctttgacaaatttacttgttcggaaaaaaatgccatgtttctccttgttaacatgtcgcatgaccataatcttttgtttaaatttttaaatatagagttccatgggcaatggcaaagtcgaaactagtg

SEQ ID NO: 15052 - DNA, 2856 bp, Zea mays
  misc_feature (2821)..(2821): n is a, c, g, or t
  misc_feature (2823)..(2823): n is a, c, g, or t
gccgcaacccctctctcattttcttcctcgtctacacctccttctctcctcctcgatacattcgagcacgcccggacgcggtcagaagggagaaagcagcaagcggcgccgggttccccctcccttcgtcgcccccgatcgacgccgatcggggccgactgctcgtgggggacgccgaccgaagcccgggcggcgctgcttcaatatacggaagcagtttctagttttcttcagttcgccgctgcagtttctagtttccagcggttcccaccagttgtctaataacttattgttgttgtacgtgaggttgcttttgtcgtatttgccaggttgcttttgttgtatttgccaggttgacacacttggtgttgtaaatcattgctatttttgggtcatgacttgtttttattgaaatcaattggctgccaagggtacactaaatctttgatgcaacataataggatcaccatgctgtcttcttcagagacttgccagcttggttctagttctagcaaccctgtcatggatcagcagaatttacttcccaacaactctaacgtggatgaacagattttactcccaaatgcattagagcatgaggactacccacactatttgctcaatagtcatgaggtgggaatgccaagtggaagcctgattggtcagcaaaatacaagcttgagcttgtgggaaccagctggatctagctcaatggagtgcttagttgatcatgacaactttttccaggcaaaaagagaacatcttgcctcttctcggtctattggtgccccgttaagtatagagaggaggagacagcaggccgcgccggcattgccttcacacaacctaaacatagacctcaacattaatcaggctgatcaatttggctctgatgatgttgatcttgcacatggtaatggacaaccaagagcaaatactgtcacagcccacaggggctctttcataactgagcatattctgcatcatggagtttcttcggatgctataggaaattcttccaggaatgcagagtgttttgttggtgcagcaggccaagacagtcatcatgcagcctttaagagaaagtatcttgatggatgtcatgcagagtcttctgctaacggaagctcacgcaatcgtcaccagaataatagtactctgctacctcctccgaccacctgtgaaagttttactatacccaccgcaacaaattttagtgttccgtaccatcctgtggagcagctaaaccagagtactaatattgctgcaagctctactttgtctgatcactattcttcatacagtgatccacgtggaaacgaattcgtgcgaaatacacggatgcgaataaaccctagtgattatgatcaatcgctgcccagtctattacctgaggggagtttcaggtgctcggcttaccaatctacacagcagcagtcatcatttattccagcgcaacctagacaagttagctcttcttctggttctcatagtcgatctcatgtgcctgctgttactcagttttcacaaaatcttcgccgtccatcaactgttagttttgggtcaagaattgggaattcttccacttctggttctacaataccaatacctgcttcacaagatcctggtacaagcttgttgggaagcgattatcctgagccacttttgttaggttctttgtttacagctgattcaacaaatttcttatctgcatctggaagcataagtaaccagcaaaattctggatccagctctagttccatgctcaggcctgctgttaatgttggaacacaagtccctgagttcaacgtatctcagccaagtacaactttaagaggttcatctgatgtgttcaggaggtccttaatttctgctggcatttctcattctagaagttcaagcatcccattgcagcaccgtggaaattcatccacatcacatgagattaggaatcatcagccaggatcaagctctcgtgcacatcagcagcaccccttaagacccggtcattcctctgtagacaggcagagctctggttacttggaccttcagtcttttatgcagaccatagcttcaagggaaggaggcagaccaatgtcagagatccgcaatgtcttcgatcagattcgtcaggggagaaatgcacgattggaggatttgcttctcattgaccggtcacttattatgagacgagctaatttgattgatagacatcgggatatgaggcttgatgtggataatatgtcctatgaggaattgctggcactaggtgaacgcattgggtacgtaaacacaggacttactgaagaaaagattttgagtaacttgaaacaatggaaatgtgtcttaaaatcattggatgatcctccaacaagtgttgaaccatgctgtatttgccaggaagactatgtggaaggcgaggacctgggcaggctggattgtggtcatgacttccacaccgcatgtatcaaacaatggctggttataaaaaacctgtgcccaatctgcaagaaaacagcactggacacctaaaaacatggctgcctttttccttaggaaaaagccggtagcggcagggcaagtggttgccatctaaccacaccctcccatgactagcaaagtatgttacacctttcccatcatcaacatacatgtgggaatctatactataggtggtacatggcacttgcctgaagccaatggctgtagaccatggagttttatcctttgtttttttcaatcttagatttgggatttaaaatttattcaatgacatttgatttacttgggcaatctgcgatatttgctctcgtggtggatngnttatcccctcccaaaaagatgtttaacttaacc

SEQ ID NO: 15053 - DNA, 1810 bp, Zea mays
  misc_feature (1162)..(1162): n is a, c, g, or t
ttattctttataaccgacggtatgtacgtacgtggctattttttaaagctaatgactagtttaaacacttaaatcgtcttcaggattctaaaagatcgaggagaaataagctaatttctcacccaatctctagaaatactaaagaaaacttaagtttctaacttagccctaaaaaaggtgaggtgagtttattgccttttcatcttttgattagcttttggtttttacaaaataaaaataaattaaaaggattagtcaaagagagccttatcttaggtgtttaaaatagtagcagtaataatagtagtaataataaaacaatatgagaacgattaaagacccgacgacctgacctgacctgacctgacccagtcatcacgtcgataggtccattctttagccaagcccggcccggtccgttgtgtaataaactgataactacgaccttaacgactagagttcgagtattctcgtctcatctgtggaagaggagagaagactgaagagaagggaagacatggccgtgacggcggaagcggcggcagagatggtgttggagcggcgggcgtacgcgcgggtggggctcctcggcaaccccagcgacgtgtacggcggcagggccctgtccttcgccatcgccgacttttccgccaccgtccacctccgcccttcgcccgagctgctcatccagccgcatccgcaccacgacctcgtcgccttcccctctctccctcaactcgtgagccgtttgcaaagtgaaggatattatggaggcgtccggctgctgatggctatctgtaaagttttctacaactattgtgttcaaaataacatcagtttaaaagctgaaaatttcaccttatcatacgatactaatattcctcggcagtctgggctgtctggttcgagcgcgattgtttgtgctgctctaagctgccttcttgacttctataatgtcagacatctaataaggtgcttgatattgagactaagctgctactgctacattctcgtactcccgactcccgagtcctgagacgtcgactcgacccgtcgtctagtgcgccaactcaagaatataatgagctttcctcttctttcccacccacattcgtctctctccttttcctctccttttctgagataggataagaattttttnttctttcagaattactttatactgaaagaacggctggagttaatcaattgattgcaccatggatttgttttgatttgattccaccccattccagaaaacataattagcgaatatattctcatctcgccctcttctctcctctgtcagccaactgaccaagcatcgtgccggaggggctacagtcacagatgggccaaggcgtaaggctaaggaagagaagcgtaaagacgtttggaccggcttgggttaatgggctgagtgagtgcgcgtgagagcgatatgtacactgttgtctgctggggagggtagcgaataatcagaactcatcttcatctccaagacattgtgctctctgcttcctgccttcttcctccttactctgaatctactctgagtattgtatccagtatatgcgagagtgtaacaagtggtatcagattcgtcgatccttggccatagcgcaagctatatcatcctggagtcgagtggtgttcatcctcatttcaccctatttcggcgacaacaagtgctcatgaatccggatacccaaaccatcctggtagaaatcgcaaggcgtttctcggatcatgacgccgagtgggatcgccgtgtggcggagctgatgaggacatcactatgagtacaact

SEQ ID NO: 15054 - DNA, 1653 bp, Zea mays
aaacgatctccggggaatattttattccgtgggattccgatgcggccagtcgtcctcctcctcctcccctctctctcccgtttcttctagtagtagtacaaataaagaagaagctgagctgctcgaggcacggcgagggaggggagggagacacaaggcgagtgtccctactccgagggcagtccggtgtgcaagcgcatagcatagcaggagccacaagaaaaaaagccccatggattccttctcgccgagtggccggatgacacggacggcagcatcatctctggcagcgcgcgcggtcctcgcgctcctcctcatcggggtatccggttccggagccacccaggcagcgtctccccacacccaccacagtcggcagctggatgtgaaccacaaggagccagtccagacgtttcggcccatcaacattgcccaccgagggtcaaatggcgaactgcccgaagagacagcggccgcctacctgagggcgatcgaagaaggcgcggacttcatcgagacgaacgtactcgcgtccaaggacgggcatctcgtctgcttccacgatgtgacgctggacgcgaccaccgacgtcgcggaccacgcggagttcgctggcaggaagaggacctacgaggtccaaggagaagatgtcaccggatggttcatcgtggacttcactcttgaagagctcagatcactgagggtgaagcagcggttcagtttcagggaccagcggtacaacggcaagtaccagatcattacgttcgaagagtacatcctgatcgcgctctacgctgacaggaccgtcgggatctacccggagatcaagaaccccgtgttcatcaaccagcacgtgaagtggtcggacggaaagcgattcgaggacaagttcgtggagacgctgctcaggtacggctacggaggcgagtacatgtccgatggctggctccggcagccgctgttcatccagtccttcgcgccgacctcgctcatctacgtctccaacatgacggactcccccaagctgctcctgatcgacgacacgacggtcccgacgcaggacaccaaccagtcgtaccacgagataacctcggacgcctacctcgcgttcatcgggagctacgtggtggggatcgggccgtggaaggacacgctggtgcctccggacccgacagacaaccgcctgggacgccccgccgacctcgtcgcgcgagcgcacgctctgcgtctccaggtgcacccgtacaccttcaggaacgagaaccagtacctgcacttcgacttccggcaggacccctacgccgagtacgcgtactggctcgacgaggtcgccgtcgacgggctgttcaccgatttcactggtagtctgcacaagtaccaggagtggactaggccgtaccggaaggagcaggagaagacgagcccggaggcactcttgcgcgagatcgcgggcatgctcaagaacgacggctatgactgatgacttaggttgccttcagttttccccgtctgtcactctctctgtaatggttaactaaataataaagcgacggtttcatggatgcatcatctggacgtgggtgtatcattaccagacactgaattttcagtaacgctctttaaaacatcagtggagtatctcgtttccttggg

SEQ ID NO: 15055 - DNA, 1687 bp, Zea mays
gatagatagctggacccacgtgccagcctccccaccaccagaaacgggtcgcgcctgccgtggagcggcctgacgggttccccggatgacgcgagccccagccctcgtgtctgtatatatatatgatgtgggaggccccacccgtcagccggacgaaagctccctaatatatacggcggcgccccgcgcatgccacaaccgcctctctcgtcctcccctcccccgtgcgaatgcgtctcctccctcggccggccgctcgtccgctcgctctcccccgcacgaatctccaggtgatggcggcgcgccgctgccactgacgtcgccagcggtggcggcggcgagcgcgcgatcgcgggcgatggccgccgaggccagcatggagcgcgcgcgcgacggccggcgccacgagcaccagcagaagcagcagcggcgcagccaccggcggtcggcttcggcgtccgtgacctcgtccacgaggcagtgggcatcagggtcggcgtctgcgtcggcgtcagcgtctccgtcccaggcggcggcggcggcggcgcaggagtcggagcggcggctgcggcggtccccgcccgtggaggcgcggcgggagcgcgagcggcgtctggcgcgcgagcagccgcggtgcggggaggtggcgggcgggacggcggcggagtgcgccgcggtgtgctgctgcttcccctgcgcggtggtggagctggtggtgctggcggccgtgcgcgtgcccgccgcgctgtgccgccgcgcgctgcgcgcccgcgcgcgccgcaggcgcgcggccaagaagaagaaggaggaggcggagctcctcggcgcctcgggcgctgccgcgtccgcccccccgaccgcggcggcggcccgggaccgcaacggcgacgccctcgacttctgccactggcccgcgcgggcggaggccgggcgcgacgagctcgccgaggcggaggcgaaggtctgggccagcttccagggcgccggcttctggcgcagcccgtcgcagcgcgaggagaggaggtgctagctcctgatcgaccgccgccgccacatctctccgtgccggtttcttggacccgatcccgatccgtcgcatgccgcatacaatcctcatagggaaaagatgaacgaactccagcgattggttgatcgatcggctgcagattgctgcgacggcgacgaccggtttcattgattgctcgcgttttttcctttttccgaaatattttcttgcattgggtgggaggagggaaggaactgtatcttctttcattgttgttcttgatcgttcgtgcgtctttcagatactgttgttctgacgtgcatgtggtggacacggtcggccaaccttgtctcctactattcatcatgcactagggctggctgtgacgatgttctagctaagtagtaggagcagctataaaaaaaagtcccagctggtttatgtcatggagagacatggacgattgacctggccttgagaattctaatgacaagtagacgcataggaactaaaaaacgtgttctgatttcatgctttatttagggttacatgcagagatcgattatttattggtcaaatgaaaagaagtcatttattagtttttcttgtcgcacaaaaccttgattgaacaccaaacaggtccaacgcttcaaggctctaaaaaaagaagcaagaagacgc

SEQ ID NO: 15056 - DNA, 1249 bp, Zea mays
gcacgagaccggtacctcgagcctcctccggccggaaaagccctcctctcctctcccctctccctcgcggcctcgccttatccccttcgtcactcacctcgaccaccgccatggccatggccttggcctccgcgaccgccgccgcactcttccgctccgccctgtccgcgccacacggcgccggcgcgcgcgtccggccgcagcgccggcagccgttcttggctccgctccacgcggcgaagggccccggctcggcgccggtggtgctggagggcaaggccaagggaaagaagaagaaggggcccagctccgggaaccttcccgcagccctcgacgtcgagatcagggaggcgcaggagtacctcgacagcgaccagcaggaacctgttccagaaaactttccatttgaattaatcgacgaagagggtatgagcgtggttattttgagaagggactacaaggacgagaaggtcgaggttactgtcagcatgcctaatttagaaggaggccccgagtttggtgatgaggatggcgagggcgatggtgagagcgctgccaaggacgacggagaagcagaagaagatgacgagagtgccggggagagcagcatctctcttaaggtggtagtttccaaagactctggcccagagctcgagttcacatgcacagccttccgcgaggagatcaccatcgatgatatgctgatagtggagaaaacagacgacgacgacggagaagagaagttcccctacgagggccccgagttcaccgagctccctgtgaatgttcagaaaggcctgttcaagtacctggagcaaagaggggtaacgctgtcggctaccaactatatgcacgattacatggtgactaagcaggctcaggagtacatccggtggatgactaagctgaaggatttcgtggcgcagtgaggaacagcgtcgtgattcggcagcattgtttggttagcctagccttagcatgtgttacagccttacaggaacactacgactacaccgaattggccacactccccaaaaaacaaaaaagggggagcattgtatctgcttcaatgtatctgtatcagctggcaaaacagtagcaagtagatttccagtaatgtttagtggtgggcattaggtattacgatacgtatctggatgaatgttttggaattctggtggctgcgagaaacaatgccgtcaccctgtcggtgcgctcacaggggggcgctctaaatcttggttaaggc

SEQ ID NO: 15057 - DNA, 1580 bp, Zea mays
agctcgcagactcgcaccatctaacaaccgccgccccgccaaacccgaaccagatctggtacgtgccgcccctcgatttggcgcgctcgatccggcatcgtggtgctggtgatatgccagtcccgaactcaaatctgggaggttccactgaagcgagattatagtcgcgaatcgcgggcgccgagatgcaggcgcgtgtggcgtccatggaggacgtgaaggaggcgcggcaggcggccatggcggcggggcaggggagggtgctgcccacggggatgctcaaggtgttcctggggttcctactgctggccgtggggctgtccgccgtcggcatgtacatggcgcggcacgcggtggcggcggccgcgcccgcgctattccgcccgtgcctgagcggctcctccgcggaggaggaacccgaggggctggagcggtggacgcggcccccagcgcgcgtagagcacgcgatgacggatcaggagctgctctggcgcgcgtcgttcgcgccgcgggtgcgcggatacccgttccgccgcgtgcccaaggtggccttcatgtttctcacgcgaggcccgttgccgctcgcgccgctctgggagcgattcttccgtgggcacgaggggcgctattccatctacgtgcacgcgttgccatcctaccatgccaacttcacctctgaatccgtcttctatcggcgccaaattcccagtaaggttgcagaatggggtcagatgaccatgtgtgatgctgagagacgcctacttgccaacgctttgctggacatatccaacgagtggtttgtgcttgtgtctgagtcgtgcattcctatatttgatttcaacacaacatacaggtacttccggaactcaaaccaaagctttctcatggcgtttgatgaccctggaccttatggacggggaagatacaactggaatatgacccctgaggtcgaactcgaccaatggcgcaaaggctcacagtggttcgaagtacacagagagcttgccattgaaattgtgaaggacacggtctattatccaaaattcaaggagttctgcaggccccattgctatgttgatgaacactatttccccacaatgctgacgattgaagctccaaaccgcctcgctaacagaagtgtcacttgggtggattggtcaagaggtggtgcacatccagccacgttcggcaggcgcgatatcacgttggagttcctgaggagagtccgagagggacggacatgtctacacaataaccagaactcaacgatgtgcttcttgtttgcgcgtaagttcgctccaagtacattggagccgttgttagagctagcgcctactgtgctcggttttggttgatggctgtgtcagtctgaagaggtgcccgtctgtaattttgatattagatcattgtaggattacacgcttggagacatgggctcagattgatggatggaaacgtacagtccccccccccccccctccctccgcttgttcattatacataaatctgttttgtttttgtacagtaatggcgtgtttagacgcatatatacttacctcagtacaaaaaaaaaaaaaaaa

SEQ ID NO: 15058 - DNA, 2243 bp, Zea mays
  misc_feature (1931)..(1931): n is a, c, g, or t
  misc_feature (1951)..(1951): n is a, c, g, or t
  misc_feature (1964)..(1964): n is a, c, g, or t
  misc_feature (1994)..(1994): n is a, c, g, or t
  misc_feature (1998)..(1998): n is a, c, g, or t
  misc_feature (2005)..(2005): n is a, c, g, or t
  misc_feature (2012)..(2012): n is a, c, g, or t
  misc_feature (2033)..(2035): n is a, c, g, or t
  misc_feature (2038)..(2038): n is a, c, g, or t
  misc_feature (2042)..(2042): n is a, c, g, or t
  misc_feature (2060)..(2060): n is a, c, g, or t
  misc_feature (2065)..(2065): n is a, c, g, or t
  misc_feature (2067)..(2067): n is a, c, g, or t
  misc_feature (2077)..(2077): n is a, c, g, or t
  misc_feature (2096)..(2097): n is a, c, g, or t
  misc_feature (2113)..(2113): n is a, c, g, or t
  misc_feature (2125)..(2125): n is a, c, g, or t
  misc_feature (2128)..(2129): n is a, c, g, or t
  misc_feature (2136)..(2136): n is a, c, g, or t
  misc_feature (2138)..(2138): n is a, c, g, or t
  misc_feature (2144)..(2144): n is a, c, g, or t
  misc_feature (2146)..(2146): n is a, c, g, or t
  misc_feature (2157)..(2157): n is a, c, g, or t
  misc_feature (2169)..(2169): n is a, c, g, or t
  misc_feature (2171)..(2171): n is a, c, g, or t
  misc_feature (2173)..(2173): n is a, c, g, or t
  misc_feature (2177)..(2177): n is a, c, g, or t
  misc_feature (2193)..(2193): n is a, c, g, or t
  misc_feature (2196)..(2197): n is a, c, g, or t
  misc_feature (2201)..(2201): n is a, c, g, or t
  misc_feature (2219)..(2219): n is a, c, g, or t
  misc_feature (2237)..(2237): n is a, c, g, or t
ctgagaattaggagtcttgagggtacccctaattatggtccccgacagttagaatcaaattctattttaataacagtaatttatgcatatatcaattaagctaattcggttttatataaaatatatttgtatactattattaataagatgtcagaaatatttatgtgctacatttttaagatagaagagtgagacgaagagcgtcatataagttatagagtagaattaaattctactaatacataaaatcatttctcatcatccatcccatgaatttgagataagcttatatctgaacttttgaaagtggttgaatgtcaaatttcaagctaaatagggtactttattgagtgaattacaattcctctaaatgaagggatccaaacgccccataaggttagtcgtacaatgaagtccgtgagcttgttcaatctgttattaggttagagtagagcatcatgcgactatgtaaatcatgttcttgtattatccctgagctctgagcctctgaggttataataattttaacaattactaaatggttgatcttataaaaaccactggcacatatcatgtgaattattcatgtcatggtcccatggatcctctaatctaaataaaacaaatatgcttgactgctgtctactttgcccaaccttcaatagtcaagccggcaatcatctattatcagtcatcaagtgcgatcctctgaggtcagaggtccctatctcttcctgactgctgctctctacttcacccgctcccacaccacgccccgccccaccccaccggcccaccccgccccgccccacgggacgcagcagaacacgacgaaggcggtgccggtccatgcacacggttcccttcatgctttccttggccggccccgtggccccccgccatctccgttgatggacaaaagccggcaagcagcggggccacccacgatgcggtgcgcgtgcctcgtgccgtcgtgcgctccctgaggtcccgatccggcattccggcgtcgcgccgatggtatgccaaccttgctctcgaattttggcgaccccacattcccacggcgcttgaagaaatcctagccccgtgctgccgcgctgcaggcggcacgcacggcatccatggagaacggcgcgaaggaggcgaggcaggggcagcacagggtgttcccgtgggggatgctcaaggtgttcctgctgctcggcttggggctgtccgcggccggcgtgctcatggcccctccggcccccgccgcggcggcggccacgctgttccggccgtggctgggcgtctcccccgccgccgccgccgcggaggggctggagcactcgatgacggacgaggagctgctctggcgcgcgtcgttcgccccgggggtgcggcggtacccgttccggcgcgtgcccaaggtggccttcatgttcctcacgcgcggcccgctgccgctggcgccgctctgggagcgcttcttccgggggaacgaggggcgctactccatctacgtccacgcgctgccgtcgtaccgggccaactttacctccgaatccgtcttctatcgacgccaaatccccagtaaggttgctgaatggggtcagatgaccatgtgcgatgctgagagacgtctacttgccaacgctttgctggatatatccaacgaatggtttgtgcttgtgtccgagtcttgcattcctatatttgatttcaacacgacgtaccaatactttctcaactcgagccagagctttgtcatggctattgatgaccctggaccatatggacggggacggtatgactggaacatgacccctgaggttgatctcacacaatggcgcaaaggatcgcagtggtttgaagtaaacagggaaagttggcatcgaaattgtgaaggacacggtctattaccccaagttcaaaggagttctgcaggncctaattgctacttctggtngagcactattttnccaaaaatgcttttcaatttgaaatttccnccanagcctanctaacangggaatggtcaccctggggtnnnacnggtnttaaaaaattggttgcgncttcnancaaaggtttnggcaaggggtttgacattnncgggaggaatttttgnggggggaagttncannaggggananacttgntntgttccaatgnagaaaaatttcnancngttntgctttttttgttttnttnncggnaagtttggctccccagcnccccctgggaaccccttnttttga

SEQ ID NO: 15059 - DNA, 1825 bp, Zea mays
  misc_feature (26)..(26): n is a, c, g, or t
  misc_feature (300)..(300): n is a, c, g, or t
  misc_feature (307)..(307): n is a, c, g, or t
ttgggtacctcgaggccggccggggncaagccaggccactctaccaccgcacgctcaactcaaacccccgtcccgaacgcagaagaccggcggcagcggcggggtgtgtgtggactggactgtaaccaattgccatcaatccaggcatccatccatccacccgccccgctgacggcggcaatggcccggctcgtgctctccgagtgctgcggcctcgcgccgctccgccgcctgcgcgccggccggggcgccattgcggcgccgtcaccccccgcgctctccgcagcgccgcgccgccgncccgcgnccgcgtccatccaccgcgactgggcgctccgcgtctccgcgcccacccgcctcacctccgccgtcgaggaggacaagaggagctccccccttggggagggggacgagcacgtggcggccagcggcgccgcgggcggggagttcgacccgggggcgccgccgccgttcgggctggcggagatccgcgcggccatccccaagcactgctgggtcaaggacccctggcgctccatggcctacgtgctgcgcgacgtcgtcgtcgtcctggggctcgccgcggccgccgcgcgcctcgacagctggctcgtctggccgctctactgggccgcgcagggcaccatgttctgggcgctcttcgtcctcggccacgactgtggacacgggagcttctcgaacaaccccaagctgaacagcgtggtcggacacatactccattcctccattcttgtcccgtaccacggatggaggattagccacaggacgcaccatcaaaaccacggccacgttgagaaggacgagtcctggcacccgctaccagagaggctgtacaaaagcctggactttatgactaggaaattgcggtttaccatgccgttccccttgctcgcattcccgttatacttgttcgcaaggagtccagggaagtcaggatcacacttcaacccaagcagtgatttgttccaacctaatgaaaagaaggacatcataacatcaacggcatcctggctggccatggttggtgttctggctggtctcacctttctgatgggtcctgttgcgatgctaaagctctacggagtcccatactttgtatttgttgcttggctggatatggttacatacttgcaccatcatggccacgaagacaagcttccctggtaccgtggacaggaatggagttatctgcgtggaggactgacgacgctcgaccgggactatggactgattaacaatatccaccatgacattggaactcatgtcatccatcaccttttccctcaaatcccgcattaccatctcattgaggcgaccgaggcagcaaaaccggttcttggcaagtactacaaagaaccaaagaagtcgggtcctctcccgtggcacctgtttggggtgctagcacaaagcttaaagcaagaccactatgttagcgacaccggagacgtagtgtactaccaaactgactcgaaaacgaacacctctgcacaaaaatctgattgacacagactatagaacgtagcgtattcttcatttttcgcaggcggactgtgcctgaagacctggccagcctcctgagacctctcgattggtgtgtgtgtgtgtgtgtgtgtgtgtgtgaccgggttcgtcaattcaagaatgtaaggtggcgaagtattatcatgtatgcgagtgagggtataattctttcgaatgatcgaagtcggatgctgcttccgatgtaacgaactgtgattctttgcacaagaggtgtactattacagtaaagagtgaaaaaaaaagaggcttagctacaaaaaaa

SEQ ID NO: 15060 - DNA, 1354 bp, Zea mays
  misc_feature (1)..(1): n is a, c, g, or t
ntcatacttatgaaaagaagggcatcataccatcaacggcatcctggctgcccatggttgtgttctggctgttctcacctttctgatgggtcctgttacgatgctaaagctctacggagtcccatactttgtatttgttgcttcgcggccggccgggacatacttgcaccatcatggccacgaagacaagcttccctggtaccgtggacaggaatggagttatctgcgtggaggactgacgacgctcgaccgggactatggactgattaacaatatccaccatgacatcggaactcatgtcatccatcaccttttccctcaaatcccgcattaccatctcattgaggcgaccgaggcagcaaaaccggttcttggcaagtactacaaagaaccaaagaagtcgggtcctctcccgtggcacctgtttggggtgctagcacaaagcttgaagcaagaccactatgttagcgacaccggagacgtagtgtactaccaaactgactcgaaaacgaacacctctgcacaaaaatctgattgacacagactatagaacgtagcgtattcttcatttttctcaggcgggctgtgcctgaagacctggccagcctcctgagacctctgattggtgtgtgtgtgaccgggttcgtcaattcaagaatgtaaggtggcgaagtattatcatgtatttgagtgagggtataattctttccaatggtcgaagtcggatgctgcttccgatgtaacgaactgtgattctttggacaagaggtgtactattacagtaaagagtgaaaaaaaagagagttagctacaaaaaaaaaaaaaaaaaaaaaaaacctatctctctctctctctctcatgtttcagctgtcccgagtgcgacatgagcctaatcatacgatagcaaaattttgccttgtttggtaaactcacggcgctcacgcttgctgtaaacaagtaacatcattgcattcttttggcaagggggagaacagagcgatggttttcagccgttggaaaagggcccgtcgctttctgtttttttttttttttttgctgttgagtcccactgggatccattccatttccaatacaagtgggctcctgagtcctgacgtttgtggccggaatcccatagagcgcgccctgcctccctcttctgcaccccatcgtagggtgtggttgtgtggctgcggttcaggaccgacgcgcacgacgccgaccgaaagcagagcactccaaaacagcaagcgtggagaccggcgcaagtgctcaaacgaagaccatggcgacccgtttgggggtggacacgcacacggcttgcgtgatccgcgagacgtgtgtgcccctgcag

SEQ ID NO: 15061 - DNA, 3926 bp, Zea mays
  misc_feature (2792)..(2792): n is a, c, g, or t
ggaggtataataaatgctggtcgtcctcgtatcggccctctttctatttaacataagcggtatatatgaaaaaggagtcgtcacaatcataaaattgttacgttttttttttatcagagcttgaaatgtgagtatgactcggttccttggttgagtcagatgagaacccaagagaaacgacggtgtgttttccgtggcccaatcgtgcggtgcctgcgctgcggccatacagcttgggccttgggcagccggcgggtgttctcacttctcaccgacggtcgttcattgtgctgcggaatcagcgacgaagatggtagctggggggacggtaaatggggtggctagttcgactgctgcctgcgctctgaagaatatgaatatgacacgtacgtacgtgcgtgctactcagccagtcgcccagtcctcgatcggtcacgcagtgcaatagggcacaggccactgcacggacgtcgcagcacaagatgcgtttgtgactttgtgtgtgtgtctgttcctgtgtttgtgcgtgagttgtgagtgagagaacgctcaagcggctcaacgggtgcaaacttttttctgctatacgtttggcctccctgcaggctagctgcgccactatattgttcttttttttttctcttctcagttttgcatgttattcgacgatcgatatcgcaaaatgaagagcgaacagcacaagcgaactagctagtgtacggtatgttatgacttgcgctgtgtcactgtcaacaacaacaaactgctcaataatatcattcttattccccagttggatcaagaattaattggccagcagggggagagtcaatacagaaacccgataattaacgctttttttttttttttacaccagaaagaaacttcactttcattattgcatggacaaagttgaagccaaagtactagctagctgaaaggcaactactgcaaaagaacaatgcaccggaaaacttagctttattacagcaaatagcagagtagttcatgcgaaagtaggtgaaaggaaaacaataatatatagctactactagctgcgagagtgttccaagctcaagagggatagacggggacgagagggatggaaggatcgacaggcgcgagacgaggagaggtagtcgcaagatgcaagagggtaactcgtaggagattatctccggacaaaaagtcttgcaaggtcaagaagacgctcgcttaactttttgtcacaagaagggttctgacagcggtggtgaataggttggaagtcgaggaataagctcggcgaggatagcgccgtatcacataacagcatcagcacggaagcgctcccagcagccgctgctgctcgcacggcggtgcttgagccgcttcctcttcttcctggtcatccagcagcagaggcgccccgccgtcgaggctgcggcagccggtgacgcgggggccccggcggtggccgagaagcttgggcagcagaccgggacgaagaacgtccggcggcgatggtggtcgtcgcttggcatcttgttgcttggtggcctggcctgagaggaggagagggttcgcaacggcaagaacggtggagcgtggagaagaagggctgctggggctctccctttatatatagcgcgcgcgtgggacggtgagagggaggaagcaagagcgcggtgccggagatgggcgagggctaggggagggaggcaaaagggaggaagcaggcgtccggttttaaaagaagtgcaaccttccctctgtctttttctttccatagaaaataaaaaggaaggaaagacaactgatgcgtgtactgttccagttctcgcagaaattaatgaaagatacgtatatattacaggttttggcaagatcttaggctcttagccaactgcattacactgggagaaatggaccacataaattcaactacaagcgaaggaacagaaggtaaagttgctgaatcgctcgggtgtagacagcccttaattccttcctcacgtggaccgcataaaggtgaaacaggagaggcctctggtgagcctagctactactagccatagctagcagtagcagcgtgcagtgcctctttatgggcacggcaacaaacgcctttcctccggccggctctcgggcaggcccggcccggcccgccggaccggacggcgaccacagcgagccggccttgcttggcatgcatgcgcgcgccattgccattgccattgctattgcccgttcccagcccgaggaacagcgcggcgtgaccgtaccggcactgcgcgttccagttatggcgaatcagaaccaaggagggtgaccgaggcgcgcatgcatgtgctgctgtacgtttgccacgctttgcgttgcagtgcgtcggatcggagtcaggccggccggtcggagggccaacgccgatgccaatgcaacgcgtttcaattcatgcggtcccccgccggccagcgatcagtgtcacacctctgctctccattaacgtacatgccgcaacgcgacgaccggatctgcagcatgcttgttttcgagtccccggccctctctcctccttgctccaaagtcgaaagtacacacacacagggagagagagagagtggggtacgtagtgtacgtactctgcgtcaagttgcgcacccgtagttcgtgttgcaccaactaacatgcccagctaacggacacatgcatgcatgcgttttctctggggtggccggcgtgatgagatgagagatggtgggcgtcaaggaattggcgacccagcccagcaccatttgggggaaaaaagctanacaagtgctagctagccgtgtccgcggaccgcggccggccacaaaaaaaaggttgctatgcatgccatccaaacaacccgtcgaacggcggttgacaaatcggccatgcccaacacggaactctagccgcatgcaggggaccgcccggacgatcgatccgctttgttcgttcgttcgttcgccgccacgccgcagccgtaatagtacatgtaccatttgcgaagcccggacggctgacgcccacgcacacccaacgcaatccatcctcgctggaacggaattctcaacttagattgttacacgtacgtatgagtgtacgagtgaccgtacgagtgttacacgtacgtattgagcacaatttagattgttagattggcacaaaacaatgtccttttacgtattccttagagctgaaaacgagacgagagccaaagcatcgttcatatatggcagctaataacatcgtttaatagattaaaggacgcaaaccccagacctttatattatatggcaggtaacaacactgtcaagattagtggcatagcctttttcctactatatgcatcgtctatctttaacatatctaactttttatttttaacacccacctgaatcttgacgatattaaattaagttcaaaatgctacaaatcttgataatggtggaccacctaaaggcttagccataatatcgatcacttgatctttagaggatatgaccggcacatctgattggtgaaacgtcatcagttcacggataaagtagtaatcaacttctatatgtttggtgccatgaaactatggattcttcgtgagatcggtagccccaatattatcacaccagaaaatcggtggccatggttctgatataccaagttcctaaagcaatattgtgcctaaataagttatgtagtagcattagtgacctccttatattgagctgagatatttgagtgcttcctagtgctccaaaaaataagataccaacaaagaatactagtgtaaccactagtgctacattgattgtccagtttggtagcccaattcgcatcagagttactgtaatagctagtttgttggttcgacgactctaggtttcgcccaaagttactaaaacatctaattagtcggttgg

SEQ ID NO: 15062 - DNA, 1786 bp, Zea mays
  misc_feature (1618)..(1618): n is a, c, g, or t
attgggaccctcgaggccggccgggagaaaccggccgggaagccgaagagaggaggagagccaagcggcgactggacctggagagccggcatggcacgcctgctcctctccgtctcagtccccatgtccgctagcagcagccgccgcattgtggttcctggtaccgcgcggcaccgaggccgcagcggcgtctgtgtcgctgtgcccgccacctccaccgccaccgccacccaacaagaatttgaccccgcggcggcgccaccgttcgggctgggcgacatccgcgccgccatccccaagcactgctgggtgaaggacccctggcgctccatgggctacgtggtgcgcgacgtggtcctggtgctgggtctcgccgccgccgcggcgcgcctcgacagctggctcgtctggccgctctactgggcggcacagggcaccatgttctgggcgctcttcgtgctgggacacgactgcggccacggcagcttctccaacaaccccagactcaacagcgtggtcggtcacattctgcactcctccatcctggtgccatacaacggctggcggattagccacaggacgcaccaccagaaccacggccacgtggacaaggacgagtcatggcatcccctccccgagcgtctgttcaagagcctggacagcgtcgtcctgatgctgcgcttcaggctgcccttccctatgctcgtctacccattctacctggccaacaggagccccggcaagtccggctcccatttccacccggccagcgacctcttccagcccagcgagagcaaacaagtgctcacctccacggcgtgctggctcgccatggtcgcactcctagctggcctcgccttcctcatgggccctctgcagatgctcaagctctacctggtcccctactgggtttttggcatgtggctcgacttcgtcacctacctgcatcatcacggacacaatgacaagcttccatggtaccgaggaaaggaatggacctatcttcggggtggcctgacaacgctcgaccgggactacgggtggatcaacaacatccaccatgacattgggactcatgtcatccaccatctcttcccgcagatcccacactaccatctcatagaggcaacagaggcagccaagccggtgctgggaaattactacagagagccgcaaaagtctggccctctccccttgcatctacttggtgatctggttcagagcttgaggcgtgaccactatgtcagcgacacaggggatgtcgtctactaccaaactgaccccaccattagctgttctggtccattcacttgactaattgagggaggctggaagttatccgaaacacaaggatcagaggctaccggagagatctgatctatgagccacacacttgcatataacaataagtcaatcattctttgggcaaaacaagctacagtacactttccagtgctttactatcaggactcattagcacatgcttagctggtactgttgcaagaaagcaatgtgcagtacctccgcttactgctgtcctcacatatgcagtacattatttgcaaaatgcaagtggactacctgcgccttagatctctctgcaaaagtaaaacagggngggggggggaacttgaaagttggagacatgggccttttcctgacaaatcatgtattgctgcttcatgacaaaatgagaatattctgacaaaataaataatgcatggaaatagaaaacgaggtaccaagtcttctttctggtccaaaaaaaaaaaaaaaaaggccccta

SEQ ID NO: 15063 - DNA, 1930 bp, Zea mays
aagccaggccactctaccaccgcacgctcaactcaaacccccgtcccgaacgcagaagaccggcggcagcggcggggtgtgtgtggactggactgaaaccaattgccatcaatccaggcatccatccatccacccgcacccgccccgctgacggcggcaatggcccggctcgtgctctccgagtgctgcggcctcgcgccgctccgccgcctgcgcgccggccggggcgccattgcggcgccgtcaccccccgcgctctccgcggcgccgcgccgtcgtcccgcgtccgcgtccatccaccgcgactgggcgctccgcgtctccgcgcccacccgcctcgcctccgccgccgtcgaggaggacaagccgagcgccgcgccggggcaggaggagggcgcggcggccggcggggagttcgacccgggggcgccgccgccgttcgggctggccgagatccgcgccgccatccccaagcactgctgggtcaaggacccctggcgctccatgagctacgtgctgcgcgacgtcgccgtcgtcctgggcctcgccgcagcggccgcgcgcctcgacagctggctcgtctggccgctctactgggccgcgcagggcaccatgttctgggcgctcttcgtcctcggccacgactgtggacacgggagcttctcgaacaaccccaagttaaacagcgtcgtcggccacatactccattcctccattcttgtgccataccacggatggaggattagccacaggacgcaccatcaaaaccacggtcacgttgagaaggacgagtcctggcacccgctaccagagaggctgtacaaaagcctggactttatgactaggaaactgcggttcaccatgccgttccccttgctcgcgttcccgttatacttgtttgcgaggagtccagggaagtcaggatcacacttcaacccaggcagtgatctgttccaacctactgaaaagaatgacatcataacatcgacggcgtcctggctggccatggttggtgttctggccggtctcacctttctgatgggtcctgttccgatgctaaagctctacggagtcccatacttggtatttgttgcttggctggatatggtcacatacttgcaccatcatggccacgaagacaagcttccctggtaccgtggaaaggagtggagttatctgcgtggaggactgacgacgctcgaccgggactacggatggatcaacaacatccatcacgacatcggaactcatgtcatccatcacctcttccctcagatcccgcattaccatctcatcgaggcgaccgaggcagcaaagccggttcttggcaagtactacaaagagccgaagaagtcgggtgctctgccgtggcacctattccgggtgctggcacagagcttgaagcaagaccactatgtcagtgataccggagatgtggtctactaccaagctgagtcgaaaacgagcacctctgcacaaaaatccgattgacagggagtatagagcgtgtagcgtgttcttcatttttctcggggaggggctgtgcctgaagacctgaccagcctccacctctgattagcgtgagtggggtacgtcgactgaagaacgtaagctggcgaagtagtaccatgtatgtatggagagggttaaatgtaattctttccaatggtccaaggcggatgctgcttccgatgtagcagcatgcgattctttggacaagaggtatactattacagtgaagagtgaaaaaaagagagagttagctacatagaaagttttctgagctctatacgcgctacctccgttttcggatatttttgtcgtcagctcgatcatttttgaactaaacggcgataaataaataaaaagaacggaaggagtatatcttaaaaaaaaaaaaaaaaaaaaaaaaaaaaaagcggacgcgtgg

SEQ ID NO: 15064 - DNA, 560 bp, Zea mays
tcgggaagttcgccttgtgacggtacccccggtgcgcccctctcgccggcggcccaagcccaacaaggctgagatctcagagtagagcccactcgtcgggcgcgcacgcacgcacgccgtgaagacgacgacagagcccaagtcgaagcgagcggttttgccggcggcggcggcgaccggaggatggggatgggaggccggggcgtggtgggagacaggtggtcgcaacgcattctctggatctgcgccctgggcagcgccgtgagcatctactttgtggcgtggagaggcaggcgcagaaccgcgcgcgggcggtagcggagggcctcaagggcctcgacggcgcaggggatgacgtgtgacagagctggacgctgccgttgcagaggggcctcctttgtttaggttattaaaatgagccacttttttttttctgcttcacatgttcacagaacttcgtagcgttgcaataataatgtactaaacatctgtgccaaaaaaaaaaaaaaaaaaatgttgatctatgtgggtgttctcctatgtcgcggcctccatctgag

SEQ ID NO: 15065 - DNA, 1331 bp, Zea mays
ttttttttttttttttgaaaaaacatttaattgttctcattcctgttcctgcaatataccatccagttcacatttttcgacaaatacaaaaacagattggttaaaacgggatacaataccaaacgaaacccatttttttccatccattttcatctctactactccaccatatcttgagtatcacactcatcgatgaaggcacaagattcgtgtgcgaacaaattttgggcgtcgtccaacctaaaatcgacttggtcattggtctacaaacgaactttatactccggcactgaactttcagatgtatctttcatttaaatcagaaatgttacaactgaattttcaaaaggtagctatcatatgaaggaatgataatgaatgaaaaattgatagtaatacgttaggttgataatgttgttgacaaacctttattttctatttactctttttgttgcctttggattatcatcattggatgaaaaagggattctgctaaccagaaacaccaacgcggcaccaatcaaagcacctgacacatgagcgacgttgttcacttgaaatgactggcccgtgattgttgttgcacgtgctgcttccaagaccttgtcaacaacaaattgtccaaggataagcacttcaagaatctttctccagtcccatgacatcttaactagaacactaatggtgaaaaggccaaaaacagcaccagatgctccaagtgacacagaggatgttggaagagctagccatgaaatcaagtttgccccagcaccagtcaaaatgtaagacatccagagagcaaagttaccctcttcctcctcgacaagctttccaaagatatacacaaagaataaattgcttgaaagatgattccagttggcatggcaaaatgttgatgtcacaaactggaaccatgaagggaatgcatgatacaggtatagtgattttatttgccgaatctggaacaagtggtcggccatgtagatgccgaaattgagcagcaagatccagaagatgccattggcgcgcctgctatgcggctgcttctccttggcaatctccagttcttcgaccaagcttgaacgcttcgtcgcgtaccggagcaggccccgccggatgccgggtgctacgggaacggcggtaacggggacaaggtggcgccgggggaggtaggagagaaagggagaggggagggccttcaagaaagttctggaaggggcggggaggaggagcagcagctgctgcgccatggctggagcctagaggtgccctcccttcccttgcttgtgctgggttttggggaggggaggactggcatctatccccgccgg

SEQ ID NO: 15066 - DNA, 1231 bp, Zea mays
ggccgcttttgtgcttttttttttgtattgtgttcttcatcttcgtactgttctctgaatgtatatcaaagttatgtcagaagttatccgaatgtaccagatcagaccttccacgtttacagttgaaacttgaaaagctttgagttcttttttacgaccagatggagttagcatcacggacatcatttagcatatgaactaaacactgccaatgaggatcatatattttgaatggcaagccttgcggctatcattccgatgttatgttctacaaacttgataccagtgttcagcctttcaagggtgtctgtcgaatccattgcttgtatcttgtagttttgcacagtgagaagttcttcatctgacatgcctgaaactgtttggtacgcagcaaatgagagacgttctgggcgtccagggataaaagactcattatactcttcaaaactttctttctcggaccacagtagagatgccctgatgttagtttgcagtggttcatcctcaggtaccttcaacttcatttgtaggctgtgtaaattgcacatggattcttttagcttggaaattcttgtctctaattcaatagcgtcataaggcccatccatcattggagaaactgtaccacggaaatagggctccatatccaaaagattcgaaatgtttacacggcacactcctctaattgataacaacgctccaatctccagcttttgaacactttctatgtggaccaagcagccatatcttacagcaaatgaagctttagtagagctatctacaactggatcaagcacaaagtgaacaaaagatttttccctcttgtacaaggcctcctcaagcaatgctatatatcttgcttcatacaagtgtagagtcttcgattcagatggtatcaacacctccgcaggctggaacgggaggagcgggaggtcgagcgacggcgtaggcggcgacaacgcgcagcgggcagcgcggagatggcgttggcgcgccggccacgcgtggaggggcggtatgggcctcaggctcggatcttgtggcggccatgtagagcgggagggcgagaggaggaggtggatgggagcggaggccgccatggccgcggccggggccggggccggggccggggtggagagattttcagcggatgggaatggtccgtgccggggcgggccagcgtcccgagataatctgaaaggaaccccggccggcctcgaggtacccaatg

SEQ ID NO: 15067 - DNA, 3255 bp, Zea mays
ctgcagccgagcgacaccttcccgcggcggcacaactccgcgacgcccgccgagcaggaggccatggcgtccgcgtgcggcttcggcggcgtcgacgcgctggtcgacgccacggtcccgcccgccatccgcgcgccgccgatgcggttccccggcaggttcgacgccgggttcaccgagtcgcagatgctggaccacatgcggcgcctggcgtccatgaacagggacttcaagtccttcatcgggatgggctactacggcacccacgtccccgcggtggtgctgcgcaacctcatggagaacccggcctggtacacccagtacaccccgtaccaggccgagatcgcgcagggccgcctcgagtcgctgctcaactaccagaccatggtcgccgacctcaccggcctccccatgtccaacgcctccctcctcgacgaggccaccgccgccgccgaggccatggccatgtgcagcgccatcctcaggggcaagaagaggactttcctcatcgcctccaactgccacccgcagaccatcgacgtgtgccgcacccgctccgacggcttcggcatccgggtcgtcgtcgccgacgccaaggacctggactacggcggcggcgacgtctgcggcgtgctcgtgcagtaccccggcacggagggcgaggtgctcgactacgccgagttcgtccgggacgcgcacgcccacggcgtcaaggtcgtcatggccaccgacctgctcgcgctcaccgcgctgcgcccgcccggcgagatcggcgccgacatcgccgtcggctccgcgcagcgcttcggcgtgcccatgggatacggcggcccgcacgccgcgttcctcgccacgtcgcaggagtacaagcgcctcatgcccggccgtatcatcggagttagcgtcgactccaccggcaggcccgcgctccgcatggcgatgcagacccgggaacagcacatccgtcgcgacaaggccaccagcaacatctgcactgcccaggccttgctcgccaacatggctgccatgtacgctgtctaccatggcccagcggggctgaaggcgatcgctgaccgggttcatggcctggctggcaccttcgcccacggcctcaagaagctcgggacagtgacggtgcaggacctgcccttcttcgacacggtcagggtcacgtgctccgatgcacgtgcaatcgccaaggaagctgtcaagaacgagatgaaccttcgggtcgtcgatgccaacacgatcactgtagcatttgatgagacctccaccctggaggatgttgacaagctgttcaaggtgttcaacaacggcaaatcagccagtttcacagccgaatccatcgcaccagaggtctcaagctcaattcctagcagccttgctcgcgagagcccctacctaacgcatccagtcttcaacatgtaccacacagagcatgagcttcttcgttacctgcataagttgcagtccaaggatctctcgctatgccacagtatgatccctctgggttcttgcacaatgaagctaaacgctactgttgagatgatacctgttacatttcccaactttgcgaacctgcacccatttgcccccactgatcaggctgcagggtaccatgaaatgtttgacgacttgggcaacctgttatgcacgatcacaggttttgattctttctctttgcaaccaaatgctggtgctgcaggagagtatgctggattgatggttatccgtgcttaccacaactcaagaggagaccaccaccgcgatgtctgcatcattcctgtctcagcacacggcacgaaccctgcaagtgctgctatggttggaatgaagattgttgctgttggaactgatgccaagggtaacataaacatcgaggaattgaggaaagctgcagaagcaaacaaggacaacttggctgctctgatggttacctacccttcaactcacggagtctatgaagaaggcattgatgagatctgcaagatcattcatgaaaatggcggacaggtctacatggacggggctaacatgaatgctcaggttgggttaacaagccctggttttattggagctgatgtttgtcaccttaaccttcacaagacattttgcattccacatggtggaggcggtcccggcatgggtcctattggggttaagaagcatttggcaccatttttaccatctcacccagtgattcccactggtggctttcctctccctgagaaaacggaccctcttggcaccatttctgctgctccatggggatctgctttgattctgccaatttcctacacatatatagccatgatgggctcacaggggctcactgatgcttcgaagatcgcgatcttgaatgcaaactacatggcaaaacgtctagagaaacactacccagttctgttccgtggagtcaacggaactgttgcccatgaattcatcattgatctaagggcatttaagacgactgctggtatagagccggaggatgtggcaaagcgcttgatggactacgggttccacgcaccgaccatgtcatggcctgttcctggcacacttatgattgaaccaactgaaagtgagagcaaggccgaactggacaggttctgcgacgctcttatctccatcagggaagagattgcagagatagaaagcggcaaagcagatgtgcttaacaatgtcctgaagggcgctcctcacccaccgcaactcttgatgggtgacacatggagcaagccgtattccagggagtacgctgcgttccccgcggcatggctccggggcgccaagttctggccaacaactggtcgtgtggacaacgtctacggggaccgcaacctcatctgcacgctgcagcaggcgacccaggtggccgaggaagccgcggccgcaactgcaaccgcgtaatctcgtccgagaaccacgataattgatcgcggcgtgcgattgtgcgaaacatcctcaagaaactataatgcatgcttcctgtaggagggaagcatcgtcatcttcctcgtcatcctttctgcagtgtacatactagctcatggcagcgcctgatcccccaccaccaccgcgcgcacacacaaagctgccaccttgtaattttgtacattacttcattgcttctctgttattcccatttaataaattaaaaggaatagctttttattgaatataatttgtttctcttttccaaaaaaaaaaaaaaaacgcccccgggggcccggtacccaattcgcctctata

SEQ ID NO: 15068 - DNA, 1788 bp, Zea mays
cgccgacctcaccggcctccccatgtccaacgcctccctcctcgacgaggccaccgccgccgccgaggccatggccatgtgcagcgccatcctcaggggcaagaagaggactttcctcatcgcctccaactgccaccagcaacatctgctttgattctgccaatttcctacacatatatagccatgatgggctcacaggggctcactgatgcttcgaagatcgcgatcttgaatgcaaactacatggcaaaacgtctagagaaacactacccagttctgttccgtggagtcaacggaactgttgcccatgaattcatcattgatctaagggcatttaagacgacttgctggtatagagccggaggatgtggcaaagcgcttgatggactacgggttccacgcaccgaccatgtcatggcctgttcctggcacacttatgattgaaccaactgaaagtgagagcaaggccgaactggacaggttctgcgacgctcttatctccatcagggaagagattgcagagatagaaagcggcaaagcagatgtgcttaacaatgtcctgaagggcgctcctcacccaccgcaactcttgatgggtgacacatggagcaagccgtattccagggagtacgctgcgttccccgcggcatggctccggggcgccaagttctggccaacaactggtcgtgtggacaacgtctacggggaccgcaacctcatctgcacgctgcagcaggcgacccaggtggccgaggaagccgcggccgcaactgcaactgcgtaatctcgtccgagaaccacgataattgatcgcggcgtgcgaaacatcctcaagaaactataatgcatgcttcctgtaggagggaagcatcgtcatcttcctcgtcatcctttctgcagtgtatatactagctcatggcagcgcctgatcccccaccaccaccgcacacacacacaaagctgccaccttgtaattttgtacattacttcattgcttctctgttattcccatttaataaattaaaaggaatagctttttattgaatataatttgcttctcttttccgaacaggcaagtagtcaacacggaagttatgtctatacatatttgatatgtccataacaaaaataaataaatgaaggagcattgttggaaatatgcttaagggctgatttggtggtcagaaatctcaagaggatccatgagaagtaatccctttgctattcaaatttgaataacaagaggattccttccaataaatcatatccatgatcatcaaatcagccataagagataacaaattggcatcaggttggattcaaattatacttaatattaggccacaaattggctgacgcttaatgtattgtgtatcttttttcttgaacacgcataagagttgtgtatcattatattaagaagaaaaatgtctaaaatagacccgacacaaccgtccagccaaaggcttagacacacactaacaaggttgaacttcagatagccgactaagaagctcagcagcatcaaccagcgatctgacgactctgaggcaagccaactggagctggaggcctttagcaccggtcttgctccagcaccatacttcctctccagcaatagagagagcagtagagagacgaggggttgctctgttaaaaacaatgccattcctgtgttttcacaagatccatgtcatattccacaagatccatgtccctaatatgacgagagagtttaaccccttcttcaaagccttatatgcctccgacacaacctgcaggcatgca

SEQ ID NO: 15069 - DNA, 1241 bp, Zea mays
gccatttttattttatcagttgtctactcacatttttagacttgaactgcaattccattgcatcaatgcaaactgcttctggtgcttgtaccatatcatggtcagtgcagacatagctgctttgtttggatggaattctgatatcaagcacaaagaatgttgttggcatggtcatatccaagtaccctcagtgcataactgaagctccatgcggcagaaaattctgacatgagcagaataaattgatgtatatgtaccttttggaatggctggagttatattggctgcagcactctaatatttttatccatcaggttcacgctacagcctatggaaatttatgttgatgatgaggctaaactgacccttcatggtctagttcagcactatatcaaattaagtgaggcagagaagaaccgaaagttgaacgatcttttagatgcactcgacttcaaccaagttgtgatatttgttaaaagtgttagtagagctgcagaactcaacaaattgctctgcgagtgcaatttcccctcaatctgtatacattctggaatgacacaggaagagaggttgacacggtacaagaacttcaaggaaggacacaagaggattcttgtggctactgatttggttggtaggggaatcgacattgaacgtgtcaacattgtcgtaaactatgatatgcctgattccgctgatacatacctgcatagggttggtcgggctggacgttttggtaccaagggacttgcaataacatttgtttcttcttcatctgattctgatgttctcaatcaagtgcaggagaggtttgaggttgacataaaggagctgcctgagcagattgacacgtcgacatacatgccatcttgatgatcgaggtgaaccagtgtttagtttgagctggaaaggagagcttgtttgaaatatacaccttagatcgctgttggacaaccttagcaccttgtttgaaagatgttccatttgtacttaaccagcagtctagtggattaagcagtaggcgtcgcaacagctgttacatgctacctaggattttatttgcaactctgtaatgttttctatgctccgactgctaattgttctgtttgagactgccctctgggtgcatgttttactagtaaattactcgcaccatgcccgagtcttcggagcatgtgtttacatatataaaaaaaaaaaaacaaataggagcggcctatattgaacatcagttgtgtgtt

SEQ ID NO: 15070 - DNA, 738 bp, Zea mays
ccagcaagccaggcccccccggcccaagcccttcaaggaaggccccaacaggattcctgtggcccctcatttggttggcaggggaatcgacattgaacgtgtcaacattgtcgtaaactatgatatgcctgattccgctgatacacacctgcatagggttggtcgggctggacgttttggtaccaagggacttgcaataacatttgtttcttcttcatctgattctgatgttcccaaccaagtgcaggagaggtttgaggttgacataaaggagctgcctgagcagattgacacgtcgacatacatgccatcttgatgatcgaggtgaaccagtgtttagtttgagctggaaaggagagcttgtttgaaatataccccttagatcgctgttggacacccttagccccttgtttgaaagatgttccatctgtacttaaccaccagtctagtggattaagcagtaggggtcgcaacagctgttacatgctacctaggattttatttgcaactctgtaatgttttctatgccccgactgctaattgttctgtttgagactgccctctgggggcatgttttactagtaaattactcgccccatgcgcgagttttcggagcatgtgttttcatatttaaaagagttgctccaaataaggagaaaaatatattgaacatcagttgtgtctccaaaaaaaaaaaaaaaaaaaaaaaaaaaaaaaaaaaaaaaaaaaaaaaacacc

SEQ ID NO: 15071 - DNA, 1270 bp, Zea mays
atgatactcgccgacggcctcttcaacttcctgtccatcgtggcgtgcacgctgcacaccatgcgcaagaggcgcagcaggcagcagccgataataatccaaggcggcggctgcggtggcggtagtgaagcccacgcgtccgcccacgcggccgcccagccgcgtccgttccactgcctcaacgctgctgccgagcaaccgaagaagagcttcgatgatcgccgccgggcgcaggtgtttctgcgtgaccacatatccaactcggtcaacatcgtgtgctacgtcctcctgtcgatggtctccgtcgccgccataccgtacctctacccgcagatgcggcgcgcgcacgtcgccctcatctacctcgccgcgccggtcgtcgcgttctgcgacgcgtacgccttcggcgtgacggacatgaacctgtcgagcacctacggcaagctcgccatggtgctcgtgggctccagcgtggggcgcaacgacggcggcgtcgtcgccggcctcgtggcctgtgggatcgtgatggggaccatgtccaacgccaacaacctgatgcaggacctcaagacggggtacctgacgctgacctcgccgcacaccgtgttcatcagccaggccatcggcacggcgctcgggtgcgtcgtcaacccggtcatgttctgggccttctacagggtggtgcagaacggcgacaccgacgtcttcgacgcgccctacgcccgagtgtaccgcagcatcgccatgctgagcgccgggcaggacgggatacccatgcacagcctctggctctgcaagctcttcttcgcgctggcgctcgcgctcagcgtgttccgggaggtggccatgtggaagcgctggcgtgtggcacactacattccgagcatcatctgtgtcgccatcgcctttgtggtgccggcgcgcatacccatcgacatgttcgtcgggagcttggtgctgtacctgtggaggcgtgccgaccctagcaaggcgccgacgttctcgatggcggtggcgtcagggatgatctgtggggacgggctagggatgctcttgtcatccacgatggcactcatgcatgcgcgggcgcccatctgcatcaagttcatgtctcgtaccgataatgtaaagctagatgccttcttagctacactgcctgtgacatagctccgtccgtgcatgtatgcaatgtatcataggagggaacccattccgtagttgtgtgggttgtattgtatctacttgtaaactcgtcgttgtagtctaaaat

SEQ ID NO: 15072 - DNA, 1000 bp, Zea mays
ccggccggggttttccttcgagaactggtcagcaatgctagtgatgctcttgataagttgcgttacctgagtgttacggattctgagcttctgaaggatggtccccaacttgatattcgcgcccggcccgaccggggtacgggaataataacaattactgattctgggattggtatgacgaaacaagagcttattgattctcttgggactattgcaagcagtggaactgccaagttcctgaaggcattgaaggagagtcaagaagcgggcatggacaacaacttgattggccaatttggtgttggtttctattccgcatttcttgtttcagagaaggttgttgtatcaacaaagagcccaaaatctgacaaacaatatgtttgggaaggacaagcagattctggttcttataccattagagaggaaaaagacccggagcagctcattcctaggggaactcgccttactctctatctcaagtgtgatgataagggttttgctcaccctgagaggattcaaaaacttctaaagacttactctcagtttgtttcctttcccatttacacatgggaagagaaaggcttcacaaaagaggtcgaggttgatgaagatccagcggaagcccaaaaaaaaggtgatgattcagcggaaaccaaaactgagcctaagaaaaagaccaaaactgttattgagaagtattgggattgggagctttcaaatgagacacaacctatttggcttcggaaccccaaagaggtttcaactgaggaatacaatgattttttcaagaaaaccttcaatgagtacttgggccctttggcatcatcacacttcactacagagggtgaggtagaatttaggtcaattctttttgttcctgctacaaggaaggaagatgtaactgctgatagtaggaagaccaagaatatcagactatatgttaagcgtgtattcatatcagatgactttgatggagaattgttcccaagatatttgagct

SEQ ID NO: 15073 - DNA, 1370 bp, Zea mays
  misc_feature (1207)..(1207): n is a, c, g, or t
  misc_feature (1226)..(1226): n is a, c, g, or t
  misc_feature (1245)..(1245): n is a, c, g, or t
  misc_feature (1248)..(1248): n is a, c, g, or t
  misc_feature (1252)..(1252): n is a, c, g, or t
  misc_feature (1265)..(1265): n is a, c, g, or t
  misc_feature (1274)..(1274): n is a, c, g, or t
  misc_feature (1282)..(1282): n is a, c, g, or t
  misc_feature (1292)..(1292): n is a, c, g, or t
  misc_feature (1296)..(1296): n is a, c, g, or t
  misc_feature (1300)..(1300): n is a, c, g, or t
  misc_feature (1320)..(1320): n is a, c, g, or t
  misc_feature (1322)..(1322): n is a, c, g, or t
  misc_feature (1327)..(1327): n is a, c, g, or t
  misc_feature (1329)..(1329): n is a, c, g, or t
  misc_feature (1335)..(1335): n is a, c, g, or t
  misc_feature (1339)..(1340): n is a, c, g, or t
  misc_feature (1344)..(1345): n is a, c, g, or t
  misc_feature (1350)..(1351): n is a, c, g, or t
  misc_feature (1355)..(1355): n is a, c, g, or t
ctgtgcggcgctcgaggcggcggcccgccgggtaaaaaaccctaccacgtctcaaaaccctcgcgaatcgtcatttccgctctctgccacgccggagcccccactgcccaccacccgttcccgcggcctcgccctttgcgtggttgaagaagcgaaagatgctcggggcctctaggcgatccctcagtgccgccgccgccgcccgcagccgcgtggctgccggcgctgcctccgccgtctccgccgacgccgccgcctcaatcccgccccgacccgcgagcaatggagcgccaggggttcatcagcagcagaagaggctgctctcagtgcttgtagcgcccaaggttgcaggaaccagcaatgttgtgtccctcaagctgatgggtggtgcccttactgggagacgctatgaatcgagtgcggcagcagttgactccacggacccgccagctgagaagcatgagtaccaggctgaggtcaacaggctcatggatttgatcgtacacagcttgtatagtaacaaggaagttttccttcgagaactggtcagcaatgctagtgatgctcttgataagttgcgttacctgagtgttacggatcctgagcttctgaaggatggtccccaacttgatattcgcatccaaactgacaaggataatggaataataacaattactgattctgggattggtatgacgaaacaagagcttattgattctcttgggactattgcaagcagtggaactgccaagttcctgaaggcattgaaggagagtcaagaagcgggcatggacaacaacttgattggccaatttggtgttggtttctattccgcatttcttgtttcagagaaggttgttgtatcaacaaagagcccaaaatctgacaaacaatatgtttgggaaggacaagcagattctggttcttataccattagagaggaaaaagacccggagcagctcattcctaggggaactcgccttactctctatctcaagtgtgatgataagggttttgctcaccctgagaggattcaaaaacttctaaagacttactctcagtttgtttcctttcccatttacacatgggaagagaaaggcttcacaaaagaggtcgaggttgatgaagatccagccgacagcaacgaaaaaagtgatgattcagcggaaaccaaaactgagcctaaggaaacgacacacctgttatngagaagtatttggattggnagccttcaagtgagaaccnacnatgngtctcggaacctnaaagagttncactgagngtaccgtganttcnacgngaccccttcatgagtacttngnccttngncatcanacanntccnntcaannggtnaaatgacatcagtca

SEQ ID NO: 15074 - DNA, 4063 bp, Zea mays
  misc_feature (26)..(26): n is a, c, g, or t
  misc_feature (3491)..(3491): n is a, c, g, or t
gttgcttcatgacgagtagattttgngacctgggccactggttttgttaaatttcatgagttgggacatcttgggaatgtgtgtggacagaagccagtggaaaggatagaataggtagtttttagctgggagagagttctgcagaggacatggaaccttgaaaattttcaattatcttcattcaccatttaaatagtctgggtacaataacatgatctaaagagacaattatgacaaatctaactattgaaattgaatgggcatctaaggacaagtacttgctatcctctgcacgatattggaacaaggctttgtaccatgttttagtcaatttcttattttttgctttgcaatgtccatgcttactttttatgttttaggaaatttattattttcgtttttctgtgtccatgtattgccttttcttttcttttgtgcgtcctctcgccagtgtttaaggttttcatgtcactggaagaagcctattaagaagagaagtgcccctactttgcttacccagtcccagttggcatcaatatgaattattttataatgtagtcagtcaatttttatactagagagtgaatcttatgagatgggattagcttaactagctttataatatatttaaccttttttggtaggttctacttttggtcgaccctatggatgaattggctatccagaatctgagctcctacaaggataagaaatttgtggacattagcaaggaagatttggatttaggtatgctcataaatgtttcgtgaacctcttattaactactagtacttagatgtagctgtcttaattctggcaaggcttttattgatattgccatccatattgtcatatgcatattaaatgtgataaatgaaggattttgtcttgtatgcattacatgtccgtttgttggacatattatttcttcagaactgaggcaactaatcttttactttggtgatttatttttattgtttctgcttgttgtgatctctaaatgtactaggtgataacaatgaggaaagagagaaggagataaagcaggagttcagccaagcctgtgactggataaagaatcgcttgggtgacaaggttgcacgtgttgacatatctaatcgtctcaggtcatcgccatgtgttcttgttgcagcgaagtttggttggtcagccaatatggaaaggttagtgtctattaattgtgaatctttgatggtttctctgatagttggtacataactgtacaatccttgctgtttgttacaggctgatgagagcacagtctatgggtgatacagcctctttggatttcatgcgttcgaggaaagtttttgaaataaacccagagcatgagataatcaaggccttgaatgtaagttctcaacctgctgttgtctctttcactttcaaatatttaggctggtagaaaaggactggcctgatcggttgtgatttttgcttcagtgctgtaggctgctgctgtaagatagtattagcctttttagccagctagcattagcaaaagaaaaacttctggtgattaacagcttatgctgcttctacagacagaagttgcacttagatcagagaagtttgtactgctaaaaattgctttatgtattttttaatttttaagcattgtggtaattttgttattttagtccacaagcactttttttggttctaatgattttttttctcggaatgcaggtggcatgcaggaataaccctgatgatcctgaagccctaaaggctctggatgttctctttgaaactgctatgatttcaagtggcttttcggtgggtacagtgtcatgttaactttttgtgtttaagtttgattttgaaatatagagacagtagagcataacctgtccatgtgaaatgaaaccaagaatcagcataggaaatgtttacgaccatggatctatcagataggatgaggcaaaaaaattattttttaacataaaactaccacttcccagcattacaagtgaaagaaatatggtgtgcttaaaaaaagaaatttgaatgtgttagttttcttattgcattgatgttctacgattatcaattatacaagtgctggcagtttggcacctcccttcccttttacgtttctgttggcgattattgtttcacatgattttttggattgactaacaaaggccagcccctgcctaggggtggtaatggatctcgatccaaatgcttcttcttcacaatttcttagagcccaagtatttctagttaaaaaatgaatagaaatagagttcgatcctaatccgaccgatccttaaattttgtagtgtagaatttaaagcctgttgtgatgttcttgtggttatgaattgaacaactcattaataacatcttcgaggttagtttttgaaataaacccagagcatgagataatcaaggccttgaatgtggcatgcaggaataaccctgatgatcctgaagccctaaaggctctggatgttctctttgaaactgctatgatttcaagtggcttttcgcctgacaacccggcggagctcagtgggaagatttacgagatgatgacctctgccatcgctggcaaatggtcctcacagccacaggcgcaggcgcaacctgccgacccaatcccacagcacgacgcacctgtgaggtcagacgagccgcttgaagctcaagtggtggaggcagagcccgttgaggctggtcagcagaagtgagggcctgttcgtgcagaatctttgtacggagtagttttgaaccgttgtgcacaacatggctgagaatttcgagtatttgttttgacggcctgtatctgtgtcatgagctgttactggtaatgtaagacgtattggttagaaattaggagattaggaataatcgggtagctggactacttgaactggttcctgaaccatcaggagggttatggactcatggttagcttctactgcgtccttgggggcagtagtaattttgaagccaattcgttgttttgtaggctctatttctgtttggctttaatacatatcggtttctactgtttctgaagcgttttgtctctatctttgtaattggatgtctgggcgtgcatagccatgcttgcatgagcctatttcgttagatagtgtcaatttctatgtgtatctgtgataacaaaccaaacacaggccgagccatagtcaatacatgtaaagagtcttgctcttcatatgcggacaggccgagccatagtcaatacatgtaaagagtcttgctcttcatatgcggacaatcaaacacacggtatgaattgaattatacctacagcggttcaaacaaatgactttaatctaaagcaaatatcccataatgactttaatctaaagcaaatatcccatctgtttaccttgcttcggtccacctaacgtttttactattttcgttctagaatatttgtcgtttgttagttcatttttgaactaaaatgtgacaaataaaaaaaaggagtnagtattttatacactcccaaccaagcttagagttttatccaatgtaatatggtatctaactaggactctctcctacctccttcccacattccaaccattggcccctccacccttggccaccggccctctcacccttatcgttggtccctcccaccctacgtcgccgccaccatctttccctctcgcccctcttcctgttgcctccttggcctgtcttgccaccgctcatgggtgtagccttatcgtcgtcgatcctctcccacaggccactggggccaccccttttcctttatgtcggtttccccttcgaccatgggtacctcaactatcgtagacgtcacgggtgaactcggcataagcgccccgcttcttgccgttcctgggctcggcgcggatgtgatcctccatgacgtccttgtctccacatggccgtcgtcacagacctctccggcatggtctggctcgccgtcgtagccaactcatgcggaggtgtgctgacccccagcacgctcgacttcccgcgggggctagaaagaagccctctcccttggccgggcttccgtgaccccgcc

SEQ ID NO: 15075 - DNA, 1869 bp, Zea mays
tggatcccccgggctgcaggcattcggcacgagatccggcggaagcccaaaaaaaaggtgatgattcagcggaaaccaaaactgagcctaagaaaaagaccaaaactgttattgagaagtattgggattgggagctttcaaatgagacacaacctatttggcttcggaaccccaaagaggtttcaactgaggaatacaatgattttttcaagaaaaccttcaatgagtacttgggccctttggcatcatcacacttcactacagagggtgaggtagaatttaggtcaattctttttgttcctgctacaaggaaggaagatgtaactgctgatagtaggaagaccaagaatatcagactatatgttaagcgtgtattcatatcagatgactttgatggagaattgttcccaagatatttgagctttgtgaagggtgttgttgactcaaatgaccttccattgaatgtttctcgtgagattcttcaagaaagtcgaattgttcgtataatgagaaaaaggctggtgcggaaagcctttgatatgatacttggcatttcttgcagtgaaaatagagatgattatgaaaggttctgggagaactttggaaaatttttaaagctgggtgccatggaagataaggaaaatcacaagagaattgctcctttgttgcgcttcttctcttctcaaagcaacaatgaattaattagcttggatgaatatgtggaaaacatgaaacctgagcagaaggacatttacttcattgctgcagatagtatgagcagtgccataaatgctcctttcttagagagactaacagaaaaagactatgaggttctacttttggtcgaccctatggatgaattggctatccagaatctgagctcctacaaggataagaaatttgtggacattagcaaggaagatttggatttaggtgataacaatgaggaaagagagaaggagataaagcaggagttcagccaagcctgtgactggataaagaatcgcttgggtgacaaggttgcacgtgttgacatatctaatcgtctcaggtcatcgccatgtgttcttgttgcagcgaagtttggttggtcagccaatatggaaaggctgatgagagcacagtctatgggtgatacagcctctttggatttcatgcgttcgaggaaagtttttgaaataaacccagagcatgagataatcaaggccttgaatgtggcatgcaggaataaccctgatgatcctgaagccctaaaggctctggatgttctctttgaaactgctatgatttcaagtggcttttcgcctgacaacccggcggagctcagtgggaagatttacgagatgatgacctctgccatcgctggcaaatggtcctcacagccacaggcgcaggcgcaacctgccgacccaatcccacagcacgacgcacctgtgaggtcagacgagccgcttgaagctcaagtggtggaggcagagcccgttgaggctggtcagcagaagtgagggcctgttcgtgcagaatctttgtacggagtagttttgaaccgttgtgcacaacatggctgagaatttcgagtatttgttttgacggcctgtatctgtgtcatgagctgttactggtaatgtaagacgtattggttagaaattaggagattaggaataatcgggtagctggactacttgaactggttcctgaaccatcaggagggttatggactcatggttagcttctactgcgtccttgggggcagtagtaattttgaagccaattcgttgttttgtaggccctgctgcccgggggctccaatacatatcggtttctactgtttctacaaaaaaaaaaaaaaaaaaactcgagacctcgtgc

SEQ ID NO: 15076 - DNA, 1226 bp, Zea mays
  misc_feature (68)..(68): n is a, c, g, or t
  misc_feature (144)..(144): n is a, c, g, or t
cccagcgtccgtgcgcttcttctcttctcaaagcaacgatgaattaatcagcttggacgaatatgtgngaaaacatgaaacctgagcagaaggatatttacttcattgctgcagacagcctgagcagtgccaaaaaaccccttntcttagagagactaacagaaaaagagtatgaggttctacttttcgttgaccctatggatgaaatggctatccagaatctgagctcctacaaggataagaaatttgtggacattagcagggaagatctggacttaggtgatagcaatgaggaaagagaggagataaagcagcagttcagccaaacctgtgattggataaagaatcgcttgggtgacaaggttgcacgtgttgacatatctaatcgtctgaggtcatcgccatgtgttcttgttgcagcgaagtttggttggtcagccaatatggaaaggctaatgagagcacagactatgggtgatacaaccactttggatttcatgcggtcaaggaaggtttttgaaataaatccagaacatgagataatcaaggccttgaatgcggcatgcaggaataaccccgatgatcctgaagccctaaaggctctggatgttctctttgaaactgctatgatttcaagtggcttgtcgcctgacaaccccgccgagctcagcgggaagatctacgagatgataaccactgccatcgcaggcaagtggtcctcacagtcgcaggcgcaacctgacaacacaactctgcagcacgcggcacctgggaggtcggatgagccgcttgaaggtgaagtggtggagccagagcccgttgaggctgatcagcataagtaaggggaaccccctttcgctttctcgtgctagctttgaaccgttgtgcacgtggcggagaattttgagtatttgttttgacggcctttagctttatcatgagctgtgacggacctaatgtttagaatttagaagattagggataagtggcggttgaactacttgaactggttatgtgatcctaggatcgtctctggactcattgtagattaattataacagttagaagcgcaggtgaggtgtctatcacggacacccaaacgcatcagagttgctaaatttggagctgaggcctgcggtgaatgagatcgtctcttttgtctcgacttcagaagggaaagatggcggccgccccccgaaagatccaaggcttaacggtaacggcgt

SEQ ID NO: 15077 - DNA, 1869 bp, Zea mays
atcgctacccagaaccctagccccctccaaaaacccttgtggcatcgtcatctccattgtccactcgctgccccgcccgagcccccgcttgtttccgcggcctcgccatttgcgtggttgaagaagcgaaagatgctcggcgcctctaggcgatccctcagtgccgccgcccgcagccgcgtggctgccggcgtagcctccgccgtcaccgccgacgcctcagtgccggcccgccccataagtgtagccatcctttttgctttctttattgatggcggttagccatgttaggtgagcaatggagcccgtggggttcctcagcagcagaataggttgctctcagtgcttgtggcacccaagattgcaggaatgagcaatgttgtggccctcaagctgatggatggtgcccttattggtagacgctatgaatcgagtgcagcagcagttgattctacggaccagctagctgagaagcacgagtaccaggctgaggtcaacaggctcatggatttgattgtgcacagcttgtatagtaacaaggaagttttccttcgagaactggtcagcaatgctagtgatgcacttgataagttgcgttatctgagtgtcacggaccctgagcttctgaaggatggtccccaacttgacattcgcattcaatcagacaaggataatggagtaataacaattactgattctgggattggtatgacgaaacaagagcttattgattctcttgggactattgcaagcagtggaactgccaagttcctgaaggcattgaaggagagtcaagaagcgggcatggacaacaacttgattggccaatttggtgttggtttctattccgcatttcttgtttcagagaaggttgttgtatcaacaaagagcccaaaatctgacaaacaatatgtttgggaaggacaagcagattctggttcttataccattagagaggaaaaagacccggagcagctcattcctaggggaactcgccttactctctatctcaagtgtgatgataagggttttgctcaccctgagaggattcaaaaacttctaaagacttactctcagtttgtttcctttcccatttacacatgggaagagaaaggcttcacaaaagaggtcgaggttgatgaagatccagcggaagccaaaaaaggggatgatgatatcaaaactgagcctaagaaaaagaccaaaaccgttgttgagaagtattgggattgggagctttcaaatgagacacaacctatttggcttcgaaaccctaaagaggtttcaactgaggagtacaatgaattttacaagaaaaccttcaatgagtacttgaatcctttggcctcctcacacttcactacagagggtgaggtagaatttaggtcaattctttatgttcctgctacaaggaaggatgatataactgataataggaagaccaagaatatcagactatatgttaaacgtgtattcatatcggatgactttgatggagaattgttcccaagatatttgagctttgtgaagggtgttgttgactcaaatgaccttccgttgaatgtttctcgtgagattcttcaagaaagtcgaattgttcgtataatgagaaagaggctagtgcggaaagccttcgatatgatacttggcatttcttgcagtgaaaaaaaaaaaaaaaatcaaaggttctgcgagaactttggaaaatttttaaagctgggcgccacggaagacaaggaaacctacacctacaattgctcctttgttgcgcttcttctcttctcaaagcaacactgaattaattagcttggacgaatctgtggaaaacatctatcctgctgagaaggacatttactttattgctgcaga

SEQ ID NO: 15078 - DNA, 1580 bp, Zea mays
gcacgagaccattacctagaacatcctaatcgaaaagaaaacggcgatgttggccgtcccattttgtaagctccccttccccgtctggccgtctcgactgccccagtcctttctcagatccatgtctacccagaatctgctaactggcgcgtgcacgagctccgccccgaccccgtccgaggcggaggaaggggacaggacgcctttggctgacgctgcgaacgcggcggaagagctgtaccgcctccgtgacacctttttcccgcgggacccttccgagaaagtcgccgcactccgcgcccgcgccgacgccgccctcgcgctcctcgacgccttcccgtccgaacaaaagaagtctcgacaactgcgtggtgtttatgaatttttgaggggaaaaatactggatgtctttcctgattatcataaggaggctgaagatcatttatccaaagcagtaaagttgaacccatctcttgtagatgcatggttatgtttgggtaactgcatttggaagaagggggatctatctgcagcaaagaattgtttttcattagcactaagcaagggttcaaataagaaaatactgtgccagatctccatgcttgaaagaagtatggctcaaggtagtgtagaccaggcgcttttagtagaagagagcattaagcatgcaaaagaagctattatgctggacattagagatggcaattcttggtataatatgggcaatgcttatctcactagcttctttgtgggaggagcctgggatcacactaagcttcatcattcagtgaaagcatatcaaaatgctgagaaggataaaactatgaatttaaatccagacctctactataattgggccacaggacaattacgatccaaaagattagcatcatttgtgtcatccttgagtggagtcaaattgaaatcatcgcacaagaaagccaccataagcactctatcagtgggtttgaacaaagccgttgctgttttgggaaaagtaattctgttcataagacatgacaatgttgctccgctgtattatttaatatgtgacttggaacggtcttattttatactgtcagtgtatgggctacataatgatgcaattaaagacggtgatcaagtggtattatttgaaccatactaccgaatccttgatgtatcatgtaaagacaagcactatcagttcaaatcaatacgagtggactttccagaacaaattctagttaacgagagagttccagcacctcatcatgttgcacaggcatcaatccatgcacacaacaaatcttgaccggtgaaaatttggtattgtgatttagttggtagccagtacttattttgtttttgatgtttattagacttattacaggaaaaccattctgcaagtttttatcagggtactgtgtggcgtcaataccgtgagcaactgccagctgggcgtatcatgtgtactcgtgtaaatgtgtagtgacatgttaccctatggctcaaaatgtgtaaggaagacttgggaacatattaaccatctcatttctccaattttcgttagttgttttcaaaaaaaaaaaacggtggag

SEQ ID NO: 15079 - DNA, 1707 bp, Zea mays
attgggtacctcgaggccggccgggatgccagtccttagctacgcccatggagtagagaaaaagtgaaaacggcgatgttggccgtcccattttgtaagctccccttccccgtctggccgtctcgactgccccagtcctttctcagatccatgtctacccagaatctgctaactggcgcgtgcacgagctccgccccggccccgtccgaggcggaggaaggggacaggacgcctttggctgacgctgcgaacgcggcggaagagctgtaccgcctccgtgacacctttttcccccgggacccttccgagaaagtcgccgcactccgcgcccgcgccgacgccgccctcgcgctcctcgacgccttcccgtccgaacaaaagaagtctcgacaactgcgtggtgtttatgaatttttgaggggaaaaatactggatgtctttcctgattatcataaggaggctgaagatcatttatccaaagcagtaaagttgaacccatctcttgtagatgcatggttatgtttgggtaactgcatttggaagaagggggatctatctgcagcaaagaattgtttttcattagcactaagcaagggttcagataagaaaatactgtgccagatctccatgcttgaaagaagtatggctcaaggtagtgtagaccaggcgcttttagtagaagagagcattaagcatgcaaaagaagctattatgctggatattagagatggcaattcttggtataatatgggcaatgcttatctcactagcttctttgtgggaggagcctgggatcacactaagcttcatcattcagtgaaagcatatcaaaatgctgagaaggataaaactatgaatttaaatccagacctctactataattgggccacagcagacaaatatttagagaattatgaaagggcccttcgtggttttgaagttgcagctttaaaagatcccgggcttggtgctaatacagaagttcagaagatcatcagtctccttgataagcttgataatgcaatgaagggacaattacgatccaaaagattagcatcatttgtgtcatccttgagtggagtcaaattgaaatcatcgcacaagaaagccaccataagcactctatcagtgggtttgaacaaagccgttgctgttttgggaaaagtaattctgttcataagacatgacaatgttgctccgctgtattatttaatatgtgacttggaacggtcatattttatactgtcagtgtatgggctacataatgatgcaattaaagacggtgatcaagtggtattatttgaaccatactaccgaatccttgatgcatcatgtaaagacaagcactatcagttcaaatcaatacgagtggactttccagaacaaattctagttaacgagagagttccagcacctcatcatgttgcacgggcatcaatccatgcacacaacaaatcttgaccggtgaaaatttggtattgtgatttagttggtagccagtacttattttgtttttgatgtttattagacttattacaggaaaaccattctgcaagtttttatcagggtactgtgtggcgtcaataccgtgagcaactgccagctgggcatatcatgtgtactcgcgtaaatgtgtagtgacatgttaccctatggctcaaaatgtgtaaggaagacttgggaacatattaaccatctcatttctcc

SEQ ID NO: 15080 - DNA, 1955 bp, Zea mays
caaactagaccgactatcaagtcagtttcacaaaatgagcaggaacttcccaactcccagatcaaactacacctgatacctccagagcgcatggctgtaaaacaaccagaggtcagctgagttcagaaggcagacacaggtgagcaaccaacgatgaccattgcccttgctcacccgaccacatgctgatgctgctataaacattccgcgccgccggcccggccgggacaggcatcgcccaagagcaaaacatctctaatacacccaaagcaaatacgcacgcagtgatagccatggctcgtggcggatctggttgccgtcttctcgccctgctcctagtcttgactgccttcaatggcagctttgcagctcgacatctcttggacacagcagctgcgccagaggccacgcctgctcagccgtccattccagcggttccaaccaaactgcctccagtgccgaccataccagcggttccaaccacgctgacgctgcctccaatgccttccattccggcggtccccaagatgacaatcccaccaatcccgtccattcctatcccaaagctagccctgccaccaacagctgctggcgcgatcccatctctcccaaacccggtgattccaaccaccgtaccagctatttctgcagtcccggttaccctgccaccaatgccctcgattcccactaccatgccatccattccaactacgattccaacaacaatccctaccattcccggactccaggtgcctccattcactgccccatccccacaaaccaccagcccttgaagttcgatgtagcaggagacttttctttacatgctgttagtcaggagtttggctcatcgtatatggtcgttttcagtgtgtgtgccatgtttgttctgctattttgatgatactggctagcatgtggtgtgcttgtgattgcagccagtctattgtaccactttgttttgctgttattgaagtattacttggtctttatacattactgagccaaatgagattcctacattattcttgtccagtaacactattggcagcatgatgttcctagtgcatataccaaagctaaaaaataccaattcccctgtgtggaatgatctcctcaaaattaaatatatctatctaaaaggaaggggaatgatagagggtaacggaagcaatactgactttggtctgagacttgtggcaacgtgtccctgaaggacaatttccagtcttgttcagtatttgcaatgaacaagaatgttctgcacagtaaatccatagtaagtgatgcacttgaccttaagactatggtttgattaagagttacaaccagcaactaacaagattgcatgacatagggggtgtttgtttgggattataatctacccagattatataatccttattttggacagcttataatcctaaacaaagaaagtcaaacatgtgaatccggtgaactggtagcaaactgtaaacaaagaaagccaactggtagcaaactgtaaacaaagaaagcaaaaggtaaaaccagaacaatccggtgaagccaaaaaccactacaaaaagtcaaacatgtgaatggactattgactatatgtcagtttagttattcttagaaatcttacctatctggcccgtttttttttaaaaaaaatccctttttcctctccatggagtttcccatcacaagcatagattacgcagtttcagcaacgtcaaagcacacagagtttcctgctgaggagagcgagatagagctcccaaatggaagctttcctttccgctgtcctgggtgagctgacgagtcgatccataaatttcatcatcaacaagtgctcgaagccacctgcaatggctgtggaggaaagcctgcaaagggctcttcttcaggcacgggccatcatcgaggaggcagtgggacgtcgcatcacaaaccaagccatgatccagcag

SEQ ID NO: 15081 - DNA, 1638 bp, Zea mays
aaatccgcggcacggacggagagacggctgcaccgccccacacccacccttttccgcgcccgcgaagaaaacgaaggcagtggaacccgaagcggaggggccagaaagcgacccgaccgtctctccgctccctccctcccccacaccacccacctgtgatctcccgcgcgggagatccgcccgccccatggcgccgtcgcgcccgctcatgcgggggatccgcccgccgcgcgtcttcccgacccgcggcggccgcgcctcgccgtacgctgtcgccctcacggccctgctcctcgtctccgccgccctcctcgcgctcatcgccttcggcgtcttctcgctccccgtgtcagcgccgaacgccgccgccaccaccacagccggaggggagaccgaatccgccgacacccgccccgcgcgcccccgcgcccgccgggacctgggggaggggctgggagagcgcggcgcgcagtggaccgaggtcatctcgtgggagccaagggcattcgtctaccacaacttcctgtctaaggaagagtgtgaatacctaattggattggccaagcctcacatggtaaaatcaacagttgtcgacagcactactggtaaaagcaaggacagcagggtccggacaagttcgggcatgtttcttcaaagaggaagggacaaggttattcgagtaattgaaaagaggattgcagactataccttcatacctgtagatcatggagagggactccaagtactgcattatgaagtcgggcagaagtatgagcctcactttgattattttcttgatgagtttaacaccaagaatggtggtcagaggatggctactcttctgatgtatctatcagatgttgaagaagggggcgagactattttccctgatgcaaatgtgaacgtcagttctttaccatggtacaatgagctttcagagtgtgccaagagaggcctttctgtcaaaccaaagatgggagatgcacttcttttctggagcatgaaaccagatgccaccctggacccattaagtttgcatgggggttgtcctgtgattagaggaaataaatggtcgtcaaccaagtggatgcatatccacgagtacaaagcttgagccttcaagactcgagagtcgagcgtaccaaagatggatctctatgcatgtgacttggggctgtctactgggttgacacccatgtatgctttacagacccactgaagctgtattctttgctcctttgttggaggggggagaattgcagataataggggccaataagcaggggccttgctcatccctgcagtatttttgggtctgatccttgctgacttggcttttgtcttttcttttctttttcttaccttgccgtaccccagctatagaggaatggtgtagtgtctgggggcatagagtttgagattttgttttgtgccacacctgtgttactagtataagctttggtactaatgaataacgaggcctaagctcacatctactacatgaatggtgtaatattgttgaagatagaaagcatctaatgttcggtggttttggttaaaaaaaaaaaaaatacgtcgacacttgtccgcgtccaaaagtgtgctttgagagataatagagctcacatctagttataa

SEQ ID NO: 15082 - DNA, 1450 bp, Zea mays
atttccattttccagcgcgcacggacgactgttacctcccccgcccttcgccactccgctccctcctccacctgtcatctcccgcgcgggagacctgcccgctccatggcgccgtcgcgaccgctcatgcgggggatccgcccgccgcgcgtcttcccgacccgcggcggccgcgcctcgccgtacaccgtcgcgctcaccgcgctacttctcgtctccgccgccctcctcgcgctcatagccttcggcgtcttctcgctccccgtgtccgcgccaaatgctgccgccaccaccggcactgcagccggaggggagaccgagtcggccgacgtccgcccccgcgcccgccgcgacctgggggaggggctgggagagcgcggtgcgcagtggaccgaggtcatctcgtgggagcccagggcatttgtctaccacaacttcctctctaaggatgagtgtgaatacctaattggattggccaagcctcacatggtaaaatcaacagttgtcgacagcactaccggcaaaagcaaggacagcagggtccggacaagttcaggcatgtttcttcaaagaggaagagacaaggttattcgagcaattgaaaagaggatagcagactataccttcatacccgtagatcatggtgagggactccaagtgctgcattatgaagtcgggcagaagtatgagcctcactttgattattttcttgatgagtttaacacaaagaatggtggtcagaggatagctactcttctgatgtatctatcagatgttgaagaagggggcgagactattttccctgatgcaaatgtgaacgccagttctttaccatggtacaatgagcttttcagattgtgccaaaagaggcctttctgtcaaaccaaagatgggagatgcgcttcttttctggagcatgaaaccagatgccactttggacccattaagcttgcatgggggttgtcctgtgattaaaggaaataaatggtcatcaaccaagtggatgcacatccatgagtacaaagcttgaggcttggcgaatcaaatatatgctgttgaattgggtttgtaagatggatctttatgcatgtgacttagggatttctacgggattgacactcatgtatgctttacagacccactggagctgtattctttgcttctttgttggaggggagataatagggataagcaggggccttgctcgtccttgcagtttttttttttttttggctgatccttgctgacttggctttttttcacttttctttttcttccttgcagtaccccaactatagaggagttgtgtagtgcctatagagtttgagattttgtttttgtgtcatgcccctaatattagtacatgaatgttgtgttactatgatacttgtaagctttggtactaatgaatagtgaggtctagagctcaacattaaaaaaaaaaaaaaaa

SEQ ID NO: 15083 - DNA, 1091 bp, Zea mays
gtcagctcttgcgagaagcacccaaattggagtactgtgaagtctgaaccggctggcctggccgttgctgagggagaggataaaagaacaccgaaatgccactcctgctgctcccaccaccggcgtgcaccacggcagcgacgtcgctcgctttcttgcggccccggccttcgcgggcgcgttgggccaacctctcttacgcgttcccccgcctgaggaaatacgggcgtcgccaccgcgagcccgtggccggccccagcctcgatgatgatggcggcgaggaggatgagacggaggcagaggactgggagtccgacgagggcgaggaagagatggaggtagacgaggaggagtttctggcgatgcggcccaaaccggcgggatttggcgaggggaaaacatattccactgacattgaggagcagcttctccgggagatgggctttggtgggggcgcggcgcggcgaggagaggcggccccggccaatcgccgcgccggggatagttccaccaaagtagctgccgcagatgtcagtgccgatggtgttcaagttcgtgtttggaacctcccaaaaaagaaaaacatacacaaggacctgaagcaagcttttaaagggtttcatggccttttatccattgatccagcagtttccgcaaataagaaaacccgtgatcctatttgtaagggttttgcatatctcaaactagagtctgctgaggctgcaacaaggttcgtggagatatactctcatcaaactgtgtcatttggcaagattcagaagccaatcagttgcggtatcatcgataaacgcagctctgttgagcattcaaataagcatccagtagtcaggcaatccctcaattaatgtccaagcaccaaaacttggtagcggcaagttgagtaacacatatctgtcatctagcacaagtaatcacgcacttctagggatctcaagttttacgaaaaagctttgataaacagatagattagacagttctctgtattccaaataactgtttgtatcaagcaatttggtagtttggtcttgtttttttagggaagcaaaaaaaaaaaaaaaaaacggcacgag

SEQ ID NO: 15084 - DNA, 1887 bp, Zea mays
cgctatattgggatagagtccagcacccagtcctccactgcgggcagcctaatgcccaaatccaatttgcaggtcctgtattccaagaagtttaccttgtgctaccatttattaatatcttagttgctgtggtgtagtggttatcacgtcagtcttacacactgaaggtctccagttcgatcctgggcagcaacattttttttactttcctccacaactctgccaggcctccgtcgcacgcgaggagaagcaagccttcgaacccaggttaatctaaaaaaagatgcagatttttacaaggcccatgagcctctgcaagttgcgtggcccatttgctgtcctccgcactccgcggccaattcctccttttttttcttttctctccggaagaaacaaagccggcgcgctcttcttgtcgagaccagaccaccgtatactggagagaaagaatcctccctcgcctccccaccccgccccacccatggcctccgccgccagcactgccgccgccgccggggccccgctgcgcctcctctcatcctcttccaaccgtatctccaagcccttccttccccgcccccaccgcctcaccctctcctcccccatctccttccagcgcctcacagcccggtccgcggcctccccttccccatccaccgccacctcgtccccgtccggctctgtcgacccggcgcaactgccccccgcgctacgcgacatcgtcggcctcttccagtccgtcccggacgcgcgcacccggtacaagcagctccttgcctatgccgcgcgcctgccgcccatggacccggcgctcaagaccgacgccaaccgcgtccggggttgcgtctcacaggtctgggtccacgccgagcccgacgagggcgacgccggccgccgcagcgtcaggttccacgccgactccgacgcgcagctcaccaagggcctcgccgcgctgctcgtgctagggctctctggcgcgcccgccgcggatgtggccagggtgcccgttgacttcatcgagctgctcgggatcaggcagagcctctctccctccaggaacagcggcctgctcaacatgctcagcctcatgaagcgcaaggcacttgagatcgccggtggtgactcaacgtcaagtcagcaatctgtccaagaggttaccagaccgcgtctagtgaacgggaaagagcctgaatttgcagctttcgaggtgcaagaaaaggaaaaggaaaggccacaggatgcagagaggcgcgacgaggatgaacaattgggtcaacttctaccacttgatgcagaagtgaatggtgctgcgggcggtgggaggaaggagaggataagggagagtttggagagggcactttctccggtagagttggagattgaagacatatcacacctccacaagggccatgctggcgtggctgggaccaatggggagacacatttcaatgtgagggtggtgtccaaggagtttgaggggaagagcttgctcaagaggcacagggctgtctatgatctcctgcaggaggagctcaagaccgggttgcacgccctgtcaatcgatgcaaagactccatctgaagtttggttctagcgtgccttgcgtggtgggtgtcccgatggtgcctagcgtacctgacgacgaagaaaggtcgaatatccctcaaaagaggaaatccatgttttgcattgcactggatccatttattaagcgaattttgatttatatatttgaaaacaagtgaaaaaatacccaaagtaaataagttcgaacatggtaacccacatgtttcttgtatgctacaatattggcctcatggtccaatctggtagacatccaaaactagttcaaatgagcctgactgcttattgattcttgcgaaaaaa

SEQ ID NO: 15085 - DNA, 577 bp, Zea mays
ccccgcctccgctcccatatgaatcaggggatccacttcggccgcacccatcgcaccaaaccaccgaacaaccttgccttcgagagaaaccaagagtgcgggaggaggcgcatccacagaatccggtgctcgatggcgtagcgctccagcgaagagaactgagggagtattggtctaggctgcgcgtccgcaaaacagaacctagtatcgagggtggctagagcatggggaatcgctcgcgggacttgctctcgcctttgtggaatccagccgccacggccaggcccactcgctgcacaatccctgacgagcaagcaactgcggacccagtactcagcagatggataatactgagcaggagctcgttgaaggtgaagagcaggtagcccaggaggaggtctacaacgagtacgagctaatctaggtggcgtctcctagtcagcgttatggcgccaaggaataattattagttcgctttattgttatcatttattcatgtaagacattttcgcaatgtaataatttttgtgacatttatctctatacatttggtcattacaaaaaaaaaaaaaaaata

SEQ ID NO: 15086 - DNA, 1711 bp, Zea mays
cattgggtacctcgaggccggccggggtgccgccgtcccgccccgcggaatcttctcgcctcgcctcgtctcctctgttctccagttctctcatagtcactcccccaactctgctgcttcccgtggccgtggttcaaaattcgaatccagaaagacttccccaagcattttccgtttctttaaaccgtcatcgtcctccctcgtgctagcctcgctcgttgcgcgttcaaatttcgaaccacctccgccttcgacgccccaaaccctagcccgacccctcctcctccacctgcgccaccgcccaccatgagctccgccgccgcgccagctgccgtcggcagcggcaaggagcttgccaacccgcccgccgacggaatcaccaacctccgcttctccaaccacagcaacaacctcctcgtctcctcatgggacaagacggtgcggctctacgacgccgacgccaacgtgctcaagggggagttcatgcaccccggggccgtcctcgactgctgcttccacgacgactcctcgggctttagcgccggtgccgaccacaccgtgcggaggttggtatttagctcgtccaaggaagatgttttggggcggcatgatggtccggttcgttgcgtggaatactcttatgctgcaggtcaagtcatcaccggcagctgggataaaactgtaaaatgctgggatccaagaggagttagtggaccagagcgcacccttgttgggacatatgctcaacctgaacgtgtatattctctttcgttagtaggaaataggttggttgttgcaacagctggaagacatgtaaatatttatgatctgcgcaatatgtctcaacctgagcaaaaaagagactcttctttgaaatatcaaacacgatgtgttcgatgttttcccaacggaacaggatatgctcttagttctgttgaagggcgagtttctatggaattctttgatctatctgagtctgctcaatctaaaaagtatgctttcaagtgtcatcggaagtctgaggccggcagggacaccgtttatcctgtcaatgcaattgctttccatcccatatatggaacatttgccaccggagggtgtgatggatttgtgaatgtgtgggatggcattaacaagaaaagactatatcagtactcgaagtacgcatcaagcatcgctgctctatcattcagtaaggatgggcatctgcttgctgtggcatccagctacacttatgaagagggagaaaaaacgcatgaacctgacgctatatttatccggacagtgaatgaagtcgaggtgaagccgaagcccaaggcattggcagccccccagtagtgctgtgacctgttctggaggctagatgacccgtacttctctgcgttgatgtcaattacattagttgacggagtgcttgtttgtgttgaaagagctgaaacgcctgtgtttcttaatctggaaccctcttctcccgttttacttgtccgtggaaacatttcatgttccagctggttgtatattccgaaacagaccatgtttaagttcactcggttcttcgttgacttaagttatttatcaaatatttaagtatcgtacgtaagtttgaaacctggggggaagaactatgctggctttgttgtactgccaatttcaatttaggaaggatgaaattgaagttagaaaacatccaaaaagctcatctacaagaaaa

SEQ ID NO: 15087 - DNA, 2446 bp, Zea mays
ggcaaacatcgaaaatatatttatggtctctagacttgctcccgatttcccctcccccttgtccgccgcatcctggttcggattcgccgtcgcgctagggcaaacaggaaaggaagatggcggctgcggcggccgccagcatggtggtggtgcgggaggtcctgggcctcgacgtcgtcgacgaggtggaccagcccatcatcgactacatcgccaacgtcctcgccgacgaggacttcgacttcggggccccggaagggcacggcatcttcgaagcgctcggggagctcctcatcgactctgggtgcgtctctgaccaggagcactgccttcaggtctgcagtaagctttgtgaaaagtttggaaagcatggtctggtgaaaccgaaacaagctatgcgcagccttgtcacaccattacgaatgaatgcggggatggacgatgatgtcgctcccaaaaagccgcagcctgaagtattcgatggaccactgctgtcttcgcgcgataaagccaagattgaacggagaaaaagaaaagaggagaggcaaagagaggttcaatatcaaatgcatgttgcggagatggagacacttagggctggaatgcctcctgtttatgtaaaccacagtaatgatggtgggccagctgttagggatatacatatggagaacttcagtgtcactgttggtggtcgtgatctaattcaagaagccactataacacttgcttttgggaggcactatggacttgttggaagaaacgggactgggaagacatcttttctcagagcgatggcattgcatgcaattgatggtattcctaagaactgccagatattgcatgttgagcaagaggtcgtgggtgacgatacgacagctttgcagtgtgttctgaacgccgatgtcgaacgagttcaacttttgcaggaagaagctcgtcttgttcaacaacagaaagatttagagattgaggctgagtttgggcagagctccgacaagggcaaggatggttttgacaaagattctatcagcaagaggcttgaggagatatataaacggcttgagctcattgatgcggatgcagcagaggctcgcgcagcatcaattttggcgggtcttagttttactccagaaatgcaacgcaagcgtacaaaacaattttctggtggatggcgcatgagaatagctctagcccgtgctctgtttattgagcctgatttgctactacttgatgagccgacaaaccatcttgatcttcatgctgtgttatggctagaaacttatctcctgaagtggccaaagacattcattgttgtatcacacgcaagggagtttttgaatacggttgtcaccgatatccttcatctgcatggtagaaaactacatgcttacaaaggtgactatgacacatttgagaggacaagggaagagcaccttaagaatcagcagaaagcctttgaaacaaatgagaaggccagacagcacatgcagacattcattgacaagtttcggtacaatgcaaagagagcatcacttgttcaatcaagaatcaaggcattggagcgaatggaacatgttgatgcagttgtcagcgatccagactataaatttgaatttccaaccccagatgaccgccctgggccaccaatcatcagcttcagtgatgcctcatttggttaccctggagggcctaccttgtttaaaaatttgaattttggtatcgacctggacagccgcatagcaatggttggtcctaatggcattggcaagtccactatactgaaactaatttctggggatctgcagccaacttctggaacagtatttcgctctcccaaggttcgcatggctgtattcaatcagcatcatgttgatggccttgatttgacggtgaatccccttttgtacatgatgaagtgctatccgggtgtgccggagcagaagttgagggcacatctgggttcgtttggtgtttcgggaagccttgccctccaatctatgtacactttatcaggtggtcagaagagtagggttgcattcgcgaaaataaccttcaagaagccgcacatcattctccttgacgagccttctaaccatcttgatctggacgctgttgaggcgctcatccagggtttactcatttttcagggaggggtgctgatggtgagtcacgatgagcatcttatcactggaagcgtggacgagctttgggtggtgtcggaaggcagggtgaccccgttctcgggcactttcaaggactacaagaagatgctcaagtaacaaaaacatgtattatcgaccatagcctatatatctatatgcttgctattatgttgtattaccgtataaattttgggagtaaagcatcgaaattattataacacatacctaatgccgaaaggagaagatttctcacatttttagttcgaaaaaaaaaaaaaaaaaaa

SEQ ID NO: 15088 - DNA, 850 bp, Zea mays
gccggccggtccgggaattctgagccagacaatcaaaagctaccccctatccgatccaaccctctctggctgctcctccgtccggccggcatcggcagtgcaggatggctctgaggatgtgggcgagctcagccgccaatgcgctcaagctctcggcgggcggcggcggagcccgggctgctgctgccggcccggccttctctatctccaggttcttctccactgttcacgatgggttgaagtacactcagtctcacgaatgggtcaagacgacgggcgacgtcgccaccgttggcatcacggaccatgctcagggccacctgggagaggtggtgttcgtggagctgccggaacccggcacgaaggtcgccgcgggaggacccttcggcaacgtggagagtgtcaaggccaccagcgacgtcaactccccgatctccggcgaggtcgtcgaggtcaatgccaaactgtcagagacgcccggcctgatcaacacgagcccgtacgaggacgggtggatgatcaaggtgaagccgagcagcccgggggaggcggacgccctgctggacgccgccaagtacaccaagcactgcgaggaggaagacgctcactagacccaggcccggcccagccagcaagcgtggatgcttaccgcgacagcgcgcgtttggtggtgttgatccgctcagtctctctttgttgcaaaaactccaccaagcagcccgccatagccaagaaggccacactcacctttatcatctcacgccttccgtttttctttttttttttggtgtgtggtactacctttttttttaagaaaagaagtggttctgaaaaaaaaaaaaaaaacccc

SEQ ID NO: 15089 - DNA, 847 bp, Zea mays
ttggccggccgggcccgggacttctcgagccagacaatcaaaagctaccccctatccgatccaaccctttctggctgctcctccgtccggccggcatcggcagtgcaggatggctctgaggatgtgggcgagctcagccgccaatgcgctcaagctctcggcgggcggcgccggagcccgggctgctgccttctctatctccaggttcttctccactgttcacgatgggttgaagtacactcagtctcacgaatgggtcaagacgacgggcgacgtcgccaccgttggcatcacggaccatgctcagggccacctgggagaggtggtgttcgtggagctgccggaacccggcacgaaggtggccgcgggaggacccttcggcaacgtggagagcgtgaaggccaccagcgacgtcaactccccgatctccggcgaggtcgtcgaggtcaatgccaaactgtcagagacgcccggcctgatcaacacgagcccgtacgaggacgggtggatgatcaaagtgaagccgagcagcccgggggaggcggacgccctgctggacgccgccaagtacaccaagcactgcgaggaggaagacgctcactagacccaggcccagccagcaagcgtggatgcttacaacgacagcgcgcgtttggtggtgttgatcctccgctcagtctctctttgttgcaaaaactccaccaagcagtccgccatagccaagaaggccacactcacctttatcatccatgccttccgtttttttttggtgtgtgctactaccttttttttaaaagaaaagaagtggttctgaaaaaaaaaaaaaaaaaaaaacccccccccggcc

SEQ ID NO: 15090 - DNA, 878 bp, Zea mays
gggggcacacccccaccatagaaacatatccccccgcccgctccggggtttctgaatgctgagccagacaatcaaaagctaccccctatccgatccaacccgctggctgctcctccgtccggccggcatcggcagtgcaggatggctctgaggatgtgggcgagctcagccgccaatgcgctcaagctctcggcgggcggcgccggagcccgggctgctgccttctctatctccaggttcttctccactgttcacgatgggttgaagtacactcagtctcacgaatgggtcaagacgacgggcgacgtcgccaccgttggcatcacggaccatgctcagggccacctgggagaggtggtgttcgtggagctgccggaacccggcacgaaggtggccgcgggaggatccttcggcaacgtggagagtgtcaaggccaccagcgacgtcaactccccgatctccggcgaggtcgtcgaggtcaatgccaaactgtcagagacgcccggcctgatcaacacgagcccgtacgaggacgggtggatgatcaaggtgaagccgagcagcccggggggaggcggacgccctgctggacgccgccaagtacaccaagcattgcgaggaggaagacgctcactagacccaggcccgcccagccagcaagcgtggatgcttaccacgacagtgcgcgtttggtggtgttgatccgctcagtctttctttattgttgcaaaaactccaccaagcagtccgccaatgccggcgtacctgatgccttccgttttctttgtgctggtaccttatttttttttataaagaaaagaagtggtgctgaatatcaaaaaaaaaaagagcccaccccctaaaaaaaaaggccccta

SEQ ID NO: 15091 - DNA, 2593 bp, Zea mays
ccgggtccgctccactcctaaacccagaacccagcccgccgcaaccctagccgccgccgccgcgcgccgccggcaccacaccactgccgtcgccacccccatggccgcgccgtcagaggacgcgttgcggcgcgcgctcgcggctcgcaaggctgctgtggacgcgcaagccgaggccgtgcgcgcgctcaaggccggcggcggcgcgtccaaggccgacgtggacgctgcggtcgaggcgctgaaggcgcttaaggttgaggccggcgccgccgcgcgcaggttgcagcaggcggtcggggcgggcgcgggtggcgccgcgagggaggagctgcggcaggcggtggtgaacacgctggagcggaagctgttctacataccttccttcaagatctaccgcggtgtcgcggggctctacgactacgggccgcccgggtgccgcgttaaggccaacgtgctttccttctggcgccagcactttgttttggaagagaacatgttggaggttgactgcccctgtgtgacgcctgaggttgtcttgaaggcatcaggccatgttgagaagtttactgacctcatggttaaagacgagaagacaggcacatgctaccgtgctgaccacttgttgaaagatttttgcaaggagaagcttgagaaagaccttgccttgccccaagagaaggctgatgaatttaagcgtattcttgctattttggatgacctctcagcagaggaacttggtgcaaagattaaggaatacggcattgttgcccctgatacaaagaatccactttctgatccctacccattcaatcttatgttccagacatctattggccccactggtcttagcgtggggtatatgcgaccagagaccgcacagggtatttttgtaaacttcaaggatctgtactattacaatggccaaaagctcccttttgcagctgctcaaattgggcaagcttttagaaatgagatctcgccacgacaaggacttctccgagtgcgtgaattcacattggcagagattgagcattttgtggacccagaggacaaatcacatccaaaatttgttgatgttgctgatttggagttcctgatgtttccaagagagctgcaactctctggggagtcagccaatctaatgaagcttggggaagcagtttcaaagggaactgttaataatgagacacttggttacttcattggaagggtctatcttttcctgacaagcttgggaattgataagggccggttgcgcttcaggcagcatctacctaatgagatggctcattatgctgctgactgttgggatgctgagatagagtgctcgtatgggtggatagagtgtgtgggtattgctgatagatctgcatatgatttgaaagctcacactgacaaaagcggtgtcccacttgttgctcatgaaaaattctccaagcctagagaggttgagaaacttgtcatagttccctcgaagaaagacctggggctggcttttaagggcaaccaaaagatggtcctggaagcattggaggctatgagtgagaaggaagcatttgagatgaaagctgaactagagaccaagggggagacaaattttaaagtctgcacacttggaaaagacgtggtgattacaaagaagatggtatcaatcagcatggagaagaagctggaacaccagcgagtcttcaccccttcggtcgtcgagccgtcattcggcataggacggatcatctactgcttgtttgagcactcgttttacacaaggcctagcaaatcagaagaggaacagctgaatgtcttccggttccctcctcttgtggcccctatcaagtgcaccgtgttcccccttgttaagaatcaagagtttgacgatgctgccaaagtaatcgccaaggcattaacaactgctggtatctcccacattattgacactactgcaatttctattgggaggaggtacgccaggacggatgagatcggtgttccatttgctgtaacagtggattcggcaacgaacgtgacgatccgagagagggacagcaaggagcaggtccgcgtggacatcgacgaggtggcgcctgtggtgaagcagctgacggaaggccaaagcacatggacggatgtttctgcaaagtatcccgcccatgtcggcccccaaagtgagcaggagtgaagaatcgccgccctgatgtctagtctagccatcgaccgagaaggcgtcgggatgagccgtcttcgttctccaattgccgagaagattgtgtggcctaaacataaccgcttttggtattgacattatccagaaaggcagttttttcccctcatacatacatggcacttgctatagcagttggatgttatgaagtctgcagatgtcaccgatgtttttgtttcttttaaatgcccctttcttgatgtattctcacccatacaaaacataccatttgaggtatttctgaactagctgtccttttgtaaggtcagactgggaattgttcagctatctacagtggaattggaaatttcagttacttgttaaaaaaaaaaaaaaaaaaaaactacagggggggcccggtacccaactgct

SEQ ID NO: 15092 - DNA, 2690 bp, Zea mays
gtgtgggtgcaattcgtttgatagattatgggaggttatggacgtggaatgatttggttgggtgagttttgtaaaattcaaactgatagattaaataatggtatagattagtgcggggtcactgcctgagcaagtagaacatctgcctaagctcaccgtcggtaaggtaggatacatctgactaggaagatatacaaattaggagcgaagatgtgctccagacaccataaatttcttggcgccgccattgtttcagattaaggttgatttggtggatagggatcatgaggggatccatggaaaggaatccctttgctattcaattttgaatagtaaagggattcctcctaatggatcttctcgtgatcctatctaccaaatcagttctaagagggaagacgtgccctataatgacaaattatttttgttgacttcttcatttttttgtgggactaaaatttaatacttctgcttcgactatatatatctagattttattgtagagtaaatgagtcaagaccaatatacatatactccaacagctgcctacgttctccagctccaccatccaggcggtctctcgtgacctcaacaatttaacccagcgggcagcgcagttgacgctcgccagcgagcacagaggacgttagaaagaggatcgaacacggtgagagtatctagttatccacagaggtgagctcttcttcctcagctagttcatctttttcttttcaagtttttctctgttgtgtatttgggctagtcagtttctcagtttgcactttgctaattccattagtcagacgctataggaatgtttttgtgggctcgcagctggagatacttccttcatgcttgtgctgcttctgtagttgagcgattgatggaaatgactcgaactttgatccattcagaattttttttttttgctcagcagcaaaattttgattttatccgatcttccatgttttggcattagatttgtcaggaagaaaattgcaggttttgactgaactgttcattcgcctaacttgcttattgtgtgacgcatgccatgacgcagattccaatcaagcttacggcccgggaagcgtcgtagacatggggaatgcactcgcaatcagtacgatacatcgatctggcaccttctccttatcattaacttgtacagtagcgacttgctagctaataattggctgtttcatttcgttgttcagtaaccacaatcatcgtgagcaagaggatgaagaagaaaatcataaaaaaggtcttggaggagatcgaaaaaaagaaccgcgagacgcaagccagcaacaacgccgtggaagatgcggtgatcgaggtcgggccagtcgagacgttcctgaatcagatcctgaacgagaagccgatgcgtttcagctccgagcaactggcggcctgcacccggaactactcgtcggagctgggatccggcggctacggcacggtctacaagggtgagctcccgaacggcctgctggtggccgtgaaggtgctcaaggtgtccatgaacaagaaggtgcaggaggcgttcatggcggagatcggcactataggccggacgtaccacgtgcacctcgtccgcctctacggcttctgcttcgacgcgaacaccaaggcactagtctacgagtatttggagaaggggtcgctggagaagtacctttactacggcgacgtggagtgcagcacgagcacgggcaaaaggcttgagtggggaacgctgcacggcatcgccgtcggcacggcgaaggggatcaggtacctgcacgaggagtgccagcagcggatcgtgcactacgacatcaagccggccaacatcctgctcacggccgatgacaccccgaaggtggccgacttcgggctggcacgactgggcgagcgcgaggacacgcacatgtcgctgaccggcggcggccgcgggacgcccgggtacgcggcgccggagctgtggatggcgctgccggcgtcggagaagtgcgacgtgtacagcttcgggatggtgctgttcgagatcctggggcagcgcaggaactacgacccctgccggggcgagagcagagagtggttcccgagatgggtgtgggagaggtacgagcagggtgagattgagtacgtcgtgtcgtgcgatgggatcggggaggcggacatggagaaggcagagatcatgtgcaaggtggcgctgtggtgcgtgcagttccagccggcggcgcggccgacgatgagcagcgtggtgcggatgctggagggggagatgccgattgtcccgcctgtgaacccattccactacgtcatggacagcagcagtggctcaactagctcggggctgtggagtgacacataccaaagtagcagagagaccattggcattgccatagacagtgagctatcggttagccctattgccaagtcgacttgattgtaagatgatgatcggactcatatgttgatgttgatgaaatcctgtactgtttgcttattataaacaaaaaaaggctgaggtttgtaaattagcatcatgcataagaatcaaagatatgcgagttgagtggattagtgtggtgtggcacatgtaggctatccctggctaataagctaagtaccgaaagatagagggcttgtttgataaaaaaaaaaaaaaaatacagggatctactgatttttttttt

SEQ ID NO: 15093 - DNA, 3433 bp, Zea mays
  misc_feature (3170)..(3170): n is a, c, g, or t
gctgtcttgtcttgccaaaggatccatcaggcactcgatcctttttttcaagggagcacttgtgattgcatcgtcaacttgtcaccccggcagtctttagagcaacgtcacacagccttgattgttgttctgaatccggcagccggcgtgcagccaatctgcgtcctgggtggtcacgagtttcagcgcaaatgaatgtgctgtctcgatcggtccatgattcgtctcgtatttccttgtcaagttgcactgacgaaacgagcgcacggtctgactgaccaaatggccctgctctgcgtctttgtttctttatttctttccccgttgtaaccttgtgcgattgattagctcgacgtctacggcacgtgcgtttggcttggattttcacttacccctgagacagacactactctatcagcagcatagtagataattgacagtgcctgcctagcagcaagtcatggcggttccttcgtagtcgtcctcctcatcgtcttctcataggcggctgagtgaatgtccagcgcacggacgcccaccaagcacgccgccgtgaaacttgcgaggcggcagaggagagaaaaccggccactgatacgtgcgcggccggctactgcaagtgcaaggtcgccggccaagtcttgggcggcggtcaacgtttcaatgatttggtcgccgctggtgccgtccctggcgtggaaggtcacgctccacgccggcgaattccccgcgctcgtggtcgtggccgtggggcgaaatttccgggggcgacgcccagacgcctctgcgccctgcggcggggtgaccactgaccagagaccaccaccagcacggttgtacatgcaccacccgagttcttctcaggggccaagatgtagatgggctgcatcacatttttagttagccggcctagcagagtagaaggtgttttgttgaacgcgtcttaaggcccggcccgtgtacagatttgtctggccctacggctcgatccagcacacaagagatgcacgtcttcctcttgcagtctagtctttctgtactgctgatgggagagaaattgatccatggaaacccagctcaacctcgtcaggaacggaccccatcgcgcggccgacgtctctaattggtcagcaacggctgcgtgcgtgttccttccttggcctttcataagtcgtctttctccttgaccagccattagcgtcgatcgatgatttagcacggagaggctcaaggctgtccacacaggttagcttttcttcttcctctagttaacctcctccgttttgaagctcttgttgtcggccgggcttcgtcggcttgttgattcagccagtcactcagtcatctgctgtagcctggattgttcgatcgttcttggagctcgcagctggagcgagagagtaatctcatgcccgctcttcttctgtagattgatggaatgatcagtaacctttatccatccatccatccatccagggattttaatttgttcagagaactaaaatttgattcctggtttttgactcagcgtagactctaaacaagcttacagcccggatgcgtcgccgacatggtgaatgcagtggctacaatcagtatgatacatctctctggcaccgtgttcttaactcgcggtagtagtagtaataatgaccggctaggctaattggctgtttcatttcgatgttcctcagtatctacagtagcctcaactgcgacagtggtagtaatcgtcgccctcatcagaaggtgccgcgtcgtgaggaagaagatgaagaagaaaatcgtgaagaaagtcctggaggagatggagaaaaagaaccgcgagatgcaggccagcaacgccgtggaagatgtggcgatcgaggtcgggccagtggagacgtttctcaaccagatcctcaacgagaagccgatgcgtttcagctccgagcagctggcggcctgcacccggaactactcgtcggagctagggtccggcggctacggcgtggtctacaagggcgagctgccgaacggcctgctggtggccgcgaaagtcctcaaggtgtcgtccatgaacaggaaggtccaggaggcgttcatggcggagatcggcaccatcggccggacgtaccacgtgcacctcgtccgcctctacggcttctgcttcgacgcgagcaccaaagcgctagtgtacgagttcctggagaacggctcgctggagaagtacctttacggcggtgacgagggcagcacgacgagcacgaggctggagtgggggacgctgcacggcatcgccgtcggcacggccaaggggatcaggtacctgcacgaggagtgccagcagcggatcgtgcactacgacatcaagccggccaacatcctcctcacggccgactacaccccgaaggtggcggacttcgggctggcgcggctgggagagcgcgagaacacgcacatgtcgctgaccggcggcggccgcgggacgcctgggtacgcggcgccggagctgtggatggcgatgccggcgtcggagaagtgcgacgtgtacagcttcgggatggtgctgttcgagatcctgggacggcgccggaactacgacccctgccttgagggcgagagcaaggagtggttcccgagatgggtgtgggagaagtacgagcagggtgagatcgagcacgtcgtgtcctgctcctgcgacgggatcgtcggaggggcggacagggagaaggcggagatcatgtgcaaggtggcgctgtggtgcgtgcagttccagccgtcggcgcggccgacgatgagcagcgtggtgcggatgctggagggggagatgcccattgtcccgcccgtgaacccgttccattatctcatggaaagcggcggcggctcaactagctcgggattgtggagcggcacataccagagcagcagcagagacaccgccggcgcagagttgtcgcctgtcggatagctctgctgccaggtcaatcggcgtcgacgcgccgtgatcgaagatgttgagcggactcgtggggggtcgtgttgatgaaacagagtttgtagtcctgtagtacacattagttaatgctttaaaaaacaatgaaggccgtggtttgtaaattagcatcgtgttttggaggactatataaaagataaaagattcgcgcacgacaaaaaaaaatcgtgcatgngttgagtgaaatgtacttgtaccggcaggtaccaaaagatagaccattattttaggggaaagttaggtagtatttggttatattgctctgttttgagactgtttgtttggaattaaagtaaacagtcactctaattaagcatgctaatggcaaaaaaccccaacccacatccaactcatacccaaatctagcaattttgacattcattccacaaccacccaaaaggccaaaaacataaggaggaaattaaactcaacccaccc

SEQ ID NO: 15094 - DNA, 1808 bp, Zea mays
  misc_feature (22)..(22): n is a, c, g, or t
gggtacctcgaggccggccggngagagatctcaacctcgactttgggctgggcagactgcataccgcagagcgcagagagcacgccacccacctcgtcccctcaatttcgcctgttcgcccccaacgcctcggtgatgggggcgtcccgcgacgtgcacctgctgagctccgcctttctcttcgtcttcctcgcctaccatgcggcgcagaacctccaaagcactgtcaacacggacgagaacctgggctccatctcgctgggcgtgctctacacgtccttcacggcgttctcggcggcgggctccgcggtggtgcggtggatgggatccaggcgcgcgctcgtggccggcacctccggctacctcctctttatcgcagcgaacctcctaccgtcctggtacacaatggtcccagcttcactctaccttggttttactgcatcgatcatttgggttgggcagggtacataccttacatcagctgccctcagtcacgcaagagaaaataatttgcccgagggtccaactttagggagcttcaatggggagttttggggaatgtttgctagcacacaggtgattggaaatttgatctcgcttgctctgctgagaaatggaaaggatggtggaagtatcacagggaaaaatcttctgtttgctgtgtttcttggttgtatgattgtgggcattgtattaatgtgtttactttcgaaaagagatgagaaaaaagataatactccaacgcattcctcatttggagctatgttgaagtacatcattgcgccacttaaggacaaaagaatgcttctcaccattcctcttatagcatattcaggtttacaacaggcatttgtatgggcggtattcacaaagagtattgtaacacccgttcttggcatcagcggcgtcggtggagccatggcaatttatggtgcagcagatgtagtttgttctttggttgctggacgattgacctccggacttcgctcagcagcatttatagtgtcggttggagctattcttcaggccatagtcctgttctggctgcttcttttttacagtccaatggatggactgcttggcgcagcgataccattagtcataggtgccttgtggggtgttggtgacggtgtcttgaatacacagttaagtgcattacttgggctgctgttcgaagatgtcaaggaggctgcctttgcacagctgaaggtgtggcagtcgggcgccatcgcagtcatcttcttcctgagcccaagcatcacgctgcaagccatgcttctcctgatggccgcggctctcgtcatctcctttggctcattcctgttccttacccttgtcgttgagaagtcatcgcccgtcagagcctgaagtgcgaaaccgtttcccgatgtccagaccggcgccagcgtgacttggtcagtgttaccagtggcctgggcagcgccatcgttgtatcccaatttcaccggaaacgcagcatccgtcgagtgcgatttgtggcacagtggtaccatttcaggcagccagtacctgaaccgaagctgtagcagttcgtgcaatggggaaaccgtcaatttgggcacgcttcttgctttgccagtagtggtcctttctccttttgcaatgtctgcactgcagcaatgttgttggaaaaaaaagatgttgtaagaaatgttgtttcatttgtaccacgtcctatcagagtggtctttttttttttgaaagatctatcgctctgcttttaagaaagcacagaaggtacacaaacagcatttaggttcatacaagacaaggaaaaaccaacagtc

SEQ ID NO: 15095 - DNA, 887 bp, Zea mays
gccggccccgcccccgctaatcgaaaaactccactcgaacggtaaagcaaaaacctgcaggctagttagctagccacgcgcacgcagatcagcagatgaagctgttcgccttcgtgaggcgcgcgcgccggccgccgccgacggcgcctgacgacgacagagccacagccacagccaccgccgctgcgaccacggagaagcggcgccggaggctgtcctcgtcttcgtcgtcggggtcggcgtggaagccgacgcttggcgccatctccgaggacgccgccatgacgtccgcgcccgtggcgcaggcgaaaccagcagcggcgccggccagggccaaggcgaggtcgcctcgccgtgccacccgggcggccggctacgacgacttccggcactacggccacccgacggtgctgccggccttcacgccgacggcgttcctgttctgagcggcggcgaaccgcaagcaacgcaaaacgtcggcggaccggcggcggtgtttgtacagctcgtgtgtgtggtggtggtgcagctcgacgacgacggcttcctgctttgttttttttgttcttccaacctttatgcacagcaaagagctgatccctagcttagtgcttctgatctatatatgatgtgtatacacaaaaaaaaaaaaaaaattctgctgtttcggatcccccaccccccaccaccatacttgggcagcgcttttgtgatttctctcgcagccataaatagtgctgcataatttgctccgttttggctcgcaccgcggcgtggctactgatagggctactttcggagctacaaaacggaatctgtacccaccactactggaatctgcacccagtttcacctctttctttaattaattggggccgatccgaacc

SEQ ID NO: 15096 - DNA, 907 bp, Zea mays
caacaccctgcggcgattcagcagcagcagcctatgccgcagcagagcaatttccagggctttggtggtgttaacccacagtacccgcgccgccggccggatcagcttctgcaggaagttaagaacaataaccacgtgaaagcacagcaactgcctccagatgcacctaaagcgagcggcggtcttgcaccaggagttgctattcccaacgttgctgctgctggggagcagggacagcatatcaacagtaatacccgtgaccataacggcgcggtgaagggtgctgctccagctggtactggcccaagcaatgtgatcaacaacacagccagcatgccccccggcagaaacaacagcttcaagtcggtgagcagcagtccagctgctgctaccggtggcattgcggtgaactcgaaggtcgacgactccttccatcaactggaggacctcgacctcgacggcttgatcacaaacgaactgatggagagcgggttgttcggcgccggacaagggtggtgagcatgtcccaccacgcctcacactactatcgagttccttcaccgaaagcgccaagcaacaatataagctttgccacccttctctttctggagtttttgtgttgacagtttcagatgatcgtgccatatacaattatgtaaggtagcgagttggatttggcttgggagtcgggaacggcgcaatctatagagctgttagcgtgtgcgtatgacatgttgctgtggttatcattttcatgctatggaggagtgtcgattatagtctcctgttgtctggcacggcgtgagtgtgtgtttcccatggttctatgaaatcaaattatagaagaaacaagatctaatgtttaggaatcgattctctatgattcaaaaaaaaaaaaaggccccta

SEQ ID NO: 15097 - DNA, 1856 bp, Zea mays
tttttttttgggagactggaattttttaaagaaaaagtcaacaactctccaccatatccaatgggccaaatttcaatggcatgtatcacatcacaagcaaaaacaaattttcatatgagagactggaattttttttaaagaaaaagtcaacagctctccaccctatccaatggaccaaatttcaacggcatgtatcactccaccaacgagacgcacgagtgcgactactgattccgtctagaaaactcttgtcttgttaagctggcctctaatcgtcttgtgatcgttggatgtccatcgggtgaaatattatgttattataagattgtataatatcatttgcaattttagttgcatccatagaaacaccaagtagaccacgtctcgagaatccagcagcatatagaccattctttcctttccactcatttggtctacatggaaatccatctttccgtgaaaaaaattcattttccttcaaccaatatggaacattacttttataaccagttgcaaaaataacaacatcgaatgattcgattctaccatcaataaactctacaccatcctcttgaaaacttttaattcccggaaacacttttatgtctccggatttgatctttgcaatcgtgccaacgtcaagtaccggtgtcttaccagacaattgttttagttccattggacctaaattaggtcgaggaataccgatacgcctggtgtcacctagaatgaaccaggctagtacaagaaggatttgatccactactttaatattaaaaaatgtctgaagccacaaggacaatgtaaatgtagagattcccagtatctctcttggaaggacgtgtcccgaatcacgcacaaccatagaggtatgcacattgtagttggcaagatccagcgacacctccatgccagagttgccacaaccaatgacgagcacatttttgccttgaaattcctcgccgttgcgatagtcgcttgagtgaaagacttcacccttgaagcttcgcatgcccttaatctcaggtaccaccggctcagcgttttcaccagtggccacaattagccatttggagcggtactccatagtgcaagaggaaagcatagaccctccaacattgtcgctggtatccttggtgcgcacgcaccaatactcaccgtcgtactcggcgctgacaacctccatgttgaagaaggggcggatgccgtgctttcgcttgtactcatcgaggtaggccagaaactgctgcctaaccgggtatgtggggtagctatgcgggaagggcatgagcggcagctggcagtagcgcttgggtaggtgcaaacacagcctatcgtacgtgcggcggtgccacgttgatgcgatgcacatgtcacgttccaggatcacgtagggcaccaatcccatggtgagcatcgccgcgcatgctagccctgctggtccagcgccaacgatgaggggcccccgtagcacggccacaccttggtcgccgatggggatgccggttgcggtggccctcgcggcgctgcgcgggctgtacatgagcaggtcgtgctccatcttgcccccagtctccgtggtcagtggatcctgcaccatctcccccttaccagtctcgacaaagcggtcccacctcacctcagacttggcgatggagcgttccatgccaggcgatgctctcgcagcgctcgctcccgcaaactctctagatacagatgggatatgcttgcggtccctcctcccctcggtctgggtgatgaagcggtccatgtcggatggtgctctcgcaatgctcgctctctcaaactctctggatattgatgggatatgcttgaagatggtgatcgagctacgc

SEQ ID NO: 15098 - DNA, 2479 bp, Zea mays
ccttcacaagcatctgacagccgaaccatgtgggcttccatggcacatttgttaccaaataataaaagggatttgcctgggcttgcactacctacatgacaagaacataattcatctagatctgaaaccggacaatatattgcttgatgatgacatggtgcccaaaatcacggacttcggtttgtcaagactcttgggtaatggaaaaagccacaccattacacaaacaagaataggaacatggggttacatggcacccgagtacttggatgatggagtgatcacaatgaagacagacatctatagcttgggtgtgataatcagacacatggtgaagggacgtaactcggcagacaccactgatgaagaagtactggcaaactggttgattaggctggaaaaggatccatcacagatgatgaggcagcagacgacccgattattatttgaaacagagtacaaagagcaaataaaagcgtgcatggatatatcatggaggtgcacgctgcgtaaaccaatggacaggccaacgacgcagcacatcctacttacactggaggaaacagaagcaaagatcaaatcggtcgttgggcctactccaccaaatgccgggcagcttcagattgccaaatttgggccgtggggtggagatggagggaagacgcgagacataagaatgacgccttgccatttgcatagcgtaacaattagcagtggaactattatcgattctatcgggttttcattcactgatcactatggtcagcaccacacaacagggccttggggcggtaaggagggtacgaataagcttgggggactacatccaattgaactaggcccttcggagtttcttacaggagtatctggaacaagcggcccattcaacgggctaacaaatgttgtaacgtcacttacgtttgtcaccaatactcgtagttacggaccctttggaaaagggcgaggaacaccgttccacatccaaacgcagaacaacggcaggatcgttggcttctttggccgttctggccagtatctctatgcgattggggtctacacgaaccaagatgctagggtcgcaaggatcgggcgacctttgggtggagatgaaggggttcttcatggcatcacagacctcagtgggcagcagcgcagcagaggtggaggtccatcgggagaatgtggagacagcgacgacgagcccaacggtgatttcgccaaattcggcccgtggggcggcgacggaggacagccgcaggacatcggaacactaccctgccgtctagacaggatcaagatcagcagtgggcttatcatcgactcgatcgagttctcgtacgctggccctgacagccagtaccgcaccgcaggcccttggggtggtcatggaggagacaacagctcttttcagctagccggttcagagttccttacaggtgtgtctgggtcaatcggcacattcaacggccatgcaaacgtcataacgtctctgacgttcgtcaccaacgctcgtagctacgggccgtttggaagagggcgaggcacatccttccacatcccagtgcagggcaatggctgcatcgtcggtttctttgggcgctccggacggtacctcaacgcgatcggtgtctacacggcgccgaaacccgaaccaaaagcaggtggtgatgaggccgtcgtcgccaggattgggccttggggcggggttggaaatgctctccatgacatcgcagagaggccgcatcgcctgcacagagtgacgatcttcagcgggacgatcgtaaactcgctggagtatctgtacagcgatggcgacgggcagcagcacaccgccggtccgtggggcggctgcggaggaactggtcgaaagattcatcttgcccctgaagagttcatagtggaagttactgggacattccatccatgcgcgtgggacagaacaatacccagtgtcgtgtcctctctgacgctcgtgaccagcacgggcaaaacacacgggcctttcggaacgcagctgggagccgcgttccaggttccggtgcagagcgacggcaggatcattggcttcttcgcccacggagacaattacatcgaagcaattggcgcctacgtgaagaaattgacagaatccagcaaccgttaactcttggaacaacttgcagctgttcgcactgtttcttgggccattgctccttaaatttagtccagatggccaaggagcaaccaaacagaaatcgctatggcagggaagatggactaaagtggactgtggcacctccagcataccctgctcttagattagtgaccagacatcatcatgatatttcgatattgtaataaatgaggagcccatctcagatgtttatgttagctcctcagtttttgcttctgaatgattaatttagatcttccttaatttttgcaataaatgaggattcttttctgtctaaaaaaaaaaaaaaaaaaagggggggcccgg

SEQ ID NO: 15099 - DNA, 913 bp, Zea mays
aggatgcttccgccccgcttccctcccctactcccccacctctcccaccctttttatatcggctccctccggcccggccggatacatacctactagtctactaccccttcacctaccttcacctggcaactggcattggtcccgtatagtgccttgctgtcagttgcatggacgggctgacggacgagcagaggctcgcgttccaggaggccttctcgctcttcgacaagaacggcgacggatgcatcaccatggaagagctggccgcagtcacccgctccctcggtctcgacccgagcgatcaggagctcaatgatatgatgagcgaggtcgatacggacggcaatgggatcatcgatttccaggagttcttaagcctcattgcccggaagatgaaggatggcgacggcgacgaagagctcaaggaagcctttgaggtcctggacaaagaccagaacggcttcatctccccggttgagctgaggacggtgatgaccagtctcggggagaagatgaccgacgaggaggttgaacagatgatcagggaagcagacaccgacggtgacgggcaggtgaactacgatgagttcgttctcatgatgaagaacgctgagcggaaaatatctgggtgaagggcgcgatgtggtgtggaactagtagtcgtcttggttggattcttctgtcagaaatctactactgtaaattgcaattgtatgcttagtactatgatcgtgttattcgaagtgttggaggttggaaaagtgatctcacgctcactaccgggtggccaacggccttatgtatacgatgaatatttagataggtggcttttattttgttacgataaatagcaggaggaagatccattgacgacctctacaagggttttcggtcaacccccctccaggaaaaa

SEQ ID NO: 15100 - DNA, 1855 bp, Zea mays
cggacgcgtgggcggacgcgatgagtacgcagatggccatggagggtcgtcgtcgtcgtcgtctcgttctgtggctcgtgatatccgcgcaaacaatgctagttgccgccgcggccggcgccaagcggcaggcgccggtgatgttcgtgttcggcgactcgacgctggacgtcgggaacaacaacttcctgtcgggggcggccgtccccagggccaacaagccccactacggcgtcgacttccccggcggccatcccaccggaaggttcagcaatggcgacaacacggctgacttcgtcgcgaagagcatggggttgaagagtagccctccgccgtatctgtcgcttgcacccaacggctccagccctctgctcgcgcagactgctctcaccactggtgtcagctacgcttccgcagacgctggcgtcctcgactcaaccaacgagggcaagtgcatcccgttgtcgacgcaggtgcgctacttcaacggcaccaaggcgaagatggtcgccaagaagggcgccgccgcggtgagcaagctgctggccgactccgtcatcctcatgggcatcgccaacaacgacctgttcgtgttcgctgccgccgagctgttgcggggcaggtcggccgcggagcagaagagcgacgccgccgcgttcctcaccgacctgctgtccaactactcggccgccatcacggatctgcactccatcggcgcgaggaagttcgccatcatcaacgtggggctggtggggtgcgtgccggtggtgcgggtgctggacgcggacggcgggtgcgccgaggggctcaacaagctggctgaagccttcgacgtcgcgctggggccgctcctcgccggcctcgccgacaagctgccggggctgacctactcgctggccaactccttccgcctgacgcaggacgccttcgcggacccgaaggcgtcagggtacagcgacgtggccagcgcctgctgcgggagcgggcggctgctggcggaggcggactgcctgcccaactccaccgtgtgcagcgaccacgacagccacgtgttctgggaccgctaccacccggcccagcgcgcgtgcaacctcacggcccgtgcgttctacgacgggccggccaagtacacgacgcccatcaacttcatgaagctggcccaggccagttaatggtttctgtatggctgtccacgaatacttactagccacgaatacctgtgaaaacagcaaaacaaaaaatgggcaccgttggccattatacatggaaacttgttaatttcttaggaatgtcacgtggctcgatcgaggccaagccatgtacgtacaagttgttcaattatttatgcatgctgctgcatgtatagatgtccaatttggcggcggcatgggcacaattcggctcgacccgtcactacaccaaaacccttaacttcttacgcccgtgcccgtagaaagttagcgcaaaactctcggaagttatacaaactgtcggaagttagctcgtcggaacaaattggtcggaagttagggtaacttccgacgggctctcggaagttaaggaaacttccgagagggtcgttcgcctctcggaagttaatggttaacttccaagagggcgcttccctctcggaagttaagtgctgacgccgtccagcacggggctaacatcgtccaggaataacttctgacatcgtccaggaagttaacccttaacttctgagagttccctattcctctcggaagttaaattgaccagcactaaatatacaatttatttttggtaattcaacataagaattcacaagtatcacatataacagccacaatacataataacaaatatatttaacagc

SEQ ID NO: 15101 - DNA, 887 bp, Zea mays
gttcgattgtggcagtggcgctgttaacccaaaaggcgcccttgatcctggccttgttctagacgcaagtaagccaattactttttcatcgaaataagccggtcgaagttatcgaaatggcggtgtcttgttgaagttattcagaatggcaatgtaacatccctcatctagttttgcttgttctagacgcaagccatgaagactacatcacgtttctgagctcgatccccgacgtcaaccagagcgaagtatcaaacatagccggctcggcttgcaactccaactccaagggacaacgccccttcgacctcaacatcccctcgatcgccgtctctcagcttcgaggcacggtggtagtgaagcgcaccgtcacgagcgtgtcgcgacgaaaccgagacctacaccatcatgacaaggatgccgccagaggtcgccctggaggtgacgcctccggcggtgaccgtgggccccggagcatcacgagagataactgtgaccctggacggcgaggtccgtgaccggcacctacagtttcggtgagatcgccatgaaaggtgaccgcggccaccttgtcagaatcccagtggtaactatgggattcaagtaggtagaagacgactgtgacatctcctagggagtagaggataggaagacgcgagttgtgcctctgtaatctgaggtcttgagctgcagaggaacgttgtataattttttcataggttgtagagaataagagttggcacaatgctgcccgtgttatgcatgccctccaggttgtaaagtatatttgggtgtcttaaatcctctgtcgacatggtgactagaggacctcttgtatcgtagtccagccttgttttgattctttaatgcatgaaggtttgaatccc

SEQ ID NO: 15102 - DNA, 1470 bp, Zea mays
  misc_feature (1173)..(1173): n is a, c, g, or t
  misc_feature (1187)..(1187): n is a, c, g, or t
  misc_feature (1193)..(1193): n is a, c, g, or t
  misc_feature (1198)..(1198): n is a, c, g, or t
  misc_feature (1205)..(1205): n is a, c, g, or t
  misc_feature (1209)..(1209): n is a, c, g, or t
  misc_feature (1211)..(1212): n is a, c, g, or t
  misc_feature (1214)..(1214): n is a, c, g, or t
  misc_feature (1216)..(1216): n is a, c, g, or t
  misc_feature (1220)..(1220): n is a, c, g, or t
  misc_feature (1222)..(1222): n is a, c, g, or t
  misc_feature (1224)..(1224): n is a, c, g, or t
  misc_feature (1228)..(1228): n is a, c, g, or t
  misc_feature (1230)..(1230): n is a, c, g, or t
  misc_feature (1237)..(1237): n is a, c, g, or t
  misc_feature (1239)..(1239): n is a, c, g, or t
  misc_feature (1241)..(1241): n is a, c, g, or t
  misc_feature (1243)..(1244): n is a, c, g, or t
  misc_feature (1247)..(1247): n is a, c, g, or t
  misc_feature (1249)..(1249): n is a, c, g, or t
  misc_feature (1251)..(1252): n is a, c, g, or t
  misc_feature (1255)..(1255): n is a, c, g, or t
  misc_feature (1261)..(1262): n is a, c, g, or t
  misc_feature (1267)..(1269): n is a, c, g, or t
  misc_feature (1272)..(1272): n is a, c, g, or t
  misc_feature (1274)..(1274): n is a, c, g, or t
  misc_feature (1277)..(1277): n is a, c, g, or t
  misc_feature (1281)..(1281): n is a, c, g, or t
  misc_feature (1286)..(1286): n is a, c, g, or t
  misc_feature (1288)..(1288): n is a, c, g, or t
  misc_feature (1293)..(1293): n is a, c, g, or t
  misc_feature (1296)..(1296): n is a, c, g, or t
  misc_feature (1304)..(1304): n is a, c, g, or t
  misc_feature (1308)..(1309): n is a, c, g, or t
  misc_feature (1313)..(1314): n is a, c, g, or t
  misc_feature (1316)..(1316): n is a, c, g, or t
  misc_feature (1328)..(1330): n is a, c, g, or t
  misc_feature (1334)..(1334): n is a, c, g, or t
  misc_feature (1336)..(1339): n is a, c, g, or t
  misc_feature (1342)..(1343): n is a, c, g, or t
  misc_feature (1345)..(1346): n is a, c, g, or t
  misc_feature (1352)..(1352): n is a, c, g, or t
  misc_feature (1361)..(1361): n is a, c, g, or t
  misc_feature (1364)..(1364): n is a, c, g, or t
  misc_feature (1368)..(1368): n is a, c, g, or t
  misc_feature (1373)..(1373): n is a, c, g, or t
  misc_feature (1377)..(1377): n is a, c, g, or t
  misc_feature (1382)..(1382): n is a, c, g, or t
  misc_feature (1384)..(1385): n is a, c, g, or t
  misc_feature (1390)..(1390): n is a, c, g, or t
  misc_feature (1408)..(1408): n is a, c, g, or t
  misc_feature (1413)..(1414): n is a, c, g, or t
  misc_feature (1422)..(1422): n is a, c, g, or t
  misc_feature (1425)..(1425): n is a, c, g, or t
  misc_feature (1429)..(1429): n is a, c, g, or t
  misc_feature (1433)..(1433): n is a, c, g, or t
  misc_feature (1435)..(1435): n is a, c, g, or t
  misc_feature (1437)..(1437): n is a, c, g, or t
  misc_feature (1440)..(1441): n is a, c, g, or t
  misc_feature (1443)..(1443): n is a, c, g, or t
  misc_feature (1446)..(1446): n is a, c, g, or t
  misc_feature (1451)..(1451): n is a, c, g, or t
  misc_feature (1458)..(1458): n is a, c, g, or t
tgcacgagggtgatcggtatcgtggattctggaatttaccctgaacatccgagcttcgctgcgcacaatactgatccatatggacctgtccctcgttataaagggaaatgtgagatggatccagtaacacaaagaagtttctgtaatgggaagatagttggggctcagcattgtgcaaaagctccagggcctgctggcgcatttaatcccgatgttgaatttgcatctccattagatggtgatggtcatggaagtcacacagctgcaattgctgctggaaacaatggggtcccagtgcgaatgcatggtcaccaatttggcaaggcaagtggtatggccccacgtgctagggtagctgtctacaaggttctttacaggctttttggtggttacatagctgatgttgtggcagctattgatcaggctgttcaggatggtgttgacattctcaacctttctgttgggcccaatagcccaccaacagctacacggactacttttttgaatccttttgacgctgcacttctttctgctgtgaaagctggggtatttgttgcccaagctgcaggaaatggtggaccatttccaaaaacgctggtgtctttcagcccatggataactactgttgctgctggagttgatgaccgcagatacaagaatcatttaacactaggaaatggaaaacttctctctgggcttggagtatcacctgcaacacatgggaatatgtcgttcagcttgatttctgcagctgatgctctattgggttcatctgcaaccaagtacagtgcattagattgccagaggcctgaactattgaataagaggaaagttcaggggagaattcttttgtgtggctattcgttcaattacatttctgggacagcttcaataaagaaagtgtctcagacggccaggaatctcggagcagctggctttgttgttgctgtggagaatagttacccaggaacaaaatttgaccctgtaccagtcagcatccctggaattctcatcacagatgtcagcaaaacggaggatcttatagactactacaattcttccaccataagagattgggctggaagggctacagcctttaaagcaacagcaggtattgcagatggtttggcaccaacactatacaattctgccccccaggttgcgctgctctcnttccgaggacctgntgagantgacnctagctnttcntnngncnacgncncnctcngnggtcccncntncnnccncncnntcnattggnnatccnnnctngnccncccnttgtntnccgcntcncccttgtntttnntccnncncctcgtttttannntttntnnnncgnntnnttcccnttcgcgctngcntgtncgtcncgcnccgtncnnacctntcccccccgcccccgttncctcnnttcttttnccnccgncgtncncnctnncnccnttccngcccccncgcttctccccg

SEQ ID NO: 15103 - DNA, 4560 bp, Zea mays
ctgcaggtatttggtgtcccgattttgcttagaggcgcatgtccttttccccatttgagttcttggttgttatcttgtttgaacacggtgctggcccgtggcaggctgagttcttgaagaaagccccaggagttaagcatgttgagagagacatgaaggtacagaaattgactacacacacacctcaatttcttggattgccaactggggtatggtcaacaggaggtggacttgatagagctggtgaagatgttgtgatcggtatcgtggattctggaatttaccctgaacatccgagcttcgctgcgcacaatactgatccatatggacctgtccctcgttataaagggaaatgtgagatggatccagtaacacaaagaagtttctgtaatgggaagatagttggggctcagcattttgcaaaagctgcaatggctgctggcgcatttaatcccgatgttgaatttgcatctccattagatggtgatggtcatggaaggtcatgatcctgacgattcttttatcttttatatttgctgctctgatcggtcactaggataaccaaatatgaaagttcaaaatgtttttgcctgctacttccaaaacagcctgatgatatcatgatgcctggcctgcaaaattattctggttgtttcttttgttttctgggaacataacaaaacttatctgatgcatgtatggtcttttccttcaacagtcacactgctgcaattgctgctggaaacaatggggtcccagtgcgaatgcatggtcacgaatttggcaaggcaagtggtatggccccacgtgctaggtaagctatgatttctgggacatgcatttttttttgggggggggatgttatagatgcacccatgtacaatcaatatcatgatactttgtgagtttgagaaagcaactttgcttttgcttacttgtcttgtgcttgttagggtagctgtctacaaggttctttacaggctttttggtggttacatagctgatgttgtggcagctattgacccggttggtttcgcgttggatcctatgatatgtgaaacaagagaatttataacataactattagagatgcatgtgttgtacatgtgtttgctgagcgttgttggttacctttctacaataacattgcctagaagcacttggcaatatttattgaaaatttactggtagaaaataacataaaaggcatggctgtttaaacgagaaaatcaattttgcacttcctgttgtttccaatttcggactagagccccaaccttcctttcttctaactgtgctgggaattagtatcttttatttctgcatgtagaacaaacatgaagttgaacgtaacttcattttctactaagttttttaaagcatccaatttgtgggaatataatgcatgaatgtctatttgcaggctgttcaggatggtgttgacattctcaacctttctgttgggcccaatagcccaccaacagctacacggactacttttttgaatccttttgacgctgcacttctttctgctgtgaaagctggggtatttgttgcccaagctgcaggaaatggtggaccatttccaaaaacactggtgtctttcagcccatggataactactgttgctgctggagttgatgaccgcagatacaagaatcatttaacactaggaaatggaaaacttctctctgggcttggagtatcacgtaagtatttttctaagtacatgtcaacaaaatcatgatgaattatttgtcagtactgtgtgcagcattttgaattgtggattgtagaattgtgcaaaaatgaactaatgaaattttcatacaacaaacttctatgtagaacccctactattatttcaccccaacaggttaaccaattattttgggcacatagggcataccaaacagaggtacaaatgacatgacagtatatactgaacctgaactagaaggttcagttgtattgaatgaatagagaatacatggataaacttcatgttactgcatcccaacttttatttcagtgtgatgatgcttagattggacaaccattttatgtttttttagtatcaaatgtcatctgatagtactttaaaggtcatatgagatatttgagtggtcctggtattctatcaataactcctatgtttctgcctgtggttattgacaattttctcatacgatacagctgcaacacatgggaatatgtcgttcagcttgatttctgcagctgatgctctattgggttcatctgcaaccaagtacagtgcattagattgccagaggccctgaactattgaataagaggaaagttcaggggagaattcttttgtgtggctattcgttcaattacatgtctgggacagcttcaataaagacagtgtctcagacggccaggaatcttggagcagctggctttgttgttgctgtggagaataattacccaggaacaaaatttgaccctgtaccattcagcatccctggaattctcatcacagatgtcagcaaaacggaggtattgcagagccttatttcatatttgcatatggttgccacttgtagacaacatcatacatagacatatggaaaaatgagactgtatattcatgaatagatcaataaatatgcaatttagttctcgaaatagcatgaattgggcttcaaaaaacaatgtgcaaagaggtgcaagatagtggcatgaattctatatggctgctgctactgctactataggatgacagggcagaagggtaaagtacctatgcattgtttggtccttgtatgaaattttctcttgtaattaggcacagtcctcgtgttgaaaccatgaagtaatctatcaatttccttttcatattattgttactattactaatactgcttagtacctttcatatcttccttgttggtggctcctgttgggtctatagcctaccctaacttgggacgaaaaggctttgctgctcggttcccggcttgtccgctactgccgtcctgcaggatcttatagactactacaattcttccaccataagagattgggctggaagggctacagccttcaaagcaacagcaggtattgcagatggtttggcaccaacactatacaattctgccccccaggttgcactgttctcttctcgaggacccgatgttaaagattttagctttcaagatgctgatgtccttaaaccagacatacttgctcctggcaatctcatatgggctgcatgggcgcctaatggaacggatgaatcaaactatgctggtaagcgtgcgttgtctgtagacctcttcccctcgaggaagcacccatgattaccatcagtattttactactgcgctcttgccgcccttgtgcatatcttctggattagtgatcggtggtgatatttttctgtgctcgaaccaactcaacattgctgtggtaatatttctcaggtgaaggatttgcaatggtttctggaactagcatggccgcaccgcatatcgctggcattgcggcactgataaagcagaagaacccaaagtggagcccctcagcaataaaatctgccatgatgacaacggccaatacactggacaaagggagccgtcctctcagagcgcagcagtacactgcatcggaaatgatgacactttctcgggccacaccgtttgattgtggtagtggcgctgttaacccaaaagctgcccttgatcctggtcttgttctagatgcaagtaagttcaattgccgtccatttttttcccgtgggataagctggtcaaagtaattgggatggtagtgtctggtcgaagctttccagatggtaatgtatagcatccctctttcactcgtctaattttgctcctctattcatgctggcagcccacgaagagtacatcgcatttttgtgctcgatccctgacgtcaaccagagcgaagtgtcaaacatcgccggttcagcttgcaactccagctccaaggggcgtcaacgcccccttcgacctcaacctcccctcgatcgccatctctcagcttcgaggcaccgtgacggtgacgcggaccgtcacaagcgtgtccgaggagaccgagacctacaccatcatgacgagaatgccgccggaggttgccctggaggtgacgcctccggcggtgacggtgctgcccggagcatcgagagagctagctgtgaccctgacggcgaggtccgtgaccggcacctacagtttcggagagatcgccatgaaaggcgaccgcggccacctcgtcagaatcccagtggtagctatgggattcaagtaggtatagaagacgaccgcgaccggcgctagagagagtaagtacgaggagcgagttgtgcctctgagatccgaggtcttgggctgcagaggaatgctgtaatttttccatagtttgtagagaataagagttagaatgccctccggggggctgtggctgggatttcggtgtttaagcctatgtacagccttgcacttaaggcaaagtatcatgtgcccatcaaaaaaaaaaaaaaaaaaaaaaaactcgagggggggcccggtaccc

SEQ ID NO: 15104 - DNA, 5718 bp, Zea mays
  misc_feature (4584)..(4584): n is a, c, g, or t
  misc_feature (4608)..(4608): n is a, c, g, or t
  misc_feature (4794)..(4794): n is a, c, g, or t
acagaaattgactacacacacccctcagtttctcggattgccaactggggtatggccaacaggaggtggacttgatagagctggtgaagatgttgtgatcggttttgtggattctggaatttacccccaacatccgagcttcgctgcgcacaagactgatcgatatggtcctgtccctcgttataaaggaaaatgcgagaaggatcttggggcccctcgaggccggccgggtgggaagatagttggggctcagcattttgcaaaagctgcaatggctgctggtgcgtttaaccccgatgttgaatttgcatctccattagacggtgatggtcatggaagccacacagctgcaattgctgctggaaacaatgggattccggtgcgaatgcatggtcacgagtttggcaaagcaagtggcatggccccacgtgctagggtagctgtctacaaggttctttacaggcttttcggtggttatgtggctgatgttgtggcagctattgatcaggctgttcaggatggtgttgacattctcaacctttctgttggacccaatagcccaccaacagctacaaggactacttttttgaatccttttgacgctgcacttctttctgctgtgaaagctggggtatttgttgcccaagctgcaggaaatggcggaccatttccaaaaacactggtgtctttcagcccatggataaccactgttgctgctggagttgatgaccgcagatacaagaatcatttaacactaggaaatggaaaacttatttctggacttggagtatctcctgcaacacatgggaatatgtcgtttagcctgatttctgcagctgatgctcttctgggctcatctgcaagcaagtacagtgcattagactgtcagaggccagaactattgaataagaggaaagttcagggaaaaattcttttgtgtggctattcattcaattacatttctgggacagcctcaataaagaaagtgtctcagacggccaggagtctcggcgcagctggctttgttgttgctgtggagaatagttacccaggaacaaaatttgaccctgtaccagtcagcatccctggaattctcatcacagatgtcagcaaaaccgaggatcttatagactactacaattcttccaccgtaagagattgggctggaagggctacagcctttaaagcaacagccggtattgcagatggtttggcaccaacactatacaattcagctccccaggttgcgctgttctcttctcgaggacctgatgtgaaagattttagctttcaagatgctgatgtccttaaaccagacatacttgctcctggcaatctcatatgggctgcatgggcgcctaatggaacagatgaatcaaattatgctggtgaaggatttgcaatggtttctggaactagcatggctgcgccgcatattgctggcattgcagcactgataaagcagaagaacccaaagtggagcccctcagcaataaaatctgccctgatgacaacggccaatacactggacaaagggagccatcctcttagagcgcagcagtacaccgcatcagaaatgatgacactttcacgggccacaccgttcgattgtggcagtggcgctgttaacccaaaaggcgccctcgatcctggccttgttctagacgcaagccatgaagactacatcacgtttctgtgctcgatccccgacgtcaaccagagcgaagtatcaaacatagccggctcggcttgcaactccaactccaagggacaacgccccttcgacctcaacatcccctcgatcgccgtctctcagcttcgaggcacggtggtagtgaagcggaccgtcacgagcgtgtccgacgaaaccgagacctacaccatcatgacaaggatgccgccagaggtcgccctggaggtgacgcctccggcggtgaccgtggtccccggagcatcacgagagataactgtgaccctgacggcgaggtccgtgaccggcacctacagtttcggtgagattgccatgaaaggtgaccgcggtcacctcgtcagaatcccagtcgtagctatgggattcaagtaggtagaagacgactgtgacatctcctagggagtagaggataggaagagcgagttgtgcctctgtaatctgaggtcttgagctgcagaggaacgttgtataattttttcataggttgtagagaataagagttggcacaatgctgtaagtgttatgcatgccccctccaggttgtaaaatatatttgggtgccctaaatcctctgacatggtgactagaggacctcttgtattgtagtccagccttgttctgattctctaatgcatgaaggtttgaatctcatctggttttcttcaaaaacaaaaaaaaaaatatggcaattcgtattgtgggcttaatattaaaattccccaaatatgggagatgtgaaatttcttgtcaggatggcacaatttttgggactttgggaggatgcaatgcaaatggtctatcagggtccgttaaacgaccgtggccagctaactagcgatcgaggcttctcgttctgggcgcgatttttgatcccatcgcgaggcgaactccttgggcctccccattcccagaaaaaaaaaatgatggtgacccgttcgcgtcggctcgccccgccaccatgacccataagcgccacgccgccaccggcttgcgcacgggcggcaccatactgcacgcgctctccgccgcctcggccgcccacctgcacgcgcacgccctgaaggtcggcgtcctcttcacctgcctccacctctgctcgggcttgctcaaaacctacgcgtcctccggccgcatcgccgccgcgcggcagctgttcgacgaagcgcctcgccggaacgtcccgctatggaacacgctggtgtccgcctacgcgcgctgcggccacccgcgcagcgcgctggccgccgcgtccgccatggcgcgcggcggcggcggcggcgcgggggcccggccgaacgtcgtcacggtggcgatcctgatgtcggcgtgcgcgaagctgaggaggccggcgcccgggcgggaggtccacgggtacgcggcccggaacgtggccgcgctcgacctccacgcgctcaacgcgctggtgcacatgtacggcaggtgcgggcggctcagggacgcgaggacggcgttcgccggcatcggggccggcgcgaggaacgccgtgtcgtggacggccatgatcgacgcgtgccgcgagaacgggcgccccgcggaggcgctgggggtgttcgaggagatgcgtcggctcgctggcgccgaggtcgacgaggccgccctgctcgccgccgtgtcggcgtgcgcgagcctggactgcgcggcggggctaggggactgggtggaggcgtgcgcggcggagagcgggttcctgcggcgggggacgacgagcgcccgcgtcgccaacgcgctcatacacatgcacggcaaggcggggcaggtggagaggtcgtgcgcgatattcgactcgatgggcgccgcgaggaggacggtggtctcgtggacggccatggtccaggccctggccacgaacgggcacgcggtggccgcgctcgtccggttcgcgcagatgctcagggaagggttcgtgcccgacgaggtggccttcctgagcgcgatcggcgcctgcgcctgcgcggggctggtgagcgaggggcgccggctgttcgagtccatggtggaggagcaccgcatcgcgccgcagatggagcactacggcagcatggtggagctgctgtgcagggccgggtcgttggccgacgcgttcgagttcgtcctggccatgcccgtcgcgcccgaccctgtgatctggcgtgccctggccggcgcctgccgggaccatggggacgccggcttggccaggagggtgatggatcatgtgatcgcgatggagccccaccatgcagggaactacctgctggcgtccaacttgtgcgcggcggatgaggactggggacgtgtcgtggatgttaggctggagatgggagccaggaaagcgacgatctcgaggactgctagtggtgccgtgtcttcagttcaagtcaacggtgagtgatgacagagcttggcttttacgcatcacccggtagcttttccaaccacgctacttcaagttcaagatgccactgccacgttgttaatgaattttctcaccttgtcaccacgtcattcgcgtgcatttacaagtgtttatattctgtactacttgtctaggccagaagaacctggcgagagaactgagtttacttgtctagtgctgcctaagattcgtttttttttgggtttaatctcttttcctaaactgttgactgagacgttaaaccagatgtggtaggaaacccccaaagtcaaaagatctggcgtccaaagccgagaatgttttatcattgggcccagcgagtgataaacgctgaggacctgaggtgatgcagcagggtccaaatggcagatggatgttctgtcaagcttgacaatgacaaatgttttatcattggtggcattagtaacggaccccgctgctacgcttaagtgtgccnggaaaaatataaaaaaaagaaacnaaaaatagagatcaacaagactcagaaacttgactgtcaagttcaaaagatagtacttacaccactatatatgctaactagccttatatgatataatcttagggtgtgtcgtggcccatataaaccacccactggatccgcctctgggtgttatgtgtctgcaaccggccggtggccaaatcggangttcgtcgccgccggcgccggatctcagtcagcaactggcatcgacgactgctagcgtgtgctttccacgtgcgagcttcgcgatggcgtccgaccgtgcctttggattgctccgtatcgtgtcgtgttcgtgttcaactgttgatgcactgagactgagcggagctgtgggccggcagggcagcgggaaaccatttgtgctgctgctacacaaacagcgggcggcgggtggcacttggcagggcagctaactgatgaaagagacccaaccatccgagctagggcagctgactgaaagagacccaaccatccgacctatctatactgtttttttcatataaaaagtagcagtgtttaactcatatataattttattttaaaaatatttatcaaaagtgcacgtcaaacggtgaaagtatttaatagagacacgtagcagtcgccgacgcgaggcaccccggaatcttggcgtgccggtctctgctttcacaccgcccccgtttcgcaatgccgtgtgcctgcatacagtgaacgggcagggtatgcacaggttacaaatggggggagagggatgagtttacagtgtttgtataaacaacctaaaggggagtttgatttgtagtgactaatttttaatcccttcattttattccattttagtcactaaattaataaatatagaatattttagtttttgtatttgacaatttaggaactaaaataaaataaaataaaataaaatagagaggttaaaaattagtgactaaaaaccaaacatccgctaaatatagagtctgctagtgtgttcttggttctgtaccagtccagtccaggagcatatctttttaagcgattcaatgcagtccgttcgtgtcagtgaagcgttataaaagcaaatccatctattcttccaaatgcgccgta

SEQ ID NO: 15105 - DNA, 1721 bp, Zea mays
ggcctgatctttccaaggaggattataagcatttttatccttcaactgttctggagacaggccacgatattttgttcttctgggttgcacgaatggtcatgatgggaattgagttcacaggatcagtaccattttcttatgtctatctacatggtcttatccgggatgctgagggtcgaaaaatgtcgaagacattagggaatgtcattgatcccctagataccatcaaagagtacgggacagatgctttgagatttacactatctttgggcactgcaggccaggacctcaatctctctacagaaaggttgacgtcaaataaggctttcacaaacaagctgtggaacgcagggaaatttttgttacagaacttgcctgataaaaatgatgtctctgcatgggatgtcttgttgtctaataagttcgactcagaagcatcactccagaaactgccattgccagaatgctgggtggttacaggactacatgaactcatcgataaggtcagcagaagctatgataagtttttcttcggagatgctgctagagaaatatatgattacttctggggggattttgctgattggtatattgaagctagcaaaacacggctttaccactcgagtgacaagatcgctgctgctacagcccagagtgttctggtgtatgtgtttgaaaacatactgaagttattgcatcccttcatgccattcgtcactgaagaattatggcaggcatttccatacagaaaacaagcacttatggttactccctggcctaccactgaccttcctaaagatttgaggtccatcaaacggttccagaatttgcaatcattgataagaggaatcagaaatgttcgagcagaatattctgttgagccagctaaacggatatcagcttctgttgttgctactgcggatgtcctggaatacgtatcaagggagaagcaggtcctagcattactttcaaagcttgacgttcagaacgtacattttactgaatcagcaccaggcgatgcaaaccagtcggttcacattgttgctgatgagggtttggaggcgtatctacctttggctgatatggttgacgtgtctgaagaggttaagcggctctccaagcgcctctccaagatgcagtcggagtatgatgctcttgttgcccgactcaattccccaagttttgttgaaaaggcccctgaagatattgttcgcggagttcgtgaaaaagcgtctgaggcagacgagaagatctctctaactaaaaatcgtctcacttttctgcaatcaaccattaccacttaaatacagtaatccacggggactctaccaggatgccattttgatcgatgacgcaggacaaaactgattgttaatagtttttggttgaaggatatgatagattggcaacgaagttgtgccttgtccagcagaaacacacattctttctagttcatatctgttgtctcttgaaacttaaaacatacattcggctaggcatataatttatattcctgacttatggttttagagcctttcgggatgcccttagttgaggtaaattttgttctgcctctgaagttgtgctgatgccattgttagtaatattcatattttgtaaggtgggcgcacgttattagatatgaatgatctgtaaggtcggtgcacatgtataatcaatgactatagtttcgggcgtcagtcggtttctgctgattccca

SEQ ID NO: 15106 - DNA, 877 bp, Zea mays
aggggcctttttttttggggcttttttttttttttttttttttttttttgaaaaggcgaaccagatcaaagcaaagggcatggtccctctggtggctggtgatacaacaacttgatgtgcagatccaaaagcaaaccgagaaaacacactgaccgatctggaaagcagccacgaacacatgcagtgacttgagaccatacacacacagttcatacacgcacatgtacacagtagtagtagtatatatacgcagcagctatttagcttggcacgcgtatagcttgcgcgtgcatatataattgcatatatatgagcaccatggttcgtgcatacacatatatgtgtgcggtcgtaggagtaggatgcgttgcatgcagtaggctcacgctcatcagatcagttcagaggccaccgtagcggacgtcggagaacttggacttgagccacttgacgctgctgcggacggtggtcttgatccggccctgcgtggcgaacacgttgtacgccgccacgcggcgccgccgcttcgcctccgggtcgtcccggccgctcggcccgttgaagctgtacgacttgccggcctgcccgggcccgccgccgacgtcctcgtagtcgtacccgcctccgcagccgtagtacgccgacgagtgctcgtgcggcaccgacctgcacttctccatggatcctcctcctcttcttcttccttggattcgctcgcgcgtgtgtgtgtgtggtggagatgacgagtgatcgagagaggtcaggggaggccgggaggggtgggtgatggatgaatgaatgaatgagtgaagcaactaattgcagtcccgcccggccccgcgtggcccaatgtgttttttcccggccggcctcgagg

SEQ ID NO: 15107 - DNA, 919 bp, Zea mays
  misc_feature (71)..(72): n is a, c, g, or t
  misc_feature (77)..(77): n is a, c, g, or t
  misc_feature (79)..(79): n is a, c, g, or t
  misc_feature (81)..(81): n is a, c, g, or t
ggtcaggggaggcccggacgggtgggtgatggatgaatgaattaatgagtgaagcaactaactgcaggtgnngcttnangncctcttttttttttttgggaactgaaaaggcgaagcagatcaaagcaaaagggcatggtccctggtggctggtgatacaacaacttgatgatcagatccaaaagcaaaccgagaaaacacactgaccgatctggaaagcagccacgaattacagtgacttgagaccatacacacacagttcatacacgcacatgtacacagcagcagtagtagtagtatagcttgcgcgtgcatatatacgcagcagctatttagcttggcacgcgtatagcttgcgcgtgcatatataattgcgtatgagcatcatggttcgtgcatacacatatatgtgtgcggtcgtaggagtaggatgggttgcatgcagtaggctcatcagatcagttcagaggccaccgtagcggacgtcggagaacttggacttgagccacttgacgctgctgcggacggtggtcttgatccggccctgcgtggcgaacacgttgtacgccgccacgcggcgccgccgcttcgcctccgggtcgtcccggccgctcggcccgttgaagctgtacgacttgccggcctgcccgggcccgccgccgacgtcctcgtagtcgtacccgcctccgcagccgtagtacgccgacgagtgctcgtgcggcaccgacctgcacttctccatggatcctcctcctcttcttcttccttggattcgctcgcgcgtgtgtgtgtgtggtggagatgacgagtgatcgagagaggtcaggggaggccgggaggggtgggtgatggatgaatgaatgaatgagtgaagcaactaattgcagtggcggcccggccggcctcgaggtacccaatg

SEQ ID NO: 15108 - DNA, 941 bp, Zea mays
accagctcgccatagttgattcatacacaatacaagcatcctccccactactggcgtcctctctctcccttcagggtagatagaaatggcatcctccagcttttatcttctcagcgttcttctcatcgtgatcgcttcttgcgcctgggctacggatcctagtcctctccaggacttctgcgttgcagacaaagaatcgcctgtacgtgtgaatgggtttccctgcaaggatgttaaggatgtcaaggtcgacgacttcttcctagcagccgacctcgacaagccaagggatacgacgatgagcaaggtcaagtcaaatgtcacattgatcaatgtgatgaagctggccggcctaaacaccttgggcatctccatggctaggattgactatgcccctcaaggacagaacccaccacatacgcatccccgtgccactgagatcttaactgttcttgaaggatcactctatgttggttttgtcacttctaacccagacaacaaattcattagcaagctactcaacaagggagatgttttcgtgttcccacaaggtctaatccactttcagttcaatccaagtcatgacaagccagcggttgccattgccgcactcaacagccaaaaccctggtgccattaccatttctaacgcagtatttggatcgaaaccaccaatcgcggacgacgttcttgccaaggcatttcaggtggacaagaaggttgtggattggctccaagctcagttttgggaggacaaccataactaagtgaagaggctattgcccttgtttttacacaccgatgtaataagtaacaccactgttttcattcatttgtttgatgtagcaaactactatataccttttgccatacatatgtattctgttaaaatgtcaaatgaccacagttacaaacgtaaaaaaaaaaaaaaaaaaagcggcc

SEQ ID NO: 15109 - DNA, 1230 bp, Zea mays
gcacccgtcctcctccttcctcatcctagtcggcccattggattcgtccgacgcactgacccgcacaaccacccccaccatggccgccgcgccaacaagctccggcgactcgccgccgcctgcgcagccggagtacggttccatctcctccatggtagcctcgtctgcctcctccgctgcagccgcggtcgcggacttcacccgctgggccgagaccttcggcaccgagaaggccgacgccgccaaggctgccctaacctccgccaccaccttggccacctcatctgcctccgaggcggcttctgcttcctccaaggccgcgtcctccgcctatgcggccgcctccgacctcaccctcgtcgccaaggaggagctggaatggttcaagacggagtactctgctcacgagcagattgtgttcggcaagatcaaagagggtgtcgtcatggcgataatgcatccaggcattgctgcaggctccgcaacccttgcagggattatccttttcaaaaggccaaggagctaccttattcaacgagtacggcacatgtttgttagcaaggagaccctactttctggagtacaagctgaagtgaatcacatgcggcagactgtgaatcttgtatccaatgaacgccaaaagctgttggatagagcagcaactgcagagaaaagattccaaaaaggatggaatacactcagtgaagaagggcgttccattcaacacgagttgcgtgagattagtgatattgaaaaccaagcagtaggtctgaagggaattcttgatcagcttcccagagcacatgcatctgaatttcggtcgaagatgtctggcctagcttctcaggttaagaaggagaagcgagtgctcaacgccgccctcacgaagattgtgaactacggtgtccccatctgactgccactccagccagttgttctgagggtccattgtatcagatttttgtgaaggaagacatacatgttcgatgtgtagggtgaacgctatactgcccacttggtttcgagaaaaggaaaagagaataagttgtgacccgtgcagatttctaatgtcgcaaaagcaacatctttgaaacctgagtaacagatgacattttgctatgttttttttttgttggcttattgacatgttcaccgccgtcagctgccgtatgcctgggaatcgtagaagtggaatgaaatttttggttgaaatcaaaaaaaaaaaaaaaa

SEQ ID NO: 15110 - DNA, 1183 bp, Zea mays
  misc_feature (26)..(26): n is a, c, g, or t
cattgggaccctcgaggccggccggngacacgcggacgctaacaaaaaccagaccacgcggaacggcaacagcaagctgcctctctcccttgcgcgcgcgtgatttcatcttcgtccgatcccatcccaccccaccccacctcaccggagcccctctccccctaactcctccggcagctgctccgatcccgaaccgtgattcgctcgatggcggcaaccgcgggcggcaacaagatccgcaacgccaagctggttcttcttggggacgtgggcgccggcaagtccagcctggtcctccggtttgtgaaaggccagttcgtcgagttccaggaatccaccatcggcgcggctttcttctcgcagaccctggcggtgaacgacgagacggtcaagttcgagatatgggacacggcggggcaggagcggtaccacagcttggctcccatgtattaccggggcgctgcggctgccatagttgtctacgacatcacgaacgcggcctcttttacgcgtgcgaagaaatgggttcaagaacttcaagcacaaggaaactcgaatacaatagtggctcttgccgggaacaaggctgatttgttagatacgaggcaggtgtcagcagatgaagcaaaggcgtatgctcaagagaatggtctcttcttcatggaaacttctgccaaaacagctaccaatgtgaacgacgtgttctatgagattgcgaagaaactgcttcaagggcagcaggttcagaacccacaaggcgggatggttctcaaccagagaccacctgagaggatggtgagctcttcttcctgctgtgcgtgaagcgcaagatggaagtgtggatcacatgttccatggcctggactccaggagtattaggtgcgcggaggcggggaagaatgttgccgaatcttgtgaagtggttgccatcccagttgctgaaatcctgtacttttcactgcttgttcgttgccgtgttccttgtaaatgtgaatacttattactttggagactcacgtcacgtgttcttacggtgcatgatcgtgcttgtctttctatgacttgagagaacagagtgaaacaagacagattcgtttgattcacttataccaattacacgatgataaaatttatgggttaaaaaaaaaaaaaaaaaacgtgaggcaaaaaaaaaaaagcggcc

SEQ ID NO: 15111 - DNA, 1142 bp, Zea mays
aacacggcacgctaacaaaaaccagaccacgcggaacggcaacagcaagctgcctctctcccttgcgcgcgcgtgatttcatcttcgtccgatccaatcccaccccacctcacctcaccggagcccctctccccctaactcctccggcggctgctctgatcccgaaccgtgattcgctcgatggcggcaaccgcgggcggcaacaagatccgcaacgccaagctggttcttcttggggacgtgggcgccggcaagtccagcctggtcctccggtttgtgaaaggccagttcgtcgagttccaggaatccaccatcggcgcggctttcttctcgcagaccctggcggtgaacgacgagacggtcaagttcgagatatgggacacggcggggcaggagcggtaccacagcttggctcccatgtattaccggggcgctgcggctgccatagttgtctacgacatcacgaacgcggcctcttttacacgtgcgaagaaatgggttcaagaacttcaagcacaaggaaactcgaatacaatagtggctcttgctgggaacaaggctgatttgttagatacgaggcaggtgtcagcagatgaagcaaaggcgtacgctcaagagaatggtctcttcttcatggaaacttctgccaaaatagctaccaatgtgaacgacgtgttctatgagattgcgaagaaactgcttcaagggcagcaggttcagaacccacaaggcgggatggttctcaaccaaagaccacctgagaggatggtgagctcttcttcctgctatgcgtgaagcgcaagatgggaagtgtggatcacatgttccatggcctggactccaggagtattatgtgcgcggaggcggggaagaatgttgccgaatcttgtgaagtggttgccatcccagttgctgaaatcctgtacttttcactgcttgttcgttgtcgtgttccttgtaaatgtgaatacttgttactttggagactcacgtgttcttacggtgcatgatcgttcttgtctttctaagacttgagaacagagtgaaactagacagattcgtttgattcacttatatcaatcacgcgatgataaaatttatgggttttaaggttgctaaaagaaaaaaaaaaaaatcggcgc

SEQ ID NO: 15112 - DNA, 959 bp, Zea mays
agggtttgtttctttgtacggcgaccctgcggacgctgacacgcgcttgcttcctctgctcggttctattgtacccccccacaggttcttcttggggacgtgggcgccggcaagtccagcctggtcctccggtttgtgaaaggccagttcgtcgagttccaggaatccaccatcggcgcggctttcttctcgcagaccctggcggtgaacgacgagacggtcaagttcgagatatgggacacggcggggcaggagcggtaccacagcttggctcccatgtattaccggggcgctgcggctgccatagttgtctacgacatcacgaacgcggcctcttttacacgtgcgaagaaatgggttcaagaacttcaagcacaaggaaactcgaatacaatagtggctcttgctgggaacaaggctgatttgttagatacgaggcaggtgtcagcagatgaagcaaaggcgtacgctcaagagaatggtctcttcttcatggaaacttctgccaaaacagctaccaatgtgaacgacgtgttctatgagattgcgaagaaactgcttcaagggcagcaggttcagaacccacaaggcgggatggttctcaaccagagaccacctgagaggatggtgagctcttcttcctgctgtgcgtgaagcgcaagatgggaagtgtggatcacatgtcccatggcctggactccaggagtattatgtgcgcggaggcggcgaaggatgttgccgaatgttgtgaagtggttgccatcccagttgctggaatcctgtacttttcactgcttgttcgttgccgtgttccttgtaaatgtgaatacttgttactttggagactcacgtgttcttacggtgcatgatcgtgcttgtctttccaagacttagagaacagacatgatcgtgctgtcaaaaaaaaaaaaaaaaaaaactcgaggaagggcgccggtacc

SEQ ID NO: 15113 - DNA, 1393 bp, Zea mays
tccacgcgtccgggagggagtacacaacacacgatttgattttgcaccatcctcgacgctaaagtacccgggcctcgtggccggcccgcacttcttcccaatccatcaatcgtgttctcgcgagccagaggccagagccatggagaagagccgggtgctggtggtgggcggcaccgggtacatcgggcggcggctcgtgcgggcgagcctggcgcaagggcacccgacgctggtcctgctgcggccggagatcggcctggacatcgacaagctccagatgttgctctccttcaaggcccagggcgcgcggctggtggaggcgtcgctggaggaccacgcgggcctcgtcgccgccgtggcgcaggccgacgtggtggtctcggccatgtccggggcccacatccgcagccacaatctctccctgcagcataagctcgtcgaggctatcaaggaggctgggaacatcaagcgttttataccatcggaattcggcatggatccatccaagatggggcatgctcttgaaccaggaagggttacatttgatgaaaagatggacctaaggcgtgcaatagaagatgccaacattcctcacacctatgtttctgccaattgctttgctgcttacttttgcccaaacctatgtcagatgcgcacccttttgccgcccaaagaaaaagttcatgtatatggagacggcaatgtcaaagctatattctgtgatgaagacgatgttgcaacgtatacaatgaagtctgttgatgatcctcgcgcattgaacaagacactatacataagaccaccagaaaacgtcttgactcaaaacgatgttatctcgaagtgggaaaagctttccggaaacgttctggagaaaatccacattcctgcagatgaattcttggcttcaatgaaaggtactgacctggccaatcaagccggagtgggacactattaccacattttctatgaaggctgcttgacaaattttgaaatcggcgacgatggagcagacgctactctgttgtacccagaggttcagtatacccgcatggatgagtacatgaagagatatctgtaaccgctaaattgaactgttggcttgtccgaacgaattcatatatggcggtggttgtatgtgatgaccctttcagattattgatgctatgttgtgtattacctagtctcggtatttcatatttttaatattatttcgcagctcctttgtttgattcatctaaaaaaaaagcaaaaaaaaaaaaaaaaaaccccaggaattaggagtcgcgatatttattattatcgcgcggggagtagttggtaaataaatcgcttattgcgagtattttggcccatgaataaggccttaaagaaaaaaaaaaaaaaaaaagcggcc

SEQ ID NO: 15114 - DNA, 800 bp, Zea mays
gcaccatcctcgacgctaaagtacccaggtctgccggccgggtcgcgaccctcttcccctttcccatccatcaatcgtcctctcgcgagccagagctatggagaagagccgggtgctggtggtgggcggcaccgggtacatcgggcggcggctcgtgcgggcgagtctggcgcaagggcacccgacgctggtcctgctgcggccggagatcggcctggacatcgacaagctccagatgttgctctctttcaaggcccagggcgcgcggctggtggaggcgtcgctggaggaccacgcaggcctcgtcgccgccgtggcgcaggccgacgtggtggtctcagccatgtccggggcacacatccgcagccacaatctctccctgcagcataagctcgtcgaggctatcaaggaggctgggaacatcaagcgttttataccatcggaattcggcatggatccatccaagatggggcatgctcttgaaccaggaagggttacatttgatgaaaagatggacctaaggcgtgcaatagaagatgccaacattcctcacacctatgtttctgccaattgctttgctgcttacttctgcccaaacctatgtcagatgcgcacccttttgccgcccaaagagaaagttcatgtatatggagacggcaatgtcaaagctatattctgtgatgaagacgatgttgcaacgtatacaatcaagtctgtcgatgatcctcgcgcattgtgacaagacactatacataagacccaccagaaaacgtcttgactcacaacgatgttatctcgaa

SEQ ID NO: 15115 - DNA, 653 bp, Zea mays
  misc_feature (632)..(632): n is a, c, g, or t
  misc_feature (634)..(634): n is a, c, g, or t
  misc_feature (653)..(653): n is a, c, g, or t
actagttgccaaccccacgcacgttctgcgacgagctaccccatttccccacccccagcaccccactccccgcttccatttccttggaccccaccaccgcgcctacatccctcagagctcagatgcagccgccggcgaccgagatgcacccggccgccgacgccgccacctccgccgccaccgcgcaggccgacactactgctcgcgccgccgtccccgcatccgatccacccccgcccccgccggcgccggcggctgagacggtcgatccgccgcccccaccgccagcgccggcgcccaagacggtcacctggagcgagaagctcacgtccgactcgccgacgcacgtgcacgccgccgccgcggcggagtccagccagtacgtgtcccgcgggcccgcatcctcgtctaagggcgccgtggaggcgatgagggagacgctgtcaaggtgggggaagtcgtggggggagaccaccaagctggtcgagagcctcagccgcgacacgtggcaacacttcaagactggacctagttttactgaagctgctatgggacgcctagcacaagggactaaagttttagcagaaggaggctatgaaaaaatatttaagcagaccttcgaggttcttccngncgaggagctgaaaatatgn

SEQ ID NO: 15116 - DNA, 936 bp, Zea mays
ggtccggattcccgggtcgacccacgcgtccgcgtgcgagctgcgactttgcttaacacggaactgaaacgggttgacccacatcacaattcacaacaccagttgccaaccccacgcacgctctgcgacgcgcgagtcccccttccccactccctgcttccgtttcctcggaccccaccaccgcgcccccattcctcagagctcagatgcagccgcagcccgccgagatggaccccgcctccaccgcgcaggccgactccaacgccagcgccgccgtccccgcagccgatccctccccgcccctgccggcgccggaggctgacacggtcgatccgccgcccccgccgcccgcaccagcgcccaagacggtcacctggagcgagaagctcacgtccgagtcgccgacgcacgtgcacgccgccgctgcggcggagtccagccagtacgtgtcccgcgggcccgcgtcctcctcgtctaaaggcgccgtggaggcgatgagggagacgctgtcgaggtgggggaagtcgtggggggagaccaccaagatggtcgagagcctcagccgcgacacgtggcaacacttcaagactggacctagttttactgaagctgctatgggacgcctagcacaagggactaaagttttagcagaaggaggctatgaaaaaatatttaagcagaccttcgaagttcttgcagatgagcagctgaaaatatgctttgcgtgctatctctcaacatcggcgggtcctgtcatgggagtcttgtatatttctacagcaaagattgctttctgcagtgacaatcctctgtcatacaaagctggaaataaaactgaatggagttactacgaggtggtcattcctcttcaccagctaagaacaggtaatccttcagtaagcaaattaagtcccccggagaaatacattcaggccc

SEQ ID NO: 15117 - DNA, 1874 bp, Zea mays
aaaatacaataaatagtactaaaataaaagggagcaaaagtcgtataaagacaccgggacctcgtcgtcgcttccccccactgattccgagtccatctttccccgccgccggccgtgatccctcctcgccgctgaccgccccgcctgccccggcattctcccgctccagatccagggccctcatagagcctccgctcgatctgccccccggatcggattggccgccgcgcatctcatgggtgaggaagctgtccacttcagcgtcgtcgacgccaaggactgcaaacagagtgcctttgaagtcggcgataagacgtatgttatttgtagatcagatgatgatttgaaaacatctgctgttaaaattcacgacaagctcactcagacttggctctcacccacaatacttggggaacagccacttctaaccaagtcacagtctgtgattcctgtcagtgatgagaagatattagttatcgagaagggtgttcccttgaatgagtccatctggttccttgagatagacaccccctttgttaagcaacaacggaaaatcaaggaaacagaagttgtttcttggagcaagggagtaatcggcgttggccaaaaaccagttgtgattagtggtccttctggtgttggtaaagggacattgattgcaaagttgatgaaagactatccatcgaagtttggtttttctgttagccacactacaagatctccaagggaaaaggaaatagatggtgttcactaccacttcacagaacgaatcaagatagagaaagatataagcgagggcaaatttcttgaattcgctcatgttcatggaaatgtgtatggcacaagtatcgaagcagtcgaatctgtaactgatgagggaaagaggtgtattctcgacattgatgtccaaggagctcgatccgtgagggcttcttctcttgaagcaatattcatctttgtatgccctccatcgttcgaggaactagagaagcgccttcgggcacggggtactgaaacagaggagcaaatccagaaacgactcagaaatgctcaggctgaacttgatcagtccaatgaaccaggtctctttgatcatcttttggtcaacgatgaccttgagacatgctatgagaatttgaagaagttgctttctctggatgatgaccaagaagattcagatgatttttttaacaaggaggacaaagaaactgcaagttactctatcgtgtccaaaactgactcagaaattttgttgcaatctgagactaacgaaggcaaaaatggagccatacacttgctggcacttgatttgtcgtctctctcaggcggtgcgcctggacgaacaaggggccttaagataggctcagttaactccttttgacaagggcttatattggcgttttagatgacccaaagcattcttcaaaatgatacagcagaagcactgacttgaattttggatcaattcccatgagctgatatcttcaaaaacatcttagttaggaaaaagaaggaaacgaaaatggaatttatttccatttgttatttgtttgggtgccacaaggaggcaaaatcatagcaaggaattgtaccttatttttttagggattgtgtacttttctgctgttgagaggtatttggtggttggataatgtgatggagcctatctaaatgttctttcatagtggtctgaataacattgagcccattgctgaaaaaaaaaaacacacttgcggcccttgggtcatgttgcacagaactaactcatagttctgaccaaagagaaatgtttttttatgttaagtacgccctgccgtaagcaagtgtaaactttggggacaaattgcttttcatgtatttgagtttgatatttg

SEQ ID NO: 15118 - DNA, 2286 bp, Zea mays
  misc_feature (180)..(180): n is a, c, g, or t
tgatttttgtaagttcaagaaatatttttacttccactgtgtactgatgcttcattgtgttttttctgatggtggatcccattatccttcagttaacaaggaggacaaagaaactgcaagttactctatcgtgtccaaaactgactcagaaattttgttgcaatctgagactaacgaagncaaaaatggagccatacacttgtatgtcattggcccaatattctttttacagaattccttgctattagtatttgctgttgaattcgtgcttaaacttgtttatgtatatgagcttccctgcaggctggcacttgatttgtcgtctctctcaggcggtgcgcctggacgaacaaggggccttaagattggctcagttaactccttttgacaagggcttatattggcgttttagatgacccaaagcattcttcaaaatgatacagcagaagcactgacttgaattttggatcaattcccatgagctgatatcttcaaaaacatcttagttaggaaaaagaaggaaacgaaaatggaatttatttccatttgttatttgtttgggtgccacaaggaggcaaaatcatagcaaggaattgtaccttatttttttagggattgtgtacttttctgctgttgagaggtatttggtggttggataatgtgatggagcctatctaaatgttctttcatagtggtctgaataacattgagctcattgctggattatgttgtgattctttcaactcttgggtcatgttgcacagaactaactcatagttctgaccaaagagaaatgtttttttatgttaagtacgccctgccgtaagcaagtgtaaactttggggacaaattgcttttcatgtatttgagtttgatatttgaaaatggtacaagtatgttcccaaacgtcactttgcgactatgtttacaagctcggccctcttgccggtctggtcctctcgctggcgtcgccgcaggcgtcacgcgccgcttcatcggacaccgtccagaccggcggagcctccgatgcctctgccggccctagcgcgagttgcgagtgcgctttggcgtggggcagcggtcggagtgcgatggcgatcgcgagcacgcccgccttggctcgaggcagcgatcggacggcgaggacgatggcgcgtcgcatattcacattgtacctacgagagggccttcttgaagaaagggaagacaggtatgctttcacctcaatccctcactgatctgtcattctgtcttctgaattaagacttagctccagattagcagcatttaccggtcaccagttatttcttccctgttacccttttccagatctattttttagtctgaattcaaataaccaatattgccgttcaagttgagaaaatatcgttctctttgtctctaatagctgcatgtgtggacatcattaagacgtgtcacaaacatgatgcacctgtgacctgacacaactagaataagaatgaaacttgagcatcatggttcgaattccattcacatcaactggaaatatatttagctcatcatctgtaaagaagtactggcatgtatttaacatgagactttcaaaagaacggcatacaagaggctgcaggctcactgcaaatcaacattgctcagaagtcaggccggttggtcttggaatagcaaaggggccctggcagcaaagcgaatttagatatgttagggggtgtttggttcctttagtcatactcctaaactttagtaactaaattttagtccccaaaaattctttttgggagaactcatttagtcctaccgtttggtagtttggggattaaaagtgactaaattttagtcaactaaagtttaggaggtgggaaccagatagccccttcatcactattttgatttgcttaggtcagttacggattctgatcagcgtatttatcttgaattcttgtgcaaaatcgacaaccaagagtattttctaaattttactccgtagactataagggtgattcatgcaaccaaagtcaaggcttagctatagattccttttattctagccatgagaaaaccgtggtaaactatgagaaagctgaaaactatttggttgtatcaattatagagcatgacgacatgacaacctagcagaaggcggcacggtccgagaggacaagggggcggtacgccgtgctgtgggaccctatgcccgcagcgctaggcccaagtgtcatgactgtagtcacgcttacccgaacgtgtccatgacgttctacacgagcagtgtgcacgatggtagca

SEQ ID NO: 15119 - DNA, 1600 bp, Zea mays
tatcggtcgtgcccgcagtcgactcgacgcccacttctgtagctgtagactgtagttctgttcctccccactcactcctgcgcttcctcgccgcgcggttccttctccctgatcctcctttggcttcgcggttcatggcgatgtggagggccgccgctaggcagctggtcgaccgggcgctcggctcaagggccgcgcacacgtctacaggcagcaaaaagatagtcggggtgttctacaaggccggggagtatgccgacaagaaccccaacttcgtcggctgcgtcgagggtgcactcggcatccgcggctggctcgagtcgcagggccatcagtacattgtcaccgatgacaaggaaggccccaactgtgaactggagaagcacattgaagacatgcatgtcctgattaccaccccattccacccagcttatgtcactgcagagaggataaagaacgcgaagaatcttgagcttcttctcacggcaggaatcggctccgatcatattgatcttccagcagctgctgctgcgggcttaactgtggctgaggtcactggaagcaacactgtctctgtggcagaagatgagctcttgcgcattctgattctgctcaggaacttcttgcctgggtaccaacaggtagttcaaggcgaatggaacgtagcaggcattgcccatagagcttatgatcttgaaggaaaaactgttgggactgttggggctggtcgtattggcaggctcttgcttcagcgtcttaagccctttaactgcaacctgctttaccatgacagacttcagattgacccagagcttgagaaagaaattggggccaaatttgaggaggacctggatgctatgcttccaaagtgtgatgtgattgtgatcaacacacctcttacggagaaaacaaggtttgtattcatcatgtacctgacatttccaaaatagtttgacagtattttctgagttttgtttgctgtttttttttcagaggcatgtttaacaaagagaggattgcaaagatgaagaaaggtgtaattgttgtgaataatgctcgaggagcaatcatggatgctcaagcagtcgcagatgcatgttctagcggtcccattgctggatacggtggtgatgtgtggttcccacagccagcaccaaaggatcacccctggcgctacatgcctaaccatgccatgacccctcacatctctgggactacaattgatgcgcagctgcggtatgcggatggtgtgagggacatgctggataggtatttcaagggcgaggacttcccggtgcagaactacatcgtcaaggaaggccagcttgccagtcagtaccagtgaccgcgcgagatgttgctgtgctgtgtaggcttttctaggcttttctggtgagaagctgagaggaagaaactcctgttccggacttgcgttactgtatgagtagctctgagaaatctgtcagcggccccctgtaataaaagaataccctgctggtatctcaccgtggagatcaataagtcccctttttttccttctctgtcactgaactgcatgcactgtcttttttcggctgtgacaacgcaaatggtaaccaac

SEQ ID NO: 15120 - DNA, 1711 bp, Zea mays
  misc_feature (1580)..(1602): n is a, c, g, or t
  misc_feature (1640)..(1686): n is a, c, g, or t
  misc_feature (1694)..(1700): n is a, c, g, or t
acattcattgggtacctccgggccggccgccacttctgtagctgtagactgtagttctgttcctcttcctccccactcactcctgcgcttcctcgccgcgcggttccttctccctgatcctcctttggcttcgcggttcatggcgatgtggagggccgccgctaggcagctggtcgaccgggcgctcggctcaagggccgcgcacacgtctacaggcagcaaaaagatagtcggggtgttctacaaggccggggagtatgccgacaagaaccccaacttcgtcggctgcgtcgagggtgcactcggcatccgcggctggctcgagtcgcagggccatcagtacattgtcaccgatgacaaggaaggccccaactgtgaactggagaagcacattgaagacatgcatgtcctgattaccaccccattccacccagcttatgtcactgcagagaggataaagaaggcgaagaatcttgagcttcttctcacggcaggaatcggctccgatcatattgatcttccagcagctgctgctgcgggcttaactgtggctgaggtcactggaagcaacactgtctctgtggcagaagatgagctcttgcgcattctgattctgctcaggaacttcttgcctgggtaccaacaggtagttcaaggcgaatggaacgtagcaggcattgcccatagagcttatgatcttgaaggaaaaactgttgggactgttggggctggtcgtattggcaggctcttgcttcagcgtcttaagccctttaactgcaacctgctttaccatgacagacttcagattgacccagagcttgagaaagaaattggggccaaatttgaggaggacctggatgctatgcttccaaagtgtgatgtgattgtgatcaacacacctcttacggagaaaacaagaggcatgtttaacaaagagaggattgcaaagatgaagaaaggtgtaattgttgtgaataatgctcgaggagcaatcatggatgctcaagcagtcgcagatgcatgttctagcggtcacattgctggatacggtggtgatgtgtggttcccacagccagcaccaaaggatcacccctggcgctacatgccaaaccatgccatgacccctcacatctctgggactacaattgatgcgcagctgcggtatgcggatggtgtgagggacatgctgaataggtatttcaagggcgaggacttccccgtgcagaactacatcgtcaaggaaggccagcttgccagtcagtaccagtgaccgcgcgagatgttgctgtgccgtgtaggcttttctggtgagaagctgcgaggaagaaactcctgttgcgtacttgcgttactgtatgagtagctctgagaaacctgtcagcggccacctgtaataaaagaatgccttgctggtatctcaccgtggagatcaataagtctcttttttttcccttctctgtcactgaactgcatgcactgtcttttttcggctgtgacaacgcaaatggtaacgaactgcatgcgctaaaaaaaaaaaaaaaaaaaaaatttaacaagcacatggtaatgaaatcagaaannnnnnnnnnnnnnnnnnnnnnnagagtgcctccggcggggtaacctgttttcaaagagannnnnnnnnnnnnnnnnnnnnnnnnnnnnnnnnnnnnnnnnnnnnnncttctagnnnnnnnccccgggccct

SEQ ID NO: 15121 - DNA, 2276 bp, Zea mays
gggaccctcgaggccggccgggccgggaaacaaaggaaccgatcagagagagagagagagcgcatagtcgatcatgaagggtggcaagaaggaagtggccggtgcggtggtggccatactgctggttctgcagctcatggcagctccaccgacggccatggccgcccgctcgccgcacggagccgtgccggatggctccctcgccacgacgcccaaggtgacgatgctgtcggccacgctgtgctacacgggggagacatgcaaatacattggctgcctcactcctgcttgctcctgcaactatagtgatcgtctatgctacatcatatttactcctgttgcttgaggccattccgcgaagccacaactcttacatgcatgcgccggccgacgacgacgctgcctctcgtgagcttctgttcaagtgatgcatgtttcaaggcatccatggatgctttatgtatatgatatgcgtattattaattagccgtgtcagggaaccgggcagaagggggtgttgttttatttacgtcttctggtgatcaaataaaagggaaaaaaaaaaaccattgggtttcgggacgccggggcggccccctgttcctcctgtcatcttctcctcctcagaaacccaccaaccccgtccagccgccggctgtctcggccgccgccgccgccgccgccgccctatcccggtccttcaggcgaaccaggttggtcatggccttcaacaagatcaaggtctccaaccccgtcgtcgagatggacggcgatgagatgaccagggtgttctggaaatctatcaaggacaagcttatattccctttcgtagacctcgacatcaaatattttgacctcgggcttccacaccgtgatgctaccgacgacaaagtcacagtggaggctgcggaggccacactcaagtacaatgtggctatcaagtgtgccaccattacaccagatgaagcaagggtaaatgagtttggcttgaaggctatgtggaagagcccaaatggcacaattaggaatattctgaatggcactgtgttcagagaaccaatcatctgcaaaaacatcccacggcttgttccagggtggacaaaacccatttgcatcgggaggcatgcattcggtgatcagtaccgggcaactgatgcagttatcaaggggccagggaagcttaaattagtttttgagggaaaagaagagcaagttgagctggaggtgttcaacttcactggtgcaggaggagttgccttatcaatgtacaacactgacgagtccatccatgcctttgctgacgcttctatggccactgcttatgaaaagaaatggccattgtatcttagcaccaaaaacactattttgaagaaatatgatggcaggttcaaggacattttccaggaggtgtatgaagctggttggaaaaccaaatttgaagctgccggcatatggtatgagcaccgccttatcgatgacatggtagcatacgcacttaagagtgaaggagggtatgtctgggcttgcaagaattatgatggagatgtgcagagcgatttcttagctcaaggttttggctcattgggtttgatgacttcggtactggtgtgccctgatggaaagacgatcgaagctgaagctgcccatggtactgttacccgtcattaccgtgttcaccagaaaggaggtgaaaccagtacgaacagtattgcctcaatctttgcgtggacaagaggacttgcacacagggcaaagcttgatgacaatgctagactacttgacttcacccagaagcttgaggctgcctgcgttggagccgtcgagtctgggaagatgaccaaggaccttgcccttctcgttcacggatcttcaaatatcacgaggagccattacctgaacacggaggagttcattgacgctgttgctgatgagctcagatcaaggctggcagccaactcgaacctttgaaatccttgccgaagttgtggtgctttcctgcgcgacgctttcgaaccgtttttattatgtcgccattttctttccctgtgccaccaccctgatgaatgaagaaggcctgagctaggcgaacatctgcaggctgcagcagtatgccaaatcattatcattaccgttaccattaccaattggagattgccgtagatttccgcgattatgggaactcatttacctgattatctgatacgtttgaaataaaaggtcgcccattagaatgaaaaaaaaaaaaaaaaaaaaaaacaaaaaaaaaaaaaaaaaaa

SEQ ID NO: 15122 - DNA, 878 bp, Zea mays
cattgggtacctcgaggccggccgggctgttcctcctgtcatcttctcctcctcagaaacccaccaaccccgtccagccgccggctgtctcggccgccgccgccgccgccgccgccgccgccctatcccggtccttcaggtgaaccaggttggccatggccttcaacaagatcaaggtcaccaaccccatcgtcgagatggacggcgatgagatgaccagggtgttctggaaatctatcaaggacaagcttatattccctttcgtagacctcgacatcaaatattttgacctcgggcttccacaccgtgatgctaccgacgacaaagtcacagtggaggctgcggaggccacactcaagtacaatgtggctatcaagtgtgccaccattacaccagatgaagcaagggtaaatgagtttggtttgaaggctatgtggaagagcccaaatggcacaattaggaatattctgaatggcactgtgttcagagaaccaatcatctgcaaaaacatcccacggcttgttccagggtggacaaaacccatttgcatcgggaggcacgcattcggtgatcagtaccgggcaactgatgcagttatcaaggggccagggaagcttaaattagtttttgagggaaaagaagagcaagttgagctggaggtgttcaacttcactggtgcaggaggagttgccttatcaatgtacaacactgacgagtccatccatgcctttgctgacgcttctatggccactgcttatgaaaagaaatggccattgtatcttagcaccaaaaacactattttgaagaaatatgatggcaggttcaaggacattttcaagaggtgtatgaagctggttggaaaaccaaattgagctgcc

SEQ ID NO: 15123 - DNA, 7975 bp, Zea mays
  misc_feature (6825)..(6825): n is a, c, g, or t
gcctgactggtgcattactggcacagcatggccaatgcatcttcaaaggttgttcagagatagcaatgatcagcatatttttagattcgaacctttttcttttcagccatgcatgccattttaaaagtgtcatactacagttttaagaatcagcttttgcaaaactacatgcatgagcagtttattccattcaggcccgcctgcaggcttcatggatgtccaaactatccatctcactgctgtggcatgatatgcaggttgtttcaatggaatgtggacccaacatgtcattcccaattcaatgcaaaaaagtttgtttaagcaaaatttcgtgatattgtttatatgtcataaagttgaatcaaggtttttatgttctgacctaatcttacgtcattcctgaaatttcagaactaaataagcaaactttacccgttttcttttgtttttcctgttttgtattttaaaactccatgtagtcagtacagtaataattcctgacttatgaaactttattcgtcttaaatttcaaattctgttttcgatactggattggctgatatattgctatatgctcatttgagctaagtcagattccgtgttcagttcgtattgctgccaggttcctggtatttgcagttatcatacacttgcattctttctagaggattacatttcggagggctggaccttatgtttgttatttgtatgcagccaagtgaagagaatacatatgcagacattgaagcagtgtaccaatgcttagaaactgagtatgggatcagccaggaagacattatcttgtacggacaatctgtcggcagtggaccaacattacatttagcctctcgtttgcctagattgcgtggggtggttctccacagcgctatactgtcaggcctccgtgtggtttgccatgtgaactttactttctgctttgacattcacaaagtaaatagctccaactgattctcttttgcagtctgcagctcttatgcttagggttaccctttactaatgtctagccaaaattatttctgcagaatgtcaagaaaataaaaaaggtcaaatgcccagtgctcgttattcatgtaagtgttctctaataggatatcttgcttttgtctatttatattgcttgtgtgattggacaaatagcattgaatttcaactaacatgcactggtttcttagctgtgaatttctcagcagtgccatcttttgtacattttaccactttagcatcccttctgatggcagtgtgctgttgttgttcctgctacactactcgtgtatgtattggagcagtaatgttattactggcagtagtaacattgaatcatttcattgctcattacacacactagtgcatcacggcatcaaaacatccttttagtagaaaaaagcaatttcatgtatacctttgctgtgcaggttcagatatagtcatataggaatcaaagatatgaacagttcgaatctatttagaagaaaatccatttaatatctggaatccctttgatcacgttctctcctctgaaatcttgctactcctagcaggacaattcatcaacattggtaccattttcttggtgcagaccttgtgctggagcctctgacatgagtggggtctataggaagggataaaccgagccaagcccaagccttccctcggtaaatgcggagaggcatctttgaacccgtgacatggtgccaatccttggcttatgaataatttctttaaaccaaatgtttgagcctatctgtggcctcttacataggtttagataatgggggtaacctccagcctctacactaaccagggatgtatacagtatacagccataagtagatggaaaagtatacaggtggaggggggaaacagcagaactacaaggtccagaaacaaagtcttcattcagcctgttcatttttaatactcaaccctgccgctgcaaatgaacacttgcacagcactgttccttgtgctgctgcagccgcagctggctgttctgaacaggcccaaagcctcagctagcgaggagttaagtcaactgaatccatgcccttttatgggctgggatgtcactagcagttgtagtagttccctacatgcccctgtgggacctcaccgacttgattcagcctgtaaccaaccccaaagaataattgggcattggtagtccttgcgttagtggtcgttggcctttcgctgttcatccagtcatagtgaacagcttatgttgtcttggctgagcccaaccaaatttataaccatgtcaagctagtaggcccaaaagaatcgggaattttttggcccaaattttgcacaggcctaactgaatctagtctgagtgtgtagcttgtttgttgctgcctgcaagtacgtattcttaagcctgtgacctcaaaacatgaaagaccaaatctttagggtctgaaagccaccagttgacatgaagcagtcttgttaccaggctcttacagtaataaatctagtttcccgcctgtctgccgtacttatatattccacttgacatgctcttacttactcacagttttcatgttactgattggtatcagtctgccatcgttagttagttagctagctgcacagggcaatagatcataggtgttctgagttgtacctagatcacttgttcgatcaaggatatcttatatttgggatgctgatttctattacttaaaattttgtagaccccggattaggaaccatcaaatcatggaaaccgtgcatgtgtttgccaaaagggttgcttgcgctgcacttgaaattacatcagaatacatcgccgaacaagttacacccgctgactgacgccttgcaggggacggacgacgacgtggtggactggtcgcacgggaaggagctgtggaggctggcgagggagcctcacgacccgctctggatcaagggcggcgggcactgcaacctggagctgtacccggacttcatccgccacctgtcgcggttcgtccgcgagatggagaccgtgacgacgaaggcccggctgaggaagatccggccggccctccaccagctccgcaagaaggcggcgcaccgggcaagcacggcggcgacgacgaccaccaccaccaccttcaccgccaactgctgctgccgcgtccgcgtccgcaagccgacctgccccagctgcggctccttcggctgtggctgctgcgggccgcttaggagctgcctcgcgctccggtttcccaggtgctgccggcctcctgctgcctgcttcacctgcggcggctgctgttggtcatgcaggtgcaggagctgcttcaagtgctgctgctgctgatgatgatgttgagacgtgcgtcaatgagtgccgcccgccgatcgatccctgcgcgcgcgcgcgcgcgtatggtatagtgaagaggaatgacagtggtcatgggatccctgctaacaaaccctttaaacgccgtagactataaaaaaaacctagatttgagctggtggctgctgaacgttgtattaacagatcccaggactccccgccgtttgtggttcctctcgttgtagttgcttgtcagattggtgattcgtctcattattaatccgactaatgtttgtgcggcctagagcaatgctaatgcctggactcgctgctcaatcatgggggcctcgcctcgccgctcgcattcatggtcatgcgtgcagagaggggattcaggaactggcgccacgttaatcatacagttccgtcgcgtacgtaccagtaccaccaccatacaggggggaggggacagctaatgaaatacgtaatgattctgaattctgtgcacaaggccttgttggccatgtgagggaagggggcattggagcattcggctgcctgtgcattccagttcaggcgagaatgggaggcggcaacggagcacgacgacgattgatgcaccacgccacaggccacagcgcagtcgctgcaggtagaagaaggagaacagtgtgtagtgtgtagccgcggcagcagcagtagctcaagtgtccccagtacagtggtgtggtccatcgatgggagctgcgggcgggggccagcagcagcggtgatgggcgtctccggcttgtctccttccttcctccaatcatccccgaccgattgacaatatctctccattatttagttatttcctcgctcatgatatcttttctttatttcttttttttttctttctttctttttcttccgttgctgcttgctaggccatgcgtctgacggctccggagaacaataccataggggaacggggacacggaattattggcgattggttttcttttgccacagagaaagaggagaaaaaacgatatgtgcattcctatgcactacctacctccacctgaatttaaaattcgtttgattttttttatatggtcggctagtcttgttcaaaagttttacggaaaaaatttaaagccatgtcacggaaaaattaaataatatgggcttcgcatatcgtatatacttcctaatgcacgcacgacgacgattcgttaattgaattagggaggagacccggttggtgcagatgcaatggagcgctgcagcgattctcttggcagtccttgtgaaaaccgagacagtagtgaccggtttaggcctgtttgattcggtttttttatcagattttctgagaatttggctatggagacaatctgactatgttaggattacatgcgaaggaagataaatatatccataaagtttaggatcatactattgcaataaattgacgaattatgagtttatgttgattttagatggtttttaacaaatcgatttttatagaaattagctgaaaagctaattgtttgtcagtccgcagcagtttttttgtggctagaagcaagccgttaaaaactgaaacaaacatgcacatagtatatggctgtgctgccaacgctctgcgcttcactaactggctactactcgtacctgatttgtatttgtatttcctcctgcttaattgcccggttgccagtagcttgtgtgcattattgaggcgcggatcttctagctaggtagctagggcatctgtccggtgcactgcatagagctagagagttggtagctggccgtggggagtcatcctgatgtgcggtggctgtcatgtagtagtagcactaacattactagctagcatcaccggccgcgccggtagtgataccaatatcaacaagcaacaaagcgagtatagcagaatgatcgatgcggaatgaatataatgcctctcgctcatcactagctactagctacagctgctcttctgcctactgctgcccagctaattacgaagaagaagaagagctcggcatcggagatgtgttttttcaatcaaggccggccggctggctagagcgaccttgttcgtcacgaagaagagctgcgagactcgatcgtgagaaaaaataaagcttttgagtgccatggcatatgcagcgcgcgtgaagggaggagggcccgcggtcaccggcggtggatgggatgcttgggttgattcgatgccatgccatgttccgcacatgcgcggcgcatgtcgtggcgtcgggcgagagcgagatgccatgcttggaagcttcccttgtccatcctggcagcagagtggctggcggcacccaacccaacaccagacaaagcaacaacccggccgacccgagaggcgcaccatcgcgcgcaccgcgccgaatccatcccggcccattccgtgcgcacaccagacctgcagaaggcagcagcggcacgagcacgacggaccgtcaccgccaccgccaacggtaatcggttagctcggccgtcgcgccagccagccgcaccgacaccgcgacacgctcccgcggccttcgagaagggagacgcgcgagccgatcgtgcgggcgggtcgggtcaggggcggcgctttccgttagtggttggcaacgtgttatcaagagtatgtaggcctgccacctttctctctctttctctctctctctcactgtgtgtttatttttggcgcgagagggcagccgggcagcagaggtggactgctcgtccgtgatcttcctcgtccaagctactcctacataccactgccctgctggccacaatgtggtaaccgtgtgtgtgtgctgtggcctattgcaatccacccacagcagcagcaagctaggtgataaggtgaaacacatcgcatcgcgtcgtggtcgtgggtaggctaagctaacgggcaacatgtacttggcaacggtcggtgtggatgcctgatctcgacggaggtgacgtgttggcggctgtatgtactcgtgccgcacacagttcgttttgggagagagagagagagggtgcatcgtctagagctactgcgcagcaccccgtcttcttcttcgtctcttttgagcatgacgagtcatacataataagcttaattatagcccggacccctccccccccccccccccctctctctgctcctagctagaagccacgtgtgattggacagatagattgcacgaggtgacgcacaaacggtggttactgtgtcctccatggtcgtgtcgtgtgtgtctagctgcagggtcgttgcagtactcgttcgttttcgcccgctagctgcagcctgcaggacggttggcagcgagaggcgcgcggccgatgggggctggcggtgcacggagcaaacggcgcgagggggaggggcgtgtggaacagggacgccgcaccccgtccccgaccgttgagggaacgggggcgggaggacaggacagctgagctgcctgcaaggcatggttggtggggcccatcgtcgnctcggttgccgtgcactgcacgctaggcaacgtcctcgtcgtcgtcgccggtggcatggcatactgtcccaagacgacggacggtccagagagacgcctcaagacgtcgtccagagatgcgtgcgtggctctacctactactactactgacatgtcagggccggtccgtcgtgtattattgtaaggtgtacacgtacggtacagtgcatgtcagggccgtacgtagaaaacgtatccagtccgctgcttgctggtggcatttggtgtgcagtgcatgcatgcatgcatgcattgatgcatgtacgtacacgtacgctcgcctcgcctcgctcgctgctgcactgacggtctactgcccgtccgtcgtcgaccatcgcatcaatgcagcagcaagcatcatcgttgtatcattcttgctctgcaccgccgccccaccggcgcagaaaagccgcatgcacgctgcactccgatcctaagtgtcaaggcggcaacaacaaggacgaggatcagatcgagcacgcacatcagcttgccatcatatccggaagcgtgcagaagatgcagatcgtgttcggcaggctaggccttctggttccttccactcaaagtgaccaggctgctgtgtactactgtgccacagtgtcacacacacctttggagtttctgaagaagtcacgctgccttttctgcgtaaactgcatatgcaggccctaattaagggtacgctactttaggtttaggaacaagggtttctttttttctcgtcacacgaaacctcatgatcaatgctgcacgactgcacgccacgacgtatgtttggttacaagtatgtttttttttgggggcggccgggggtagctgagcgttgactgtatatagaatgctattttatctttaccttttctaagtacgtaattgactgacagaggtcaaataaattgaaacgtacatataacagcaggggagaacagtatataaaatacgatatgttggcccttttttttctctctctcttgtatttattaatcacaagtcaactggcgcgcgcttgtttttgatgttatacgttttcatcaagctaaatcaaatggttttatttgtatacaaaatatggcaacatgttctaccaccctaatgagtttatagatgg

SEQ ID NO: 15124 - DNA, 997 bp, Zea mays
  misc_feature (702)..(702): n is a, c, g, or t
  misc_feature (784)..(784): n is a, c, g, or t
  misc_feature (823)..(823): n is a, c, g, or t
  misc_feature (884)..(884): n is a, c, g, or t
  misc_feature (942)..(942): n is a, c, g, or t
  misc_feature (951)..(951): n is a, c, g, or t
  misc_feature (954)..(954): n is a, c, g, or t
  misc_feature (962)..(962): n is a, c, g, or t
  misc_feature (968)..(968): n is a, c, g, or t
aaggctgctgagcagagcagggcgagcgctcgctagtcggctagtgctgtgctgtgcagcggttgctcctcctggtcctgctactgctccgctctcctcgtcgcttgctcgtctttttttccacactgggcggatttctttctcgcaaggagcaggaggaggaggagggggaaaggtttgtccgtttcttgcgagagcccgttgcagagatccagccaggcagcaggattcaagaacctgacctttttgtgctctactccccgagagattttcacccaaagtttggtccttggagccgattcgatccctggaaacaaccaagtgaaggtgccgcaaatccgttgtgactgcacaaaatcccaaaacgcctctgccacctatctatttgatcgttgggaacctagctccatccatctgagccaagaaagcagcagccgcagggcgggggggaggggaggggagaggagaggagagggcgtcctcttccgagcagcccgcattgccgcctgtcgatgagtgagcgctgcctccgatgccgtcggggtgctcggtgtccagtctcgcggcgcggttcgccttcttcccgccggagccggcgacctacgccgtccggaaggacaaggccacgggccgcctcgtcgcctccggcgtaccgcgggacaacgccatggacgtcctgctcgtcgacaccagcaggggaanaaggtggtggccttctacttccggaacccctgcgcgcgcctaaccctgctctactcgacacggaaacttgccgacctcggcnatctgtacgacctctttgtgcattacaagtcatctcaanatcaacctgatggggatatgactattctggatatggtgcatctaatggcaagtaaaggaanaactctttttttcaagtatgaactatgtagcaccaggacataatgtttttttttctanaacacgcanganctgcaaanctttanattagagagagagaaacagattacatcca

SEQ ID NO: 15125 - DNA, 3068 bp, Zea mays
tgatgattgatgatcatttctcccagttaatatgtccggtgcaatcctccattttttttccaagacagtgacgttccaacagttcaacgccagttgtttcgtgcctttggcgtcagctttccaatggagcagcgatcaaagaagcgtcgtagcattaaacttctctcgtagtctcgtgatcagagttcagatggctcaagcaactgccaacagaataaacaatcaggcagggtgcgagcgaccagtgtaagcactgaaccggacaaacacaaagcgactgctggcagcaggctccactgagcaaaaacagaggattaggcgtttgtaattgtaaccactggcattagtttaaacagcagcaatcaagtgtcatcacactttggaccatttgcggcgattaacatatgccggcagttaggtaccgtcgtaacatgctccaggccacacaccttaaacaagctccgtgacatcaggcagaagacatgagataaagccacaccaacagggagttctcagtatgccaattggctggtcgagagagccagcaccagctcgggttctctgcccggccccctcttggcgactgatgttttttttttttggtcaaacaaaacttccatctttgaatgtgtcatttacactttacagcttcgacccatacaggccgaatatgatgcatacaaaaatgcctgcacaaacaaccaaccaatccctaatataatatgtacagccgtgccttccgggggaaggaaaacttctccccctagtcttatatattatatagtggcagagggcacctgcagttagtgaatgcagctgatttttttttcacacgccttgacctcagcaaatcgtcgaatgaatagctgcacgtgcatcttgatttcaagacattgcgcatttagctttgcagcttggccagatgtaccaaggatccgaacatgggtggttccatctccagcctaaatcgtttccacctgaggcctggttcggccactttaatcccatgcggatttctagtgttttaataggggccctctaactttgcgaattgatgcccacctgtatagcaatgtgaatcgacaggatgtaaaacttaaatgatattgaccatttgaaagaattgacccacaattgttgctactcatttactctgtgcataacaacaaccagattttttacagcagggaaaaaaacgaaactagggaaaaaatggaactcccacgaaaatagagaagccgagaacttactttcaagaagatgacatctctgacaaaattctttcggcctcgacgggtgaaccgttggcgatatcctccactactttacacttctccatataagcctacctactgaacttggtcttgattttggaaaaagcgagctacttctctgtacaattgctcgccctcgaatggcttggatacataaccgtccatttcagattttaagcactgttcgtgcgtcgcctggataacatctgctgtcatggctaatattggagttcgccactgccggagccctgcgcattccggtggggcttctccacgttctatttgctcatttagatctctttccatcactctaatcctttttgtggcttcaaatctgcaaggtaccaaatgcatgacacaagagaacaagaaaatgtaaatcggtgacaagagcaagtattgtttatcaactggatataggtacagatagtgtctaaagtatagtgagatgatgaatatacaaagataaaactcacccatccatttcaggcatctgtatgtccatgaaacaagcatcaaaactgtgaggaggtttcagttgcgtgattgctttcttcccgctatcagcacaagttacttctgcgccatatttcttcagagcgcctgcagcaaccttgagatttacaatattgtcgtcaaccactaagattcgtttcttgtgaagaaggctgcccagtgttgaattgccaagtactccattcctgcagtgcagtttatctatcccacccaatgctctgtgtagcgaaacctgaagcatgcttgctcgaagtggcttcataattacattcaagttaaattccctgaatatatgtgaattgcttttggcagtacttttagggttctccaaaagaaataactttgtagagtctggctgatctttgttcctcaatttagtaaccaaaagaggcatagagtgggattccttcagccaggtttctttgtcaatgagcacaagctttgcaatttgtgatccgcaattaattttagaaatatattgatctaggtcagttgtcaattcggtctgaactcccagtctctgtaaatggtacctagtaaccttggcacggaccggcctatgatctaccaccaatgcattgatccctttaaattctgacgatttattctcatttctgctggaatgggccctcgtaagaaccgcagtgaaggtgaaagtagaaccaacttggggtttacttgcaaatccaatctctcccctcatgagtccaaccaagcatttgctgatgcttaatccaatgccagtgcccccatggatgcgagcaatggatggacctacttgcatgaaagggcccggcccacgggactgagcatcgaacgggattccaacacccgtatcttcaactgatattatcaagcttattgagtctgatgcgatgggtgcaaaaggcatctcagatgagttcagttccctgctaaagactcgaaagttttcccaactgcgctttctgttcgccactgggtagccacttaaggtattggcggactgagttcccgtctcaacctcaagacaattcataatctcttcaacaacatgaactgtcaagtagatatgacccttctctgtgaactgtggaaaaatacagaactcttagccaacaaagaacaaatgcatatatgcatataaatatacaagggattatcctatttcctgctatcgatatatagtgatcgtcttacttttatagagttcccgacaagatttgtaatgatttgccttattctgccaggatcgccaattagtgcttgtggaacttggtcagaaacaaacactgccag

SEQ ID NO: 15126 - DNA, 6384 bp, Zea mays
gataatagtaagctttctaggtcttgatagttgtcaagctgcactatcttgaatctaaaatcgattaagtattggttttgcttaaaataagccttgacatgtctattaaacagtgacatttcgaataagtttacctaactggaggccacatcccagcgttgctagcgttttaatagggcccctaactctggggattgatgcccacctgtagcaatgtgaagcaacggtgatgtaaaactcaaatgatactgaccgtttgaaagaattgacccacaattgttgctgctcatttttattcgggtgcggttgccatggcatgaattatataatctgggcataccagcctcacatgttacagcaggaagaagaaaaaagaaactagggctaggggaaaatgaactcccaagaaactagagaagtcaagaacttactctcaagaacatgggatctctgacagaattctttcagcctcgatgggtgaaccccgatatcctccactattttacactccatataagcctacctactgaacttggtcttgatttaggaaaaagcgagctacttctctgtacaattgctcgccctcgaatggcttggaaacataaccgtccatttcagatttcaagcattgttcatgtgtcgcctggataacatctgctgtcatggctaatattggagttcgccactgccgaacccctacgcattccggtggggcttctccacgttctatttgctcatttagatctctttccatcactctaatcctttttgtggcttcaaatctgcaaaatgtgccaaatgcatgacaaaagagaacaagacaaatataaatcgatgacaagagcaagtactgtgtatcaactgaatataattacagataatgtctaaagtatggtgagatgatgagtatccaaagataaaagggataaaatctcacccatccatttcaggcatctgtatgtccatgaaacaagcatcaaaattgtgaggaggtttcagcagtgtgattgcttccttcccactgtcagcacaagttacttccgcgccatatttctttagagcgcctgcagcaaccttgagatttacaatattatcatcaaccactatgattcgcttcttgtgaagaaggctgcccagtgttgaattgccgactactccattcctgcaatgcagtttatctatcccacccaatgctctttgtagcgaaacctgaagcatgcttgcacgaagtggcttcataattacattcaagttatattccctgaatatatgtgaattgctcttgacagaacttttagggttctccaaaagaaataactttgtagagtctggctgatctttgttcctcaatttagtaaccaaaagaggcatggagtgggattctttcagccaggtttctttgtcaatgagcacaagctttgcaatctgtgatccacaattatttttagaaatatactgatctaggtcagttgtcaattcagtctgaactcccagtctctgcaaatgatacttagtaaccttggcacggaccggtctatgatctaccaccaatgcattgatctctttaaattctgatgatttattctcatttctgctggaatggaccctcgtaagcactgcagtgaaggtgaaagtagaaccaacttggggtttacttgaaaatccgatctctcccttcatgaggccaaccaagcatttgctgatgcttaatccaatgccagtgcccccgtgtatgcgagcgatggatggacctacttgcatgaaaggggtgaagacacgggattgagcatcgaacgggattccagcacccgtatcttcaactgatatcatcaagcttattgagtctgatgcaatgggtgcaaaaggcatctcggatgagttcagttccctactaaaaagtcgaaagttttcccaactgcgcttcctgttcgccactgggtagccacttaaggtatttgtatactgagttcccgtctcaacctccagacaatgcataatctcttcaacgacatgaaccgtcaagtagatatgacccttctctgtgaactgtggaaaatatagagctcttcagccaataaagaacaaatgcatatatggacataaatatacaaagggttatccaatttccatttgctatcaatgtatagtgattatcttacttttatagagtttccaacaagatttgtaatgatttgccttattcttccaggatcgccaattagtgtttgtggaacttgatcagaaacaaacactgccaactgctcccattgagcgtcatagtaaggaataaccaaaataaagtcagtgcatttataataaaatacagtaaaactgagggcgtgacagcaaggctgcaatctttgattacctccagtcctttctcctgtgctttcccacagaagagagacaaaatgtcatcacaaactgttctaagatcaaagggtaccacctcaagctcaagtttaccagactcgatctttgcctgatcaagaacctcattgatgagggataccagagttttgccactggcttgtgcggttctaacatagtcttgttgtgttgtgtccaaatcagtatccatgagcatttggagcatccctgcaaaaattggaaacattcatatctcctttcgccctaattaacaatgaaaattattgtacaatttagatacattagaacctcacctaggacaccattcattggagttctgatctcatgagaaacagtagccaagaactgcatgcaaaaacagcattgaattaataaggtgccatttttggtccctcgaaaaagagagaaaagaacaagcctttggcctccaagagaaacagtaacacaaacacgcatagtttgcagcgaactaatcacctgtgacttggcaatatctgcatcctctgcgcgcttcttgagcaaactcatctcctgaaagtcatcttcaactctggcaatccgttttgcggtagcatgaactatgtatccaatcagtaaagcaatcactagagttccaattgatgtcgttattgccatccaaggccaaggtgggctctgaatgaacctattaaagagaaacagatgagacacagagctttacaatgaatagactacaaggacaacacattttagttacgggtttcttagaagaggaaataaatcacctgcagtgcatcacatgcttccttgaagggtcaccgaagttcagtgtgctgacctggcacatgccactgcctgtatcattcgaaccatacatactgattggtctctcattagtagtatcgtaaacgttcaccatgatggattgcttgcccgcgagctggtgaagcaacttatcaacaagagcttcaatatcaaatatgccacctaaatagctgtttgcaaaaagaaaaagaaagggccagcggttattcagttgcaccattccttactggaaataggaggtcgggctcatgaagagcttaccctatagcagcctgaatgcgctcctgtggcctggcatttgcaggaagctcatacttgtacacagcataggtgaagatcactccaaggcgattattgagcagcttgaaaggagcagtaagaacacccttcccagattctctagctcggagtacgttgtcccggtcatcctgtaagagcagaagaggcgtaggagattagtggatggataacccctgttgcccatgacatgattttttttttggtttaccatgagtaattgaaccccggattaaaaagaaagggcaaaaaaaatccgatgtgaaaaaggggtagcaacagattatgactggtgagcacatggtgaacgccaaagactgcagctttttttacggctgtggtcctgctctgtaaaaaagatgaagaaatcttgcgaggagaaggtagggggctgggggcagggcgagtgctcacggcgccggatagcaagtcgaaggagatgacgtgcttgtaggcgtcctgcgcgaagattacgggagcatactcctccgccggctcccgcacctcggcgtcctcggcgttcccgggtccctgcgactgattcttggtcttggaggagtacatcttcttgatgctccatccctgctggcgctcaaactgctcccgctcggcgtgcgtgacccgcaccccgtacgcgaccccgctcgtcagcggccgctcgaacgccgtcctctccgcatacctcgcgttccttgcctgcagcaacggtcagatggatttcgtcacgcccgggagaagaaatcttgcttagccttagattgaggtgaaggaacactccctaggatagcagcacagcagggtacctacctggtcgatggcggagggtgtcttggagtggtggaaggtggagacgaggatggcgagcgcctggaggtggttcatgctgacgttaaattggtcctggagcatgcgcgcgcgctcgtcgcacatgctggcgagagactcccggcgcttgccgacggcctggtagctcatgcaaaggtagatgagggaggcgacgaggacccaagagctgacccagagcgggatgagccagctggagctgtcccgcaccttgcgcatccggtagttagtgaagaggtgcgtccgcagcgtcctggccgacagcttctccggcaggcggagcggcggcaggaggacgcgcatccgatcgaggctcaggaagccgagcccgggagcgccgcccttctcccccatcccggctccaccgctcctcccgcgcgccgtaacggtcattcccctttccctttcctcgcgggtcggggagctagcgctacatctccttccggacgccggcggcggcgcggcggctgatgctgcttctccggcggccgaggcccgcggcgcgcatgctccggcgggcgtccgcgtgatcgacggaccgatcgggggagacacggggcgggcgcgacgacagggggcggaaggggccgggacgcggggagctaatttatggaggccgccgtgctgtagcagccgcccacccgcccactgttggctccaattgaatgcccccgagggagcaggcacgtccgcaaggggcaggctttctttcctccacccccgcccctctctctttctccctctcttcccccttcctcttgatttctcgccgcacaggcttgatttctccaggaaggaagcagcggcaaatcttgggagccgctggtttgaccagacaccagaggacgggaggggagcagggcggctgaggagagaggatacgaatacgagacgactagcgagtagaagcacgggacggacgggaataggactagcaacagcaacagcgagcggacagaggatggtattggtgccggcgggagacgaggagattgggggagaaaagcgaccaagcaggtgaggtgcgacgagacgagagggtggaggggaggagactggggagaaaagcgaccaagctgcaggcggggtgagacgagagggtgaagtgggggcagaacagagcagagcagagcagcactgcagctgctgcggtaggggcgctctctcggctggtcgaggggagaagagggattggggcacggaggaagaagggaaaggagaggtggcaccagtcacaacagtaggagaggccagcaagccgtttgtcatcgtcgatagggagttttcgtatctctattttacggtggcaggtgtaaatttgctacagatagtattaactgctctatgctctataattttactgtttcgctgatgtgtcacgccaaatgaatacaccacatagatcctatttcgaatggagggatatgtaaaaaatcagctttaccttcaatcatatctctttgctaatcattgccagtggggcaataatgacaaagttgtagaccggttactatttaccatagcaaattttagttctcataataaaactaccagacatagacaagttgttggattagctttaatctaaaacggtttttactgtattttatatttgtgtattacacctgcagcggtatgaatatctagctttaatccgaagcgaagagactgagaaatgatgtctatatcaatatcaaatagttaaatatttcacatgcaggtggcaatctcatcttccccggacctactcttctatgggccttccccttattagattatcttcagtagtctcctttcaacattccgtgtttcatatttgatactgtaaacagtacatactatagtaaaaattgtgttttacacgtccatatacacacttagctgtagatagctttatggttagagcaaggttaataatatagcttataataggggttataatgttgtcatgtcatgtactattagctaaaagtctagtcaataagttatatgtttaaaacctggatcatctcttactctcaccaaatatggtgaaggctgtgtttaggc

SEQ ID NO: 15127 - DNA, 7024 bp, Zea mays
tcggtacccctgtttcatgcctttggcatcagctttcaaatggagcagcgatcaaagaaagcctcgtagcattaaacttctctctcggtagtctcgtgatcagaattcagatggctcaagcaactgccaacagaataaacaatcaggcagggtgcgagccactggtgtaagcactgaaccggacaaacacaaagcgactggcaggctccgttgagcaagaaccaaaggattaggcgtttgtaaccactggcattagtttaaacagcagcaatcaagtgcatcgctttggaccttttggggggcgattaacatattgcggcagttaggtgccgtcgcaatatgctccaggccacacattaaacaagctccgtgacatcaggcaaaagccgtttcatcagataaagccacaccaacaggcagccttcagtatagtgattggctggttgggagagaaccagtagcaggagagaaactcaggaagacaagctgatgacgaccgatgtatttgtcaaacaaaacttccatctttgaaaatgccatttacattttacagcttcgacccaaacaatacagaccgaagacgatgcacaacaaaatgccaacaaatgcctgcacaaacaaccaatacctaatatgtacagccggtaccttccggggaaggaaaatttctctccctactctatattatagtggcagaggacatctgcggttagtgaatgcagctgggcttttttttcacacgccttgacttcagattgtcgagtaaatagctccacatgcaccttgatttcaagacattgcacatttagttttgcagcttggtcagatgtaccaaggaaccgaacatgggtggttccatctccagcctaaagtgttttccacctaactggaggccacatcccagcgttgctagcgttttaatagggcccctaactctgcggattgatgcccactctcaagaacatgggatctctgacagaattctttcagcctcgatgggtgaaccccgatatcctccactattttacactccatataagcctacctactgaacttggtcttgatttaggaaaaagcgagctacttctctgtacaattgctcgccctcgaatggcttggaaacataaccgtccatttcagatttcaagcattgttcatgtgtcgcctggataacatctgctgtcatggctaatattggagttcgccactgccgaacccctacgcattctggtggggcttctccacgttctatttgctcatttagatctctttccatcactctaatcctttttgtggcttcaaatccatccatttcaggcatctgtatgtccatgaaacaagcatcaaaattgtgaggaggtttcagcagtgtgattgcttccttcccactgtcagcacaagttacttccgcgccatatttctttagagcgcctgcagcaaccttgagatttacaatattatcatcaaccactatgattcgcttcttgtgaagaaggctgcccagtgttgaattgccgactactccattcctgcaatgcagtttatctatcccacccaatgctctttgtagcgaaacctgaagcatgcttgcacgaagtggcttcataattacattcaagttatattccctgaatatatgtgaattgctcttgacagaacttttagggttctccaaaagaaataactttgtagagtctggctgatctttgttcctcaatttagtaaccaaaagaggcatggagtgggattctttcagccaggtttctttgtcaatgagcacaagctttgcaatctgtgatccacaattatttttagaaatatactgatctaggtcagttgtcaattcagtctgaactcccagtctctgcaaatgatacttagtaaccttggcacggaccggtctatgatctaccaccaatgcattgatctctttaaattctgatgatttattctcatttctactggaatggactctcgtaagcactgcagtgaaggtgaaagtagaaccaacttggggtttacttgcaaatccgatctctcccttcatgaggccaaccaagcatttgctgatgcttaatccaatgccagtgcccccgtgtatgcgagcgatggatggacctacttgcatgaaaggggtgaagacacgggattgagcatcgaacgggattccagcacccgtatcttcaactgatatcatcaagcttattgagtctgatgcaatgggtgcaaaaggcatctcggatgagttcagttccctactaaaaagtcgaaagttttcccaactgcgcttcctgttcgccactgggtagccacttaaggtatttgtatactgagttcccgtctcaacctccagacaatgcataatctcttcaacgacatgaaccgtcaagtagatatgacccttctctgtgaattttatagagtttccaacaagatttgtaatgatttgccttattcttccaggatcgccaattagtgtttgtggaacttgatcagaaacaaacactgccaactccagtcctttctcctgtgctttcccacagaagagacacaaaatgtcatcacaaactgttctaagatcaaagggtaccacctcaagctcaagtttaccagactcgatctttgcctgatcaagaacctcattgatgagggataccaaagttttgccactggcttgtgcggttctaacatagtcttgttgcgttgtgtccaaatcagtatccatgagcatttggagcatccctgcaaaatcggaaacatcatatctcctttcactctaattaacaattaagattattgtacagtttagatggactagaacctcacctagaacaccattcattggagttctgatctcatgagaaacagtagccaagaactgcaagcagaaaaggcattgaattaataaggtagtaaggtaccattttttggcccctcaaaagagagagaggaaagaacaagcctttcgccttcaagagaaacagtcaaataagcatgcatagctattatttgcagcgaagctattcacctgtgacttggcaatatctgcatcctctgcacgctttttgagcacactcatctcctgaaagtcatcttcaactctggcaatccgttttgcagtagcataaattatgtatccaatcagtaaagcaatcacaagagttccaattgatgtcgttattgccatccaaggccaaggtggactctgaatgaacctattaaagagaaacagatgagacacagaaccttacaaagaatagactacagggataacacattttaattacaggtttcttagaagagaaaacaaatcacctgcagtgcatttcatgcttccttgacgggtcaccaaagttcagtgtgctgacttggcacatgccactgcctgtatcattcgaaccatacatactgatccgtctatcattagtagtatcgtaaacgttcaccatgatggattgcttgcccgcgagctggtgaagcaacttgtcaacaagcgcttcaatgtcaaatatgccacctaagtagctatttgcacaaaaaaaaaaggccgacagtaattaagtcgcacggttactgactggaaataggaggtctgactcaagaaaagcttaccctatagcagcctgaatgcgctcctgtggcctggcatttgggggaagctcatacttgtacacagcgtaggtggagatcactccaaggcgattattgagcagcttaaaaggagcagtaagaacacccttcccagattctctagctcggagtacgttgtcgcggtcatcctggaagagcaaaagaggcataaagattagtggatagatagcccctgttgctcctgacatgattttttttaccatgagtaattgagcccctgattaaaaagaaagggcaaaaaatccacggtggaaaagggggtagcaacagatcatggcctgtgactggtgagcacatggtgaacaccaaagattgcagcttttttacggccgtgggcctgctctgtgaaaaagatgaaatcttgcaaggaaaggggcggggaggctgagggcagagcgagtgctcacggcgccggatagcaagtcgaaggagatgacatgcttgtatgcgtcctgcgcgaagattacgggagcatactcctccgccggctcccgcacctcggcgtcctcagcgttccctggtccctgcgactgcttcttggtcttggaggagtacatcttcttgatgctccatccctgctggcgctcgaactgctcccgctcggcgtgcgtgacccgcaccccgtacgcgaccccgctcgtgagcggccgctcgaacgccgtcctctccgcgtaccttgcgaacgtggtctgcggcaacggtcagacagatgagtttcgccacggccgacggtggagaaatcttgcatggattcgggtatgtggtggaggaaggaaaggggctacgacagcacagcagtactagagcagggggtacgtacatacctggtcgatggcggagggtgtcttggagtggtggaaggtggagacgaggatagcgagcgcctggaggtggttcacgctgacgttgaactggtcctggagcatgcgcgcgcgctcgtcgcacatgctggcgagcgactcccggcgcttggcgacggcctggttgctcatccagaggcagatgacggaggcgaggagcacccagaagaggacccagagcgggatgagccagctggagctgtcccgcaccttgcgcatccggtagttggtgaagaggtgcgtccgcagcgccctggccgacagcttctccggcaggcggagcggcggcaggaggacgcgcatccggtcgaggcccaggaagccgagcccgggcgcgtcgcccttctcctccatcccggccccgccgctcctcccgcgcgccgtaacggtcatccccctcgccctctcctcgcgggtcgcggagctacatcttccggacgccggcggcggcgctgcggcggccgaggcccgcggcgcgcatgctccggcgggcgtccgcgtcgtcgacgggccgatcgggggagacacggggcgaaaagggggccggaaagcggggagctaatttatggagtccgacgtgctgtagcagccgccccacccgcctactgttggctccaattgaatgccgggcgcgaggggctggctccctttcctcttgcgtctctcgctccgtccctccctcttgatctctcaccgctcaggcttgattcctcaagcaaggaagcagcggcaaatctcgggagccgctggctttgaccagaggacggcaggtgggagcagggcggcggcggcggcggcggcggcagcggcgggtgggagagaggatactagacgaccagtgagaggaagggaagcacgggacgggaatagcaacagcaacaggccaacagcgagcgagagcaggcacaagtgaacaggaagcaaaaactagtggggtggggtggggtgcgtgggagagccggaacaccggagcagagggatggtattcgtgtttagggagacggggagattggtctgattggaagaggggagtggagaaaagcggccaaacaggtgaggtgagaagagagagaaacggtggaaaagggggagagcagaacagagcagcagcaggcagcagctgtggtagggtcgggcgctctctctcggtctcggctggtagagaggagcggagggattgggggacgggcggacggaggaagaagagaaaaggaggggaggtggcgccagtgggagaggccagcacgcaagtggctcctcctccccctacccccacccgacagacacacacactcgtactaatcaccttcgtcactccgcggggctcggagcaagcaaaggaagggaagaaaaaaaacacccccaatcattccatattggtgctttggttaggtttgttttggacaaatctacagtgtcctattgaatggcacttgccgtgaatccagggggtatgatctggtcaacaaaaagaaatacaggagatggtgtaacagatctggcctcacgtgtcaacctcacagcaagtgaactccttaatctttccataccactctcttcgtacggttctctgataaggcccaacattttaaaaaaacagcgtacattacttaaaccaggtacacctattaatacagcagcgctctatctgctcaaaaaacgcaatgacagaagtaaatatattagaattttttgtcaagattggaaatagtttttatgcgccacagatatcaataataacttgcatatatttgtttaaagttgaaatgtttggcttttttattaaaaaattgagaacgtaagctcccgaacggtggtaaggtaaagccactcgatcgttagttggcgccttggcggcttcgtgcgtgcgacggtagtagggtggggactgagggggcggtgggcatggtggaaggataagaagacgagatgagcagagggggggccccgcaagcactgcggctgcgggacaggttgttgtcttctcttcccccggtggggttgaggaggagacgaccggagccgatgatcagctgccaggctctgttatagtttgatgctacgtaatctagcagccaggctagctagccaggggtaatcggatcggaactatatttgtttttataattttattcgaaatcgaatatagatagcttcgagtgtgaatatgaatacagatattttgggtgcaaatacggaactagtcggacactgataactttagtaacagatttttttctcgaatattgtgtacgactccattacacacatatcacagttgttataatcatttagcgactttttgagtctaaacgttttttaaattatatgtagatatatgttatgactctctaaaattttagaaattcatgaatctatttatgtattgttaattttttttatagaaaatcatcaaaatacaattaaaatcatagaatattttagtatagactcaaaattacaaataaataaccaatattaatgaggattaattgtatgcatactactcaact

SEQ ID NO: 15128 - DNA, 1108 bp, Zea mays
cattgggtacctcgaggccggcccggccagcggccaccgcgaccctcgaggccgccccttctatctatctactatatatcgatccacccatccctcgcagctccaaagcattgaagcaaagaaccctgcaactgcaacaagccctgacgcttaatacatcggccggcactcgatcggcagcagatcaaagatggcggcggaggagggggagaaggcgaagagcggcggcggcgggcagcagatgacggtggtgcgggggctggacgtggcgcggtacatggggcggtggtacgagatcgcgtcgttcccgtccttcttccagccgcgggacggccgcgacacgcgcgccacctaccggctgctggaggacggcgccacggtgcacgtgctcaacgagacgtggagcaagggcaagcgcgactacatcgagggcacggcctacaaggccgaccccggcagcgacgaggccaagctcaaggtcaagttctacctcccgcccttcctccccatcgtccccgtcgtcggcgactactgggtgctctacgtcgacgatgactaccagtacgcgctcgtcggcgagccgcgccgcaagaacctctggatcctgtgcaggaagacgagcatcgacgaggacgtgtacaaccagctggtggagcgggccaaggaggaaggctacgacgtgagcaagctgcacaggacgccgcaggacgacccgccgccggagagcgacgccgcgcccaccgacaccaagggggtgtggtggttcaagtcgctcttcgggaaatgactgcccgtcaccgcacgcgcgcgtgctccggtactgtgcttgcagttgcagcaaataaaaccaggcctgagtgagtgaggattggtattttagctttgtagtatctgtctcgctatctgtgtgtgtggaactgtggactgtgctgttacgttatacgtgcatgtatttttaagatttctctagctaattgcatcgatcggcgaggtagtcacgcaaaaaaaaaaaaaaaattgcaaaaagccctatacgtctagacgcggctttgcttgacagccaaaaaaaaaacccacgcgtccgtcccacgcgtccgcggacgcgtgg

SEQ ID NO: 15129 - DNA, 2989 bp, Zea mays
  misc_feature (2666)..(2666): n is a, c, g, or t
atgccaccttttgcggtctttaggaccaatattttggtgcctcaacaaatatgtacatataactaggaatttgctatcaactatggttagcttacaacccattgtaatataacacatccaatctggacgtgatcctatatttgcatatcccaacttttcagtggtacaaacatatttatgcttacatattttttcattcatattacataccgtcttctacacatatattactaagatacacattgtttatatacactcacaacatcaatttacttaatgtctatatacatcaaatcagctatttaattatgttataaaaaaactcgcgcaaggcgcgagcaagtttctagttagatatatatccatgcaactttgttatatatattagacctcatgcagaagcgtgattttttaggacttcgtttcggacactgatgtgtttggtccctccataaaacaacagcggcaaaatgaagggaggaaatgcaggtgtttgtttggaatagaatagatggtgatctaataaggaacaagtaagcaaagacacaaatggcttcgtggactcgtagctgcggttccagaaatgggtcgcgagggccaacgctggttttccgatagatggagagatgctacagcaacacggtatactactgatgcagagatgatcagtaaagctaaagcagcacagttaccttggcgtacaagtcaccacgtgcagacagaggggacgacgactggcccattgggcaagcagacaaacgctcgctaagcgttccagagccctccacgtctctctcctcgcacctgcaccgtatcttgtattgctcttgcgctgctccagattaataaacgacccccgcaaccaaagacctctccccttctatctatctactatatatcgatccacccatccctcgcagctccaaagcattgaagcaaagaaccctgcaactgcaacaagccctgacgcttaatacatcggccggcactcgatcggcagcagatcaaagatggcggcggaggagggggagaaggcgaagagcggcggcggcgggcagcagatgacggtggtgcgggggctggacgtggcgcggtacatggggcggtggtacgagatcgcgtcgttcccgtccttcttccagccgcgggacggccgcgacacgcgcgccacctaccggctgctggaggacggcgccacggtgcacgtgctcaacgagacgtggagcaagggcaagcgcgactacatcgagggcacggcctacaaggccgaccccggcagcgacgaggccaagctcaaggtcaagttctacctcccgcccttcctccccatcgtccccgtcgtcggcgactactgggtgctctacgtcgacgatgactaccagtacgcgctcgtcggcgagccgcgccgcaagaacctctgggtatgttatgtaagccaattaattgccagctcttccacctccaagctgcatgtgtgctcgcgcgctcatgcatgtacgtgcagatcctgtgcaggaagacgagcatcgacgaggacgtgtacaaccagctggtggagcgggccaaggaggaaggctacgacgtgagcaagctgcacaggacgccgcaggacgacccgccgccggagagcgacgccgcgcccaccgacaccaagggggtgtggtggttcaagtcgctcttcgggaaatgactgcccgtcaccgcacgcgcgcgtgctccggtactgtgcttgcagttgcagcaaataaaaccaggcctgagtgagtgaggattggtattttagctttgtagtatctgtctcgctatctgtgtgtgtggaactgtggactgtgctgttacgttatacgtgcatgtatttttaagatttctctagctaattgcatcgatcggcgaggtagtcactcaggggattatgtgagtttgcaaaacgccaaaacagtcgatacgcgtatagaatttgcttgcttgcttgacagccagccaactgttgtcgaatgatagttctggcgttgctaactgtcaggcttttgaaagcgagtcaaagacggtccagctcgcgaaaggtaccggcctgcctgcgcagcagaacaaacctagctacgaggcattaattcgtttgatgtgcctttttggactcaaatcgattctctctctctttttagaataaatactagcactaaattagtaatatcagtagagttttctattttgtactcatgttccttcttagcattcaaagctagcctattggattcaaaattaaaatgtgaaaggctaacgagtcaaacttttacagatagatggggggttttagaccagattaaatgccgagtggcatggtttacattgaaagcctaaatattgtctattactagggataccaggtcacggttggtttaaagtgcagccgaacgacttcaagtttatgggtttaggctttgtttaggtactccagtattgttctcaattcacatgagtgtaaattagtttaagttacatctaatccacctcaatataagtggattgagatctatactaaagccttagatagctcagaaaccgacccacaaatccactcaatgcttatattcgacaccgcgatggcttgtgccactgcccctgcccccgtcccagatgccctcgctgcgccgggccccgtctgccgncatcatccctactccgcccccgttttgtccaccacacaccctcgcccccagtccagcatccttctccgctacctctcagtggctccttgggcctgcccggctgtcgtccccctcgcccccttgtttgagttctcgctcagaactccttcatcttcaacctacactccatcgtgcacccaggttcggtgatcgcctcccgctcactcctgcgtccgattattctaattacaacattgttcaaaacttgttgagctttctcctatcctcgcctcgtactgtctcactgtctctctagtctcgtcgttcgtgttccgcacgagtca

SEQ ID NO: 15130 - DNA, 2003 bp, Zea mays
cccctgaataggtactaactctaatatattttatttttctattcctatattttgataaccctctgtgtttaacgaccagggccgtagtaaaacggcctgtttgaagtaactctttccaacttttagttgctagctattagcaacgtgaatccaaacatgacccagcgtaggacatttcccccgcgacacatttgtatacctcacaaaaaaatcacagctccacatgtaagtaccaatgcaaagttaagaacgtttgttgaactatcgttgtcttgaacataatggaatttctgctggcacacgaatggtaacggtaccactttacacaaatggtaacgatactactttttttatatatatggttacacaccgtgaggtacatcccgaccgacacggttctacaaatgtaaaggcgttctggttggctggttgctgtcagtgtcacaaatagttacagatctctgtggtggttctgtacaacatataataatcgtcgtaaggatgatggacttggagctaaaaacatacaaactagaactttttttttttttttttctgatattggcgcacaggcatgtatagtatatttatatgttaatatgtatcgtacatttggcaaatgccactgccatgtggggactggggagtcgtccatgaatggtcgacgtcagctggctgtgtgtttgtacggggaaaggtagagccctcgtgccatgcagcagccgcagcagcagcaagcgtcttcacatcatcaggtacttggagttctgctggatgagcttgtccaccacgatgtcgtaggccttctgcgtggggtggaagccgtcccagaatatgtagtcgggcgcgttggggcacgcgctgtggtacgcgatgaagatggcggcgttcagcaccgtgctgccgcagcaaccttcgctcacgtccttgaaaccgtacgaagctggattctggatgaggtcgagcaagttgtagtatatgtcgacgtagacgaacttggagccagaaccgctccgctccgcgttgaggcgctctatctccttggagaccctggagttgtacagctccgacgcctggttccttgccggatcgcactggcgcgacgggctccccgcgagcgtgatctgtgacgggcagcatcctagtggcggcacgccgaggaacgctatcctctgagctcccatgtcgttcagagtccttgtgaagttgatcgccgaggagacgaggaagtcgacgtaggacgagaggtcgtactggtggcgtctgatggggaggatgaagtagttgtttacgatgtcgtttgcccccatcaccgtgaagtagacggcctgcgagacgacccgctccatctcctcctccccggccagggccgccagcttatccttgtagtcctggaacagctggagctggtcggcgctcgacagggtcgtcgcgagcttggacgtgagcggatcgtagccactgccgccgcaggcgaaggccacgccggtgagcaggtcctcgagctgcaggtcggtgccgatgaacggcggcagcagctccttgatgcccagcttggaagctaggaggtccccggggaccaagccgttggagaacctccccgtggcgacgccgccggggaagtcctgcccgtacggcgggaagttggccttggcctccgtcagccggttgttgttgttgcccgggtccacgatggagtcgccgaacatgaagatggccgggatcctctgctgggtggcggcggcggcggcggccgcggagccacgaccaccaccacctgccgccgccagcgccagcgccgctacgagcagcagtgcccggacgagccgccgccggcaccgcggcgcgtgggcgtgcccccagctgggacagggcgccgtgggagaccgggaccgatgagagtgagacgccattattggcttgcttgcttgcttgcttgtccagctgctggcccgcccgacacccacacacccacacggatgttctaggtaatggtctcgtgc

SEQ ID NO: 15131 - DNA, 3569 bp, Zea mays
atatatatatatatatatggttacacaccgtgaggtacttcccgaccgacacggttctacaaatgtaaaggcgttctggttggctggttgctgtcagtgtcacaactagttacatatctgtggtggttctgtacaacatataataatcgtcgtaaggatgatggacttggagctaaaaacatacaaactagaactaatgaatcattatgtatgatattggcgcacaggcatgtatagtatatttatatgttaatatgtatcatacatttggcaaatgccactgccatgtggggagtcgtccatgaataatggtcgacgtcaggccgtgtgtttgtacggggaaaggtagagccctcgtgccatgcagcagcaagtgtctgtcttcacatcatcaggtacttggagttctgctggatgagcttgtccaccacgatgtcgtatgccttctgcgtggggtggaatccgtcccagaatatgtagtcgggcgcgttggggcacgcgctgtggtacgcgatgaagatggcggcgttcagcaccgtgctgccgcagcaaccctcgctcacgtccttgaaacctggaaataataataaaaaaccaacgcttgcctgcagtacgatcgatatatatgaaagggccggttggtatctactagctagaaaaaaggagatagtagtatagggccgggctagctttaccgtacgaagctggattctggatgaggtcgagcaagttgtagtatatgtcgacgtagacgaacttggagcctgaaccgcttcgctccgcgttgaggcgctctatctccttggagaccctggagttgtacagctccgacgcctggttcctagcaggatcgcactggcgcgacgggctccccgcgagcgtgatctgtgacgggcagcatcctagtggcggcacgccgaggaacgctatcctctgagctcccatgtcgttcagagtctgaagaagaggaggaggaggacgacgaagaagaagaacaagaagaggaggaagaagcagaactcataatcataatcagcgtgtcattcagaaattaaagactaccggccggtacgtagtagtgtgtctacttatacgtacgtacccttgtgaagttgatcgccgaggagacgaggaagtcgacgtaggacgagaggtcgtactggtggcgtctgatggggaggatgaagtagttgtttacgatgtcgtttgcccccatcaccgtgaagtagacggcctgcgagacgacccgctccatctcctcctccccggccagggccgccagcttatccttgtagtcctggaacagctggagctggtcggcgctcgacagggtcgtctgcaccggccgcggcaaccaacggtctcaattgttacgtacgtagtagtagtaacggttttattcttctcagtctcagataacatcttcagtagtcagtacgtaggagtgagtgtgttaatgcagctagcttccggacgacgtgtaaagttaccgcgagcttggacgtgagcggatcgtagccactgccgccgcaggcgaaggccacgccggtgagcaggtcctcggcctgcaggtcggtgccgatgaacggcggcagcagctccttgatgcccagcttggaagctgcgcagtagcattgaagtctaaacagctgctatagtaggctagtgtgtagtgtgtattattattgtagttagggacggggatgaaacattattattcttcagctaataagtctaaacaactccacgtacgtacctaggaggtccccggggaccaagccgttggagaacctccccgtggcgacgccgccggggaagtcctgcccgtacggcgggaagttggccttggcctccgtcagccggttgttgttgttgcccgggtccacgatggagtcgccgaacatgaagatggccgggatcctctgctgggtggcggcggcggcggcggccgcggagccacgaccaccaccacctgccgccgccagcgccagcgccgctacgagcagcagtgcccggacgagccgccggcggcaccgcggcgcgtgggcgtgcccccagctgggacagggcgccgtgggagaccgggaccgatgagagtgagacgccattattggcttgcttgcttgcttgcttgtccagctgctggcccgcccgacacccacacccccaccccacgacgaccacgagttttttttatagcgcgcgccttccggtccggtgtgtgtgagcgagttcgctacgcttattgcgcgtgcaccgacgtgatggatcgtactatcggtccggctgcgtgctgtctgtgccgtctgtctctgcatgatccggtggttgcgcgttgcatcggccacgctgcagctattaatacgggtgtgcggtgtgtgtgacgtgaacgtggggaaggggcaagacgaaggaggaaggaggaagaagaagaagaggaggaggaggagtaggcgcgacggagaatattgtattcaggtagtgctgcctaactcgatcacagcacagatgcctctacgccggcctagctaggaaactccagtgtccagcctaactcgatcgccccacctaattaaactctctcttcaattcgaacacccaatacaccgaacgcgcggctgagggaacaccgtacccgaccagaatgaagacgccccatcgcacgacgttctggtacctcaagtcgttccaaggtgatggggggtagctcgatctgcatgcaatggtatgctcaatacaagcctaactctctattcaattccgacaccgaacacaccgaaaacccgcgcgcgtccctgtgggggtgccgagggtgcggccgcaccaggcccccaaaaatagagggccccttcgccactggacgatagcatttttatattaaacctatctattatagacacaaatacgtaaaaagcgatgcattatcgagttatcgactagtctcgtttatattcttaaactgtctcaattacttatcgaatactctatccgtttcaaaatagtatttgttttagttcttgatttttatgtttatattgatgatgatgaatccactaaagaagcaaaacaaattctagtttgatatagggagagtattataaactatacatatgatggttgctttggcagagagaagctttttaaaattgaaatatttttgtgaactatttttggtcaacaataacacaaaagatgttaaatgacttggtgattctatatatcgaaaaaagttgttggatgagattgatctcaataatataagagatgactttttatcacaaaatgttagaagatatttttaataatatcagataacaagtgttttttgctatattttacatttattatcttgtaaacttcaaaatagtgcataataatttttatatgtcaaatatttgattatatatgtatagttatatatatatttgtgtgtggatgggcctcgatatcgtatttcgcactgggcccctaaaaagttaggaacggccctgcaccagccgcccacacggcgcgctcttctggtacctcaagaccttaaatttccaagtgatggggtagctctgctctgc

SEQ ID NO: 15132 - DNA, 2536 bp, Zea mays
gaggaagggtctttggtgtaagcaaatgcttgacacaaaacgttctgagcttcgaaaagctgaatctgaggttgacattatgggagacaaggttaatgcactcttgagtcttgttcaaaagatatatgtaactcttgagcactactctcctgtttttcagcatcatcctgtgctattggatgctttcttgaagacatgcaagcttgttgcaggtatcagaagcagacaaaaaaaggacttgcaagatacaatctaagttggagcagcaagtttagagtggcctaaaagacactagagagagattaatttcgtcggtggaggaacactacacagtcgcaactcacaaggctgtgaaattgatctatggccaaattgacaccgcaaatctgcagccagaaggaagttgaggtagtccattcgacagaattttgaaatctagggtatgcatttcaagggcattaagctgtaatatatttacaaattgtagcaatgcatttttctaaacatagtttgataatggatgcagttatactgtctctgctcactccgcagatgattggattcatgtcctgtatggtgtatgtagaagtctatgcactttctaatgtacaaattatgatagttcaaattctgtgagggtgatctcattttttgtcagcagcgtatgtagaaataacttagctgttatacaagccatagtcatattgtaagcatagtaacttcaaggctgtcttttacttgattctggtattttcatcgttcttataaattttggagtcctgtttgtactaatggttttataacctgcatagacgttatgtactgcatttgtccattttcaaggaagcaagcctttctagggcaataaaatagattttgtatacatagttatctcaattgtttgatctatatttatgattaaaatttcattagtagtttcttttaaaaaattggaattccacagtgattgagcatttgagtgatgtatgcatggctgattgctataacttactgttgccattgcttggttgtttgcatgagcaacagatgacagaaactgatgtaagtggagttactttgcttactatcatgcttgctatcacatatttgatgactatttcaaatttcaccagaacaaatctcatgtattgacacacattttctctccgccactatttttatcttttttttttttttttaaatcaaattccttgttgtaaacctttctttctcgagaagattacaaccttttcaagcaacctgttacagcaaatgcaaaaggctaggtgatgattcagcagtaaaacataatatacaataatttgcaggatgttccattattgaacagttctaatgtcgccatctaattcgctcgctatagcattccatgctaataaagctgcaccaacagctggctccaccttgggatgtattggataggcacctgggtaattcttggtaacacaatctatcacttctttcccaatgtcccactttttgtttgcctcaaggactttaccaaccataacaagtggaaatggatgcttgccatcttcaccgccaaggtcaagcctttgcactacagccttgacactggaagctagttccccaactgaattgtgtaggatcttgtttgccacctcatcaccactttcagctgattctaccacaactggaagaaggtcagcgatacgagcccatgattggtcttcatatgtccaccctatcaattcatctggcgatgccagtccaaggaagtcaaggatgttgttcgtaagcactgtttcggggccccggccatcataagctctcaccactgctgtcaatgcctgggcagaaatcccatagccactgccccagtcacccagaactggccctgcacctgctgctcgagcttccctaccatcactagtgaacccatacgctatggtccctgtccctgcgatcagcacacatccgtgcagcttgcccatggttccactggccagcgccgccaccgcatcgttctccacgaacagcttgacatggcttggaaatatgtccctgagccagtccaacattctctgctgatcgactggatggttgacgcctgctacggccaagcagacggcgcagacatttgaccgtcgccggcgcgccttgagcagcgcctgcgacatcaccctctccagcgtctcccttgccctgtcctctccgacggagttgtggttggagcagccggcgacggtgcgggagaggacggggagcgggtcgttgaagggcatggcggcggggatgcagacgcagacggtgttgctggcgccgccgtcgacgccgaggatgacgctgcccatgcgcgggctctggcactcctccacgtcccacatgtcccgccccgtgagccgctgcatctcccctctctctctctatctctctatctgcccgagcactcgctggtctacacaacactggaacgggaagagagagaggcttctcctgctgtcctaccaactgctctgcttttttgattaggatgttctaggtaatggtctcgtgc

SEQ ID NO: 15133 - DNA, 1736 bp, Zea mays
  misc_feature (372)..(372): n is a, c, g, or t
  misc_feature (784)..(784): n is a, c, g, or t
tgtgtaagggaagttcatgtggagatgtaataactagatttctaagaaagtagctcatgcaacaatgggcctattaaaataaacttatgtgactgctagcaattattgaccggacttatgttgatcggcaaggcgattaatcacaccatatcgacgattagtcggacgataaggacgatcagctcctctgatcgaatcgactcctctaatcgagtacttagaaccgatcagaccgactaatcgtgactaatcacgattagtcggacgatatgaaagcactgctccgaatcatcaatatgaaagaaataacatctagatacactcatatgcatgtgcgcactctcatctcatttcttcgttgggtcctgggcnaatctatttccttataggtacttcagtgacaactgacaacttgtactgtagctttagtaatgtgtaccagagctgatgaatgtgaatgatgtagctagttaatattactgggccaataatagtctaagagtgtgttcagccaagtgcaattctaaaacattttggtcaatttgacggtccaccattgatactgattcttttaggtcaatggaatgtggaccaagagcaattagcaatccagatttccttagcacaaatcagttttcagtttctttgttagcactctatcctttgggaggaaagagctgtttagacttcagaaacatatcacaacaaagcgaatatggtaactatgcttgattggcagtaattgactcttcagttggtttatcactcatacattttatatggnagctacatatatggttggcaaaggaataatgtagttttatactagtagtctgaactgtatatttaaattctcagacatattaatcttaatgagatttgctaatagttcataatttgctacatgtcatcaattctccttagatttcttcacatttgtgatgtctctatgtttctttgctgacacagggggtgggtaatctattttattgtcacggtactattgttttcagcaacttttatgtttctcacaagattaactaatcaaggaaagcaaatgagtgaggtaaaggtggtatccccacctccactgaacacaatggagcagctcctagctgttcaaaatgccatttctaaaattgaggagcttgtccaagatgcaaatattgttcttctgaagataagagctctattgttggcttttccatcccaggcgacggacagggctattctggcattggtactgatggccctgagccttgccatcgttcccacaaaagtgcttctgctgctggtgtttctggaggtatccacgaacaactcaccactacgaagagcaagcacagaaaggtgtaccagaaggttgagagagtggtggttcagcatacctgcagctccagtggtggtggagaaagagaaagaggacaagaaaactagatgatacatccaatgtaatctttatgttgcttggctgatacgttgtgtaacgtatcagccaatgcccacctttgtacaaagaccgcaatatcaacaacgaggggcagtttcaatgaagatttcatctcacttgtaccacctgccctgtttacatggctcttgatgctttggtgcaaggtgactagagctgaggccggtgtcaatcgccgcttataacacaaatccctttctctgggttggacatatcgccgtgcggacctgcgccccttcgtttgtaacatgaacagtattgattctac

SEQ ID NO: 15134 - DNA, 1798 bp, Zea mays
  misc_feature (1493)..(1493): n is a, c, g, or t
ccggccgggtaatttattcttctcaaatattatatgcttcctccaaatatcttccctttcatgaggaaaatttttagagaaagagtcgaatcagatggtgagtgcacaagtcctaaagttgtctttggtgctatggttggcctagtgggatacttctatgtagagtgtgtgataaagagccccttgccccggggcgagagggcggattcctacaagctgttgaataagatactacttttttgcttgggagaagccactgctcttgcaaaacttgttcctgagatcatttatcgaagtgaaaatgtaagtaacaatgatgtgctcctttggggcagcttcaggctgtgcgtacaggttattcaaggttcatttcgtagtaccaacatacaggtgcacatgctgggtctgcaagtactgagaagctatgcacagaaggagctaactgaaggttcagaaacaaagttggattcttttatgatgttgcttacggaattgttgggagacttgtttttggtgatggagactacattgaaggaatgttcaaacaaaaaatctgtcagtgtcgttgatgaatgtttgaaacttcttttcctcttccacacactagcacaatcaaagaaataccgacaagatgctacaactcttctgctggaggccttgctgatggttttctctctgtccagtgatactgtttcacaggagcttgctgaagtgaacaccatttccagaaagttgttctctcattttattcagattccgtctgtggctatacagatcaaagacataatgctttctgcaccagctgaaaggagactacagcttcaggacatggtccgagcttcagtcagtcaagggcagataacggtgccagtggctacgagtgcacactcagaacagaatattcaggatagttgcagtaaaaaccctgggtccacatctgaagcttctgattgtgttgcaactcacgggaataatgacaatgaagttgttgatgatgactgggatgacgattgggatgctttccaatctcttcctgcaattgcaaatgatggtgttgattctggagaaatctctcttacaactaggtacaatgaacagatccctcaagaaaatagcagttacggttcttgtaatgcggatattacagctcgtgctatggaagacataacttgtgtggacaaggaacttgaggagccctctgatttgcaattctcaagtactgaacaacagcctaaacatgatttaccagggtcatcccacgaaggttgtgctaaacttgaaagacatccatctgttgattgcaaagagcaattagctgatgatgagacagcagatgaactgcagcagcaggttcatgaagacactgatcatgtaaataaagatagcgaagttctctctgcagaaattcatggggttaaattggatatccttgatgaagatgttgaagatgattccccaatgaattcaaacaatctatcagatatcgcagaganaaaaaaaaaaaagttggtacaatgcaacgagggtggaccgcaagcttgtcgagatagtagagaagagctgtccggttcctctgatgctggcataccagattttagtatgtcaggacacgtgatgagcaagagcggaggaaatgagcaaaatgttattttgcctgtatcaatatatattgcacgagataaaaataatataaggttacaaccatgatttttattttgtgccaaaaaaaaaaaaaaaaaaaaaaaaaaaaaaaaagaaaagggggggcgaagaggaagtgggggtttgtgagcggggt

SEQ ID NO: 15135 - DNA, 1250 bp, Zea mays
actcgagccggccgaaacagtgacatccaaaccgtcccattttttcgagcggcttgagccacaacagccccactctgtctgagtgtttgtgcctgctacctgtgcaaagtagggttcccaccgggacacaggccgcctccatcccatggcgcgcgccgccgcctccaggctcgccgccgtggcgaacttttcctctacgcgcgagttgttcgcccgccacctcgccgccgctgccgcctcggcgtggaccgcaccgccgcgtctgcctgaaccagggagggagcggcggagcccgtgctggtggtgtccgagcaggtcgtttcatgccacaaggcaggtgtatacaagggattactatgatgtgcttggagtaagcaaggatgcttctgcaccggatataaagaaggcatattatgcgctcgcaaagaagttccatcctgatactaataaagatgatgatgcagaaaaaacatttcaagaagttaaccgtgcctatgaggttttgaaggacaatgacaagcgtgaaatatatgatcagcttggaccagaagcatacgagcgtcaagcgtcaggtggtgaccctggagggccgggttttcctcggggtaacccatttggtgacatctttggtgatatctttgataatgcatacagaggtggccaagatgttaaggtttctgttgaactatcattcatggaagctgtccaaggttgcagaaaaaccattacgtacgaagctgatactttttgtggaacttgcaatggaagtggcgtcccccctggaactgtgcctaaaacatgtaaaacatgtcgaggctctggtgtgatatacatgcagaagggtatatttactgtcgaatgtacttgctccctgtgcaatgggagcgggaaaattgtcaagagtttttgcaagacttgcaaaggagaacaggtagtgaaggggaaaacgtcagtcaagctagacatagccgcaggaagtggcgataatgacatcatgaaggtttttggtaagggtggtgcagatgttgaccgaactaagcctggtgaccctttatgttactatcaagggcagagaggaccctccttttctaaaagaaggcatccatgtgcatgttggatctgttttaagcattgctcaagctgtcctaggtggaacttgcacggtaccaaccctcactggaaaagttacagtcaaggtttcgtcaaggtacccacacctggaagagaaggtggttcctaccggggcaaag

SEQ ID NO: 15136 - DNA, 1257 bp, Zea mays
gtcccggtccggaattcccgggtcgacccacgcgtccgcggacgcgtggcttgtagttaaccgtgcctatgaggttttgaaggacaatgacaagcgtgaaatatatgatcagcttggaccagaagcatacgagcgtcaagcgtcaggtggtgaccctggagggccgggttttcctcggggtaacccatttggtgacatctttggtgatatctttgataatgcatacagaggtggccaagatgttaaggtttctgttgaactatcattcatggaagctgtccaaggttgcagaaaaaccattacgtacgaagctgatactttttgtggaacttgcaatggaagtggcgtcccccctggaactgtgcctaaaacatgtaaaacatgtcgaggctctggtgtgatatacatgcagaagggtatatttactgtcgaatgtacttgctccctgtgcaatgggagcgggaaaattgtcaagagtttttgcaagacttgcaaaggagaacaggtagtgaaggggaaaacgtcagtcaagctagacatagccgcaggaagtgacgataatgacatcatgaaggtttttggtaagggtggtgcagatgttgaccgaactaagcctggtgacctttatgttactatcaaggtcagagaggaccctacttttcgaagagaaggcatccatgtgcatgttgattctgttttaagcattgctcaggctgtcctaggtggaactgtcacggtaccaaccctcactggaaatgttacagtcaaggttcgtcaaggtacccaacctggagagaaggtggtcctacggggcaaaggaataaaagcgaggaactcgccagtgtttgggaatcagtatgtacacttcaatatcagggttccgacggaggtgacgcaaaggcagagggagctgatagatgagttcgataaagaggagtgcgcagaccgggaaagacctgcggttgcctccggatgaagtttttggttcaaccattaattagttttagcaccacactagtttgatgccctcaatttctccaacccgccataaggtgctgtaggcaccaaaagcttattgtaacatttgaatcttatatagcatctacccagtgtgtaacgtatacattacgcgctaaattattgtaccattttcgatttttaaacagaaaagatagcgggggttgtcttcactcttcagtaacattcaaaaaaaaatgtggttgtgtgccaagaatgaagaggggatattggcaggag

SEQ ID NO: 15137 - DNA, 3812 bp, Zea mays
aattcggcacgaggcccccgcccccccccggcccatccatctgtccgtcttcgccacccgtggtctccagaccaatccgaggcacgggacatatggcggcgctggcgggcgaggacaaggacgttgacgccttcctcgcggactgcacggcgtcgggagacgccgcgtatggcgccgccaaggccgtgctcgagcgcctccacgcccccgccacgcgccccgccgcacgacgcctccttggcgccgtccgccgacgcttcgccgcctcccgcgccgcgggggaggactgcttccgcaccttccactttcgcatccacgacgtcgtcctcgacccacacgtacaaggtttccaacaaatgaagaagttgacaatgatggagataccaagcatcttcattcctgaagattggtcattcactttctatgagggcctcaaccgtcatccagactccattttcagggataagacagtagctgagctgggatgtggcaacggttggatatctattgctcttgcagagaagtggtgcccttcaaaggtctatggcctggatataaacccaagagctgtgaagattgcatggataaacctgtacttgaacgcattagatgacgacggtctcccgatctatgacggggaggggaaaacattgctcgatagagttgaattctatgaatctgatctcctttcttactgtagagacaacaagatagagctcgatcgtattgttggatgcataccacagattctcaacccaaatccagaggcgatgtcaaagattgtaacagagaattcaagtgaggagttcttgtacgccttgagtaactactgtgctcttcagggttttgtcgaggaccaatttggccttgggttgattgctcgtgcggtggaagaagggatatctgtcataaagccttcaggtattatggtattcaacatgggaggtcgaccaggacagggtgtctgtgaacgtctatttcgacggcgtgggtttcgcattactaagctctggcaaaccaaaattatgcaggctgctgacacagatatttcagctttggttgaaattgagaaaaacagcagacatcgattcgagttcttcatggatcttgttggggatcagcctatctgtgctcgcacagcctgggcatacatgaaatctggtggtcacatttcacatgctttgtctgtgtatagctgtcaacttcgccagcccaaccaggtgaagaaaatatttgagtttcttaaagatggattccatgaagtcagcagttcccttgatttatcctttgacgatgattctgtagctgaggaaaaaattcccttcctagcttaccttgctagttttctgaaagagaacaagtcaaatccctgtgagccaccagctggatgtctaaactttaggaaacttgttgctggatttatgaagagctaccatcacattcctctaactcctgataatgtcgttgtgttcccttctcgctctgtggcaatagagaatgctcttcaattgttctcaccggcgcttgcaattgttgatgaacatttaaccagacacttgcccaagcaatggttaacatctttagcaattgagggaagagcagattgtaatcacgccgatggtacagttactgtaattgaggcaccacgccaatcagatttactgattgagttgatcaggaagctgcagcctcaggtggttgttactggcatggctcaatttgaggctatcaccagtgctgcttttgagaacctactaaacgtaacaaaagatgttggctcccggctgttcctggatatttctgagcatctggagttgtctagcctgccaagctctaatggtgtattgaaatatcttgctggaaagacattaccgtcacatgcagctatactgtgtggtttagtaaagaatcaggtgtactctgatctggaggttgcttttgccatttccgaagatgcagctgtatataaagcattatcacaaactattgagctattggaaggccacacttctctgatcagccagcactattatggttgccttttccacgagcttctggcatttcagattgctgaccgtcatccacagcaagagagacaacctgcggaagtgatacctcagcagatgataggattttctgacccagctgtgtctaccctaaaggctactgaatttttcgttcctggttcagctgaatccagcattattcatatggatttagatcgcagcttcctgccagtaccttcagcagtgaatgcgtctgtttttgaaagttttgtcaggcagaacatcactgattctgaaaccgatgtccgttccagcatccaacagctggtgaaagacagctatggtttatccgcagctggttgtgcagaaattatctacggaaacacctccgtagcactcttcaacaagctcgtcctttgttgcatgcaagaacagggcaccttgcttttccccttgggcaccaatggccactacgtctccgcagcaaagtttgtgaacgctagcaccgtgactataccgacaaatcccagttcagggttcaggatcgagcccaaggttctagctgacactcttaagaatgtatctcggccgtgggtgtatgtttgcggccccacgatcaaccctactggctttctgtacagtgacagtgacatccgagagctgctctccgtatgcgctgaatatggagccagggtagtgatagatacatccttctctggcctggagtacgagaccgatggatggaggcagtggaatctggcaggatgcctttcctctttgaagcgttcagagccatcgttctctgtggtcctgctcggagagctgtcctttgcgctgactgcaggtgggcatgactttgggtttgtgatattgggtgactcgtcgttggctgagacgttccatagtttttctagcttgagtcgaccgcacaccacattgaagtacactttcaagaagctgctggggcttaagaaccagaaggaccagcatttctcggatctgatagtggagcagaaggaggagctgaagaatcgcgccaaccagttgatacagacactggagagctgtggctgggaagctgccatcggttgcggtggcatctcgatgctggcgaagcccaccgcgtacatggggaaggccttcaaagctgctggcttcgacggcgagctggacgcgagcaacatccgggaagccatcctgagggccactgggctgtgcataaacagcagctcctggacggggatccctggctactgccggttcagctttgctctggagaggggggaattcgagcgtgcgatgggatgcatagctcggttcaaggagctggttctgggaggcgctcagatgaatggtgcctgatggagcaatccatgttatacgtaaccttggtgctgtgtagtagcgatgatattgttccaggtgatggagatatcaaggaataacaagagcctacctgctgtgaagtcaatgtactactaggatggatagggcgcttcgatgcgccctttctgtcttcgaattgctgtgctgtgcacggagaataaacatatactattatatatatacatacaatttgctaagataaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccctttttaaaggatcaaattttattcccgggtgtttgggaggtaatagtttttttttggggcccccaaaaataaa

SEQ ID NO: 15138 - DNA, 1129 bp, Zea mays
tggttctgcaaaaggtgctgcagagactctgggagtcaatatggccctgggggggtttcctgtttgccgaaatacaatcacttggattcgatcgaagacaaagatcggagctgttgtacccttcaatgacaacataaacttccataaggtaatagcagcaggtgttgcaggtggtgttgctttgcatgcgggtgccccccggccggccgggtttcctccgctgctccatgcaagcgatgctgcctatgaaccaatgaagcctttctttggagacaaaaggccaccaaattactggtggtttgtaaagggaactgaagggtggacaggtgtggtcatggttgtacttatgaccatagccttcgtattggcccagccatggtttcggcgtaataggctcaaggattctaatcccctcaagaaaatgactggcttcaatgccttttggtttacgcaccacctatttgttattgtgtatgcactgctcgttgtccatgggatctgcttatatctaagcaggaaatggtacaagaaaacgacctggatgtaccttgctgtccctgtgctcttgtatgtaagtgagcgcattcttcggctatttaggagccatgacgctgttaggattcagaaggttgcagtgtatccggggaatgttttggctctctatatgtctaagccacctggattcaggtaccggagtgggcagtatatcttcataaactgccgtgctgtctctccatacgaatggcacccattttccattacatcagcaccaggagatgattatcttagtgtccacattcgcacaaggggtgattggacttcacgtcttaggactatcttctctgagccgtgccgccctccaactgatggagaaagtggactccttagagctgacctttccaaggggatcacagagagcagcgccaggttccctaaactcttaattgatggaccatatggtgctccggcgcaagactatcgggaatacgatgtgctcctgctcattggactgggcattggagccactccattgattagcattgtgaaggatgtgcttaaccacacccagcatggaggatctgttttaggcacggagcccgagggcagtggcaaggccaagaagaggcca

SEQ ID NO: 15139 - DNA, 3545 bp, Zea mays
acaaacctcaactcgccgcatactgacacgaacaccagcgctactcatacgacacctcgccgccgcccgggccccgtcctcattgtggtttcctcagcgactacttttttaacagttgttcatcgcattgaggaagggaggccggctggtgctactgcttttctagtacctgcccacctgcacttgcatctcctgcttccctgagcggcctcccggctgcgaatccaccagcatttcccgaggcccagcgccgcgtgtgcctgtggggcggagtcaggaaatgctcggagctccattccacggctgaaacttctgggaaggtttaagccaaaccttgttgcagtttagggagaccggcagcactaaagaaactagcctgagcctctctttcagcctctcacccactatcgtgagggcattttgtaccttccaagaaagagagtaaggagaacttgacctcagcgctagagaagaatatggcagccactgaagctgccacggacacaggcagttcaaggaggtcacaagatgacactacaacattagtcccacacagtgggaatttgggagaaccaatccagaagggcgtgaagaccaccagattcaaagatgatgacgaggttgtggaaatcaccattgtacagcgcgattcagtggcaatcgaagatgtcagggtagtcgatgatggtggctcagggcatagtaatgggtttgatggcctgtcacttgtgtcaccttcctcatcaaggagcggcaagctatcatcaaagattaggcaagtgaaaaatggactaaagatgaagaactcaagcactaaggcgccacagacacagttgggaaagaacatgaggaagagattggacagaagcaagagcggggctgctgtagcgctcaagggcttgcagtttgtgactgcaaaagttggtcatgatggctgggctgtagtggagaaacggttcaacgagctacaggttgatggtgtgctgctacgttcaagatttgggaaatgcattgggatggatggatctgatgagtttgcagtgcaattgtttgattcattagcaagaaagagagggataacaaagcaggtgctgactaaagatgagctcaaagatttctgggagcaactcagtgatcagggttttgacaaccgtttacagatattctttgacatggttgataagaatgccgatggaagaatcacagaagaggaggttaaggagattattaccctcagtgcatcagcaaacaaactttccaagctcaaggaacgagctgatgagtacacggcactcataatggaagaacttgaccgtgacagccttggatacattgagcttgaggatctgaaggcacttttgctgcaatcaccttctcaagttgttgcaagatcaacaacgcatagctcgaaacttagcaaagctcttagcatgaagcttgcatcaaacaaggacacaggtccattttaccactactggcaagagttcatgtacttccttgaggagaactggaagcgcatttgggttatgactctctggctctcaatctgcattggcctctttatttggaagttcatccaataccgtaatcgagcagtatttcacatcatgggttattgtgtgaccactgcaaaaggtgctgcagagaccctcaaattcaatatggccctggttctttttcctgtttgccgaaatacaatcacatggattcgatcaaagacaaagatcggtgctgttgtgcccttcaatgacaacataaacttccataaggtaatagcagcaggtgttgcagttggtgttgttttgcatgcaggtgctcacctgacatgtgattttcctctgctgctgcatgcaagtgatgctgcctatgaaccaatgaagcctttctttggagacaaaaggccaccaaattactggtggtttgtaaagggaactgaagggtggacaggtgtggtcatggttgtacttatgactatagctttcgtattggcccagccatggtttcggcgtaataagctcaaggattctaatcccctcaagaaaatgactggcttcaatgccttttggtttactcaccacttatttgttattgtgtatgcactgctcattgtccatgggacctgtttatatctaagcaggaaatggtacaagaaaacgacatggatgtaccttgctgtccctgtgctcttgtatgtaagtgagcgcattcttcggctatttaggagccatgatgctgttaggattcagaaggttgcagtatatccagggaatgttttggctctctatatgtccaagccacctggattcaggtatcggagtgggcagtatatcttcataaaatgcagtgatgtctctccatacgaatggcacccattttcgattacatcagcaccaggagatgattatcttagtgtccacattcgcacaaggggtgattggacttcacgtcttaggactgtcttctctgaggcatgccgccctccatctgatggagaaagtggactccttagagctgacccttccaaggggatcaccgagaccaacgcgaggttcccgaaactcttgattgatggaccatacggtgctccagcgcaagactatcaggaatatgatgtgctcctgctcattggactgggcattggagccacaccattgattagcattgtgaaggatgtacttaaccacatccagcttggaggatctgttgcaggcacggagcctgagggcagtggcaaggccaagaagaggccattcatgacaaagagggcctacttctactgggtgaccagggaagaggggtcctttgaatggttccgaggggtcatgaatgaggtggctgagaaggacaaggatggagtcattgaactccacaaccactgctcgagtgtgcaccaggaaggggatgtacgttctgccctcattgtcatgctccaggagctccagcacgcgaagaagggagtcgacatcttgtctggaactagtgtcaagacgcattttgcacggccgaattggcgaagcgtcttcaaacatgttgcagtgaaccacgagaaccaacgcatcggagttttctactgtggtgagcccgtccttgtgccacagctacggcagctgtcagcggacttcacccacaagacaaatactaagttcgagttccacaaggagaacttctaatggaggaactggagaaaagctctaggcgtggccctctaatggtttcagaatatgtgaattacgatggttgtaacatatatacgagtagaagaataagacgatgggagttgttttgttgtacatgtcaagagtagatgaattgtctttgcaagcatacaaccttaaaagttgtaacacatgtcagctggttttgacaggtctgtttgttttgtctgctcctgttggagtgttgggcataaaaaaaaaataacttttaaagcaccaccactacattgaaagccctgaggaaggtattttacggcacaaatgagtcaggttcacttgtgaattgtgatcctcaactcctgatgctgagtaactggttgtgccttccgt

SEQ ID NO: 15140 - DNA, 2766 bp, Zea mays
  misc_feature (288)..(288): n is a, c, g, or t
gctcgcaacaccgagcacacgctctacacgtgacgacggcgaaggagcatctcatcgtcggtgtgtacgtggatgacttgatcatcaccgaggtgcgggaagaggacatcaacggcttcaagcttgagatggtggcttgtttccatatgaacaatctcgggttcctctcctactacctcggcatcgaggtgaagcaagggagggactccaacataggaacacagggaggttttggagcgaagtggcatggcggattgcaagttgtgcacgacatcgatggagaggctnaagctgataaagaccagaactgcagaggtggacaagacgtgccaccgaagcatcgtctgtgggctgctctacttgactcacacatggccgaacatctcattcattgtcaggtatgtgagcactgagcaggttcaaggatgatcctcgaaaggattgctggcctgcagtgaagctcctgctgcgctatgtcaagaggacgactaatcaagatttgttcacttgtgttctgctaatctgctctgttctcacccttctcttctacctccagccccaaaatgagttgagtgtgtgtgagtgagcagctactcacctgtgcaagcttgccggctgccaacatactaaagatacagttatgtccacaacggtgtaaattaaatgaaataaacacccagtctagagtatattttccatgtatgagcatcaaagcattgctgtattataaagatgagaaccagaactttactgtatctgagaacaggtaacagcaccagtaggactggaaaatcattatttgcttcctttgaagaagccaccttaccattctggggcctgaagaacataaaaacgcaagtaggcaaacataaagcaacaatatttaactgaagatttgaataacgaaacattaggtctcctagttatttatcaagtatcatctcaggagatactttgaagcacatgcagccctccaaagagtgatgaaggaaacaattaccttattatcaatatagtcatctgattgcttttctgttagaagcactatctggtatttttcaacttatcacttttgctgtataatcaaaaggctcaaaagcttacctgaaaacaaactaacactggttctcaacattcaccaaaaaccccagtcaaaaaaaaacattcaccaaaaacaaatattcagtttgtttagtaggaaagaggccagataggaactaagtctgctcccacactaggaagtgcatttgttccagtgaaacctgtgggtactagactacatgtagtgctgtgtgctgcagctactagcgaaatgtttttttgatctattcttattgattttaatgggtacacattcttatatgttttgtgatgctacaagttccagaaaatacataaaaaataagagatgactggtaataacgctaaacagataccacccagggtccaacgacctttttgaattcagattttctaaccctgacaccatcaaggataaaaagttgtgtgcagtgtcctaatgtaggaccaaagtagcaaaggtatttggaacatttgggatcacaatattcgaggtgcctaaaacagttacaaagttaccattttcatgctaagctcacacagtatctgtctctagtttaagctactaagtttcacttaaaatatggaagtaatcaaaattgttggcaaaatataaaacaagtatgagtataaatactgtacgaaatttacacaagtgggttcagtgtcacaatttcaagggagaaaacaaagataaggaatggtagagcaaagatacagaaaaacttctgttgccatttccctccaatttacagagatagtccatgggctcaatgacccattttacatacaaacttcatgcacgcatcacaagaagatagagatgttttcaataaatgtgttgtttacaaatacagataagatggaaacgtaaatcaaatcaagaactagtagtgttttatcatgccatgaaaaggggaagtcctccagtgtccagtcctctgttgctataagccacttcatatttccagcagtcagttgccttgtaactaaaaaacatgagacatgacatatatttggtgtatcaatttccttagaacctgaagcacttcagtggcaggattcagtgcctcggcgccccgaagcaattgactgacagccaaatctagtgaatcaacattcttccgtagaatcttcagttgcatagctaagctttccaagcctctcatttcctcattcaacctcaagcacgaattgatgtacttatttcctttcgaagatgcttcaagtgcggattcctgcaagcggccgacgacgtcccccaagcactccatgttctccgccgacgtcgaggtgacgtttgatagagcgacgcggagtgaagcgaagagggaggcgtagctctcggcgatggcaaccgcgtcccgctccaccgcctccatcgccgccgcgaccgcctgcgccccgggagggggaggcgtttcgggagcaacgacggccgtggcggaggacgaggaggagggtgaaggctctacggtagaaaggtcctccgggggcgggggcgggggcggcgaagaatcggactctccggcggccgcggcgggttccatctcgtggtcaagtttttggaggcgcagtacctcttttgctcctcaaaaacttaaaaaaaacaatctacatagacatataatttggagttatttatataccactaccactgattatgataaaacaatctaaactttt

SEQ ID NO: 15141 - DNA, 1190 bp, Zea mays
ccctgtcaatccatccgaagggctcactcagctcttcggaattcagacgacggatcgagcaaaagtgaggacccctccatcttatgagaacaatatttgtaaccatgggactgaatttaaattacaggagaaagcatagacgcttttttttttttttttggaataattttgccaagtatgagtagaaatatcaatatgttaaaatcataaaacagcacactagctttatgcttggaatggccagcacgactcctcaatgtgtcaatgtcacgtgagaactggaccagaacaaaaatctgaatcaaacatacataacgtcaggttgccatatgcacacagaatggctgcccaaggaatgatacatatatattgagaatatcttcactactagtacaacagatcatcgcatagctaattcgagcttggtgacatcgtatttggtcaagcaactatggcaggaacatgacaccagcttaccaaacagtttcctcattcttccatgatggtgtcatcatctgaaaccggttcaccttccaagagccactgttcaagctcgtcgagatcgtcgtcattatgccgataccagtcagaggaggtgtcccagagcatagtccctaattcttcaccacggcaagccatatgtaagaatggccggcttcgagacagtgcatccaccataaccctattcaagctacctgtaattcccagccaccgcaatctagggaagtaaggtttcttaaaccaacgtgctgcaaggggtgtaatcccaccacagtcaaaaagatccagcagctgcaaggtactaccgtaggttccaccatctatttgcatggattgcacatgagacacagtgatgaacctttgcatacaatttgggtagaacatatccatcatgtacacaggcctcctgcacatctctcacggcagcctgctcaacaatgttcctcaccaagaaccgcttgatagccttatccttggggcagcacttggcgcagttggagcagcggatgtacttgacgtggccgcgcccgtgcttgttgcgtccgccattcctccgcttgaacgtcatggctggatgagctcgaagccgccgctgacgagggctagggtacggtgcgcgaaacggcggcggcggcggctctagtgtggtatgcttttggattaggatgttttaggtaatggtctcgtgc

SEQ ID NO: 15142 - DNA, 1240 bp, Zea mays
cgtctgctttatatatagagtttcatcttctctcctctatctattttaatacattaaataatagttttagtaaaattaaaaatatatataatatatttgagatggctagagacattagaaccagtccactttcctatttacttttgaataaacgagaaccaatcacctctctatttaattctaaatagagtacggtggtttagcagcatgtgggcacgacatggctctcgtcccagcaggggacagggctgctcgcttggacccacctgtcaagcttgggctggagggtgggggctgatccgctccgccgcctcgaggccgcccggggacccacccatccaaccacttccacgaatggccctcgctctgtgaactcgtcgggttccatggcggcgccgtcgcctaaacccccgacaccacgcgggcgctgccaccacccgcccaacgccacccgccgcctccacgtggccacccgctgcttccccgacccaccaccaccacctgcctccatgccgccgatcccgagtccgaaccctgtgctgtcccttctctccgcggtgcccgactgggccgacgccatccaggagcgccgcgtccgcgaccgccgcccgctctacgaccacgccacctggcggcaccaccgcagctcccgccgccacctgcgccacctcctcacctcgctgtcctcccgcgccatcctctccctggcgcccccggtgtccgccttcaccgccttcgccgccgccatcgccacctacaacacgctcctaccggcctacgcgctcaccgcatcctcgctcccctacgagctcactgcgcccgcgctcgcgctcctcctcgtcttccgcaccgaggcttcctacgcgcgcttcgacgagggacgcaaggcgtggatgcgcgtgctcgccagcgcagccgacctcgccgggatgctcatgcgtcatcctcctcctaacaatctgcatacgggtggcgctcccaatccgggaccgggaggacgacaggctgacgacgagccgctcaggcgcgcgctcgtcaactacgtcctcgccttccccgtcgcgctcaagtgccacataatttgcgactctgacgtaaaaggggaccttgagggcttgcttggcgaagatgacctgagcgttgttctagcatcgaaacatcggccacgctgtattatcgagttcatcgcacagagtctccaaatgctagatctcgacgagcagaagaggagcatcatggt

SEQ ID NO: 15143 - DNA, 2090 bp, Zea mays
ctggtagtcctcaaacttggtatattgtgtcactcagtcctcgaacttggcatgttacgtcacttgaatacgcgaactttcattagtgccctccattgtggcatgccacatcagcatctggttcgagcaaatctaggtttggacaggtttgcatggatctactaggttcaaggatctatttttctggttttctaatttcgggacataataagtgacacaacgtgccaaaagtttagcgacgtactgttgatatattttactatgatataaacgacatgttggacagcaagagggttgaaatagtttgagatagaagataaaaataaggaattttgatggttggatattattgaatctctcgatccaccgacacattttacatttatatataggccggccgggtgggctgatcattattcggctagctttgcatacgtacatacacaattacgtacgtcggcggtgctgttgtcttgtatcggcgcatgagcgaagacgccatgaccggccatcacgtatgtacgtgtgcacatttgaatgtgtgtgcccctatagcttcccaacatcgatcttctccctctagcaaacgatagcaattttggacttgcggccttggtgtttgtatccgtgcaacgtcgttcgttgccgatcaaattgaagctttttttttaattcttcgcaaatatatcaccatgcataaatcttaggtgtacaaaaaaaaaacgatcgaatttggatcaaaaccaaaccagtgtgaactaccatgaccggtgggcaggacataactccaatcgttgggccatcctctactccaacacacatttaattacactgcttcaacatataatgaaacctgacagagagaaaaagagagtaccctacaggtttacggccggccaccaccatgtccttcttcctagtaaacatccaatggcacgacggagaattccttacacgtcgaagcacgatttcacatgccatttcctatataaaggcatccacacacacacacacacccacagagcaaacaaagccaacgtgatcagagagggatatatagctagctagctagcatagcatggcgcttgtagccgacgacgacgccgagctcaaggccaaggccaaggccaaggccgaggtctactacggcgacgaggcctgtcagctgtgcgcgcagctcctgctgagggaagcaggcctccccaacggcctgctgccgctggaggacctgacggagtgcggctacgtccaggagaccgggtacgtgtggctgaagcagggcaggagggtcgaccacgtcttccggagcctcggacgcctcgtctcctacggcgccgagatcaccgggtacgccgagaagggccggatcaggaaggtgaaggggataaagaccagggagctcatgctgtgggtgcccgtcgaggagatcgccgctcttggcgacccggcggctggcgggaagcttgtctgcaagagcgttgctgggatcaccaggaccttccctgcgtctgccttccatgtccctgagaaggcggcggcggcggaggaggtgaaggtggactgtgccagggcgccgcccgccacaccggtgctcgtcctcatggacagatcaggagctccaccagttgttaagaacaactgatgcttgcgtgcttacgaacgaaagcgaaccatgcatgaccccccaaccaagttcatttcatcctttcatgcatgtactatgtatgtagctctacatatatatatattgctactactatcaagcatgtatgtcgccgttgtggagacacatctattgatctatacatgagcttgtggaagcagataggtctgcattaattaaaaacacaaaaaaaaacaaattggccggacatatgtatccgcttctgcatcaaatcaaagtactatgaaaccggaccatctccggtcccctacactcaacatcctttaataattcagaataattggctatatcatcgtaccttcttcttagataacggtaacacacaataccggccaacaaatcaagcaactaaaaaagaacatccgaagcgaccacacatgcatggtgcaaactaggcgaagactgg

SEQ ID NO: 15144 - DNA, 967 bp, Zea mays
atgtttgttggcataaaaaaattaacaggctggcgagtaccttttttccgtcaaaatgttcataagcagtgctcagcggcagcactgaagcaggccagctggctcagctgtaatactacaaatttgagcaagttgcagagcagaactgaggttggttaactaggaacgcagccatggcaagcagtgccgtcatcgtccctgcctctccaagaaagttggagggaaaggtggccgtgatcactggcggggcgagcgggataggggagcgcacggcccggctgttcgtggagcacggcgcccacgtcgtggtggccgacatccaggacgaggccggcgcgcgcgtctgcgccgatctcggcgcgggtgccgccagctacgtccactgcgacgtcaccagcgaggacgacgtcgcggccgcggtggaccacgccgtggcgacgttcggcgcgctggacatcatgttcaacaacgcgggcgtcagcgggccggcgtgctacagcgtccgggagagcggcaaggctgacttcgagcgcgtgctggccgtgaatctggtgggcccgttcctcggcaccaagcacgcggcgcgggtgatggtgccctcgcgccgcggtggctgcatcatagggacgtcgagcgtggcggcggcagtgactggcgtgtcgtcgtacgcgtacgcgtgcgcgaagcgcgcgatggtgactctgacggagaacgcggctgcggagctcggccagcacggcattcgcgtgaactgcgtctccccccgcgggggtcgccacgccgctgaccatgaggtacatgggcctcgaggcggaggcgttggagcaggcaatggagggcatggccaacctcaagggcgtgggcgcactgcgggggcacgacgtcgccgccgacctgctcttcgtggcccagcgatgacaccaggtacatcagacagggcacaacctggttcgtccggacggggggg

SEQ ID NO: 15145 - DNA, 1265 bp, Zea mays
  misc_feature (1233)..(1233): n is a, c, g, or t
ctcccggccgccccgaacatccatctttccccacggcttcgctgcagctttgccagccactcaaatccccttccccttctctacacacacgacgaacgcaagctcccaataacgcatcccattggatttgaaagcttctacatgggacaccgagcctcgtagacgaagcagaggaaaccagcgaaatcaaagagcaaggaagcaagaagcagggagccatggcgttcctccttcccaagctcacaacgccgtcctgcaagttgcccccaagtcccctcctcaagccccagctcgctcagccggtccacggcggcggcaagattcaaggctccgtcttcggctctgttgcggcgcaggtcgcggccccgggccacctcagtctcctgctcctgctcagcgcctcgcagcaggcagccgccccggcggccaaatccacggcgaccaagaaccggggcaagggcggcggggatccgcaaaggtcggatttttacctcaacctcgggacggcggtgcgcacgctgcgggacgacctgcccgacgtcttcgtccgggaacccaactacgatatctaccgtgaagacatcacatttgtcgacccactaaacacttttcatgggattgacaactacaagactatcttctgggcgcttagattccacgggcgcctactattcagagaaattgggcttgatgtatcacgcatttggcaactgacagagaattcaatagttgtccggtgggagctgtggggcactccacgtgttccatgggaatcgtatggctgcttcagtgggacgtcgagatacaaggttgacaggaacgggaaaatttacgagcacaaagtcgacaacttggcattggacttcccacgatcagtagcgaaagtgggcagcattgctgacatggtagtcgccacaccgagccccaatttaacgttctggaacgtggttgggacaggtgatggttgctcatggacaaagctgtatgaagccgtgctggaagctgtggaacgggaagagcatagttccacaggcattggcgttggagctctaggccctgttggctgcggatgtggctgcagtttttgaactggaaaactactgtagcttgaactgctgcagccagttcaagcgaagagggcccttaatcactagttcataggatggaatgagctccgggactagttgcttggtagtagttcttaggggaaatggtatagaagaatatatatantatatgggcacatgaatcacgataccactaat

SEQ ID NO: 15146 - DNA, 3063 bp, Zea mays
tgctacctctttttagcatgtatgttaccccctttctttctttgattgcctttgatcctctcactaatcctttcactacttctcattcgatatttgctaaataatggagggattgaaacaggttgctaccttgtaaaaaaacgcggcttgctaatatggaagtgaaaggaagaaaggccagactattacaccacgtcgatcgtcgaaccagtgactcagaacaacaatctttcccaccgggcttccctgcagctttgtagagccactcaaatcccctcccccttctctacacacacgacgaacgcaagctcccaataacgcatccccattggatttgaaagcttctacatgggacaccgagcctcgtagacgaagcagaggaaaccagcgaaatcgaagagcaaggaagcaagaagcagggcgccatggcgttcctccttcccaagctcacaacgccgtcctgcaagttgcccccaagtcccctcctcaagccccagctcgctcagccggtccacggcggcggcaagattcaaggctccgtcttcggctctgttgcggcgcaggtcgcggccccgggccacctcagtctcctgctcctgctcagcgcctcgcagcaggcagccgccccggcggccaaatccacggcgaccaagaaccggaccaagggcggcggggatccgcaaaggtcggatttttacctcaacctcgggacggcggtgcgcacgctgcgggacgacctgcccgacgtcttcgtccgggaacccaactacgatatctaccggtgagtaagaagagccatttccccctttgtgttgctatttcagttaattttgggttaggcctttcagaatcgttcgcgcttgttgtatgaattggcttaatttggatttgatagtttgctatttgctgatcatggagaacgttcacgtgcctgctaaggtcaaacagagaaattgagctgctaatggtcactcggtgcttacataaatcataaatgcagtagtagtgggctagtggccagcatgaacacaatggtgatttttcagtgatgccagacagccagtcacgattctagaaatgaagtatactgattgtttgcttatttcacctagccttctagtagaactgagaatcaatagatgagcaacaagtttattgtttggttataagactaggctgttagagggcaatgagatgcaacagtcatcatttttttataatgaccagtctatcaagccacgtttttcattaagagtaaacaagttttattaagtgatgttaagtcatagcttactgcccagagcagaacagacatcaatctaacactgaaaacaattacaggctatatggcacactagtttgtgacaatgacaaattcagcacatgggtggcgatctagttttaggattgagagtcatcagggtgccaggacctccatttttgtttttggctgtgttctttttacacaggttagaagtgtgttcgagataattgtaattacatcaactctacgtaatgatcttgagttaataaaatctgttctttgccaaaagaacgaaattcagcacaaaggcatgtgcaagtcatcatcaacagtttgctattaattatctctgacaagaacactaggcctgaattttgcaatctcttgcaagcttattctttgtaggcatgacactcatttgaaaagggaaactgaaaatatttttttacatctattgcagtgaagacatcacatttgtcgacccactaaacacttttcatgggattgacaactacaagactatcttctgggcgcttagattccacgggcgcctactattcagagaaattgggcttgatgtatcacgcatttggcaactgacagagaattcaatagttgtccggtgggagctgtggggcactccacgtgttccatgggaatcgtatggctgcttcagtgggacgtcgagatacaaggttgacaggaacgggaaaatttacgagcacaaagtcgacaacttggcattggacttcccacgatcagtagcgaaagtgggcagcattgctgacatggtagtcgccacaccgagccccaatttaacgttctggaacgtggttgggacaggtgatggttgctcatggacaaagctgtatgaagccgtgctggaagctgtggaacgggaagagcatagttccacaggcattggcgttggagctctaggccctgttggctgcggatgtggctgcagtttttgaactggaaaactactgtagcttgaactgctgcagccagttcaagcgaagagggcccttaatcactagttcataggatggaatgagctccgggactagttgcttggtagtagttcttaggggaaatgtatagaagaatatatatatatatgggcacatgaatcacgataccactaattatttctctgtatactgtagctataggacagcaaatttagataaaacacatactaggtggctacatttgattacccttgtgaccttgtctcatacagtcatactgaggtagtgctttcactgctttcatatgcgatacatggattttgagtgtgatttgtccagtactagacacagtttaggatgtggaggaaaattgaacatcggcagttgagggaggtcaaaataagtctttttccttctctagatgtgttgtgtctggtttggccggaacataactgaggatttttctatcctcattaatagagataacaatgtcgtcttatataaatcatattgttgttcctcacaaacacagaatgattcatgctgataccaagcacttaacactttctaccaaacaagcttatagttatagcactaaggccatgtttgggatagttccagtttcaataaatttgatagagcaggtcattaggtgctctagaaaatcgtgtaactaaaattgtaagtcgttaacaaacatttagataaattaatttgtttattatttagatttaaaatatttttaaaactatttaaattgatattataaactacactccacacttaatttggaacctagagccatccaaaaagggccattggctg

SEQ ID NO: 15147 - DNA, 2021 bp, Zea mays
aacgatctttcctcccaccgtccacaggcttcgctgcagctttcagagccactcaaatcctcttcctcttctctacacacacgaacccacgaacgcaggctcccgagaacgcagcccccattggatttggaagcttctccatgggacaccgagcctcgtagacgaagcagaggggaccagagaaaccgaggagcaagaagcagggagccatggcgttcctcctgcccaagctcacaacgccgtcctgcaagttgcccccgagccccctcctcaagccccagctcgtcccgccgggccacggcggcggcaagatccaaggctcctccgtctccggctctggcgcggcgcaggtcgcggccccgggccacctcagcctcctgctcctgctcagcgcctcgcagcaggcggccggccccgcggccaagtcgacggcgaccaagaaccggggcaagggcggcggggatccgcaaaggtcggatttttacctcaacctcggcaccgcggtgcgcacgctgcgggacgacctgcccgacgtcttcgtccgggaatccaactacgatatctaccgtgaagacatcacatttgtcgacccactaaacactttccacggcattgacaactacaagaccatcttctgggcactcagatttcacgggcgcctgctgttcagagaaatcgggctcgatgtatcacgcatctggcagctgacagagaactcgatcgttgtccggtgggagctgtggggcactccccgtgtcccatgggagtcatacggctgcttcagcgggacgtcgaggtacaaggtcgacaggaacgggaaaatctacgagcacagagtcgacaacttggcgctggacttcccacgatcagtagccagagtgggcagcatcgctgacatggtagtcgccacgccgagccccaatttgacgttttggaatgcggttgtgacaggcgatggttgctcgtggacaaagctttatgaagccgtggtggaagctgtggaacgggaagagcatagttccactggcattggccctgttggctgcagcttcggttgcggctgtggctgcagtttttgaaatgcaaactgctgtagcttgagctgcttgttcataggatggaacgagctccagggctagttgtttggttgttcctaggggaaatgtatagatcaatatatatgggcacacgaatcacggtatactgatatctctttgtatactgtagctataggacagcaaatttagataaaacacgtactagatggctatatttgattacccttgtgaccttgtgttatacagggccacaggggtagtgctttcactgctttctttcatatgcgatacacagatcttttgggtgtggtttgcccaatattagacacagtttaggaaaaatgaggctgagcgtgtgttttttttgtctccgaaattatataagttggattatgatagaagtgtagaagagcaaaatatcactttataaccacaaataagttaaaatgggctagtattggatacattatttcagcttaattgcgattacaaagtaatattttactcttctacctttccaccataatctaacataatctatgacgaaaacaaatagtgtctcagtccagcatgacgtggatgcggtgttttcgtggcgtgcagtactctagtgtcattcagcggctgcccaatgcggttgcgaaaaaggggcatcccctccctctctcccctaaatatgtgtattctctcacttctccccttcttttcgcaagctgcgatgggcatatccggaatgcgctcgtctctccgtgtcacgtgttctctgcgtccacgctcgcaaatcactggaaacaggccgaggaaaatcgaacaacatcagtagttgagagaggtcaaaataagactcactctctctcttcctccctctctctccatatctctctctaaatgcgttgtgttggggttagctcgaaaataactgagatatttttatcctactaatatagacaacaaagtcatctc

SEQ ID NO: 15148 - DNA, 623 bp, Zea mays
  misc_feature (3)..(4): n is a, c, g, or t
ttnnggcatgggatgcccgtcatatccattccattttcaaccaataatacgaatggttcaaaacgacaccgacgtttccagcaaaacttgcatatagacacctgatcgaatggctaacctacatagtaactaaaaatatttaactaacccaccaaaattttcctatacaaaggataaaccatcgctctaccgcgcgaccttattcttcaacctactcgacaaacaagcgtcggccctgtcctgtgctaactgtgtgcacaggggagccggtgcccccctaaaaataaatgtctatctcccgttcggtcatctcgtacacatggtcccgcgcctcagaaagagcgacctgtccgaatttcgtgaagaagttgtttgcgagatttaacgacgtgactgccagatcctcgttagccttgagcgcctgtgccaatgcgaatgctccgtcgtctcgaatctcattgaaacccaggtcaagggacgtcaacgattcgttgattatcttgaaacttcgcgccaagcatatagcaccatcgtttccaagcccgtttgcccgccccgcctacctccccggccggccgctcgacttgagacagtcggcaatacactctgcaccttccatgcct

SEQ ID NO: 15149 - DNA, 2689 bp, Zea mays
ttactctagatgaaatagatgaatgctaatatagttaagagatttaactagactctttttgtgctttgtctcgatttgaatgtcgaggagggccgtctgtcccgacaatgattgtggtgctagaaatcgaaatgactcgctatagtttctgctcaactgctgataatatatatcgacctgaggctcgagacgggtattgtcgaaatgatcacgtcataccgacgacaacatatcaccctcgataaccccacgcctcgggaggacaaaggaaaagccccatccgtcgcgcacctacaaaaatatagccccatccgtcaacctggtccactgcgtccgtagtgccgtctgctccatgcgcgccgcgtacgcacgcatgcacgccgcacgggcatctctttctcttctgcagacaggactgcaacgtagcagcaggcactgcactggcacagctagttccgtagtatatttcatggcccaagaagcacacgaagctccagtagtcggtggcagtcgcagcagctcctccccttcacgagacaccggcatgtgggagtctcctcggcagacgcaagcgcacacgcccttcccctcctggatcccctacgccggcacgttcgccgccggggtcggcatggtggcagcggcagactcgagcctgccgagcgagcgcggccccggccccgactgtgcctggaaccagagcgccccgtaagtacaccgcaccggcatacacatccaatcccacccgcgccgcatacgatcgacatgactgctacctcgatgcgtgctcttgtacgactgacaagccgacgttctgcatggttttcagcagcgtgggagcgcgtgacgggggcagcggctaccgagggaactacttcctgtctctgctcgattcgaagaacgtgacgccagagatgttcgaggacgacgtcgtcgttcttcccgcggcgtcaccgtctcgcgactacctcggagtcggaggaggggcggccgccgccgccagcaacatggccggcccagccgccgcctatggcctcctcgacccgtactactctcctgttgttgccagccgtgctcctccagtcgaccatgagacggcgagctcgccactcgtgtactcgggggacggtgtggtgcgcgggaccagcatgccatgctacgacgacgaccacgaggagaaacggccaactggtggcaggcagccgcagggttttggagctcccgcggccgcgtttctgcaggaaatgatgatcccgagccgaggggaggccgagctccagagtggcctgggttatttaggcatggtgtctcaaagtcgactcgagacctcctttggcgtcgtggggagcttgcccgatgctgctggttctttcagtgacgagtacaacagcaacaggtcaagtgcggacttcatgtccagcaacagcgacagactggagcagcgggtgggcggtagcagcagtggaagaggagctgccacgaggaggaaatcagatggagggcttggaggaaacacgaagaaatctaagcaggaggcttcccccaagcaggtaatcactaagaaattagggatgaactaactagcgaaggcgttggtcccggaacttttgagcaagcaagcaagcgttctgacgattttgtttcaaacttagcctcaagcgcccagagtgaagataggagagaagatcacagctttgcagcaaatcgtgtcacctttcgggaaggtacgtacgatcgaggttcttgccgccacttgtgcttcaaaaatgaaatccatgcagtttatttcgatctgttcctgcttctcttttgattgataaataacgttccattttgccagactgatacatcatcggtgctgtttgaaacgatcgagtacataaaatttcttcatgagcagatccgggtaactccatgtacacgatttgcaatatctgatatatgtttgtaactactcaatcagttctcaattataaacgttttgtttttctagatgagtagcttttactacgtatttaaatatacgctatgtctcgatatacaatgtaataaagaaaaacaaacatcatataattttaagatagagggagcagcactaagttgagattgagaaacaagctaagatccttaatcgtcaccaggtttatataaactgtatctgagaaatgtgagtaggccgtgtaattatgtaatatactaccatccaagataatatatacatacagtggaccagccatttgccctggtttcagtgagcataccacattgaccttttgtcagtggacttccaagtcatgcccaagtcctgtgcaacaaccatgctgtccttttccagacttcagacaccaatagatagaccaaggggggaaagggtcgattacacactctcacagccattagtctaccttttcttttctttttttctgaagcctagtaatgctgacaagttgattgctaaatattttttttaaaaaaagttaaccaccatgctgatgagctgatccactcttccatcctgcagatgtttagtgaaccgtacatgacgaaaagcacgtacaaggtaccactaaagcaacagatctatactaatatttttccaataatgcgtggccacgacctttgccggtattttatttcagggtcacatgggactcaaaagcgaaaaaagagaaagcgggacggggcatga

SEQ ID NO: 15150 - DNA, 2999 bp, Zea mays
attcccccggctccatctccctcccacagcctctctggtctctccggcgcctcgactgcgagacccaccgcgacgccccaccgatatggcgacagccggtggcgccgcaccggcggcaatggacgagaaggcgcggcgcacgcgcgacctccttgctagcttctacaacaccgacccgtccgcggccgccgggggtgccgcggcccccgcgttcctggcgcgcccgtcccctaccgccgcgcccgcatcgcccctcgactcaatcaactccacctccttcgatcccgacatctacatgaatgtcctggtgcaacaatccaatctggaaggtcttctacaaaggcatgtgaagatggctactgagatcaagaacctagacacagatttacagatgctagtgtatgagaattataacaagtttattagtgcaactgacactataaaaaggatgaagactaacattgttggaatggaggcaaatatggagcagctccttacaaagataacatcagtgcaatcaagaagcgacacagtgaatacatctctttttgacaaaagggaaaacattgagaaattacatcgcacacgcaatctgctccggaaagttcaattcatatatgaccttccaactcgtcttaacaaatgcatcaagacagaagcatatgcagatgctgtcaggttttttactggagcaaaacctatttttgaggcctatggagatacatcctttcgagactgtaaaaaggcttctgaggaggcaatggatgtagttatacaacaccttcagacaaagttatactcagattctgaacctattgaagcaagagcagaagctgtagttctccttaaacaattgaagtttccagtggacaacttaaaatcgaatctacttgagaagctggaagaatgtctcttgaatttccagaatgagactacacatgcttcaattggtgacatctcaaagacatttcgtgcttatttaataatatttcctgattcagaaaggcgtctcattgaacttgcacaagctttgttcttaaaccgatatgagacagtcagagagaatctgaagaaaagaattccatcaacagatctactggcaatgctacgatccttatgggaggatgcaaccatcatcgatgaggttatttcagaggctgcgctaccagctttttctttggagactactcgagacattgttaagcaacacatagcaactgcatttctccatcttcaaagtgaaatatcagaggcactggttaggacacattcaacatcaaatgagaagttggaagagtcacagctgcaaactgctatggagacaagcaaaatcaaagtatcccaaggatgcatagatctcctgcaggaatttcatcatctggtagatggcaatatagagttgcttgttaagctgagggatttgattattgattgggtacaagaaggttttcaagagtttttccagaaacttgatggacattttcatgtgctttctgggagaagcaaaacaaatttacaagagccaactatggattctatgcaaactgataagaccccaacagtcttggtacttatgcttgcacaactctgtgtttacattgaacaaacaacagtccctaaagttacagaggagttagcttctttttttggaggtggtgcacatagctacgaatatggaccaccttttgtgcctggagaaatatgtcggctatatcgatcatctggagagaaattcttgcaccattacataaatatgaagacccagaagatctccaaacttcttaacaagcgatttacaacaccagtttggattaagcacaaggaacctagggaagtgaacatgtttgttgatctacttctcctagagatcaatggtctggtatctgaagtcaagcagatcttacctggtatggttcggcgacatcggcattcagatagcactggtagcacgacttcctccagaagcaatccaatgcgagaagacatgttgaaccgatcaaacacacatcgtgctagaagtcagtttttagaaaatcacctggcaaagttatttgagcaaaaaatggaaatattcaccaaagttgaatacacacaggaatctgttatttctactgtcctcaagctctgcctgaaaagcttgcaagaatttgtccgtcttcagactttcaacagaagtggatttcagcagattcagctggatatggaatttctcaagacctctcttaaggaatttgtggatgatgaagcagccattagctttttactcaaagaggtgaacaatgctgcccatgagagatgtcttgacccaatccctcttgagccccccatattagataagctcataaatgcaaaactagcaaaaattaaagagagaaacccaaatatgcggtagctatgcacagattggtgtcgtttactagaattcagttctgtccatttgaatgcactattcagagttgtgtgtgcaacttcatagagtttagggcacatagcatggatgaaaatctggagtcagactcagatttgaataacactccccaaattgtatactggtatacttaatttggggtggtcgagctgttagcatccccttgcttgtcaggctaccgtcaagttgtcttctgtgcattgttttcttatcccaggtcaggtactggtctgaatttaatcaaatgagcatcgagctgttagaaaaccaaggcaccaactctaatagattcaccatctggaaagcgagggcagttatcatgccttgtgaagatggtttgttgggattgcgattccctttatgcgtcctgtttttttatttgtcatcttctgctgtatcatcctttctttgaactatattttcatgtggtacatgataccttttgttaccttcgccacagtactgctcacgaatagcattttgagccattttgctatgccttggaataaaacttttatcctcgatcctaggaatggataaccccttggatttccaaaaaaaaaaaaaaaaa

SEQ ID NO: 15151 - DNA, 808 bp, Zea mays
  misc_feature (792)..(792): n is a, c, g, or t
  misc_feature (794)..(795): n is a, c, g, or t
gggcccaccgcggccgtttctcctccacgcacacgggcgcgcgcgggcacgcctctgccgcgccaccgccggaatggccgggccaccgtggcgccggggcgtccgcgcccagctattttcttcgtcgttttgtctcccttcgtgatggagcattgaagggcgtctgttttctttctcccccattcctcctcccatttacgacgagcaggaaccgccgtctccattgatggcacttgatgggagccgccggccacctctccctctccgtagcgccctctcctctcccctcctcctctataaagggcagtcaggccctcctctcttcctcccctgcccaagctctccctcaaccgcgcccgccccgagtcgctggagcaccgttcgccgccgtccgcagagctcgccggtgccctcctcagcctcgccctcaccgtgccgagcccgtgcctcgacgaagccgcgcccacgccgatgttccccatccgagcctcgccccgccaagccctgcctaatcatgtcgtccgttcatcttgactgtgtggtagaagaaccgaattcgtttgaggacgacccgcatgacacttttgagcaaggggtgatgaagaagaccttgatggagattttgatgagtactgagtctaacgatgcgtcgctcatcttcctgtgggagattacccatgttattttcgctatactttgatgatattgtttaagattcttatgtctggatgatgtaataaagttattttactctctttaaaaaaaaaaaaaaaaaaaaaaaaaaaaaaaaancnnaaaaaaaaaaaaa

SEQ ID NO: 15152 - DNA, 1571 bp, Zea mays
gccggcacagagggcctcgcacagtcgcactctttattatagccacggccggccggtggacgacagcaccacaccacctccaactacccgagaccatcgacgagcatcttcctgcatctgcaatggctgccgctaccgtgtccgtcccccgcatcaagctgggctcccaggggctagaggtctccgcgcagggcctcggctgcatgggcatgtccgccttctacggtccgcccaaacccgagcctgacatgatcaagctcatccaccacgccgtcgccgccggggtcaccctccttgacacctccgacatgtacggcccgcacaccaacgagatcctgctaggcaaggcgcttcaaggcggtgtaaaggagaaggtcgagctggccaccaagtttgccgtctccttcgccgacggcaagcgcgagatccgcggtgacccggcgtatgtacgggcagcctgcgaggccagcctcaagcggctcggcatcgactgcatcgacctctactaccagcaccgcatcgacaagaaggtgcccatcgaggtcacgattggtgaactcaagaagctagtggaagaaggaaaggttaagtacattgggttatccgaagcatctgcatcaacaatccgaagagctcacgcagtccatcctatcactgcagtacagcttgaatggtcattatggtctagagatgcggaagaagatataattcccacttgcagagaacttggaattggaattgtagcttacagtccactaggcagagggtttttttgtagtggagcaaaactagttgactcactgtcagagcaggacttccgcaagcatatgcctagacttcaaccagagaatattgtcaagaatgctaagatattcgagcatgtgaatgcaatggcagctaaaaaaggatgcacaccatcacagctagcattggcatgggttcaccatcagggaaacgatgtttgccccatacctggaacaacaaaaatcgagaacttcaaccagaacgtgggggcgctttctgtgaagttgacaccagatgagatggccgaactcgagtcctgtgctgctgcaggtgaaatcttgggtgaccgttatcctcaaatggccaacacctggaaggactctgagaccccgccattgtcttcttggaaatctgagtagccaatctggtgtctcttcaattctgccaccgtcacattggtgtatctccaaattgtcggactgcagaagatactcaggtgcactttgcaaaagcgtccatatgatgtgcttgccttttgcaagctatgatgtttggtacttggtgtgtattgcatgcctcaatttgtatcaagagtatttacccatgagtatagcttgaaggttaaaaccactggttcgacgaataaccatatgcatttgtatcgagagtatttaccatgagtagcaaactgaattttgtaataatagtcaaaagtgtgattgtaaaatgtacttagggaatgtggtacgctatattagcgtgcaaacataagtatagccagttaagcccctccaaaaaaaaaaaaaagagcggccaaaaaaaaaaaa

SEQ ID NO: 15153 - DNA, 1390 bp, Zea mays
ccggccggggaaaaaaaaaaaataaaacccccaccgccggccgggaaatccccattcatcagcaccccggcagtgccatccgactccctgcacctgccatggctgccgctctcgtgtctgtgcctcgcatcaagttgggctcgcaggggctggaggtctccgcgcagggcctcggctgcatgggcatgtccgccttctacggcccgccaaaacccgagtctgagatgatcaagcttatccaccacgccgtcgacgccggggtcaccttcctcgacacctccgacgtctacggcccgcacaccaacgaggtcctcctgggcaaggcgctgcaaggcggggtgcgggagaaggtcgagttggccaccaaattcggcgtctccttcgccgatggcaagcgggagatccacggcgacccagcctacgtgcgggcagcgtgcgagggcagcttcaagcggctcggtgttgactgcatcgacctctattaccagcaccgcatcgacaagagggtgcccatcgaggtcacgatcggtgaactcaagaagctagtggaggaaggaaagataaaatacattgggttatccgaagcatctgcatcaacaatccgaagagctcatgcagtccatcctatcaccgcggtacagcttgaatggtcgctatggtctagagatgcagaagaagatataatccccacttgcagagaacttggaattggaatcgtggcttacagtccactaggcagaggtttcttctctagtggagcaaaactagttgactcactatctgagcaggacttccgcaagcatatgcctagatttcagccagagaatctcgacaagaacgctcagatattcgagcgcgtgagcgcgatggcagcacggaaaggatgcacgccatcacagctcgcgttggcctgggttcaccaccaaggaaacgacgtttgccccatacctggcacaacaaaaatcgacaacttcaaccagaacgtgggggcactgtctgtgaagcttacaccagatgagatggctgaactcgagtcgtacgccgcggctggtgaagtcttgggtgaccggtatggcgatcaattggccaacacttggaaggactccgagaccccaccgttatcttcatggaaattttgagtagccagtatctggtattttcaactgcgtcctctgttcgttgacgtatctccgagttgccgggatgcagaagatctccatgtgcactttgcaaaagcgtccatatatatgtcatgttgtgagtttatgatgtttggtacagactgcggagtgcgtattggtttgccttcctcattttgtttttgtttgtatatgcttaaatgttaaaacctctgatgggatgaatagaataaccatgtgtgcattgtatc

SEQ ID NO: 15154 - DNA, 2126 bp, Zea mays
  misc_feature (383)..(383): n is a, c, g, or t
atctcggaggacgcaaggaaggagatgtcaacggtgaatgttccgattagttcgatccagggatagggcaactgtatacatgttgtatatttgggatataagatgaggtgtcctattcagttttattttttttatgaaatagggaaattgttggagctatatttttagaaaaatgtcctataattcaagatacaatacctgtatatggcattgttggagatgatctagagagactaagatttagtccagaatcaaaacttattatacttagcgggatcccgaatttaatagcccaacattacttgtacagcccaacagcccaatgcccccatgcatggtggaaccctagagcttcacccctttttagcaccagcattccgccncacgacctcactccccacaggtgcggcggcgcacactgctgcacactgcactccctccgtcccgcgtccccgttcggcgctctcggcacgaccgccggtagcccgggacgcacgtcgcacggccccatccctccctagcggccggtgacggcaccggcggccctttgctcggctgtgcccaagctgcgagggcgagatctacccccgcgtccgtgcatcttcgtcagccccttctccggacgagcactcacagggtataccgaccccttcttttccgtccctgctatacgaaaccggcatcccaaaccatgaacgtgatctattcagctatctcctatctgtcccggaacccggttcttatctagtaattacgactgcagtgtacatgcgttatacctgctaactttaattttttgggagcccttttactggtctgcccctggcaaagccagttttttttttgagtcgttgaatacctgcgattagaatttattatgggtagcaaaacaacgatgaacatgctgcgaatagtcttcattagtctttaggtcgctggtgatcaatggtcggtagggcagtgcatgccttaatttctggcttggattggagtattggaccgtgaagtgaggtagttgttggtgatggattgatcgtgtatagccatgaacgggtcactttttcttgttctgcacttgacaatgctagtttaatttgagttgttgaatagctcagattagaatcggttgggggaagcaaaacaccgatgcacaagctgtgaatagtctttattcctctactataggtcgcattgtagctgctgctgttttcccagtaatttcagctctaattccaggtgtcaacattcagggtatcaaggaacgcacacctccagattttgttacctcagggagaagatacatgaatagaagcatttgccaccacctccttgcccactgcaaaaagctaagagagctccagagaatccacgctctggctgttacccatggtctccaccccaaccatcagtctgtttcctgcaaaatcttccgctgctacgctgattttggccatgtagctgatgctcgcaagctgttcgatgagatcccacaccctgaccttatcttttttactagcctcatgtccctccatctcaagttagatcaccaacgcgaagctatatccttgtttgctcgtgttgttgccgctggccaccaccttgatggctttgcggttgttggtgccctgtctgcctctagtggtgctggtgatctagtggttggtagggcagtccatggccttatttttcggcttggattggatcacgaggtcgtcgttggcaatgcattaatagatatgtatagccagtgtggggagtttgagtctgcggtaaaggtgtttgataggatgtttctgaaagatgaggtcacatggggtagcatgctgcatggtcatatcaaatgtgctggtctggattctgcactgtcgttctttgatctggttcttgtgaggagtgcagttgcttggacaacactgataactggtcatgtgcaaggcaggcagcctgtacgggctctagagctttttggtaggatggtactggagggccatcgccctacccatgttacaatcgtaggtgtactctcagcttgtgctgacattggtgctctggatctagggagtgtcattcatgggtatggaagcaaatgcaatgccagctcgaatataattgttagcaatgctctg

SEQ ID NO: 15155 - DNA, 905 bp, Zea mays
catggtggaaccctagagcttcacccctttttagcattgggaccccgccgcccggccggcctcaccacaggtgcggcggcgcacactgctgcacactgcactccctctgtcccgcgtccccgttcggcgctctcggcacgaccgccggtagcccgggacgcacgtcgcacggccccatccctccctagcggccggtgacggcaccggcggccctttgctcggctgtgcccaagctgcgagggcgagatctacccccgcgtccgtgcatcttcgtcagccccttctccggacgagcactcacaggatgtgttctgaagttcatgttgagggagatgcaagtgtcggacagaagggttgcaaggatataaggcgttacaaatgtgaattttgcacagttgtcaggtcaaagaaatgcctaattcaagctcacatggttgcacatcataaggatgaacttgataaatcagaaatatacaactcagatggggaaaagattgttcatgagcaggaacataggtgccaagagtgtggccgttgtttccagaaaccagctcatctgaagcagcacatgcaaagtcactcacatgagagactctttatttgcccactggaagactgccccttcagctataaaagaaaagatcacttgaaccgacacatgcttaagcatgagggcaaattgtttagttgcaccctggatggttgtgatatgaggttcagtatgaaggcagatatgcaacggcatgttaaggaaatccatgatagtaagaacccccatcaatttgtttgtaaggaggacggctgtaacaaggttttcaggtattcatcaaagctgaagaaacatgaggaatctcatgttaaattggactatgtggaggtagtgtgctgtgagccaggttgcatga

SEQ ID NO: 15156 - DNA, 1929 bp, Zea mays
aattcggcacgatgcatggtggaaccctagagcttcacccctttttagcaccagcattccgccgcacgacctcactcaccacaggtgcggcggcgcacactgctgcacactgcactccctccgtcccgcgtccccgttcggcgctctcggcacgaccgccggtagcccgggacgcacgtcgcacggccccatccctcctagcggccggtgacggcaccggcggccctttgctcggctgtgcccaagctgcgagggcgagatctacccccgcgtccgtgcatcttcgtcaggcccttctccggacgagcactcacaggatgtgttctgaagttcatgttgagggagatgcaagtgtcggacagaagggttgcaaggatataaggcgttacaaatgtgaattttgcacagttgtcaggtcaaagaaatgcctaattcaagctcacatggttgcacatcataaggatgaacttgataaatcagaaatatacaactcagatggggaaaagattgttcatgagcaggaacataggtgccaagagtgtggccgttgtttccagaaaccagctcatctgaagcagcacatgcaaagtcactcacatgagggcatagatagttaacagcgtgaagcattggatcccatttaaagaactccaaaatgcgacgaggtattttttattcttgcctgaactagtaacaggttgggatgacctcctgtgaagcttcaacaagattgcctcagtcacgctcactgagtagagactctttatttgcccactggaagactgccccttcagctataaaagaaaagatcacttgaaccgacacatgcttaagcatgagggcaaattgtttagttgcaccctggatggttgtgatatgaggttcagtatgaaggcagatatgcaacggcatgttaaggaaatccatgatagtaagaacccccatcaatttgtttgtaaggaggacggctgtaacaaggttttcagttaaattggactatgtggaggtagtgtgctgtgagccaggttgcatgaagatgttcagaaatgttgaatatctgagggctcataaccaatcttgccatcagtatgttcagtgtgagatatgtggagaaaagcacctgaagaagaacatcaagcggcatctgcaatcacatgacaaggtgccctctgatggaaggatgaaatgcacttttgatggttgtgaacacttcttttccaacaaatcaaatctgaccaagcatgtcaaggcatgccatgaccagctgaaacctttcaagtgcggaatcgttgggtgtggcaaggcgttcacctacaagcatgtcagggataaccatgagacatctggtgctcatgtatacatggaaggagactttgaagagttggatgagcagttgcgtgcccggccaagaggtggtcggaagaggaaagcattgacggtggaaacactgacacgcaagagggtgaccatctccggcgaggcttcatccttggatgatggagtggagtatcttcgctggttgctatctggtggggatgattcaattgattgtcagtagccggcgtctttttgctatcaccgctgctttgtacatgggttagattatgtaatgtaagttgtttggtagactacgatggtgttcatgacgcgtttgatatattgtcagcagtatggtagtgcagggctctcatagtaaagcttgccatttttgttgtatctttaacccacgtgggtccagatgatgtgtttattcctatgtatttacttatctacatgtatccacatgtgcgactttggcgtttgtttgaaaaaaaaaaaaaaaaaaaactcgagggggggcccggtaccccagattataattccaaacaaacactgactaatgctctatttgttttaaaaaaaaaaaaaaaaaacaaaaaaaaaaaaaaa

SEQ ID NO: 15157 - DNA, 1363 bp, Zea mays
gtcgccaacaggaacagcctcgttctgtccaagtccaactccaacgaggcaacgactcgtcagtggtcagtacactacaccgtaaccgtcgccggaatcgatcgacccaaagctccctttagagcccgagctctatccaacccacgaacgggatcccgatgcccgtggcggcctcggttctcgccgcagcggcggtctcgcccccgctgacgtggcggagatggactcctcttctcgccgcgtcacatccacaggcgaacccgcctcccgcactgcgcccgcgggcgcccgctcctcctctccgggcctcctccgttccccgcgattcctgcgccggagccgccgtccggaggacgccgtgtgcggcggcggcggcacttggtggatgtgtgaaggcggagtccacggagcgggaggcgctcgatcgggatgctctgaagcgggtggcgctactcgcgcttggctgctgcgctgcagccgccgcgctcggctgcggcgctgcagccgccgcgctcggctgcggcgcggcgcgggcagcggcggaggactccatcaaggcgtcaggattcgggctgcgggtggcggagtcgctgcggaggctcggatggcccgacgacaccgtcgtgttcgcgctcgcgacgctgccggtgatcgagctgcggggggcgatccccgttgggtattggctgcggctccatccagtccgcctcaccatcctatccgttcttgggaacatggtgcctgtaccattcatcatcctctacctgaagaaactcgcaacgtttctgtctcagaacagcgcgtccgcgactcgaattatggacctcctctttgagcgggcacggcgcaaggctgctcctgttgaggaattccagtggctcggcttgatgctgttcgttgccgttccattcccaggcacgggagcgtggacatgggccttcattgcatctgtactaggcatgccgttctggtcaggttttacagcaaatttcgtgggagtcgtccttgcagggctgctggtgaacttgctcatgaatcttggcctgaaatacgcgatcgtcactggagtagttttgttctttgtctcaaccgtcatgtggagtgttcttcgttcccttaagaagtccgttaatgtcaagtgatctagtagtctttatcaaactgttcctaatcccttcagagttcagccttgcgtaggaagcttagttgtgtaattttaagtggaactttcagcttccaagtggatttacaagagagagtaacactccatatctccagcgagctgagaattggccatgcttatgtaagtcgcaagtaaaaatgtctttctcatccagtaattgaatatgcggtattttagctt

SEQ ID NO: 15158 - DNA, 2001 bp, Zea mays
gttcggtcaccaaacagtcagcgcggggcaggcggtcagcgcagggcagggcagcctgaaagaaagcggcggcggcagcaggtcactggctcactgctctgtcctctcgtctccagagtccagaccaccgcatcgccatggcgccgccgcagacgatcccccggcgcggcctctttattggcggggcctggagggagccgtgcctcgggcgccgcctgcccgtcgtcaacccggccaccgaggccaccatcggcgacatcccggcgggcacggcggaggacgtggagatcgcggtcgccgcggcgcgggacgcgttctcccgcgacggcgggaggcactggtcgcgcgcccctggggccgtgcgcgccaacttcctccgggcgatcgccgccaagattaaagacaggaaatctgagctggctttgctggagacacttgattctggaaagcctctggatgaagcaagtggagacatggacgatgtcgctgcatgctttgagtactatgctgatctggcagaagctttagatgggaagcaacagtcaccgatctctctgcctatggaaaactttaagtcgtatgtacttaaagaacccattggggttgttggactgatcactccttggaattatcctctgttgatggcaacttggaaggtcgcacctgccttggctgctgggtgtacaactatattaaaaccttcagagttggcttctgtgagctgcttagagcttggtgcaatatgtatggaaataggcctaccaccaggtgtcttgaacataattactggtctgggccctgaagctggtgctccattatcctcacattcccatgtggataaggttgcttttactggaagtacagagactggtaagaggataatgatttcagctgcccaaatggttaagcctgtttcattagagcttggtgggaaaagtcctcttattgtctttgatgacattggtgacattgacaaagctgttgaatggaccatgtttgggatcttcgcgaatgctggtcaagtctgcagtgctacttctcgtttactgctgcatgagaaaattgcaaagaaattcttggatagattggttgcatgggcaaagaatataaaagtctcagatccactggaggaaggctgcagactgggttcagttatcagtgaaggacagtacgagaagataaagaaattcatctcgactgcaagaagtgaaggtgccacaattctgtatggaggtggccgaccacagcatctcagaagagggttctttcttgaacctacaattataacagatgttagtacgtcaatgcaaatttggcaagaggaagtctttggaccagtcatctgtgttaaggagtttaggacagagagtgaagctgtggaacttgcaaatgatactcactatggtttagctggtgccgtgatctccaatgatcaagagaggtgtgagcgcatttcaaaggctcttcactctggtattatttggataaattgctcgcaaccatgcttcgtccaagctccttggggagggaacaagcggagcggttttggtcgggagctcggagaatggggtcttgataactacctgacagttaagcaagtcaccaagtattgctcggatgaaccgtggggatggtaccagcctccatctaagctgtgaaggggcattcactccagggaatgtaatgcatcattaactgacagcatcagtcctgttaatggacaggagctcgtgtacagtacagtgctcgtaaaaaaagctctttgatggtaaagttgcttgctgctatcactactccagaccagaattcaggactggagagtacgatgtcatgagttgtactacttgttagtctgcactcttatcattcgaagtttggcagtggtgtgtagttgcacttggaagattgcaataataataaagataattggataattgatccattttaatcacttttctttaaaaatgcaaaaaaatcgtaaatattaaaaaattggggggc

SEQ ID NO: 15159 - DNA, 556 bp, Zea mays
accatcgagtgacttcgtctagaaccaagctgatcgtctgtgaatgcaggacacaaatgtaatcggagacctggggacccttcacactgtcggtgcaggccatggtgtcggggagccctcgcactccccctcacgcaacacaacaccaatggcgcaaaggttgttcgtctcaggggctcgccgccttgatgacgtagggcaatgagggtaatcacgcgagcgtcggtgtcgccccccctcgcacaagtgttaggaatgtgagcccaaatggcccatacggcccaggttgctaaaggaacactacaaagagagacagtcaccagaaaggcagggggaatgagattacgcagttcatcttgcttatcaagtttactccctcccatatattctctacttccctctctaggatcttctagacccttgtagagtggcttcggcattcttctcccatccctaacctcatgttgtttttctttccgggattctaattctcggtaatcgctactgttaagttgaatcaataaaaaaaaaaaaagaaaaaaaaaaaaaaaaaaaa

SEQ ID NO: 15160 - DNA, 912 bp, Zea mays
cattgggtacctcgaggccggccgggagcggcgcagaacttcacgctctcccacgcagcccttccagcaccaccaccaccagcagcaagcatcgtcgtcccccgtccgcctctccgcttccttccaggcttctagccctctctcctcggcatctctagcgcgggcggcatctatagtagccctagccccggccgcggcattggaggaaggcagcggcattggctgcgggaaccggagaaggaggcattgactaggtacaagcctctgtaacctgccggatccggatccgaatccgcgctgccgactgccggagtttgggggcaacgaagcttgctctagtctctagagatggaggacctactgggttcggagatcgggaagaacgactacgattggctcctaactcctcccgggaccccacgtgttcctgcactggagggtgctgagaaaacaccacccacaaatatattaccgaagcgcactacaactagatcatcctcaactactagagcatctaggctttcaatatctcaaacagagaatgggaattcgacgattcccactagaccagcaagaagtaactctgttagccgatcatctatccagtcagctctcatgaatggcaacaacaggacatcagttctgaatacaagcatttcttcagtcacttcaagacctacaactcctagtaggcgaagcagcacagttggcacaccgaagcattcagctcctgctgcacgtccagtgcctgcaagatcctctactcctgttaatactcgtccatctacaccagcaaaaactcgcccatctactcctacgagaactcgtcccacagcaccaaactcttcaactgattccgctgctgcccagactacattcacacataatgcaaggcccatcactcccaattcc

SEQ ID NO: 15161 - DNA, 2483 bp, Zea mays
ttgacaagaatgtgagtgcttcttgcttatgtgtggccatatattatcagaaatgtgttaaaaggattgaggacgatgagactgggcacaagcactgtaccggtcagtactttgattactggaaatgtgttgacaagaatgttgcagagaaactctttgagatgttaaaatgacaaattttccctccatttatccacctaaagttggtaataattgtatcacttgtgaggcctatagactattaaggcacttaatatttgtcagagaacttttgcctcttgggtaacacaaattttccactgccagtttgcatttcatttctgctactagtattgaaccagcaaggtttcctccattgctggataaaaatcaatggaatattcccaagattgtggctgagcattaaatgctataatgtaccttaattgcttttatggtgtattttgacgaggacatagctaatcattcaggtccataacttggatgagatggaataacatgtgtacattacttctagctggtggtaatgatttgtcatgagaagtttgtagtatcatcggaatgaaacattggcacaatatagttttttttccagatgtagtgagttgacacatggatgctgttatgaggagagcttgtggttatatattccagcatctcttgcattcgagcggcctgtgtggttccccggccttgtatgtttactgttcattgcatatggggctatctggtgcattatggcggggtaaaatctgatggaacatttttatctttgccatccagtggtttggttatgttcactgtcgctttgtgtttgtctcatgttctgtttgccatgcttggtgttgtgctatggcgacaactgacaagagctcacttcttgctatgttgtatcatcagacgtggaatgctcaaccagttatctgctgtgcgtgccacgaatttgttgcatcggtgcattctgactggattaaatagactggatgttctcctttgctttggatgatggtgatcaatgtgtcctgacctggcctagcgaaaatctacctgaaaggtttttcagattcgtgcagtgcttgcaccgtaacaatgccatcatgtagtcgatacatgtgtactagaatattcccaaaggtgtttctaagtttggtctaaggtctatttgagatttttgtgtcaaggctatgattatcaggactcgtcacgactcatgactcccacccacctctcacccagtcgcacttgtcattgtcaggactcccacccagccatccctggcctgctctcctaccgtacctctcgcgtggcatgcggtgtgactcccggcggcctgtgactctcggcctccggcgaaccttcggttcctgatggctggctcaaggtgagctcctgggttccagatccagacaccgacgtgacccggttaaaatcatgtttgaagattcatgttacttgcatgatacactaaacaagagtctagatgcttacatgatacactacctggactcagttcgttactaatgtttgcctatgggacatttcgcccttagccattgccttgtgcccacaccacaacagatacaacaccacttgacatcgatcaacaaggttcttgggaccaggcatagctcttcaacaactccacataaatgtcattgacaccacctctgtcctcgaccaagtggtatgttgactctagtgtcggctcccacatgaccaacattgtcgatatcgtttcttcctcacgccctcctccgtctagtccttcatctgccattgtcaataatagggtcttgtaacgtgtcacctctattgggtaatattccttgttcatgccacaatgatctcttttttctttctaatgtattaatttcacccagcattattaagaacttgatttatgttcattgctttacaactaataacaattgttccattgagtctgatccctttggtctttctatgaaggacttacaaacttggagcatgattgccaggcgcaatagcacatgtggtctctacccattcttcccaccggttagcatcactgcactttccaccatcgtgtcctcctcctccctctagcatcgttgccttggtacatcttggtcatgatgccctatgcaagctcattaggtccaatgctattttttttgtaataagcgcacagatgatcttatatgtcatgcttgtcaattaggtcatcacacatgtattccttttagcatgtaaaattctcgtgtgctacaccattttgatttaatatattgtgatctttgaacatttccgattgttagtgtatcatgttacaaatgttacctcgtcattcttgatgattgcactcactacacttggatttttttctcttcacctcaaacctgacatttttggtattctctccaatttttctcctatgtgcataccaagttcatctcacccttcaaggtggtccagtgcgacaatgtgcacacctaggttatctc

SEQ ID NO: 15162 - DNA, 957 bp, Zea mays
  misc_feature (893)..(893): n is a, c, g, or t
  misc_feature (916)..(916): n is a, c, g, or t
ggaccctcgagccccccccggatcaacaattcctgataaaaacagacccacttcctctgatcctcttcaacccacccaccgtgggttcgtccagccttccggccttcccccccggtggtcatcacatctcccccaattcgccgccccctccgacctcgccgtactcctctcgctccgttgaagtagcctcttcatctgctcgccgcagttcgtccgttgcccatggcggatgaggaggtaactgatccaaaggcgttcctagaggaacgttcaaaggctaagtgtgtgtcgcagtggtatgaatatcagaaatgtgttaagaggattgagaatgacgagactgggcacaaacactgtaccggccagtactttgattactggaaatgtgttgacaagaatgttgcagaaaaactctttgagatgttaaaatgacaagaaaagttttccctacttcagttatccacccaaagttggtaataattgtatcacttgtgtggcctatagactattaaggcgctcaatatttgttagagaagttttgccacttgggtaacacaaattttccactgccagtttgcatttcatttctgctactagtattgaaccagcaggtttcctcctgcattgttggataaaaaatccatcgaatatttacaagattgtggctgattattaaatgctgtaatacaccttaattgcttttacggtgtattttgaggagcacatagcaaatcatttgggtcctaaacttggatgtgtcggaataacatttgtacatcacttctagctggtggaaatgattcatcatgagcagaagtttgtagtactgcactggaatgaaacattggcacagcatagcttttgtccacatgagaagtgatacgtggatgctngtatgagcagagcttgtggctanaaaaaaaaaaaaaagcggcctcgagctcagctttgttcccc

SEQ ID NO: 15163 - DNA, 1049 bp, Zea mays
ccggccgccccccaattatcaacaattcctgataaaaacagacccacttcctctgatcctcttcaacccacccaccgtgggttcgtccagccttccggccttcccccccggtggtcatcacatctcccccaattcgccgccccctccgacctcgccgtactcctctcgctccgggttaatcgctgctgtcttctgcagttgaagtagcctcttcatctgctcgccgcagttcgtccgttgcccatggcggatgaggaggtaactgatccaaaggcgttcctagaggaacgttcaaaggctaagtgtgtgtcgcagtggtatgaatatcagaaatgtgttaagaggattgagaatgacgagactgggcacaaacactgtaccggccagtactttgattactggaaatgtgttgacaagaatgttgcagaaaaactctttgagatgttaaaatgacaagaaaagttttccctacttcagttatccacccaaagttggtaataattgtatcacttgtgtggcctatagactattaaggcgctcaatatttgttagagaagttttgccacttgggtaacacaaattttccactgccagtttgcatttcatttctgctactagtattgaaccagcaggtttcctcctgcattgttggataaaaaatccatcgaatatttacaagattgtggctgattattaaatgctgtaatacaccttaattgcttttacggtgtattttgaggagcacatagcaaatcatttgggtcctaaacttggatgtgtcggaataacatttgtacatcacttctagctggtggaaatgattcatcatgagcagaagtttgtagtactgcactggaatgaaacattggcacagcatagcttttgtccagatgtgagttgatacgtggatgctgttatgagcagagcttgtggctatatattacagcatctcttgcatcatataaatttgtgtgtttccccccttgtatgtttactggccattgtatatggagttatctggtcattttttttaccccaacaaaatgacc

SEQ ID NO: 15164 - DNA, 925 bp, Zea mays
acggcgggcggcccagcccaccagacccgcttccgccccggcccacacctcggggccggaggggcttcgtccgtcccctcctctcccgtgctcaccacctcccccattttcgccgccccctccgatctcgccgttctcgtctccttccgttggattagggctcttcatctgttcgccgcacttcgtcagtcgcccatggcggatgaggaggtcactgatccaaaggcgctcctagaggatcgttcaaaggctaagtgtgtgtcgcagtggtatgattatcagaaatgtgttaaaaggattgaggacgatgagactgggcacaagcactgtaccggtcagtactttgattactggaaatgtgttgacaagaatgttgcagagaaactctttgagatgttaaaatgacaaattttccctccatttatccacttaaagttggtaataattgtatcacttgtgaggcctatagactattaaggcacttaatatttgtcagagaacttttgcctcttgggtaacacaaattttccactgccagtttgcatttcatttctgctactagtattgaaccagcaaggtttcctccattgctggataaaaatcaatggaatattcccaagattgtggctgagcgttaaatgctataatgtaccttaattgcttttatggtgtattttgacgaggacatagctaatcattcaggtccataacttggatgagatggaataacatgtgtacattacttctagctggtggtaatgatttatcatgagaagtttgtagtatcattggaatgaaacattggcacaatatagtttttttcccagatgtagtgagttgacacctgcctgctgttatgaggagagcttgtggttatatattccagcatctcttgcatccgaaaaaaaaaaaaaaaaaagcggcc

SEQ ID NO: 15165 - DNA, 3737 bp, Zea mays
cattgggtacctcgaggcccgcccccgttcttccccgaggggcgaggagtgtccaggaccggagcctgacgcgcctacagagggagaaaggagggggaatacccggcccggtccagatctctcagaccgaagcgctggacaaggggcagatggcttcggcggctgcagcggtgatcccggacggccggcgatggagcaaaggtccgggctcctcgtcgtcgccggtgacgacggccattttcctcttcttcttcgttgtcgtggtcggcgtcctcgtgtccgcccgctggatcaccaccacgactcatctgtcgaccaccaatctggatcagtggagctcaaagctggctatcttaaccgcgacgcacaccacctcctccatcccggccatccccgcggcaccgccgccgcctcggccgacctactccctctcctgcccggcgccgccgcttcaccgtgacccgaccatccccagcaacatctcccagaccctcgacctcgtgctctcccccaacgcctcctccgcctccacttgcgccgcctttcccgaccccccgccgctccctgccaactccaacgcctcctccacctgccctgcctacttccgcttcatccacgaggacctccacccatggcgcgccgctgggggcatcacccgcgccatggtcgaccgcgcgcgcgccaccgccaacttccgcctcgtcgtcatccggggccgcgcgtacatcgagcgcatcgcgccggcattccagacgcgcgacctcttcaccatctggggcattctgcagctgctccggcgctaccccggccgcgtccctgacctcgacctcatgtttgactgcgtcgactggcccgtcgtgcacgccgaccagtaccagggggagaacgccacgctattgccgccgctcttcaggtactgcggcgacaacgagacgctagatgttgtcttcccagactggtcattctggggctggcctgagatcaacataaaaccgtgggatgctctgcagaaggaattgaatggtggaaacaagagggtgaaatggttggctagagaaccttatgcttattggaaagggaatccagatgttgcagttacaaggcaggagcttggtaagtgtaacgtctccagtaagcatgaatggaatgcaaggatttacaaacaggattggctcaaagagatcaaggcaggatacaaacagtcagatttggctagtcaatgcactcataggtacaagatttatattgaaggatcagcatggtcagtcagtgagaagtatattctagcttgtgattccatgacactagttgttacaccaaaatactatgatttttattcaagggtgctgatgcccatgcaacattattggccaatttgggatgacaataagtgtagctccataaagtttgctgttgattggggcaactctcacaagcagaaggtatcttttcgtgtacacctttattatatcattaagaagggcaggcctagtgcagcggtgagagcactgagtcatcagataacgggttcgaagtagcttgtccgcatttgagggggcggggagcttgactcagtttatcactttctcagatcccactcatatgggagcctctggcattgggtctgccccctttattatattagtaacaaagcttcactgttttatttgttttgagtcaggtcccatatatcagtcacagatgtaaatgaacctcataacaagagagaacaactttctaatacagatattataagagagtaatacatttattataagtcttcaaaaagtatagctaggactgtacagcattgtactagtagtagaaaggacaaaaggttggttaaatacgacagtggagtcaggatggttgagaatttcttttgtttccaaaacaaatgtcaccaggtactacaatgtgcaaaataatgagttaaaagaagtgtgctttgtttgattaggcacctaccataaggtaaagagattggttagacaatgttagttgttagtgtaacaaagcttcactacagaaagtatcttacctatttgcatgaatgatggaatacattggttatatggtgcattgtgctgtatgcactcaggagatatttctagtgtcacctataataatcaaactaacatgacatatatcatgctcagcatatttctaggaagcttttgccagacaaactttttagcctgtaatattaggcagattcatattttaatagaagttcctcaagcagtatataagactcctttttctcctttgtagtatatgctatagctgaatgttctgtgctttaaccagagcataagtgtagaaaataactgttgaaatgacttgtgggtagtgagtcatcaatttgaatactcgtctacttttctaatccaattctccttgacctttcacaaataataacatagtggagtaaatagtgccccttttcttctatagagaatgttttcttacgtacatttgtaaatgttttgcatgttttattaatgaccgtgtacatttgtaaatgttttgcatgttttattaatgaccatatccacgtattgcacttcaaatataggcacagaggataggaaagcaaggaagcaactttattcaaaaagagctcagcatggaatatgtatatgattacatgtttcacctcttaactgagtatgccaagctcctaaggttcaagccaagaaaaccacctgaagctattgaggtctgtcctgaatctctggcttgccaagctataggccgcgagaagaagttcatggaggactccatggtgagatccgccagcgatgctggcccatgtgacctgcctcctcctttcagtcctgaggaattcaaagcactgcgacgtaggagagagaaggcaatgaagcggatcgaaacatgggtgcaaaaaacttcgaggcccatggttagcaagccctgagagagcttcatgcttttccctccccaatagatacatacccaatttttgtcgtgctaataacccaaggcatttcttatctgtttgaatcaaatgtgtgattctgcagaagttatagatggtttcagttctccagatcttatcagtattcttctatttgtcttgtggcttgtatttttcgatactctctgctttagctgtaggatgtagcgatattgcttagtgacccgactttagagtgagagtaaagaatgtgtttgtctagagccagttgaggggagggtttagatagagggattccaggacattttgtttggttggtgggacgagaaatgcggttttaggggcacgtttggtctgtggctcttgatgagaaagccaacgtttggttatccaagtttggcacccattaatatctctatcacttcgaatatatttgatactagttagaagtattaaatataatctaattataaaactaattatatagataaagactaaatagtaagacgaataattaggtcatgattcacccatgtgatgttacagtaaagtaaacatttacaaatcataaattaattaaacttaataaatttgtctcgttgtttgatatttatcgatataattagttttgtatataattaatatttaaatatttaatatgacactactaaactttagttaagagaattccttattcaagggtagtctcttgagggctcgttcggttctgtgccaatccatatagataaagggagattgagggggtttcaatccctagcaagtcaaaatccctcgc

SEQ ID NO: 15166 - DNA, 3844 bp, Zea mays
  misc_feature (266)..(266): n is a, c, g, or t
ttgccgtatccgtcatgcaatccgctcgcgcattgccgtcgccggcgatcttcttcccttgcgttgcgtcagtgccgataacagtagcagagtaatgagctagcacgtgaactgctttcacgaaccctagcaaccgtctacgatgacaatcaatgcgatttaccccgtaatagtagcagagtcatgtgccgttcggatccaccgcttcaatgttctttctttttttttttcctttccctttgctcgaatctaaccttgcagcttgnaggcaggagaagcagaagaacacaagcgtcaatggcccacttaaaatatctccaagaagtaatggcggcatggcatgagcgcaccaaacaacggctctcgccatttacagtcccaccgcacagctgagccgagtgatgaataaacttaggccggccgggcaaaggggggttgtgtggccccgtctggcgcctgctgttcactctccaatctccactcccctgcttcccacaccggacaccggagctcactcgaggacgctgtacgagcagcagcagcatacataaggcacggcagctgagctggctcctccacctttctgtccatccatcacagcttcgagactcgtcctccatgggttctggcggcgtcagatggaaggctctgccgctgtgcctagctctcgtggctctgcaagcatgcctccctgctcgcggggcggctcccaagacttacatcgttcagatggccgcatctgagatgccgagctcgttcgatttccaccacgaatggtacgcatccactgtgaaatccgtgagctctgtgcagctggaaggagacgcggacgaccattacgccgcgaggatcgtctacaactacgagacggcgttccacggcttcgcggcgaagctggacgaggacgaggccgagcggatggccgaggcggacggcgtggtggccgtgctcccggagacggtcctgcagctgcacaccaccaggagcccggacttcctgggcatcagcccggagatcagcgacagcatatggtccgccggcctggccgaccacgacgtcgtcgtcggcgtgctcgacaccggcatctggcccgagagccccagctttagcgacaagggcctcggccctgtcccggccaggtggaagggcctgtgccagaccggccgcggcttcaccgtagccagctgcaaccgcaagatcatcggcgcgcgcatcttctacaacggctacgaggcctcgtcggggcccatcaacgagacggccgagctcaagtctccgcgggaccaggacggccacggcacgcacaccgcggccaccgccgcgggcgcgcccgtgccggacgccagcctcttcggctacgccagcggcgtcgcccgtggcatggcgccccgcgcccgcgtcgcggcgtacaaggtgtgctggacggggggctgcttcagctccgacatcctggcggccgtcgaccgcgccgtggcggacggcgtcgacgtgctctccatctcgctcggcggcggctcgtccccctacttccgcgacagcctggccatcgcgtcgttcggtgccatgcagatgggcgtgttcgtcgcctgctcgggcggcaacggcggcccggaccccataagcctcaccaacctgtcgccgtggataaccacggtgggcgcgagcaccatggaccgggacttcccggccacggtgacgctcggcaatggcgcaaacctcaccggggtttcgctctacaaaggccggcgaggtctttcgtccaaggagcagtacccgttagtctacatgggcggcaactcgagcatccctgaccccaggtccctgtgcctggaggggacactccagccccacgaggtcgctggaaagattgtgatctgcgaccgcggcattagtcctcgggtgcagaagggtcaggttgtcaagaacgccggtgccgcgggcatgatactcgccaacacaccggcaaacggcgaggagcttgtcgccgacagccacctcctgccagcagtggccgttgggcagtctgaaggcattgccgccaagaagtacagcaaaaccgccccgaaaccaacggccacgctcagcttcgacgggacgaagctcgggatccgcccatcgccagtcgtagccgcgttctcgtcccggggaccaaacttcctgaccctggagatcctcaagccggatgtcatcgcgcccggcgtgaacatcttggcggcatggagcggcgacgccagcccgtcgagcttgtccagcgaccgccggcgggtcggcttcaacatcctgtcggggacgtccatgtcgtgcccgcacgtcgccggcgtggctgcgctgatcaaggccagccacccggactggagccccgcgaagatcaagtccgcgctgatgaccaccgcgtacgtccacgacaacacgtaccggtcgctgaaggacgcggccaccggcaaggcgtccacgccgttcgatcacggagctgggcacatacacccgctgcgtgccctcaaccctggcctggtctacgacatcggccaggacgactacctggagttcctctgcgtggagaacctgacgccgttgcagctcaggtccttcaccaagaactcgagcaagacatgcaagcacaccttcagctcgccgggtgacttgaattatccggccatctccgcggtcttcgcggagcagccatctgctgcgctgacggtgcgtcgcaccgtgacgaacgtcggcccgccgtcttcgacttaccatgtcaaggttacagagttcaaaggcgcagacattgtcgtcgaaccaagcaccctgcacttcacaagttcgaaccagaagctaacctacaaggtgacgatgacaaccaaggctgcccagaagacaccggagttcggagcgctgtcttggagcgacggcgtccacatcgtccggagcccccttgtcctcacatggctgccaccgatgtgagcttcgtttatttaccgtgcgtttagagcaagcaatggagcaggaacctctgggcctgggtaatcaagccagagatccgttgtgtcgcagcggcagcggcagcggcagaacaggttcactaaccaacggaaaaatactgtcaaagctccacatgagaaccgcctttattcttcaatgtattcatgcttattccaaatgttcagttgccagtttgattgtttctacattaatgagtgtacaagaaatggaagcaaatagtacggaaaatttgctgctagcaggtttagctagattcccaaatggtgacaccatcacaagtgcagagttccttgtagttctctcctacgccggcacttcttgcaatcaccgctgcggcgatgccagggtctgatttgtccttcgctgcatacaaagcaatcgaccggccgttcccaaaatcaactggttttgttactctcaatttctccttcggtcctgagaaatgggcttccccgttctctccagcttctagagttcccaggtcaccaagtggttgtttcagagaggtaaaaatattagttcccaattttgatttgaaggagttacgttttcattgttgaaattggtattccttcaaataatgaaattgatttctcaaagcaggtcacttgaatacactgttgagctcagggttcaaaagatttgtgctttccatgttgaaagtcgaaactgtgttccctcagttgcaacaatattttatttctcaagactgatcactcagctaaatacaacacattctctgaaaccttgataaaacataaaaccctttataaaacataatcagccaacccataagaaattgctaccttatctttcccaatgatggttcagtaacaaatatgctatgcaaatc

SEQ ID NO: 15167 - DNA, 1184 bp, Zea mays
aaagccaaaaacacaaagcccgggccccacgcgtccgcccgcccaaccatccagctacacctcccagcagcagcagcagccatataaagctactgcctactagctacgaggggagacgagaggcgaggagagacgccgccggactgccgtgcccagcgcccgtgaccatcccatcccatccggtcatacatgaaggaccgccgtggcagctcctccgtcggcggcggcgagcgcttcgccgttttccccttctccatgggctgcatgtcgcagtccgccgtgtccgtcgccgaccccggcgacaagaaggcgcagggggacccgtcctccactgccgccgccacggtggctcgggggagcaggttcatcggaagaaggcgccggcgaggccatgacgaaggagaaggccgtgacggcggcggcggcgacgacgccggggctcgtggcggccggggtgtcgaggctgatgaaggggatccggagcctgtcgcagatgttcgcgggggaggacggcggcgaagatgaggatgacgaggagcgggagatggtgatcgggtaccccacggacgtgcagcacgtggggcacatcggctgggacggccacaacagcaagggcgggcgccgccgcggccatggctggcatggtgaacgccttctccctgccttcctccctctccctccgccacctcgacatggccatggaccgcgccgccgcgcacgcctccgcctgaacccggcctgatgaccgcgcgcagctccgacggccggtatcgtacgtagctactagattccgcggttccgccatttgattgcttgacacgtacgtacgcggagaacgaaggaaggaaggaattgatcgactcccatgcctccagtttgctgctgctgcttgttactgccgccggccggtccctgttcttgccagtccattgccgtacgtgcgtgaaagtctctcgctttctgtgtcatatcatatccggtgtgagctactatagcgtagagcatgagacgacaagcgtatttgtgtacatacgtgcatgccaacttgtatagtttgtgaggcttcgccatcacacaccccacggtgcctgctggagctcatgtcagtatgtgtgtgtgcctgctgccagtgacctatataactctgcgtgtgctttttaattaacacccgtttcaatttttcg

SEQ ID NO: 15168 - DNA, 2444 bp, Zea mays
gtcaccccaaaccggtctttgtcgcttcaaaccgtccaagggattcaaaacgcattgcgtaccgccacgccggcccttggtttctttctttctccctacgccttgtccgctcctctctccctctctcgttctcgtcctcgtctttctcgagccgcgaggcgatcgcatcggagactcggagccggcaaaaccctaaggggaaggtttctgcaaggaggagggagatgcagggcgccagccacatgctcctggaggagcccttccgcctcgcctccgtcctctcccccgccaagcctaaagtattcccatcactcaccaagatagttgggacgctcgggcccaattcacactcggttgagattattcaggaatgcctcactgctggaatgtcagttgcacgatttgatttctcatggatggatgctgcgtatcaccaggagacccttgataatttgaggaaagcggcacagaatgtgaagaagttgtgccctgtaatgttggatactcttggtccagaaattcaggttcacaattccactggtgagccaattgagttgaaagctgggaatcatgttatcataactccagatatttctaaagctctctctgctgagatcctaccaattaagtttggtgatctggcaaaagctgtgaagaagggtgatactctttttatgggccaatatctcttcacaggaagtgaaacaacatctgtctggctagaagttgtggaaacttctggggaaaatgtaaattgtctagtgaagaatgcagctacacttgccggccccatattcactctgcatgcttcacaagttcacatcaatttgcccactttgagtgaatatgataaacatgtcatttcaacttggggttcatgtaacagtgttgacattatatcactttcccatacccgctctgctgaagatgtcagggagctcagggcctttttacaagcacacgcccttcctgacacacaaatatacgcgaagattgaaaattctgagggtttggatcattttgatgacattctcaacgcggcagatggtatcattatttctcgaggagacctgggtattgaccttcctccagaaaacgttttcatgttccaaaagacagctattcataaatgcaatctggagggtaaacctgtgatcatcactagagttgtggacagcatgattgacaatctacgccctacccgtgcagaggcaactgatgttgcaaatgctgtcctagatggcactgatggcattttgcttggtgcggagacacttcgagggctttatcctgttgatgcagtgagtactgtggggagaatatgtgcagaagctgagactgtgtataatcagccgcttcaattcaagaaagtaatgtggcatgtaggtgacccaatgccccacgaggaatctgtggcatcagcagcggttggttctgcaatcaaagtaaaagctgctgccattgttgtgttcacattctcagggagagctgcgaggttagttgccaagtataggccaacaatgccaattttagcagttatcttcccacgtgaaggatccgatccatcaaagtggcgttcttatggcacaacacaggcaagacaatgtttcgcagtgagaggcgtgtaccctttgatggggagtactgatgaggccgaaactggtgggctaacaaaggaagagtatgggataaaacttgcgatgagctatggtcggtcggtcggcatagtgaagcctttcgacagggtgataatctttgaaaagattggtgattcttctgttgtcaagatcattgagtgtgaaggttaggcattagatgattgatacctacaaggctacaacccatgctgtagtttcatgtatcgcatgggagattacctccagttccatctcacttatttaaccaacaagtagagtacagcaagagcacaagatatcttgttagggaattttgccctcttttcagattgtcttttgatttgacgcaataaattatgatgtcacagatttatactggaattatgatttgattatgcaaatataggattgttggcaacaaaaaaaaaaaaaaaaaatcggtgacggccgcctcgccccagctagccaaccaagggccggcacgacaagccaagaacacgtataccaccagctgacagctcgcagctagctgccggcggactgcctgctgtgccaatctcaaagagaggcgcaagcgcaactcaagcttggtttgctctctctctcttgcgggcattgctttgcttgctccggtctcatccaacatttgttgtcattttattgtctagtttgaatactctagtattaattttaatcatcttcacacacacgtggattagagttaatactagaatacctaaacaaagtctaattagttttctttttcttttttcccaactttctttgttatttcttttcttactttcc

SEQ ID NO: 15169 - DNA, 3811 bp, Zea mays
catctttccttgggttattatagttcgattaaaatcattagctggctccttcagtgcccacatacatgcatgtgtagggtaactctttttgaggcatgataaggagttttgatctcattaccttcaaacaccagtatccatttggttaatatggccatggggagcctagtttgtgcatccaatctaaaatctgtagtttggtcatataatggaatttaaaagctattcagagtatgtttgagactgactttgatcttgttgagcaggtaaaacttattgataatttcaccaacaagaaaggcatgacaagtcattgctacagaatagcatataggtcaatggaacgttcgctcacagacgaggagattaacaatcttcaggtacatgcaacaattctcatggagaaattgtttaatgatatcctgatttcttaatctgatcatctgtgcaattaaattgcagttgaatgtcagggaagctgtgaaagataaattgaaagtagagttgagatagcagcagctaattatgctgtcatagcatggactaaattttgcctgtctttatgtaaatcaattaaaaaggattttttatctatcgagaaaatgcgccatttgttcctggcattgatcacgttctcttctgtttagggaagagaaaaggtccctgttccatttgggaatcatatcttgtaattcataaggctttgtttggttgcacagggatcaaaggagattgaggaggattaaatccctctctattcaattttgactaggtagagatttaatcccctctaacctccttttaatccccttgtaaccgaacaagccctaagatgatgagctgtacacttctcactattttggaggacatgtggtttgggaattcatgtttggcctttcaattcaattttggccgttgtacattatttgtaacgaacaagtaaaagcactctgtatataaagtctaggatggttcaaatctgaaattaacctttagaagaacagtatatatctaaagtggtgaaagaataagagaatggaggtaggcctagtaataagtaataactatttagccttctaaccatcaaaataactaatctattatatacaatgactatagttagctttaaaagatatgttgatggtttacaacaggttaaaccattagccttgcttttagacgtcgatcgccactgacagtggacattctattggtggtggtggagactggagagcgagtatctcgcttccgaagcaatactctcgaagagggcgattggttgcttgcagttggcctaggcccgtcccacgacatgcaagatttctatgagcctgggccctatttggttgtgtatctaagagcatctccaagaggaactcctataattagggtctcaaaagctaaatttgacctgattcaagttaacttggatcaacattttttatcaactccaacaacaactactaaactcactcctaaacccacgtggtagttaactccgtgagattagacacacatgaataggtcccctggctggggtgctatatttagcaactgtgactcatttgatagaaatttataaaataacaactttgttgaaagctattttgagatcttaactcctatatttgaatatatgacccgacttaagtcctctcttggagatgctctaagatgctaaagattgctacatattttgtcacacttgtttaaaattagacgtttgaattcttcaccatactttagcatgttaaaacaaaatcttgtcatatttttatgatgagtggatcctatgcaacatgagaaaaatgttaccacaaatatggctgcacaccaaacatatgcctaaatatttaattatataaccgatttcatatcttgatatttttttaaacaaaacaaattttatctagcctggctcaccaatacaatcataatagactgatgcgggtaaccaatcagcctctaacatttgcaacatctgacaagaatcggagaaatgccgcctccgacgagccaccgtcctccatcgcttcctccgtctctttcttcagttgcagcgctcgtttcttaagcctcgtcccctcctcggactccaacgctagcctcagttttccctcaatttcttcagctttgatgagacctgtcatgtagccctccatctccatcccgacgcccatgtcctcggttataaacaccttgttcatcctctgctccgcgcccgccagtggccaacacagcatcggcacccccgccgcgatcgcctccagcgtcgagttccacccgcagtgggtgacgaatacgcctgtagcggggtggttgagcacatccacctgcggcgcccacgacgtgacgacgaggccacggtccttggtccgctccacgaagccctccggcaagagcgcgtccagatccgcctcggcacgttgctcccagtatcttccgggcccgtccctgcctgccggcgtgcgcacgacccacaggaaccgttgcccacatctttccaggccaacggcggtctccttgagctgctccttgggtagggcgcccttgctcccccagcagaggaacgcgacgctgcgctccggctgcgcgtccagccacgcgaggcattcgtgctgagggccgccgtcgccttcctgtctgcccgtcccagtcccaaccaacggcccgatggggtagactggaggcagtgcctgtccgggaacgcacaggggatccctcagcgcctggagggcccgctgctccagcgactcgaacgtgttgaccagtacgccgtgggtgcccgcgttgcgctccaagatctccatcgaggtcctgcacagctcgtcctccggactctccagcagcgacgtggcgagatgggacgccggcatgggcggcaccccgaggaactgaagcggcttgtccccaagttccttcaggcccgtcagcctaccggcaagcagcgccggcagctgggtgaagatcgccagagtccccgcgcctgaggcgaagaacttgaatacggggacgcccagcctcgtcgccacatcgatggcgtgggtgcagaacaggtcgatgacgagggagtgcaggcgctcccgggggatggagcggaggaagctctcgagcttgtcgttgtactggcgcatcagctccagtatgaggaggaaagggtgcttggtggagctggccacgtcaggtgccggggtcggcggcaggacgtggaaggtgatggacgggttggaggcggccacgcgctcgatgaagccggcgccggagtcggtcgacttgatgggcggctcgatgagcaccatggtgacgtcgtagccgtggtggaggaagaccttggcgagctgcgtcatgggcccgacgtgcccgacgccgccgacggggtacagaacggcgatctgcttcacggatacgtcatccatctctgaggcacgggcgcaccgcgcagtcgcgcacgactggttaggatttgggaatctactttgaccttgggatttcctcgatctgtggcaggcgccaggcagttctgtttggccattcgcgtttataaataacatcaatagaccacccggagttctggcatttgtagttttgacaacgaaagccaagactctgagacctaaagactttaatgattacaagtggggataaatttttattcggcgcattacggcattagcatttgcgtccgattttgcaactaaagaaaaaaaaaagatttcattccactcgtggttagcccgtctcgactcgattcattttaattttatcacgagttagcaagcatcttaacttagtttgttaatgagctagcttg

SEQ ID NO: 15170 - DNA, 1776 bp, Zea mays
atttttcttacacttctcgtcttcttcccctttcgctttcactcttcctttgcagctcacactcacaagaatcccccgcgtcgcagacatgcggccgcttatccgaaccgctcgctgctggctcctccgcgcgcgtgttcgcggcatggccacgcttccaatggcgctctcccccgccgccatttcccccttcaccaccctccccctctactattcttcgcgtcctcaccgccgcctcctcgcccgcttcttctccgtcgcttcggcaccgggcggagcgaaagggcaccgaccggcggcctccgccgttgaggtgggcggcgtcaagatcgcgcgcgaggatgttgtgaaggaggatgatccgacaaacaacgtgcccgacaatatcttttcgaagatcggcctgcagctgcacaggagggataaccatccccttgggattttgaagaacacaatttatgattactttgacaagaacttcactgggcagtttgacaagtttgatgacctttgccctcttgtttctgtcaagcagaattttgatgatgtcttggtcccttctgaccatgtaagccggagttacaacgacacatattatgttgatggtcaaacagtcttaaggtgtcataccagtgctcatcaagctgagctgctaaggcatggacatacacactttcttgtaactggagatgtttaccgtagggattccattgattcaactcactatcctgtcttccatcagatggaagggttccgtgtcttctctcctgatgaatggtcagggtctcgcatgggtgggacagcatatgcagctgcagaactcaagaaaacactggaaggcttggcaagacatctatttggtgctgtagagatgcgatgggttgacacttacttcccatttaccaacccatcctttgagctcgaaatatactttcaggatgattggttggaggttttggggtgtggagtcaccgagcaggaaattttgaaaagaaatggcaggagggaccatgtggcttgggcctttggattgggcttggagcgccttgcaatggtcctttttgacattccagatattcgactcttctggtcgaatgataaacggttcacgtcccagttctcagaaggcaagcttggtgtcaagttcaagccattttcaaagtttcctccttgttacaaggatatgagtttctggatcaatgatgcatttacagagaacaacttatgtgaggttgtcagaggaattgctggtgatcttgttgaggaggtaaaacttattgataatttcacgaacaagaaaggcatgacgagccattgctatagaatagcctataggtcgatggaacgctcgctcacagacgaggagattaacaatcttcagttgaatgtcagggaagctgtgaaagataaattggaagtagagttgagatagaagcagctagctatgcagttataccatgaactaaattttgcctctctttatatgtaaatccatttaaaatgatttttttgtatctatcaagaaaatgcaccatttgtttctgtatagatcacgttttccgttatgtttaggggagagaaaatagttcccaatccaattggcactcatcaaatcgtgtaactcataaagatgacgtgctgtacgctgctcgctaggtttttttttgtgctgttagtgtaggataagatgactctatgtttgcagtagtcagagttgtgccattgtcctcacttcccatatacatatttcatcgaattaaaaaaaaaaaaaaaaaa

SEQ ID NO: 15171 - DNA, 1766 bp, Zea mays
ggccccgcccgcgcgtcccccctcccctcccagcccacaagactccgcggcgccgcagacatgcgcccgcttatccgaaccgctcgctgctggctcctccgcgcgcgtgttcgcgccatggccacgcttcctatggcgtcccccgccgccgccatcccctcctccgccacccgccccctcgcctccccttcttcgcgttctcaccgccccctcacccgcttcttctccgtcgcgccggcgccggtcggggcgaaagggctccgagcggcggcctccgccgttgaggtgggcggcgtaaagatcgcgcgcgaggatgttgtgaaagaagatgacccaacaaacaacgtgccagacactatctttgcgaagattggcctgcagctgcacaggagggagaaccatccccttgggattctgaagaacacaatttatgattactttgacaagaacttcactggacagtttgacaagtttgatgacctttgcccccttgtttctgtcaagcagaattttgatgatgtcttggtcccttctgatcatgtaagccggagttacaatgacacatattatgttgatgatcaaacagtcttaaggtgtcataccagtgctcatcaagctgagctgctaagggatggacgtacacactttcttgtaactggagatgtttaccgtagggattccattgattcaactcactatcctgtcttccatcagatggaagggttccgtgtgttctctcctgatgaatggtcaggttctggcttggatgggacagcatatgcagctgcagaactcaagaaaacactggaaggattggcaagacatctatttggtgctgtagagatgcgatgggttgacacatacttcccatttaccaacccatcctttgagctcgaaatatattttcaggatgattggttagaggttttgggctgtggagttaccgagcaggaaattttgaaaagaaatggcaggagagatcatgtggcatgggcctttggattgggattggagcgtcttgcgatggtccttttcgacattccagatattcgactattctggtcgaatgataaacggttcacgtcccagttctcagaaggcaagcttggtgtcaagttcaagccattttcaaagtttcctccttgttacaaagatatgagtttctggatcaatgatgcatttacagaaaacaacttatgtgaggttgtcagaggaatagccggggatcttgttgaggaggtaaaacttattgataatttcaccaacaagaaaggcatgacaagtcattgctacagaatagcatataggtcaatggaacgttcgctcacagacgaggagattaacaatcttcagttgaatgtcagggaagctgtgaaagataaattgaaagtagagttgagatagcagcagctaattacgctgtcatagcatggactaaattttgcctgtctttatgtaaatcaattaaaaaggattttttatctatcgagaaaatgcgccatttgttcctggcaaaaaaaaaaaaaaagccgccgccgggaagagaaaaggtccctgttccatttgggaatcatatcttgtaattcataaggctttgtttggttgcacagggatcaaaggagattgaggaggattaaatccctctctattcaattttgactaggtagagatttaatcccctctaacctccttttaatccccttgtaaccgaacaagccctaagatgatgagctgtacacttctcactaaaaaaaaaaaaaaaaaaa

SEQ ID NO: 15172 - DNA, 1965 bp, Zea mays
ggcctgtgtccgagccggcctaccccgcctctgaacaccgcctcgccgcccgcgtgcgcccccctccaactcctatggccgcgccctcccacctccacctccacctcccgggctgcccccaaaccctagccctgcccctgccctccccggggggtttctccgcttggcccggcctccgctcctgctcccgctcccgccagccccgcatccgcccggtcgccgcgctcggacccgccgacgccggcgacctgctcggccgcgttgaggcgttcctctacaccgttgcggacgccgccgttaacgcggagcccgtcgcggcagccgcggacaccgggaccaaggaggccgccgccggggactggctctccggcatcaccaactccatggagaccgtgctcaaggttctgaaagatggtctatcagctctccatgttccttattcatatggctttgcaatcattctcctcactgttcttgtcaaggcagctacatttcctctaacaaagaagcaggttgagtctgcacttgcaatgaggtcactgcaacctcaagtgaaggccattcaacaacgatatgctggtgatcaggaaaggatacaacttgaaactgctcgcttatacaagttatcctggtgttgacccacttgcaggatgcttgcctacccttgtgacaataccagtttggattggtctatacagagctctctcaaatgtagcccctcgcggccgtctgactgaaggctttttttggataccttctctggctggtcctacaacaattgctgctcgacaaaacggccaggggatatcatggctttttccttttactgatggccatccacctcttggctggtcagatactttggcatacattgtgttaccagttcttcttgtcatttcacagtacatatctactcaagtaatgcagccaccacagagcaatgatcctaaccaacaaggtgctcaggctgtaacaaagttcttaccattgctaattggttattttgctctttccgtgccttcaggactaagtctgtactggcttacaaataatatcctcagtactgcacaacaagtgtggcttcaaaagcttggaggtgcaaaaaatcctgtcaaagaatatattgacaagctttcaagagaagaaacgactactgttcagaagaatgattctactcttcagagtgaacctctctctaaacatagtaaaccccagcctagccaagagccgaaaccaagtgggccacaacgtggtgaaagatttaggaaactgaaggaggaagaatctatgagaaaagaggttatgggacaaggtaaacaatcagaacagtcaagttctgaatctagagtcgcggatggaacacaaaattttgatgcgtcttctggagaccaaaaagaccaacaggggtctcatgaaaatggaccggttgtagctagtataaatggtggagtcaaccatagtcgaaatgaaaagactcagaacttatcctcagaaaaggaagcagctgacgatcactcacctgatgtccacaaattaacggaccgagagaatggcaatgacgcggtatagagtggatgttagcgatctactgctctctgaagatcagtgagtatcgtatctgcttcatcgacgtatagctgggagatagtgaccaacagtttcacgaacagctactacaggagagttgagaatcaacacgaagaagatgcaaacaggaggcaaaattgtgcaaaccacggtctaggtctaggctcatttatttatttttgtggctgtgctttaggttatgtgaagcatatggcatatatatatatagtagtagatgaaagatttgagatctcaaaggatttatgttgttcagctgggatgggatggatgtacaaggtggctgtaataaatgtacacctggttttgaccgtgcaattcgatattttacctcatgcaaaaaaaaaaaaaaaataaccc

SEQ ID NO: 15173 - DNA, 2669 bp, Zea mays
ttgggtacctcgaggccggccgggaggtgctatcataccagcactaatgcaccggatcccatcagaactccgccgttgtgggtacctcggcggccggaccgcaacccacccctcgcccaatgcgtagttgtatctgcatctccaacaccaccagcagaggttccagttagttttttttagattagaaaaatcgagtccaacagactcgccgcactgcgcgggatcgacctcgtcgcaactcccgtgtgcgccgccaataatggagacccgggacacggatgcgacgccgctcccctactcgtacacgccgctgccggccgccgacgccgcgtcggccgaggtctccggcaccggcaggacgcggagcaggcggcggcccctctgcgcggcggcgctcgtgctctccgccgcgctgctcctagccgtggccgcgctcgtcggcgtcggtagccggcccggcgcggtggggatgacagagtcggcggcctcgtcgccgacgccgagcaggagcaggggccccgaggccggcgtgtccgagaagacgtccggcgcgtctgacgacggcggcaggctccgtggagccggcgggaacgccttcccgtggagcaatgcgatgctgcagtggcagcgcacgggattccacttccagccgcagaagaactggatgaacgaccccaatggccccgtgtactacaagggctggtaccacctcttctaccagtacaaccctgacggcgccatctggggcaacaagatcgcgtggggccacgccgtgtcccgcgacctgatccactggcgccacctcccgctggccatggtgcccgaccagtggtacgacaccaacggcgtgtggacggggtccgccaccacgctccccgacggccgcctcgccatgctctacacgggctccaccaacgcctccgtccaggtgcagtgcctggccgtgcccgccgacgacgccgacccgctgctcaccaactggaccaagtacgagggcaacccggtgctgtacccgcccccgggcatcgggcccaaggacttccgcgaccccaccacggcctggatcgacccctcggacggcgcatggcgcgtcgtcatcggctccaaggacgacgacggccacgcgggcatcgccgtcgtctaccgcaccacggacctggtgcacttcgagctcctcccgggcctgctccaccgcgtcgacggcaccggcatgtgggagtgcatcgacttctaccccgtcgccacacgaggcagggcgtcggccaacggcgtcgacatgtccgacgccatcgccagcaacggcgccgtcgccggggacgtcctgcacgtcatgaaggccagcatggacgacgaccgccacgactactacgcgctggggaggtacgacgcggccgccaacgcctggacgccgatcgacgccggcagggacgtcggcatcggcctgcgctacgactggggcaagttctacgcgtccaagacgttctacgacccggccaagcgccgccgcgtgctgtggggatgggtcggcgagacagactcggagcgcgcggacgtgtccaagggatgggcgtcgctgcagggtatcccccggacggtgctcctggacaccaagacgggtagcaacctgctgcagtggcccgtggaggaggtggagacgctgcgcaccaactccaccgacctcagcggcatcaccatcgactacggctccgtgttcccgctcaacctccgccgcgccacccagctggacatcgaggcggagttccagctggaccgccgcgccgtcatgtcgctcaacgaggcggacgtgggctacaactgcagcaccagcgggggcgccgccggccgcggcgcgctggggcccttcggcctgctcgtcctcgccgaccgccgcctccgccgcgagcagacggccgtctacttctacgtggccaagggcctggacggctccctcgccacgcacttctgccaggacgagtcccgctcctccagcgccaccgacatcgtcaagcgcgtcgtcggcagcgccgtccccgtgctggaggacgaggccacgctctcgctccgggtgctcgtcgaccactccatcgtcgagagcttcgcgcagggcgggaggtccaccgccacatcgcgcgtctaccccaccgaggccatctacgccaacgccggcgtcttcctcttcaacaacgccaccgccgcgcgggtcacggccacgaagctcgtcgtccacgagatggactcgtcatacaaccacgactacatggcgccggtggcagacatctgatcgatgcaatgcaaccacgccactctgcaccgcaacaaattttccaacacacataaatataccaagcaattcccatctgtcaaattttcttatttccctgccatgattttggtctctatttttcctgctggctactacttatcttccagcactagtaatgtacgtactggctagtaactagggtatccagtgggaagacgtgtagcctctagttgtacatgcatgtatgatgctgtgtagcaccgcatcatgcacaccacaccaatgcaaatgagttataaatgtttttaagctccaaattaaaaaaaaaggtgcctgaagagtcaaaaaaaaaaaaaaaaaaaaaaaaaaaaaaaaaaaaaaaaaaaaactcgagagggggccggta

SEQ ID NO: 15174 - DNA, 1155 bp, Zea mays
cacgagcccacgacagagctgaagcaaatcgctgcaggccgcgccgagccgccgacaagcaacgtgggttcaccagtaaacaattcaaattcgacttctcagctcgttaaatatacggtggcgccggcccggcccggccgctcgactcaaatcgtgaaactattgagaaaattccattccaacgacatcgaaggagcctgcgaagcgagcgagagtctataatggcggacggaggcgagctgcagctgctgggctcatggtacagcccctacgtgatccgcgccaaggtggcgctggggctgaaggggctcagctacgagttcgtcgaggaggacctctcccgcaagagcgacctgctgctgaagctcaacccggtgcacaggaaggtgcccgtgctggtccacggcggccgccccgtgtgcgagtcgctcgtcatcctgcagtacgtcgacgagacctgggcaggcaccgggacccctctcctccccgccgacgcctacgaccgcgccatggctcgcttctgggcagcctacgtcgacgacaagttctacaaggagtggaaccggctgttctggtcgacgacggcggagaaggcggcggaggcgctcggcgtcgtcgtccccgtggtggagacgctggagcaggcgttcagggagtgctccaaagggaaacccttcttcggcggcgacgccgtcgggctcgtggacatcgcgctcgggagcttcgtggtgtggatcagggtggtggacgaggcggccggcgtaaagcttctggacgaggccaagttcccggccttgacggcgtgggcggagcgcttcttggcggtggacgccgtgaaggaggtgatgccggacgccggaaggctgttggagcactacaaggggtttctggctaaacggtctccacctgctggttactgaacgctgtaactgtaagcctgtaacagcaagctcagtgttcgtgtacttttccgtgcgttaacgtgtactagagttcaggaaaggctttgattctgtccagagtccagacgaataaacgaatgttttttataaaaaaaaaaaaacaatatatactttatttgacttttttacttaaagttttatcggtttgttttattaaaaaattctaatttattaccaaaaaaaaaaaaaaaaa

SEQ ID NO: 15175 - DNA, 1743 bp, Zea mays
cattgggtacctcgaggccggccggaggggctctttcccacacttcacttcgcccaatttctctcccaccctcctgctcctcctcccacggtcccgccatttcgtcccccgctcaccaactcaaaccccctccgctctcaaaccctaaccctagccctagcccgctcccggcggaccgacgatgccgaaggcaggcggcggggcggcggacgaagaggagttccgcgccgaggtggaggagcgcctcatcaacgaggagtacaagatctggaagaagaacacacccttcctctacgacctcgtcatcacccacgcgctcgaatggccctcccttaccgtgcagtggctccccgaccgcaccgagccgccggggaaggaccactccgtccagaagatgatccttggcacgcacacctctgacaacgagcccaactacctcatgctcgcgcaggtccagctgcccctcgacgacgccgaggccgacgcccgccactacgacgatgaccacgccgacatcggtggttttggcgccgcctccggcaaggtgcaaattgttcagcagataaatcatgatggagaggtcaatcgagctcgctatatgccccaaaattcatttataattgctactaagacagttagcgcagaagtatatgtttttgactatagcaagcacccatctaagcctccactagatggtgcatgcaaccctgatttacggctgaagggacataattctgaaggatatggcttatcatggagtatttttaaagagggacatttgttaagtgggtctgacgatgctcaaatttgcttgtgggacattaaagcaaatagtagaaacaaaagtcttgacgccttgcagatttttaagcatcatgatggtgtcgttgaagatgttgcttggcacttgaggcatgagtacttatttgggtcagttggtgacgattatcatcttttgatttgggacctgcggtctcccgcccctactaaacctgttcagtcagtggtggcgcaccagggtgaggtgaactgcctggcttttaacccgttcaacgaatgggttgttgcaactggttctactgacaagactgtcaaattatttgatcttaggaagattgatacttctctgcacacctttgactgtcacaaagaggaagtttttcaagttggatggagtccaaagaatgaaactgtacttgcatcctgttgtctgggcagaaggctcatggtctgggatctaagcaggatcgaccaagaacaaacaccagaggatgctgaagatggtcctccagagctcatgttcatccatggaggccataccagcaagatctctgatttctcctggaacccctgcgaggactgggtggttgctagcgtcgctgaggacaacatcctccagatatggcagatggctgagaacatctaccatgacgaagatgatctgccaattagcgatgagccggcaaaaacttcttgaagcaacacatcacaaaaggaatcttaactcctatcgactgttggtgctcctagatcggaaccctgctcgccggagaatcttaaccgagtgagagttggctgtaggttgcttccgtggtcgtaactttatgcttgacgggttggtcgtttcttcgaccgtctgtatgtgtattcgtcgaacctttagcattatacatatgctgattgactagatctgttcgtcacagttgtgttttgtagaagggccgccaaaaaaaaaaaaaaaaa

SEQ ID NO: 15176 - DNA, 1840 bp, Zea mays
tttccatccttacttcgcccaatttttctcccacccctgcccctcctctcgcgattctgccattgtcccccgctcaccaacctaaatcgagagaattcgatatttgccatcatcaccaaacacgatagtaaaaatgtcacagagtggcaaaattccaattattatttcacctaaacccctctgctctcaaacctagctcgctcccggcggaccgacgatgccgaaggcaggcggcggggcggcggacgaagaggagttccgcgccgaggtggaggagcgcctcatcaacgaggagtacaagatctggaagaagaacacacccttcctctacgacctcgtcatcacccacgcgctcgaatggccctcccttaccgtgcagtggctccccgaccgcaccgagccgccggggaaggaccactccgtccagaagatgatcctcggcacgcacacctctgacaacgagcccaactacctcatgctcgcgcaggtccagctgcccctcgatgacgccgaggccgacgcccgccactacgacgatgaccacgccgacatcggtgggtttggcgccgcctccggcaaggtgcaaattgttcagcagataaatcatgatggagaggtcaatcgagctcgctatatgccccaaaattcatttgtaattgctactaagacagttagcgcagaagtatatgttttcgactatagcaagcacccatctaagcctccactagatggtgcatgcaaccctgatttacggctgaagggacataattctgaaggatatggcttatcatggagtatttttaaagagggacatttgttaagtgggtctgacgatgctcaaatttgcttgtgggacattaaagcaaatagtagaaacaaaagtcttgacgccttgcagatttttaagcatcatgatggtgttgttgaagatgttgcttggcacttgaggcatgagtacttatttgggtcagttggtgacgattatcatcttttgatttgggacctgcggtctccagcccctactaaacctgttcagtcagtggtggcgcaccagggtgaggtgaactgcctggcttttcacccgttcaacgaatgggttgttgcaactggttctactgacaagactgtcaaattatttgatcttaggaagattgatacttctctgcacacctttgactgtcacaaagaggaagtttttcaagttggatggagtccaaagaatgaaactatacttgcatcctgttgtctgggcagaaggctcatggtctgggatctaagcaggatcggccaagaacaaacaccagaggatgctgaagatggtcctccagagctcatgttcatccacggaggccataccagcaagatctctgatttctcctggaacccctgcgaggactgggtggttgctagcgtcgctgaagacaacatcctccagatatggcagatggctgagaacatctaccatgacgaagatgatctgccaattagcgatgagccggcaaaaacttcttgaagcaacacagcacaaaaggaatcttaacttctatcgactgttggtgttcctagatcggaaccctgctcgccggagaatcttcatcgagtgagagttggctgtaggttgcttccgtggtcgtaactttatgcttgacgggttcgtcgtttcttcgaccgtctgtatgtgtattcggcgaacctttagcaatatacatatcccgattgactagatctgtacgtcgcagttgtgttttgtagtattgttttgcagccagtaggatcatgttcgtgatgtgatttgtaacgggaacaaaataatattcactccaaaaaaaaaaaagggcgg

SEQ ID NO: 15177 - DNA, 931 bp, Zea mays
gcacgagaccattacctagaacatcctaatcgaaaaattatgtagtgttttgagaaaataaacagaaaattgtctcaactcgtagtgtcatcctctcgatgagagtaaaagtcatgttgcttacacatatgagggtttttatctgtcttaagagaagtacattctggatcttcttgatcgggcctctcttcggacagttgagactcctatggaactcaatattcatctatgtgccacggatggtgagcatcttgaagaccctaatcattattgtcacattgttgggagtcttgtttaccttggtgtgactcgtcctgactacttgggctagtgattcctcttatcgacgttctctttctgcctattgtgtttttcttggtggttccctcattgcttggaagactaataaataggcaatggtttcttgttcgagtgtagaggctgagttgcgtgatatggcccttatgactacagaggttacttggttgcggtggttgcttgaggattttggtgtctctatctgtatgtcgactcctcttttgtctgacagtacaggtgctattagtattgctcgtggtccaatgaagcatgagcttaccaagcatattggtattgatgctcattatacacgagcataggtttaggatggtgttgtttctcttcgatgtgtcgtcggagcttcaactagcagattccttcaccaaggctcagactcaagctcaacatcggttttatatctccaaactcagagttcttgtcttcttgatccaccttgagtttgagggggtgttagagatacatgtacttgtttatatttctccattgtataaggggttttgtgcatatttgtaatctcatgtacctctatatattcgggcatagagccctcataataaatatgatctctattcaaaaaaaaaaaaaaaaaaaa

SEQ ID NO: 15178 - DNA, 290 bp, Zea mays
gaaaaaaatttcgaaacgagaggtgtctgcctgtcacttgcgaagaaatcgcgaggggaagcgtgacacctgacgagctgagcaggcaggcggtagtggccgagcgaaagcatcctcgatctcgtatcgtagctgccgccgctcagagcaatggagagggcggtgccagttcggaagtcgcacaccaacacggccgaccttctctcctggtcggccacgggccctgacgcatctgcctcgccggccgcgtcctcccgccccagcctcaagccggccgcggggattacgcc

SEQ ID NO: 15179 - DNA, 1486 bp, Zea mays
ccggccgggatcgtcactcgcgcgcggggggaacaggcatggatatggatgtgtaccagtacaaaccagtggcaggcagcggtgtcgccggaaaaaaatttcgaaacgagaggtgtctgcctatcacttgcgaagaaatcgcgaggggaagcgtgacacctgacgagctgagcaggcaggcggtagtggccgagcgaaagcatcctcgatctcgtcgtatcgtagctgccgccgctcagagcaatggagagagcggtgccagttcggaagtcgcacaccaacacggccgaccttctctcctggtcggccacgggccctgacgcatctgcctcgccggccgcgtcctcccgccccagcctcaagccggccgcggggattacgccggcgatgttcggcgcgccggtcaccgagcaggaggccgaggatctgagcaagagtgaaaggaaattttgctctggctcaaagttgaaagagatgggtgggagtgggatttttgctgagaagagtgaaaatggtgatgcagaggcttcaaatcctgctaacaagacttccttgaggatgtaccagcaaaccgtgactggaataagccagatttcatttagcgctgatggaagtgtttcaccaaagaagccatcgtcgatacctgaggtggctaagcagcgagagcttagtggcaccctggaagatgctgatgctaaaatcaataagcagctttctgaagccaagaccaaggagcttagtgggagtgacatctttggtccgcctcctgagattccagcgaggccattggctgctcgtaacatggagctacaaggaaatgtcgatttttcacttccacagcgaagcgtccacacatcagttaaagtatctaatcctgccggaggtccaagcaacatctctttcagcgaagagcctgtagtgaagacagcaaagaaaatccacaaccagaagttccaggagctgacaggtaacaacatcttcaaggaggacgtccctgcctcggccgagaagtctctgagctctgcgaagcttaaggagatgagcggcagtgacatcttcgccgatggaacgccagctccccgagaataccttggcggcatccggaagccccctggcggtgagagcagcatcgcgctgatctgattgttctgggctgctctaattcgcactggctagcagcgccccctcgtcagtcgtcactgaagcgcacacagagtgcatttcttgacctcttggttctcgaatcgtgttggggatcataatttatgttgggtgtcgttagtctaatataatttggagtcagcagaatctgatccggttacctccgtatcatctgatacgcgggtgtgtgatctcatctgtgattcatgctacattattatgttatgccatccgaactgagaacttatgcaagaattatttttggactcgtttctgggaccaaaaaaaaaaaaaaaaaaaagtcctctgcgtgggcgccccggcc

SEQ ID NO: 15180 - DNA, 1562 bp, Zea mays
gcacgggagccagtggcaggcagcggtgtcaccggcaaaaaatttcgaaacgagcggtgtctgcctatcactgccatttcgctcgcgaagaaatcgcgaggggaagcgtgccgagctgagcaggcaggcggtagtggccgagcgaaagcatccccgatctcaacgtctcgtagtcgtagctgctgcctctcactcagggcaatggagagggcggtgccggttcggaagccgcacaccagcacggccgaccttctctcctggtcggccacggcccctgacgcatctgcctcgccggccgcgtcctcccgccccagcctcaagccggccgccgggattacgcctgcgatgttcggcgcgccggtcaccgagcaggaggccgaggatctgagcaagagtgaaaggaaattttgctccggatcgaagttgaaagagatgagtgggagtgggattttcgctgagaagagtgaaaatggtgactcagaggcttcaaatcctgataacaagacttccttgaggatgtaccagcaaactgtgactggaataagccagatttcatttagtgctgatggaagtgtttcaccgaagaagccgtcgtcaatacctgaggtggctaagcagcgagagcttagtggtaccctggaagatgctgatgctaaaatcaataagcagctttctgaagccaagaccaaggagcttagtgggagtgacatctttggtccgcctcctgagattcctgccaggccattggctgctcgtaacatggagctacaaggaaatgtcgatttttcacttccacagcgaagcgtccacacatcagttaaagtatccaatcctgccggaggtccaagcaacatctcattcagcgaagagcccgtagtgaagacagcaaagaaaatccacaaccagaagttccaggagctgacaggtaacaacatcttcaaggaggacgtccctgcctcggccgagaagtctctgagctctgcgaagctgaaggagatgagcggcagtgacatcttcgccgatggaacgccagctccccgagaataccttggcggcatccggaagccccctggcggtgagagcagcatcgcgctgatctgattgttctgggctgctctaattcgcactggctagcagcgccccctcgccagtcgtcactgaagcagcacacagagtgcatttcttgacctcttggttctcgaatcgtgttggggatcataatttatgttgggtgtcgttagtctaatataatttggagtcagcagaatctgatccggttacctccgtatcatctgatacgcgggtgtgtgatctcatctgtgatccatgctacattattatgttatgccatccgaactgagaacttatgcaacaattatttttggactcgtttctgggactatggcatcatataggatgttttgcttgtgctgtcgatgattccaaaggtacatagtttggaaaagaagacatgctacattattatgctatgtattagtacaaccgaactgagaacttatccagtaattattttggactcgtttctgggaaaaaaaaaaaaa

SEQ ID NO: 15181 - DNA, 2555 bp, Zea mays
cagtggcaggcagcggtgtcaccggcaaaaaatttcgaaacgagcggtgtctgcctatcactgccatttcgctcgcgaagaaatcgcgaggggaagcgtgccgagctgagcaggcaggcggtagtggccgagcgaaagcatccccgatctcaacatctcgtagccgtagctgctgcctctcactcagggcaatggagagggcggtgccggttcggaagccgcacaccaacacggccgaccttctctcctggtcggccacgggccctgacgcatctgcctcgccggccgtgtcctcccgccccagcctcaagccggccgccgggattacgcccgcgatgttcggcgcgccggtcaccgagcaggaggccgaggatctgagcaagagtgaaaggaaattttgctccggatcgaagttgaaagagatgagtgggagtgggattttcgctgagaagagtgaaaatggtgactcagaggcttcaaatcctgataacaagacttccttgaggatgtaccagcaaactgtgactggaataagccagatttcatttagcgctgatggaagtgtttcaccaaagaagccgtcgtcaatacctgaggttgctaagcagcgagagcttagtggtaccctggaagatgctgatgctaaaaccaataagcagctttctgaagccaagaccaaggagcttagtgggagcgacatctttggtccgcctcctgagattcctgccaggccattggctgctcgtaacatggagctacaaggaaatgtcgatttttcacttccacagcgaagcgtccacacatcagttaaagtatcaaatcctgctggaggtccgagcaacatctcattcagtgaagagcccgtagtgaagacagcaaagaaaatccacaaccagaagttccaggagctgacaggtaacaacatcttcaaggaggacgtcccttcctcagccgagaagtctctgagctctgcgaagctgaaggagatgagtggcagtgacatcttcgccgatggaacgccagctccccgagaatacctcggcggcatccggaagccccctggtggcgagagcagcatcgcgctgatctgattgtcctggactgctttaattcggaccggctgtagctcccatcgccactaaagctcgcagagagtgcatttctcgacctctcgattctccatccgtgttgggatcataatttatgttgggtatcgttagtctaatataatgtagagtcagcagaatctgactcgtatcgtctgatacgctggtgtgtgatctcgcatcttttattgttgcgacattattatgttatatatttgtacacccgaaccgaaacttacgcaataattaaattttggactcattttcagggataaaaaaatcataggatgttttacttgtgctgttgtttgacgcaaaaggtccatactcgtcttctatttgcaacacccagtcgatgctaagggtgaaatagtatataaacgccaaaaataatggtgaaagagtaagtaaaaacaaaagaaccgacatcccagttgatgttaatggcaaaacagtatataagtcaataataggaagcatatataagtgaaaaataagatcagggtgattatatgtaaaatagactaatccctactactctatacaggggcggacccacaggggggtccgggtgggccctggcacaccctaagctaggcccaccggggaccccatccggccatccgttcgcccgttcagccgacgcctgacgttccaacttctccggttctcccgagcgttcggctaatcggcttcctcttcccagttcctggcgtctggcgagtgcgctgtgcctgtgcgcggctgttcctcagttcctggcggctggcgtatggccacaggccaccggcgtcttgcaaggctgcaacagcatcttggcatatcgctcgcctggacgcctgctcggtcggctccagagccttcggtcctgcaaaggctgcaagtctgcaacacatcttgctcagtcttaagacttcaagcaaccacatcttgcaacggcatcctgcaaggcttgcatgcaacgcctactgcctgcgctcactaacgctcgcgtggaggtgcccttcccagggtacaggtacgcaggaacatcgcccctctcggttgattcactggtgactaaaatatgaaaaagcagtgagatattgtctctttttttcaatcatgctgcaaagaaacataagtttattgtgtcgacacctaaaaaacaagaggaagagaggataaatgaagaaattgtgaatccaatgccatctgcactaccaccgccaacactttatgatgttagtcgtcttccacatgatccaagtaaaagacaacatattgcaagctaccatgctaatgaccatgatgcaattcgaagaacatatattattattattagaggtccatttcaaccacatgcacatgaatttccaaataggaaaattggagatagagatcaccattttaattttgttgcggcacaccctatataaaaatcctaggtccgccactgactctataagc

SEQ ID NO: 15182 - DNA, 752 bp, Zea mays
  misc_feature (29)..(29): n is a, c, g, or t
ccccctcggagtcgacccagcgtccgcgnagggcacggcctcgaaataaaaactgccgttgcccctcgcccccgggccaacggatccaccggagagatctggtctgccattcccacgctccttcctgtgaaccacaaacctaacgcggagcggcgcgggccggccgccgggcgaggtgcgcgtacctgccgtcgatcgtcgccggatccatccaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaagtgccgggagcacgccgaggccaagcaccccaagacagacgtgtaccagtgcttcccccatctgaagaagtgaaaggcctgaacttagcaaccagtgctggtttggtcactacgatcgggccagggggcgttccttgtgttgagggtgttcattccgtgttatcttcccgtcagtcatgcgtcctgtcctatgttaacctacataagaaagtgatgtggtgtccacttctagtgaaactactgtctgctgttaaaacctggttggtttcagaacgacgatgattttcgtgtgcaaaacagattactggtccgtgggagttgggccagtttgcattgtcttaaaaaaaaaaaaaaaaaaaaaacccgagggggggg

SEQ ID NO: 15183 - DNA, 806 bp, Zea mays
  misc_feature (725)..(725): n is a, c, g, or t
attactttgccgcccgcgggccggacggatccaccggagagatctggtctgccattcccacgctccttcctgtgaaccacaaacctaacgcggagcggcgcgggccggccgccgggcgaggtgcgcgtacctgccgtcgatcgtcgccggatccatccaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaagtgccgggagcacgccgaggctaagcatcccaagacagacgtgtaccagtgtttcccccatctgaagaagtgaaaggcctgaacttagcaaccagcgctggtttggtcactacgatcgggccagggggcgttccttgtgttgagggtgttcattccgtgttatcttcccgtcagtcatgcgtcctgtcctatgttaacctacataagaaagtgatgtggtgtccacttttagtgaaactactgtctgctgttaaaacctggttggtctcagaacgatgattttcgtgtgcaaaacagattactagtccgtgggagttgtgccaaaaaaaaaaaaaaaaaagccgccctcctgcccagccagcgacaaatattctagaatggaggtagtacaatttttcgtagntatagatatccgcgaccctacttagcagtattccataaacatgcatgcgtgttatgatgtcagttatgtacttttccgaat

SEQ ID NO: 15184 - DNA, 701 bp, Zea mays
tgtgccgcgctcgcgccggccgggccggccgacggatccaccggagagatctggtctgccattcccacgctccttcccgtgaaccacaaacctaacgcggagcggcgcgggccggccgccgggcgaggtgcgcgtacctgccgtcgatcgtcgccggatccatccaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaagtgcagggagcacgccgaggccaagcatcccaagacagacgtgtaccagtgcttcccccatctgaagaagtgaaaggcctgaacttagcaaccagtgctggtttggccagggggcgttccttgtgttgagggtgttcattccgtgttatcttcccgtcagtcatgcgtcctgtcctatgttaacctacataagaaagtgatgtggtgtccacttctagtgaaactactgtctgctgttaaaacctggttggtttcagaacgatgattttcgtgtgcaaaacagattactggtccgtgggagttgggccagtttgcattgtcttaagatgtgcctcctgcccagcccaaaaattcctttaaaaaaggccccta

SEQ ID NO: 15185 - DNA, 744 bp, Zea mays
ggcgacgggcacggcctcgaaattaaaaactgccgttgggcgactccgcgtggcccacggatccaccggagcgcgccggtctgccattccctcgctccttcccgtgaaccacaaacctaacgcggagcggcgcgggccggccgccgggcgaggtgcgcgtacctgccgtcgatcgtcgccggatccatccaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaagtgccgggagcacgccgaggccaagcatcccaagacagacgtgtaccaatgcttcccccatctgaagaagtgaaaggcctgaacttagcaaccagtgctggtttggtcactacgatcaggccagggggcgttccttgtgtcgagggtgttcattccgtgttgtcttcccgtcagtcatgcgtcctgtcctatgttaacctacataagaaagtgatgtggtgtccacttctagtgaaactactgtctgctgttaaaacctggttggtttcagaacgatgattttcgtgtccaaaacagattactagtccgtgggagttgtgccagttcaaaaaaaaaaaaaaaaaaggcgccccgcccggccagcgcaaaaaaaaaaaaaaaaaagcggcc

SEQ ID NO: 15186 - DNA, 760 bp, Zea mays
  misc_feature (40)..(40): n is a, c, g, or t
  misc_feature (42)..(42): n is a, c, g, or t
tacctcgaggccggccgggccgggaattccaaaaaagggnanaaaaaaaaaaaaattcccaaaaaaaaaaaaaaaaaaaaagtgaaccacaaaccccacttgggtacccccgggccggccgccgggcgaggtgcgcgtagctgcccgtcgatcgtcgccggatccatccaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaagtgccgggagcacgccgaggccaagcaccccaagacagacgtgtaccagtgcttcccccatctgaagaagtgaaaggcctgaacttagcaaccagtgctggtttggtcactacgatcgggccagggggcgttccttgtgttgagggtgttcattccgtgttatcttcccgtcagtcatgcgtcctgtcctatgttaacctacataagaaagtgatgtggtgtccacttctagtgaaactactgtctgctgttaaaacctggttggtttcagaacgacgatgattttcgtgtgcaaaacagattactggtccgtgggagttgggccagtttgcattgtcttagtatgtgcctcctgcccagcgcaagaattcctttgcaaatacaatttttcgcaagcggacatacaaaaaaaaaaaaaaaagcggcc

SEQ ID NO: 15187 - DNA, 922 bp, Zea mays
cggaattcccgggtcgacccacgcgtccgcgtgtattttatggcaacttcctgtcggttaatagttcctcgcggctggattgacggcccaagatctcctcaagagcgcgttcccggcacgcaccgacggcgacgggcacggcctcgaattaaaaactgccgttgggcgactccgcgtggcccacggatccaccggagagatctggtctgccattccctcgctccttcccgtgaaccacaaacctaacgcggagcggcgcgggccggccgccgggcgaggtgcgcgtagctgccgtcgattgtcgccggatccatccaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaagtgccgggagcacgccgaggccaagcatcccaagacagacgtgtaccagtgcttcccccatctgaagaagtgaaaggcctgaacttagcaaccagtgctggtttggtcactacgatcgggccagggggcgttccttgtgttgagggtgttcattccgtgttatcttcccgtcagtcatgcgtcctgtcctatgttaacctacataagaaagcgatgtggtgtccacttctagtgaaactactgtctgctgttaaaacctggttggtttcagaacgatgattttcgtgtgcaaaacagattactggtccgtgggagttgggccagtttgcattgtcttagtaaaaaaaaaaaaaccagcgcaagaattcctttgcaaatacaatttttcgtagttttagatatccctgaggccttgttccggcctgccggattggtgggttgg

SEQ ID NO: 15188 - DNA, 3494 bp, Zea mays
tccctgcaggggcagcagcaataagttcgcggtcgcctttctctcctctctgcccccatcgcaaaagagctagaagccagaacagcacagcaccacgagcgccgatatataaagaggctccgtcacccgtaccgaattaccaacccaaccagacctgtacggggctcaaaaccgcgtggaggatcgtggggtaccagcgaacagcaccagcgaggcctcggccgacagcgctggagctccctctacctagctgcccagcggaatctcttcttcatgtccggtggtataacaagccattgaggagagccggcggagcttcgatcaggcagggcggagcgagaaattgagctgagagagggggattcgtcatagttcacccatggttgtgcttatgcagaagccgtggctgcccgtcgacctgcggctgccggcggggccgcaggcgtcgctggggatcctggcgttcgaggcggcggcggccatgtccaagctgctgtcgctgcaccgttcattgtcggacccggaggtctcccggctgcggtccgacgccatgcgctcgccgggcgtagcgtacctcaactccaccgaccaggcgctcctcctcaagctggcctgcgccgagctggtcgtgtcgctggacaccgccgccgccgccgtcgcgcgcctcggcctgcggtgcggcctcgacttcggcggcgtgtacgcctgcctcaaggccggcacccccgacgcgcgcctggacccgctcctggccaaggggctcagggtgaaggccaagaagatggagcgcctcgtcgccgccaccgccaagctctgctccgagatggagacgctcgacgagctggaatccgccgaccggaagttgaacgtccggggctggagtcgactcagcggcccgatcccgcagcagccacaggcggcggcccagcagcagcagcaacaattgaccggggattcacctggcgcggagtcgctccggcaagagctcaagacgcagcagctcaaagtgaagcgcctcaaggacgagtccctgtggaaccagagctacaagaaggccgtaggcctcatggcgcgcgccgcctgcgcgctgttcgtccgcatctgctccatcttcggcccattcgtcgctggcctcccgccgccgctgccgtcggccagcacggacagcgtccagacccggctgtcgaagctgctgcacccgcggtcggcgaaggcgaaggcgtcgtccgggccgatcacgcgtcgggacggcccgtcccgcgtgcacccgccgatgagcaactcgtgcccgatcatcgggcggcacccgccgggccagaaaccccccaccaactggcgcaaggtcctggacgcgccgcccagcaccgtcggcggcgcggggctggaccagcagtacgcgaacgtgatcgcgtccgcggaggagctgctgcggatggaggccgaggggcgccaggaggaggcctccgcggagcgcgccgagatgtacgagatgctcccggcgaagctccgcgcggcggtccggtcgaagctgcgggagtggtggcgcgacccgggcccgctggacgagggcctggcgcgcgggtggaaggacgcggtggaccgcatcatggcgtggctgggccccatggcgcgcgacacggtgcagtggcaggcggagcggaacatggaccggacgcgccggttcgacggcgcgccgcgcgtgtacgcgctgcagacgctgcggtgggcggacaaggacaaggccgaggcggccatcgtcgaggtgctcgtcgcgctgagctgcatctgttggtacgaggagcgccggcgaggctccgtccgtctcggttgaaccattcaacgcattctttcccctcgctcgatcagatcggtcgtggcgagtggccgtttcttcctcttctctcctgcgtttgtcaaatatttgatttgaagagttgattttttgggccggtagtagaagaattagaagttagaacggggtggtgatgcgttgaacgggttaggaaggaaggagacacagcagcagcagcaatacttgaaacgaaatcgatggttggtatgcgcgttggggtggctgtcagcggcgtgacgccgacacgtgggggcctcgcttcccactctcccgtcggtctcacgccagtgacagagtccggtgtacaacacagtgtcacgaggattgtgtaatatatataatacgattgattctttgaaattcgtcccgtctgagtagagtatgtaacccgctgttgcttttttcctttctgctgcctcccaacaattgacaaagtaatcctagcctcaaaatctgtatcaacaacgaacagaataattgaacaaagttaggtcttgttcggttatttctattatacatgaattgaatgtgattgaaaaaaatttagaagaattttaacttacttgtgatttaaacctactcaatcccacataattcatatagattgagagctaaccgaacaaaccctaagttggaccaggctaggtatccggccgcccaactaacgacaccccttttttggttagaaggaaattgaagggaactgagaatcggtggggaaattaagccatttctctcttaaccccttttaatcctcttctaaccaaacaagcctttagtgcatgctaaaattattaaagccgattagtccgttaattacacacaccacacatctaaaggcgggttaccgcaaaagaggcgcatctaggtcatgtttcttgtggtactaatgtacattgtatgtatgctcttttaactctaacgcacatcaaacttttgtcttggatccacaacacaaaacaggtaaattagggtgggtttggttgcaatgacaacacggggcgggatggaacgatccatcaaataaggttatttggttcagagtcaagggttgggacatgactatcataatgttgcctcaattgtccttcaaaattggaggtacgagagatgacgccagagaacgtctctgtcctgtcccgcaaccaaacatatcctggttgcaataacaggacggaacgatccttcaaataagtttgtttggttcagggtcaagagttaagacagaactatcccagtgttatctccggttatccctcgaattttaagggataagcgaggataccaggggacgtccctgtactaactctcccgcaaccaaacgcacccttaatttcccccttaatccctctgatcctccctctgatcccgacaagatttgagttcctaaactatcctttcatttccttatccaccaaaccagacctcaaagtaaaaaaaaaacgtggcatcccaaacctgttctggttactgactgaattcaatgctgtgtttactataactatgtgcggcaacgctgattatcaaacagcccagcttagtagcttacgtcaagattcgtgaagggtatccatccgccaatgatgtgagacagagggagaaggaagcggtgaaaacaggtgtacacacatgccatctgcag

SEQ ID NO: 15189 - DNA, 1078 bp, Zea mays
cattgggtacctcgtcccgggccggggcctggtgttcttgtataccacgcgtccacgccactgctaagctgctccccgttcgccaggtcggcgaccaggcgaaacgtgctgctgctgccgctgcaagaagaagaataggtacacagacagcatgtccggagttcaggcgatgccgacggccgtgggcgtggcggggctgagagggtcagggttagttggcagcagcagtaccagcttgttcgccggcgactgcaagaggaaggctcgtcgcccggcgtgctcggcctgggccctcaggcagagccggatcggcagcaggagcaggagcaagaggggcctcggcatcgtctgcaacctcgcgggacagtacgaggattccttcgacgacgtccagcggcaactgatgaactacttcacctacaaggccgtgaggaccgtgctgacccagctctacgagctgaacccgccgagctaccgctggttctacaacttcgtcgctgtcaacaagcctaccgacggcaagcatttcctccgtgctctcggcaaggagaggcaggagctcgcagagcgagtgatggtcaccaggcttcacctgtacgggaaatggataaagaaatgcgaccatgccaagacgtacgagaagatctccgacgagaacctggcgctgatgcgggagcggctgatggagacggtcatctggccaaccgacgacagcagcacggagaagatcggctgatgcctgatgcctgcggaggcgccgagtcctttcgggttgctgatcaagcttagctccttctattagcatgtagagcagcactctgggtttctctatcagtcagtcagtcagccagccagtcagtgggttgtatataatcggagttgtagtagacagtatacatttctctgggcaggcaatcactgtttgaggtgttaacagtgccgttttgccctcccaattaagcctctacagtcggtctaagtgaagcaaaaatgcttaccttgtagtagctaaatttacatgtgcggggatatacgttgtaatagaatatttctgcgccccgtacgtggctgtttgatg

SEQ ID NO: 15190 - DNA, 888 bp, Zea mays
ggaccctcggggcccgccgcgccggcgcgggcctggaccctggtgtccttctataccacgccactgctaagctgctccctgttcgccaggtcggcgaccaggcgaaacttgctgctgctgctgctgcaagagaagaataggtacacagacagcatggccggagttcaggcgatgccggcggccgtgggcgtggcggggctgagagggtcagggttagttagcagcagcagcaccagcttgttcaccggcgactgcaagaggaaggctcgccgcccggcgtgctcggcctgggccctcaggcagagccggatcggcagcaggagcaggagcaagaggggcctcggcatcgtctgcaacctcgcgggacagtacgaggattccttcgacgacgtccagcggcaactgatgaactacttcacgtacaaggccgtgaggaccgtgctgacccagctctacgagctgaacccgccgagctaccgctggttctacaacttcgtcgctgtcaacaagcctaccgacggcaagcatttcctccgtgctctcggcaaggagaggcaggagctcgcagagcgagtgatggtcaccaggcttcacctgtacgggaaatggataaagaaatgcgaccatgccaagacgtacgagaagatctccgacgagaacctggcgctgatgcgggagcggctgatggagacggtcatctggccgaccgacgacagcagcacggagaagatcggctgatgcctgatgcctgcggaggcgagtccgcccagtactttcgggttgctgatcaagcttagctccttctattagcatgtagagcagcactctgggtttctctatcagccagccagtcagtccgtcagtgggttgtatataatcggagttgta

SEQ ID NO: 15191 - DNA, 1154 bp, Zea mays
ctcggccgggaaaaaaagaaaaaaaaaaaaaaaataaaccctccggaagaactcccccggcaacctggtgttcttctataccacgcgtccacgccactgctaagctgctccccgttcgccaggtcggcgaccaggcgaaacgtgctgctgcaagaagaagaataggtacacagacagcatgtccggagttcaggcgatgccggcggccgtgggcgtggcggggctgagagggtcagggttggttagcagcagcagtaccggcttgttcgccggcgactgcaagaggaaggctcgtcgcccggcgtgctcggcctgggccctcaggcagagccggatcggcagcaggagcaggagcaagaggggcctcggcatcgtctgcaacctcgcgggacagtacgaggattccttcgacgacgtccagcggcaactgatgaactacttcacctacaaggccgtgaggaccgtgctgacccagctctacgagctgaacccgccgagctaccgctggttctacaacttcgtcgctgtcaacaagcctaccgacggcaagcatttcctccgtgctctcggcaaggagaggcaggagctcgcagagcgagtgatggtcaccaggcttcacctgtacgggaaatggataaagaaatgcgaccatgccaagacgtacgagaagatctccgacgagaacctggcgctgatgcgggagcggctgatggagacggtcatctggccgaccgacgacagcagcacggagaagatcggctgatgcctgatgcctgccgagtcctttcgggttgctgatcaagcttagctccttctattagcatgtagagcagcactctgggtttctctatcagtcagtcagtcagccagccagtcagtgggttgtatataatcggagttgtagtagacagtatacatttctctgggcaggcaatcactgtttgaggtgttaacagtgccgttttgccctcccaattaagcctctacagtcggtctaagtgaagcaaaaatgcttaccttgtagtagctaaatttacatgtgcggggatatacgttgtaatagaatatttctgcgcccagaacgtggctgtttgatgaaagcattctgtacggtagtcaggaaccctctcccacttgaaccagtcgcgagcgtt

SEQ ID NO: 15192 - DNA, 3642 bp, Zea mays
gccggccgggtcggcacacgcctagccgtcaccgagctccagcaggcagcaggcaggacgagagtgctctacatgttttttcttctctctctcccagtctcccttccttctttctccgcgtccctcgcggccggccttttcctttggctttccatcgcatctcaatcctgttaccgttgtggactcccactcccctgtctgtctgtcgcggtgtcgcctgacaccttcttcttcctcactcccccctcaacctcatccccatcccgccctcgcacttcccacccaccccaatccatccatccatccacccgtctgaaaaccaaacccacattcaccagcgagcaagcttcccctgccctcctccggccgcctcattctcgtttccatataaatctgtaactgcaaggacaacccaccacaggacacacgaggtgaaaggagatccgtgaggaggcgcctcccccatggctgagaaggagggcaacctcgaggccgtcctcaaggaggccgtcgacctggagaacatccccctcgaggaagtgttcgagaatctgagatgcagccgcgagggtctctccaccgagcaggcgcagcagcgcctcgaaatctttggcccaaacaagctcgaggagaaggaggagagcaaattcctcaagtttctgggtttcatgtggaacccactgtcctgggtcatggaggctgcagcaatcatggccattgctcttgccaatggaggggggaagccaccagattggcaggactttgtcggtatcataactctgcttgtcatcaactcaacaatcagttttatcgaggaaaacaatgctggtaatgctgcagcagccctcatggctcgcctcgcacctaaagccaaggttcttcgtgatggccgatggaccgaggaagacgcagccattcttgtaccaggagacattgttagtattaaactcggagatattatacctgcagatgcacgcctccttgagggggatcctttgaagatcgatcagtctgctctgaccggagagtcactgccggtcactaaaggtcccggtgatggtgtctattctggttcgacggtcaagcaaggtgaaatcgaagctgttgtgattgccacaggtgtccacactttcttcggaaaggctgctcaccttgttgactccacaaaccaagttggccatttccagaaggtcctgacggctatcgggaacttctgtatttgctcaattgctgtggggatgtttgttgagatcattgtcatgtatcctatccagcacagggcttaccgccctgggatcgacaacctcctcgtccttctcattggaggcatccccatagccatgccgaccgtcttatctgtaactatggctattgggtcccatcgtttgtctcaacagggggctatcacaaaaagaatgactgcaatcgaggagatggctggcatggatgttctttgcagcgataaaacaggaaccttgaccctgaataagcttactgtggataagaaccttgttgaggtttttgaaaggggcactactcaggaccaagtgattctcatggctgccagagcgtctcgcacagaaaaccaagatgctattgatactgctatagttgggatgctagctgatcctaaagaggcacgcgctggaatccaagaagttcacttcctgccattcaatcctactgacaaaagaacagcactgacatacattgatggtgatgggaaaatgtatcgtgttagtaagggtgcacctgagcagattctccacttggctcacaataagtcagatatagagaggagagtacatgctatgattgataaatttgcagagcgtggacttagatcacttgctgtagcatatcaggaagtgcctgaggggaggaaagaaagtcctggtggtccatggcacttcgttggtctcatgccactttttgaccctccaagacatgacagtgctgaaacaattagaagggcactcaaccttggtgttaatgttaagatgatcacaggggatcagttggcaatcggaaaggaaacaggacgtcgtctaggaatgggtacaaatatgtacccctcttctgctttattaggacagaacaaggatgagtctattgctgctttaccagttgatgatctcattgagaaagccgatggttttgctggtgtattccctgaacataagtatgagatcgtgaaacgtctacaagcacggaagcatatctgtggaatgactggggatggagtaaatgatgctccagccctgaagaaagcggatatcggtattgctgttgccgatgcaactgatgcagccaggagtgcttcagatattgtcctcacagaacctggacttagtgtgatcattagtgctgtgcttactagtcgtgcaattttccagcgtatgaagaattacacgatctatgctgtctctatcaccattcgtattgtgcttggatttatgctccttgccctcatttggaaatttgatttccccccattcatggtcctaatcattgcaattctaaatgatggtaccataatgactatatccaaggatcgtgtaaagccatccccattacctgacagctggaagttggctgaaattttcacaactggagttgtccttggtggatatcaggcaatgatgactgtcatcttcttttgggctgcatacaagacaaactttttcccaaaaatatttcatgtggaaagccttgagaagacagctcaagatgatttccaaaagcttgcatctgctgtttacctgcaagttagcaccatcagccaggccctcatcttcgtgacaaggtcccggagctggtcatttgtcgagcgcccagggtttctattggtctttgctttcttggttgcgcagctgattgccacactgattgctgtgtacgccgactgggcgttcacttcgatcaaaggcattgggtggggctgggctggcattgtgtggctgtacaacatcatcttctacttccctctcgatatcatcaagttcctcatcagatatgctcttagtgggaaagcgtgggatcttgtcattgagcagaggattgcgttcacaaggaaaaaggactttggtagggaggagagggagctgaagtgggcacatgcacagaggaccctccatgggctacaggcacctgatgccaagatgttcccagagaaggctgggtacaatgagctgaaccagatggctgaagaggcgaagaggagggccgagattgcaaggctgcgggagcttcacacactcaaggggcatgtggagtctgttgtgaagctgaagggactcgacatcgagaccatccagcagtcctacacagtgtaactttgcctgcccttcccagaggaagtttcttgttctttttacccaccggcgtgtgaatttgatggtggctggcttctctttgttttatttatttatttaaccgagctgcaagcaccgacaagtagctgaaatgagacagacagacccctcgctgtaatccctgatttcttctgtcctctcctcacatggtatgccaaccagtttatgaactttgctcggctatataaataagtgcttgaagaggggagcagggttttgggccaaaaaaaaaaaaaaaaaaaaaaaaaaaagccaggggggccccccc

SEQ ID NO: 15193 - DNA, 803 bp, Zea mays
caaaggggaaggccaagatagaagtgtatgaaaaggaccggaagcagggtgctggggctttagcaactcatgctaaggcatacaaacctgcagctgatatggtactttctgaagaaacaccaaagaagtcagaattggcttcaaagaagaggaaacatcatgaggttcaaactgaaccatcggcagagcttgcagagggagcagtccaggaggataggaagaagaagaaaaagaacaaggaaagcgatgaggctcctgctgctgaaggtgatggtgagaagaaaaagaaaaagaagtccaaggatgtcggggaagagcctgctgtggctgctgctgctgccacagaaggtgagaaaaagaagaagaaaaagaagtctgacgcggacggtgagggtgttacaacgcaaaccgaagagtctggtaagaaagataagaagaaaaagaagaaaaggcatgccgatgatgagtgagacattcttcggaagagaatgtgcgggtaccaaatgctgggactcagctgttctgtaaaatgggtatcacggggttagaaaacatattgagatcagtttttggggttacctggtttttttgggggacctggcttgtattcaacaattacttgctcggtctagatgatgatggaatttttaacttttgctgttgtaaccccataaatttagtatgatgattgtcatggtaactctgcaactgagagaccttccattctcgaaaaaaaaaaaaaaaagctttaaaaaaaaaaaaaaaaaaaaaaaaaaaaaaaaaaaaaaaaaacggacgcgtgg

SEQ ID NO: 15194 - DNA, 2469 bp, Zea mays
agatttaaaatgcaagtcactcgaaaaatggaaaaaggtgaatgcaaaaatggtatccatgttatttagcataagttacggcctatttcagtaacataccggaattttcgatcaccatgctcatgaaacatggccgtgaacatgccattcagttgttttaaaaatgtataaaacataaacaaagtcaaaaaaatcatgaaacttgtcgaatttgagaatgttgtcacgcactatgtgtagaaatctaagtgtccttctcatggaatcatagaacttcaatgtccatatagaaccgcttctcagtattaattaaaaaacccttttcaaatcggatttgtggacattatatttgtatagccagtgtaactttgttctcacagatagaaagatccccctccatccttattccttaacaacatgtataagtatattgtgactctagactgagggagtacgcaaagacacagacactccaatccgttcaagaaatgcaacaacgggagcatataacagattattaagcatgcgccggccgggcgatccgatccagcacatcttgcacgtcttaattatcctctcaggcggcggcggcggacgcggtgtggttacgatgagaagcatcggcgagggacatggcgacggagcacatcttgccgaggtcaccgatcttgtcgacgatgcgcatctcgccgccgccctccaccttctggcagtcgctcaggcacgagtcgccgtcgagtttcgccgccgtgagccacgtgtcgacggcggcctcgtccttggccttctgcaccgccaccttggaccgctgcaggtcgaccagcgcgccctggaacttggccacgcactcgttcaggcacacgggcggcatgccccccggcattttctccaggcccttgacgaacgccaccgtctcggcgccgcactgcgccgcctgcgccagcgccagcccggccagccccgccagcccgccccgctccgccttcgccttcgcctccggcgccgcggacgacagggacttgacgcacagctccgggtacttggtgtactgcttgcacgcctcgtcgacgacggtggggaccgtggccgccgtggcgcgccggagagagaccgagacgaccgcgaggacggcgatgaggacacggagggctgctgccatgttgacgcgatccgggcgagcgatggcggtgacggtggtggtggcgttacagggaacgcgatcgaggtcgccgtctcgtagagggctgggacccgcggacgtgccgccccccctcgccctaccgagtcgcccgaggccggggaggtttgcagagctgcatgcatgcatgcatgcacgcacgtcgaggccgagcgtacggacgacgtccacggcaaaacggtcaacgcagacggtttcaaactttgagcggccaaaatttactccgttggtgctacggttgggggtggcatactggcatcgcaaggagaacgccatcgtcatctgcggggcaacagtagtacaggtacaggacatctcaacgctggacgtgccatgccatggcggcggtgtccccgccgaggatgacggaagtgagtcatcgttgggaaacggtggccatgcccggcccctatggccgcgcgcagactagacacagctcgaagctggacatgatgcatgctgccgaggtggtcgttgtcaggtcctttaaaaacttgcagtggtggccgcagactagctagacagctcgaagccggacatgctgctgccgaggtggtatgtcaggtaaaaccttgccatggcaaccatttgctcacagaacaaacaaactcaggtgactcagaaaaaaaaaacaccatctctggtgatacaaagcttgactgcattttcaagttctactacatagaaaataaattacagtcctcacgtacagactaatttcctaacatgagtagcatatcaaacttattagcaacaaatttagcactaattacataccaaacacgtaaaggctaatttcctaatatgagcaacatactaaactagcattatttaaggtttattttcaacagtcctcttaagccttgtggtgcgagcagctacatcatcaatcacatcaatcttggagccaattttctaaaactttgtcttcacatgccccttaactaagcaacaccccacttaaccctttttcacttcaatgctgaggtaacagttaagtactccgataccactcatcttgaatgtaggcgacatcttcccttgaacgtcttgatgtctttgtagcttgagctagtgattttcggtaggtttacataagtgaagatacggtttatatgagtgaggacatatacaccgagggtgatccccctcttttgagggagccatgagaagtcctgactcatctaaattgatcgtgactatggaagatgaaatggcatcaatgagtatcaaccatgttaaaacatagtagaaattactaagagaggacg

SEQ ID NO: 15195 - DNA, 2741 bp, Zea mays
aatgctctcaagagattatgttgtgtatgaagagtcgtgtagagacgcactattcacgaatagccgtttcttgtgttttttacatttaacccctagagacccctcaaaagacgggtattaaatgaggttacatataccattaagaaacagagaataaaaatacattctttgtaattcgatctagagatagttatgcctcatatactagtacggagggagtagtcaagtacactctgtagcgtggtgactttgtgtaagttaggatcaaaatctaagcaaccagttgctgtaggaattgtttttttggtggtattattatcgctatctatacgatctagagaaccatgttcaatctaatggaataaggtttcgtattgacctaggcaattttccctgggattagtcattttgttgaaagactctgtactatactctgtagcgtggtgatttttgctagatggcatgcttccatttaggaagaagagatacttttcatctgccctcatgtttacaattaccatgctgtagttgttctatataataaaagaagtgtttactctatcagcgatttggtttaaacagcttgtttcgatccgagatagggagcatgatagatttaaagcgctactgaaatcatgttctgggatttgactgtctggatattggctataatccaatcagtgaagttgtaaaaatgagcttttaagtatatttctatggcatagaacacagaatgcagatgtgactaggaaaagaagctcttcgctgttgaaaagccatctttaatcgacacgacaaaggtagcttatgccatgattcctgcaagtggcacttgcagcttggaccatggctaaccgtcaatggttcttgtttggaaatgttaacattcatttccatcttaagatcgttaaactcactttcggacaatattgttcctccaatttcaatagaaaattttagttgggccaacagttcagctgacttctctgtgagttggatagcatttgtccaattttctgtcacctttttgctaacttaaacgtggaaacacttgttgcaggggaccgatatttgaaaccattcgtcattccaaaaccagaagtcaccgttgttcctagggcgaaagatgacgactgcctcattcttgcaagtgatgggctgtgggatgtagtgtcgaatgaagaggcatgcaaagctgcgcgtcggcagatccagctgtggcacaagaacaacggtgtcacatcatcattgtgtgacgagggtgatgaatccaatgatcctgctgcacaagctgctgctgattatcttatgaggctcgcactgaagaagggtaccgaggacaatatcactgtcattgtggttgacttgaaacctcgaaagaaggccaagagcaactcataacactgggatggatccatcacggtagagctgaccatgatatgtccaaaggcttctgctgctagttgttggtcgtccgcaagagacttgaccccacaggtttttttcgttgggcctcaagaactgtaggtgcattttccatggagggttatgatgcttaaccccactctggtttctggtggctaaaacattctctccagtcggcttctaccatgagccctggcacttagtatatccctaatgttgtatgatggttgaacttgtaaagagacaagcggctgagacggtcactaaaattaacatattgttacttcatgattcaaggactatccatctgcctgaatccgatgaaagttttgtattgcagcttcaagtgtgtgcccacctatatatacagtttgattgggtacatatacatgattagttgggtgtacctccctaacatggctctttgtatgcgttgactagctccgagagcatgttgggttaactgcacgcactcgattagacatgcatgatgcaactcacgtatttgcggtagctttttgcctacatacgccgatacaggtaaaaatcacatatctgctgtcagggccaggctcatgcgagcacacctacacagacacagtcatccatcacacggatacggtctgattggatacctgcaggctcccgtgagggtggccgaatggatacgtcagttttgagagttcctgtggatgcaggtaagctaggtaatcaaacagtagcacgtgtaaagtcaacgcatacccatcagacggatagtaactccacacagactggcctgcaatctcatacaacaaatctaaggattcgtgtcctctccactacaataaaaacgcaaagctttggttctcgcggatgaaaggcagcaggtcattaactgacgtctcctcaatgtttggcattgacttcgaaatatcttcaagcgaaaagggtatgctgcgacaagaagagaaatgatattatgaaacgagtgtaactgagcaaataccatttggggggcatgaaaactagagcctacaaattgtcagggaatagacctggaatcatcatccagcaggaccgaaaagctggagacgctatttgattcttcgcgcagcatagctctcatgcttgacatgaactatgagtagtaaaggtaaattaaatgaaggtagctagcatttcgaacaaaacagtgcaagactaaagggataaagcctatcgtcttacctcggctgaagttacatttgttccctttaaatcatcccaatacataccgactatccgctctagctgctgcaaactgagagcctaaacaaatagctacatgagtacac

SEQ ID NO: 15196 - DNA, 1322 bp, Zea mays
agcgccgagatggaggacgcctgcgccgcggccccgcggttcgccgacgtgccggtgcgcctcctcgccagccgcagggacctcgacggcctgggcctcgacgccggcgcgctccgcctgccggcgcacctgttcggcgtcttcgacggccacgggggtgccgaggtggccaactactgccgggagaggctccaggtactcttgaggcaggagctgaggctactcggcgaggatctggggcagactagctgcgacgtggacatgaaggagcactgggacgagctgttcaccgggtgcttccagaggctggatgacgaggtgtcagggcaggcgagcaggctcgtcggtgccgtccaggagtcacggccggtggccgccgagaacgtgggctccactgcggttgtcgccgtcgtgtgctcatcccatgtggtggtcgccaactgcggggattcgcgtgccgttctctgccgtgggaaggagccagtagagctgtcgattgatcacaagcctgacaggaaggatgagcgcgcgaggattgaggccctgggaggcaaggtcatccaatggaacggctatagggtctccggtatacttgctatgtcaagatcgattggggaccgatatttgaaaccattcgtcattccaaaaccagaagtcaccgttgttcctagggcgaaagatgacgactgcctcattcttgcaagtgatgggctgtgggatgtagtgtcgaatgaagaggcatgcaaagctgcgcgtcggcagatccagctgtggcacaagaacaacggtgtcacatcatcattgtgtgacgagggtgatgaatccaatgatcctgctgcacaagctgctgctgattatcttatgaggctcgcactgaagaagggtaccgaggacaatatcactgtcattgtggttgacttgaaacctcgaaagaaggccaagagcaactcataacactgggatggatccatcacggtagagctgaccatgatatgtccaaaggcttctgctgctagttgttggtcgtccgcaagagacttgaccccacaggtttttttcgttgggcctcaagaactgtaggtgcattttccatggagggttatgatgcttaaccccactctggtttctggtggctaaaacattctctccagtcggcttctaccatgagccctggcacttagtatattcctaatgttgtatgatggttgaacttgtaaagagacaagcggctgagacggtcactaaaattaacatattgttacttcatgattcaaggactatccatctgcctgaatccgatgaaagttttgtattgcagcttc

SEQ ID NO: 15197 - DNA, 1922 bp, Zea mays
gagaacggtagaaacaggaatggaaatggcagaaccaggaatggggcagcctaccccttagagtcttaataggtagtatagattagccaaaaatgttacttctggaatttgaatcgaactcggagaaaatagacttgtttatttctttccataaatggcatgtctgattttttttgccgaacagcagatctcagctgttgaatgaacacagtgctgacataagggacccagcagcaggggctttctctggcgtcctggtcgaaacaaccccaccacctccaggcacaagcacacgaagccttcgcattcctgtccggcggaaccgctgaaggaagggagccgaacgagcaagcaagccaccaacgaaggttgctagggccggagtggatggggttcatgctgcgggtgaggctcgcctccttcttcgtcggcgcggctgccgccgccgcgggcgggggctacttcctctacaaggactacaagctcgccaacgactctctggccctcaaggtacgcactccgcccctcttcctcctcgcttcgcatcagatcttagattgttgcgctcgtatcgctactggtgctctcggtggtggtgattctgaagcagtaatgcttgaagcgcatcggcatgttgcgtgcgggatggggggatcgagggtaaaccctcgacaggagggcgtgcctttgagctttagccctggccgtcatgccacacacatcttgtttgatgatccgatgacggtcgtatggtttggttttactaagaataccagttttggtagattgatgcaaggttgggtagcatttctgtctatcatgtagacatgtacttgtcatatcattgggaaggggattggcataattgttttgttgagacgttggatgcttgctttgtgtctagggcgtgatctgtattgttttctggaaaaaaatttggtgcaggactgctgcaaaccagactgtttgcagccctgttttctggcaagttggggatacatgaggtttctatggacctttcagtttcaattcaattcatgcttatatttatttgtttgtttttttgctctgtatactatataccaaattgaactagcattctttttaagatctatggttgtagttccaccactgcatcatatgatgtcacttgtcaaattgaaggtttttttttgttatcagtttcttactcaaccgttcagcattttctgttaagggtgtcttcatatgttccgttctgggcaaccgacatacatttctcatattgttaaatctgtaattgacttctaaattacctgaaagcagaaccagcaaactattcttgatcaaatttccaagttgtatttgtatatatatgcggctcatgttgtttaccattggtttgctgcaacttaagattctgtaaatagaaatggctgatcatatttttttgcagaactatttagaacccatagctcttattgaattgtacattaattttgtgactggaagcagtgtgtttgcagtcaattgcagacacatgatgatcatgtgctggtgttctaaacaagtgaactgttgaagtgatcctgaattttaaaatagcagtccattttaaaactcaacagtgttgatggattatagctgtattaaaatgagttttctacatgtgactcgagcattgagaagtagacatagacagaggcattggtatgcgttagtgcaatacaacgccgacaacaacaacaaagccttttatcccaagcaagttggggtaggatagagttaaaaacccaatagaaaccacaagccatggtgcaggctagatctagatgttttccatgcactcctattcaaggctaaatctttgggtatatgccatcctttcaagtctcctgttattattgactcttcccatcatcccatgtcaacttcggtgttcc

SEQ ID NO: 15198 - DNA, 794 bp, Zea mays
gcacgagccccgcggccggggccggctctggcgtcctggtcgaaccagccccaccacctccggcacaagcacacgaagccttcgcattcctgtccggcggaaccgctgaaggaagggagccgaacgagcaagcaagccaccaacgaaggttgctagggccggagtggatggggttcatgctgcgggtgaggctcgcctccttcttcgtcggcgcggctgccgccgccgcgggcgggggctacttcctctacaaggactacaagctcgccaacgactctctggccctcaaggtgaaatgtctccaagactcaactgacactcgctacgaagcccttgaaaagcgactcgctgctttggaaggtctgcaaagccctgaggctgcaccggatgtggatacgccatctgattagtctgttcgctacgagactttgatttacgtctgttttcgtttgccccagttgtcttctcctttgaaagcaagtacctgaccaacaacaaaataatctaggatgcttcttttgtactgcaaatgtctgaggctgagattctcccctacatttcatgccagaaaagcacatgaacatcagaactctgattactcaggcatactgagaatggccaaatgggcgtgaacccaaaacccagtttgagacaataatgctgcaatggtttttgccgcgccaaaaaaaaaaaaaaaaaagccgcccgcggccatgctgtatatgtatgacaatggcccaaatgggcaaacatactacgtgttatttatgcggtggctaggcctaggcatgcta

SEQ ID NO: 15199 - DNA, 683 bp, Zea mays
accacctcccgcggcacccacccaggcacaagcacacgaagccttcgcattcctgtccggcggaaccgcggaaggaagggagccgaacgagcaagcaagccaccaaggaaggttgctagggccggggcggatggggttcatactgcgggtgaggctcgcctccttcttcgccggcgcggctgccgccgccacgggcgggggctacttcctctacaaggactacaagctcgccaacgattctatggccctcaaggtgaaatgtctccaggactcaactgacactcgctacgaagcccttgaaaagcgactcgctgctttggaaggtcagcaaagcactgaggctgcaccggatgtggatacgccatcagattagtctgttcgctacgagactttgatttacgtctgttttcgtttaccccagttgtcttctcctttgaaagcaagtacctgaccaacaacaaaataatctaggatgcttcttttgtactgcaagtctgcaaatgtccgaggctgagattctcccctacatttcatgccagaaaagcacatgaacatcagaactctgattgctcaggcatactgagaatggccaaatgggcgtgaacccaaaacccagtttgagacaataatgttgcaatggtttttgccgcgctaaaaaaaaaaaaaaaaaagccccgccggcc

SEQ ID NO: 15200 - DNA, 2600 bp, Zea mays
ttcgatcttcactttagtcttcacggtaaaccgagtgcttcccacgagaaggtgatccaaattacttcttgttaaaagacgttggagttcgggacgctccccgcgcttcacgcgtccggagagttcggcttgctgacgcgtgctcaactgcccattcacggacccgagatatttcttcaattctttgagccattcgcgtctgcgtccgctcccccatatccgatcgatctttgagccattcgcgtctgcgtccgctcccccatatccgatcgatccactgcacctcgcgagcgatagggcaactcccctgcacgaatccactgctcctcgtccctgcgccgccgccgctcgacggagtcggcctcatcgccgctcggaatcaagtctcccccccaacgcacacacatgctcgccagatcccctccgtctccaccgccgtggtcgagcaagtgggtcaagtcgctggtggccctcaaggtggccgagaaggcggcgggacataagggtggccataggtaccatctcaggtggagctagccggtcgtgtccacggcgagcgctagcgagcgcagtgcgctggcgtccgaggcttctgcggcttcgactgactcgtattcgttgaaacaaactgaagcagcgctattagggatcagcgaggttgaggaagtccagctggaagttgctcgcctcggtgaaacgcgcggacccgaccagggcgcctgccctggtgatgcggcagccgccggggccggggccgagggtgacggcgcaaccctgcctgacgagctggccggtggacaccaggttcaaatccagaccagggacgtaccacacgtcgtcgaggacgatgcgctccgtgcgcaccgacccgcttccgcggactcgcagcggcagctctcttccattgaccacctggtggacgacggcgccctcaccgttgttgccattgccgtggccgccggtcagaagcaggctctggttgcccgtcatatgatgcaccgctgcagacgcggcgaaccaggtcgatgactcacgcggcggactgcatttgacccgtctgcttgcatcgtcctcgcctctcgctcctttattatgtccaaggaaacaagtctcgaatctggccacttggagcaggaagcagaatggaactagaacggccaggatgaagacacagacgaatgttgttacgacctcgctggagctgacggcaccgaatgaaccggtgagcccaatcagaagcaaaagcgcaaaatgctttcttttcagtagcagcagcttgtggatcgccaacttggaataacttagcagtgtttcttggttgctgccgtcgtctctcatggccactctgttccactgatccaatgtcagatctttactagctaacaagcttgatccaatttgtatcattaaattcttttatattcctgttattttccgctcctctactaatgagaagtatttatcctttcaaaaaaaaaaaaaaaaaaaaaaaaaaaacagtgcttatttgatataccatttttattacgttgtttcataacaattattttttaatattgtcttttttcacatgaattcttttaatgacacctacttatgtggatatgtgatgtttgtctagcactattgatttttttgccaatgtgctcagtgaggctcaggatgggattctagatttgaacagcacaacatataggccggtttgctgttgggtgtggtgaagatgatgcaagtatctcagagcttgaaaatcttgatatgataactggtcatgtggaaattagcaaccttaaaaatctaagggatccaagtgaggcagaaaaggccatgttgaagcagaagaataatatatggagtttggagttggattggtcttcaagtcaaaccaaggaagagttagtatcagatgcggaacaagaccagggtgtgcttggtgctcttgaaccaccatcacaaattaagaacatgagaatctgcggttatagaggcctctgtttgccacactggatgatgcaaaatgattcttgttgtgcagataaactgataaagcaaaccagcatatgtcagttgctttctctaacggatatgacactagaaggatttccaaacttgaagtatatacgaggacttttggtgtttggttcgctcaagtccctgaacctgctcagaatggctaatttagaggagctgtggactacaacaaatggttctaaaattcatgggtgctgttttcctgtcctgtctgagctatgtataacaggctgcccaaaactgaatgtgaagccctacttcccaccttcattgattacattgtcttttgaagacagcaatgagcagctgttatccccaagcagtttttcccatcggcttcctctatctgccgatgagccatcgtcgtcctgcaacgtgcattcagattcagcagcccttcgtctcaagaaactacggctgccaggctcatcatcgagttgggggtacctgcggcactgcgctgaactggagatcttgcacattgagtgctgcaatgacatggcagaattgcttgagatccttcaaaacctaacatcacatccatgtagcagttgtctataatgggttgt

SEQ ID NO: 15201 - DNA, 1631 bp, Zea mays
gggtacctcgaggccggccgggatcggcccggacggccaaccccgaatcgctcacagtcacatctgatccgctccggctccgacgacgaatgggctctatggaagcgtcgaccgcgccggagaacggctccgccgccggtggcggagccggcaacggggcgggcgccgcgtcgaacggaggaggtgttgagaggaggctgaggtcctcggctgcgcccgcgtcgtgggcagcccagcttcccctggaggtgggcacacgcgtgatgtgccggtggcgcgaccagaagctccaccctgtcaaggtcatcgagcgccgcaagggctccgcttcctcttcccccgctgactacgagtactacgtccattacaccgagttcaatagaagacttgacgagtgggttaagcttgagcagcttgatcttgctactgtcgagaccgatgttgatgagaaagtcgaagataaggcaacaagcttaaagatgacacggcaccagaagcgtaaaattgatgaaacacatgtggagcaaggacacgaggagcttgatgcagccagcttgcgggaacatgaagaattcacaaaagtgaaaaatattgcaaagattgaacttgggagatatgagatagatacatggtatttctctccttttccaccagagtacaatgactgcccgaagctgtttttctgtgaattttgcctcaacttcatgaagcgcaaagaacagcttcagaggcacatgaagaagtgcgatcttaagcaccctccaggtgatgaaatctatagaagtggaactctttcgatgttcgaggttgatgggaagaagaacaaggtttatggacagaatctttgttatctggccaagctatttcttgatcacaagacattgtactatgatgttgatttattcttgttttatgttctctgcgaatgtgatgaccggggatgtcatatggtgggatatttctctaaggaaaaacactctgaagaatcttataatttggcttgcattctcactcttcccccataccaaagaaaaggatatgggaagttcctgattgctttctcatatgaactttccaagaaggaaggtaaagttgggacaccggagcgccctctttctgatcttggcctgctcagctatagaggttattggactagagtgcttctggaaattctaaagaaacataagggtaacatatctataaaggaactcagcgacatgacggcaataaaagccgatgacatcttgagcacgctgcagagcctggacctaatccagtatcgcaaagggcagcacgtcatctgcgcggacccgaaggtcctcgaccgccacctgaaggcggcgggtcggggaggcctggacgttgacgttagcaagctgatctggactccctacaaggagcaaggctaaaagcgcagctgctcccagccccagattagagtccctgtacataacgtttggtactaggatctcccctcagctctcacttcactcgtgtaccgtgaaaactgtacactgtaacaaccacattgctgtgtttgtgctgtctgccgcgatagtctccgaaatcgaaagaaacatcacccaactctttaaaaaaaaaaaaaaaaaaaacaaaactcgagggggggc

SEQ ID NO: 15202 - DNA, 1642 bp, Zea mays
gcacgacggtaaaaccaacgggccccaaacagtccagaaccgccggcccgaccggatccgctctggctccaacaacgtgatgggctccatggaagcgtcgaccgcgccggagaacggctcctccgctgccggtggcggagccggcggcacggcgtgcaacggggcgggcgccgcgtctaacggaggaggcatggagaggcggctgaggtcctcggccgcgtccgcgtcgtgggcggcgcaccttcccctggaggtgggcacgcgcgtgatgtgccggtggcgcgaccagaagctccacccggtcaaggtgatcgagcgccgcaagggctccgcgtgctcttcccccgccgactacgagtattacgtccactacaccgagttcaatagaagacttgacgagtgggttaagcttgatcagcttgatcttgacactgtcgagaccgttgtcgatgagaaagtagaagataaggcaacaagcttaaagatgacacggcaccagaaacgtaaaattgatgaaacacatgtggagcaaggacatgaggagcttgatgcagccagcttgcgggaacatgaagaattcacaaaggtgaaaaatatcgcgaagatcgaactggggagatatgagatagacacatggtatttctctccttttccaccagagtataatgactgcccgaagctgtttttctgtgaattttgcctcaacttcatgaagcgcaaagaacagcttcagaggcacatgaagaagtgtgatcttaagcaccccccaggtgatgaaatctatagaagtggaactctatcaatgttcgaggttgatgggaagaagaacaaggtttatggacagaacctttgttatctggctaagctatttcttgatcacaagacattgtactatgatgttgatttgttcttgttttatgtcctctgcgaatgtgatgatcggggatgtcatatggtgggatatttctctaaggaaaaacactccgaagaatcttataatttggcttgcattctcactctccccccataccaaagaaaaggatatgggaagttcctgattgctttctcatatgaactttccaagaaagaaggtaaagttgggacaccggagcgccctctctctgatcttggtctgctcagctatagaggttattggactagagtgcttctggaaattctaaagaaacataagggaaacatatctataaaggaactaagcgacatgacggcaataaaagcagatgacatcttgagcacgctacagagcctggacctaatccagtaccgcaaagggcagcacgtcatctgcgctgacccgaaggtcctcgaccgccacctcaaggcggcggggcggggcggcctggacgtcgacgttagcaagctcatatggactccctacaaggagcaaggctaaaaggcgaactgctccgtgtctcagatttagactcgctgaccgatgcgatgcagtccctgtacatagcatctccccacagctcacttgacttgacttgactcgtgtaccgtgaaactctacttgtaactttgaacatccacatcgttgtctcctcatttctccttgcattaaccatgctaccttttttttaaaaaaaaaaaaaaaaaaaaaaaaaaaaaaaaaaaaaac

SEQ ID NO: 15203 - DNA, 1495 bp, Zea mays
ctcgaggccggccgggctcgggctctcgcacgagaccattgcccaggacggcctcggcccaccacctcctcttctcgcctgtgccttttgcccctgtgctcgccacacgcggcgcaaccgcccacccacccagccaggagaagaagatctccgtcgcctgctcttcgcttcgcttcgaatcggaggtgtcgagtagccagtggtgtccctatggattcagcttttagaagagctctcaatgagcctatgtgcttggaagaaaccgtcgtccaacaaggaattgaaaggtgcccattcctgaggaacatcaatgagcctacaagtttttccttctcgtccgtcaacttccctattcccgcaagaggagccaagggaccgattttcgaagatgggcctaattttgacatggcatttcgagttttccatggtagagatggggttgttccactttcagaagggtcattggcccagattgagaagccactgccaaagcccaatcctgagttcaacccattggcagccaaagcagcaaccatcagtctatctgcatttggagggtttttcagctttggtgacttctcaaataagcgcaataagaaaaactccaacaagaagaaccccaacaacctcccccagaataaaggccagcctaacaataacaaccatgaagcactgagcaacgagtggctggagatgggccaatgtccacttgcgaaatcttatagggcattaagtggaattgtgccacttgtcgcaaagatgatgacacccccagctggtatgaaacttaagtgcccacctgccgtggttgctgcccgcgcagcactatcccgcacagcctttgctaaggggcttcgccctcagcccctgccaacaaaaatactggtgattgcattgcttggtatggcagcaaatgttcctctgggcatctggagggagcacacacagaagttttcattgcagtggtttgccgcagtacatgctgcagtgccgttcatagggatgctcaggaaatctgtgctgatgcctaagacagccatggcccttactatagccgcctcgatattgggtcagacaatcgggtcaagagctgaacgtatcagactgaagagggccgcggcagcaaaattagcaagagagagccatggtgacgctgctgactacatcaaagcaccaatgagtctgaaaacagggaaccacactgttcagttttgggatccgctttccctcagagctgaaagcacagtggctgcaggtaccacagcagttcttgtccctgccatttctgctttcaactgatgacaggaatggattcattacgattgtaccagcatcgctggttggtgtattcttttttttctcctattctaaataatctgattgttgtatccattactgtacttttgagcttaagaaagaaatacttcacggcaaaaaaaaaaaaaaaatttggtggccacatgacagcgaataaattagagaacacgttgagctg

SEQ ID NO: 15204 - DNA, 1537 bp, Zea mays
tgggacctcgagccggcgggtccggctgcctcgaggccacccgccccccggttcgtcacttcgtcgctttctcgtcgagccgcgactgccgactgcgaccgagagaattctctatccggtccccgtccggtttggttagagttcgcactcgtgattgggttggtcgcttggttcttccctgccggaagatacctttcgttcggtgtcgccaactcgccattcttgggaggtcttggtcgggaccggtgctgatggaggagaggtacgaggcgctgaaggagctgggggccggcaacttcggcgtggcgaggctggtcagggacaagcggaccaaggagctggtagccgtcaagtacatcgagaggggcaagaagattgatgagaacgtgcagagggagatcatcaatcaccagtcgctccggcaccctaacatcgtacggttcaaggaggtttgtctaacacccacacatcttgctattgtcatggaatatgctgctggtggagagctatttgagaaaatctgctcagcagggcgattcagtgaagatgagtccaggtatttcttccaacagctgatatcaggggtcagctactgccattctatggaaatttgtcaccgtgatcttaaacttgagaacaccctccttgatgggagtccaacacctcgtgtgaaaatttgcgactttggttactcaaagtctgctttgctgcattccaaaccaaaatcaacagttggaactccagcatacatagcccccgaggttctttccagaaaagagtatgatggaaaggtagcagacgtttggtcctgtggtgtcacgctgtacgtgatgctcgtgggatcatatccatttgaagatcctgaggatccaaggaacttccggaaaacgatcagcagaattcttggcgtgcaatactccatcccggattatgtgagagtgtcttcagactgcagacgccttctgtctcagatattcgttgccgatccttcaaagaggatcacgatcccggagataaagcatcacccgtggttcttgaagaacctcccgagggagatctcggagagggagaaggccaactacaaggacgcggatgccgccgagccggcgcaggccgtggacgagatcatgcggattgttgaggaggccaagacccccggtgacatgtccaaggtggttgacccggcgctgctggccgagatggcagagctggagagcgacgaggaagaggcagacgccgatgacacctactgatcgctcctgcatgcagctcagcagctgctcagtcatggtgtccagtcctttgtgctgcagacatggcgccgccgagcgcccgagcttaacccgtgcgtgtgatgacggatgttgtattgcactctttacgctgtttgtataataaaagtctgtacaacgctgtacaattgcagattgccttgtacagatgaactagcgtgcagtgatatactcagtcccaaattctatgttccaaaacggtttaaataattttattttttagagagatcaaaatagttttaagt

SEQ ID NO: 15205 - DNA, 1701 bp, Zea mays
  misc_feature (1697)..(1697): n is a, c, g, or t
  misc_feature (1701)..(1701): n is a, c, g, or t
tcgacgccgtcctgatgcccagtatacccccatacccccactcccagcgcctcgggtcctcgcctcgcatttgcctaccttcgccttgatccggcgatctcattgtctcctcgctgaccgtcgccctcggcccccgtccctaacttcagtgacctcgatccagcaatacaacaccatctcccctctccatgtctcctctctctctcgatgaactatgtgagttcgtgttgtagcctagtctctcctcccccgctcgttgtcgtttctaatcagtgtctctcgtctaggtgcccgatgtcttctccaactccaggctccggttgcacaagtaaactctaaccctaaccctagatctctaattattttgtgtaggtcagttgtcgatgcctcgtcttcctcctctagagtagactaggcatgtacgacggctgcacgcaccgttgaggaacggtgtagatcgatcgtccgtggtaaagatcgccatgtattagagttgaggaatgatgacgaggtctattcgctcaccggcaatgatgactttcgcacgacaaggcttgtctccaatgacaaagacgacattaggcgagacgctgttgcatgccttgttcggtatcgatgtcttgtgtttgaaaattctaaaatttaccatattttagaggtgttgtatatctggggggctcctgtgctccaacggaccaacccaacacaaaaacaaatccgtaggatcgtgccgaggtcgacgtccagagtccagacacgtgagccactttaagtacggcccgtgaaaacgccgcgccgtgtcggcccgttgactatcgggtgatgtccttcactgttgttgacagaaaacctctcttctctgccgcaatggtaggcagggcacgcgtcctagaagcgaggccaggtgtcgcgccaccgaagctcggcgccgccacgtcttctctctgcgggcagcttgctttgatccttcccctgggttccagttccagcgtctgcttgcttgctaccacgcctcctcatctgctgccaccggcgtctctccttcccagctggggccctgagctgagagcagagcagggagcgaaactttgcgctgagattgagctgctcctacttggaaggcggcggcgtcggcaatggggtcggagacgttcgtggagatcctgctggccatcctgctgccgccggtcggcgtcttcctccgctacggcatcggggttgagttctggatctgcctgctgctcaccatcctgggatacatcccgggcatcatctacgccgtctacgtcctcgtcgcgtgaaagcacaacatggtgtggtaggtatgacgacgatggtgaccgtccgcccgcccgccgggagctggaatatatgagacccagacccagtgcttctgatccatccattccatgcatgcagtgatgcaggcatacgtacgtttagcccatgctgtatgtttgtgtcttgctttagttagctttagctagctgcttgcagcttagcttctctcagctcgtctaccggtccgttttgctgtgcccatggacatggatgggaagaaggaaccgtagcttgtatgcaagtgtgtactagagtccagagtttctactctgctactgattctgaatccagacatgttttctgagatcaacattcgtaataaaaaaaaaaaaaaaaaatggaagcataaaaaaaanaaan

SEQ ID NO: 15206 - DNA, 2996 bp, Zea mays
cgcggaaaagcgccatctcattcttcttcctccatcttgtctctacttgccccgcgccggggagccgcgagcgtcgcgccactcccatcgcctgcccacaactccggcatggagccgtcggcgtgggccgtcgccttcgccgcactctgcatcgtcgcgcccaatgacttcgagaagaaagatccacttcctgtgaaagtcaacaagctgacctcaatcaagacacaacttccctactcctactattctctcccattctgcaagccggataccatagttgacagtgcagaaaatctcggtgaagttcttcgtggagatcgcattgaaaactctccctatacgtttgaaatgagggagcctcagatgtgtcaagtagtctgcaagatatctgttggggagaaagaagcaaagcttctcaaggagaagattgaagatgaataccgtgttaacatgattcttgacaacctacctttagtcgttcctattcaaagagtggatcaagaaggtgcatatttctatcaacatggattccatgttggggccaaaggaaaatattcagggagcaaagatgaaaaatacttcatccacaaccatctatcttttacggtgaaatatcacagggatgagcaaagggatgtttccaggattgtggcctttgaagtgaaaccatacagcgttaagcatgaatatgaagggcaatggaatgataagaagacccgcctgacaacgtgtgaccctcatgctcaacgtatcattacttcgtccgagtctcctcaggaggtcgaagttggcaaggatatcatatttacttacgatgtggatttcaaggagcagcgacttcagtttgattctttttgtattccaaataagtgattgtagtagctgtagtactaagtgtcctataagtggagcatgaatattgtgttttgctcatttctgagaactactgtaaatttgtaggagagcgacatcaagtgggcatctcggtgggacagctatctattgatgacagatgatcagatccactggttctctattgtgaattctctcatgattgttctctttctggaatggttgcaatgatcatgcttcgtaccctttaccgggatatctctaagtataaccaacttgagactcaggaagaggcccaggaggagactggatggaagcttgttcacggcgatgttttcaggcctccgtcaaactcagactggctctgtgtttatgttggcaccggtgtgcaattctttggcatgctgcttgtcactatggtatttgcggttcttggcttcctttctccatcgaacaggggtggactgatgacagccatgctcctgctctgggtgttcatggggttgcttgctggctactcttcttcacgtctttacaaactgttcaagggctcagaatggaagaacatcgccttgaggacagccttcactttccctggcagtgtgtttgctatttttttcttcttgaatgctcttatctgggggcaaaagtcctcaggtgctgttccattcaccaccatgtttgctcttgtcctcctttggttcggtatttcagtacctttggtttttgttggaagcttccttggcttcaagaaacctaccattgaagatccagtgaagacaaacaagataccaaggcagatccctgagcaggcctggtacatgaacccaatcttctcgattctaatcggagggatccttccatttggtgctgtcttcatcgaactcttctttatccttacttccatctggctgcaccagttctactacatctttgggttcctcttccttgtgttcctgattctcatcgtgacatgtgctgagatctcgattgtcctatgttacttccagctctgcagcgaagattacctgtggtggtggaggtcgtacttgacttctggttcctctgcactctacctcttcttgtatgcaaccttctacttcttcacaaagcttgagatcaccaagtttgtctcagctgttatgtacttcggttacatgctcattgcctcgtacgccttcttcgccttgaccggcacaatcggattctatgcttgcttcctgttcacaaggctgatttactcatcggtcaagatcgagtaaggtgaagtgcactcttgcctatttctttgttgccacgaagaaagaagtattctatggatagtgaattctacaggactgctgagtttagctgcaagtgggctcgttttgagttttcaaagctggtagttatgatgaagatgcgattcattaccgtatgattccggtattatagctagctcagtatgtttctgtttttcttttgtttttttttgttttcgggctgtgcccgaccgtgaggatatatgcttatcaagagcttgacgctgaaagaattgtatacgggtgctgagtaatctatctcttgttcctctcagaatttatgtacttgttgatgtgcactgtgacgtacatgatatacatttatagctaccggctcggcggctcctgtttcttttgaaaaaaaaaaaagaaaaaaggattcttatacgcggccttctaacgttctgaccttggagagcttttgcatttgtcatgagggtatcctgggtcgtatttgggagcctggcccttgccagccatgctgtcagtatacagcatgtttggttggcaacgagtcggatattgcaaatattcgcccgcaaccatatccacggttgcagataatatccgcccgcgactatacccgcggatagaaattcatatctatgaccatgctcatcgggttttggatatctatcgaatatccattggatatgacaaataatcattttcaacaatttaataacgtaattaatcaaatttcttcccaattcaccacatgcacagctaaaaacttaataaaaattaagcaaatatacatgtccttcaacaagcaacattctaaacatgataaaaaaaatacatgtcttgaattgcaataataaattcagaatagaaagtgca

SEQ ID NO: 15207 - DNA, 1300 bp, Zea mays
ggggacccccgggctggccggtggatgggggccgccggggccgggagcggaaaagcgccatctcattcttcttcctccatcttgtctctacttgccccgcgccggggagccgcgagcgtcgcgccactcccatcgcctgcccacaactccggcatggagccgtcggcgtgggccgtcgccttcgccgcactctgcatcgtcgcgctcgcgccgccggcctcagggttctacctccccggcgtcgcgcccaatgacttcgagaagaaagatccacttcctgtgaaagtcaacaagctgacctcaatcaagacacaacttccctactcctactattctctcccattctgcaagccggataccatagttgacagtgcagaaaatctcggtgaagttcttcgtggagatcgcattgaaaactctccctatacgtttgaaatgagggagcctcagatgtgtcaagtagtctgcaagatatctgttggggagaaagaagcaaagcttctcaaggagaagattgaagatgaataccgtgttaacatgattcttgacaacctacctttagtcgttcctattcaaagagtggatcaagaaggtgcatatttctatcaacatggattccatgttggggccaaaggaaaatattcagggagcaaagatgaaaaatacttcatccacaaccatctatcttttacggtgaaatatcacagggatgagcaaagggatgtttccaggattgtggcctttgaagtgaaaccatacagcgttaagcatgaatatgaagggcaatggaatgataagaagacccgcctgacaacgtgtgaccctcatgctcaacgtatcattacttcgtccgagtctcctcaggaggtcgaagttggcaaggatatcatatttacttacgatgtggatttcaaggagagcgacatcaagtgggcatctcggtgggacagctatctattgatgacagatgatcagatccactggttctctattgtgaattctctcatgattgttctcttcctttctggaatggttgcaatgatcatgcttcgtaccctttaccgggatatctctaagtataaccaacttgagactcaggaagaggcccaggaggagactggatggaagcttgttcacggcgatgttttcaggcctccgtcaaactcagactggctctgtgtttatgttggcaccggtgtgcaattctttggcatgctgcttgtcactatggtatttgcggttcttggcttcctttctccatcgaacaggggtggactgatgacagccatgctcctgctct

SEQ ID NO: 15208 - DNA, 717 bp, Zea mays
atctttgggttcctcttcctggccgcgcctggttctcatcgtgacatgtgctgagatctcgattgtcctatgttacttccagctctgcagcgaagattacctgtggtggtggaggtcgtacttgacttctggttcctctgcactctacctcttcttgtatgcaaccttctacttcttcacaaagcttgagatcaccaagtttgtctcagctgttatgtacttcggttacatgctcattgcctcgtacgccttcttcgccttgaccggcacaatcggattctatgcttgcttcctgttcacaaggctgatttactcatcggtcaagatcgagtaaggtgaagtgcactcttgcctatttctttgttgccccgaagaaagaagtattctatggatagtgaattctacaggactgctgagtttagctgcaagtgggctcgttttgagttttcaaagctggtagttatgatgaagatgcgattcattaccgtatgattccggtattatagctagctcagtatgtttctgtttttcttttgtttttttttgttttcgggctgtgcccgaccgtgaggatatatgcttatcaagagcttgacgctgaaagaattgtatacgggtgctgagtaatctatctcttgttcctctcaaaaaaaaaaaaaaaaaaaaaaaaaaaaaaaaaaataagaaaaaaaaaaaaaaagagggccccgcggtacc

SEQ ID NO: 15209 - DNA, 3382 bp, Zea mays
  misc_feature (748)..(748): n is a, c, g, or t
  misc_feature (791)..(791): n is a, c, g, or t
agaggattcagggggttaaaattttcttgctagttaaaattgaatagcaagagaatttttgcccccacaatcctcttctctcaaacataacctacacaaaaagaggggaggggacaagcatggtgtgaagcaaacattaagtgcaccccaacaattgacactaggttagcatattatagggttataaaaggacttagatgtaagaaaatggatacagaagaggtagaagaagcaaaagggaaaaaaagaagatcgaacactttcctcacgctctcgttcgacttcatcgacttttaggttttttgcttttagggatctagcaacaatagcaacatggagggagtccttgagcggtggaagacgaagatcttcgttggtggcagcctctccgccgcgcgaggacgaggcacgactcaagtggcattttcgtggctcggcggtggcgtggtaagttctaagatagagagatgtattgttgtttttgttgatagtttcacagtaagtcagtaaaaaaaaggaaattccgcacaagattatatagtgcctgtttaggagagctctgggaagctccggccaaccactcctcgatagcccacatgcctagcagatggctccggctccgccttgttcctgaaatgacaccctcacaaaaatggctctctcctagctagaagttgtgcgaaggtgactccgctgacggcgccggagggcagaaagagctggagcgtctgagagcactaacaaagangcccatagtgtgcatgaaaatgatgacagtagccttatactgntgttgcttttgcatccctaacaggggattttgcaatgggagcgtatcatatgctcacagaatctccgcgtttatatgaactctttaaatttggtgcgttcatgagcaagccgacgataactgttacttttttaattgatctcttctatcttggttttgatggtatatttttttgttatcttttgataggtttttttttccttttagtgttctcaaaagcttttccccttccttttatctcttttttttcttttggtgacaacttgttgggttttaattctaatctatcttaacttgcttaggactaaaaggctatgttattgttgttgttatcttttgaatcggtcctggattttaaatggtcttaggagtatggacgtttgaggggcctcggccggttgttgttgggccgaacgaacgagaagactaaaattgtttgtgctttggtggcccaccaccgttgccggcccctgggaaacgccgtcagaacgtggtcgggtgcttggctcggttgccctggtcgccgtcggcgccaccgccaccgctccagctacctccacactcctcctaaatttagccatgcccaccacccatcgtccgctcgtccgctccaatccacgcctctcgccaccacggcaccgctctccgtcgatcccattccaatggggtgggccgcgtctcctcctcctcctcctccttcgtcgtcatcatcatgatcatcgtcgaatcgcctgcccttccgccgtttggaacctacaccgccgccgtaaccgctcctcggtattgtattggatcgcttcgttcaattgtccttgtacttcgatcaaccaatgcttcgtcgcatttttttggataattcagtagcctagcgattgaatgaatgattactattactgcattgtatttctgttgatagatgtgtcttgatgtgcttttctatatacgtcctgattattttttttccagatggagtcctccagcaagtcatcatacagcaagctgtccgctgcaaatgacaagatggattccgatgccgccgggagccacgagagtgcacggtcgaatggcctctcggttgatgcagccgacaaggcgccggccgcgggaggagcgggcagagctgacaagacctccgacgcttccactggtagcagtgacgacagcttggtggatagctccggtggtactggccgccatacgaagcggcacactgggagcgatcgcaggtgggaggccatccggtcggccagcgccgggggctccccgctcagcctcgtccacttcaggctcctgaagcgcctgggctacggagacatcggcagcgtgtacctcgtggagctgaggggcacgggcaccttcttcgccatgaaggtgatggacaaggaggcgctcatcagccggaacaagctggtccgcgcgcacacggagaggcagatacttggccttctcgaccaccccttcctgcccaccctgtacacccacttcgagactgacaagttctactgcctcgtcatggagtactgctgcggcggtaacctccattcgcttcggcagaagcagcctaacaggcatttcactgagcaagcagccaggttggttggttgcttcgtttcaactgtcttcttaactgtattacttattgtttgcctgccgatcgacgacaggttttatgcctccgaggtgttgcttgctctcgagtacctccacatgctcggcatcgtctacagggacctgaaaccagagaacgtcctggtcagagatggaggtcacatcatgctctccgacttcgatctgtcgctgcggtgctcggtcagcccgatgctagtcagatcctcatcggtccatgccgccgccaacaacggcgtggtccatgccgacggtgccagccagcagggccagggctgcatacagtcaccgtcagcgttcttcccgcgcatagtactccccaagaagagccgcaagaccagcaggtcggactccagcatcaaggacgggtcgatcctggagttcaacgcggagccgacggacgcgcggtccacgtcgttcgtcggaacgcacgagtacctcgcgccggagatcgtcagaggcgagggccacgggagcgcggtggactggtggaccttcggcatcttcctgtacgagctcctccatggcacgacgccgttcaagggggacagcaaccgcgccacgctgtgcaacgtggtcgaccagccgctgcggttccccgacgcggccccgcctgtgcctgtgagcaccgtcgcccgggacctcatccgtgggcttctggtgaaggacccccagaagagaatcgccaccaggaggggcgcagctgagatcaagcagcacccgttctttgatggggtcaactgggcactcgtcagggatgctcacccaccttctgtccctgaccctgcagacttgggccggtttgcatctaaggagaagccggcggcggcagttgccactgctcatcgtgctcctgcagctaaaccaaagaccggcaattttgttcagtatttttaggttgtctatatatcatgtttttgtttttggcagacaaaaaatacaagtcattttttaagaacgaaaaaa

SEQ ID NO: 15210 - DNA, 3428 bp, Zea mays
aattcggcacgtgcgcaatatacggtgcgtgtgggggcggcggcgacgagggttttgctgctccgtacaccgcgtgcagcggcgacgcgaccgcagctggtcgccgccccggatcgaggagggggaggagccggcggaggctcctgtggtggctgcgggggcgggagcgggagcgccatgaggggcggtggccgtggcggcggcgggagacagccttcctacgcggcgccggatggggcggatgcggcggcgatcccggtcgcctcaaggaagatggtgcagagcctcaaggggatcctggccgaccgctcggagggcgagatctacgccacgctctgcgactgcggaatggaccccgacatagccgtcgagaggctcatctcccaggatacttttcatgaagtcagaagaaagcgggataggaaaaaggagactaaagttaatcacgaaacaaggcctcgacctttccagaaatatacataccgaggatataaggctgtttcagatcgaagtgggcgagaccctacaggcggtttcaaaggccctgtaaagaaggaaccagagttgcaagctccactaaactcatcagccttggatgtcaagacaagtgacactacagaaatattttctgctactatcaatgttgcccagactgatgctaagaacaccacttctcagcctttatctaaagtgcagcatggttggggtggtattccaggtcgcccttccatggctgaaatagtgaagatgggcaggcctcaagctaaagttgggagcagatctgttgcaagtagcactgcgttgccaaccgttggtgattcagtcatttccaatacaccaaatcttgtgcccgaggaatataacagaactgtttttgcatcagaagcaggccatgtcgcagcagataaattgccaaacggtgctgttgaggtgcactctctacctaaagatgcttccgcatttgatatgttaccttcagctgagggaacagatgttgaagccccttccatgagtgctagtgcacaaggttcatcaatgccagatgccaatgaagatgacattgaaaaatatgcaaatttggaagagggcaatacagaaagcttgatatctcctggacaagtttctgcttctggtaaagatatacaatcagaatatactgaagttgtcagccatgtggatgaaggctcgatagagaaaacagatgactttcagctcaatggccttccatttgagcacaaccaaaatctgaatggagatgtgtctacagcgacaacacaatttgatcatttgactctgcatgagggaccaaaattgtccgatgataatccggctgtaataattcctgatcatcttcaggtttcgaatgctgattgtgcacatttgacgtttggtagttttgtgtctggaacacttgattcatccttgacaacaaaacctcttgaaagtcatggggatgctgcgacagttcctgatgatgattcaattgaccaatcagatggcaggatccatgacgatgaaggcaaggtgacattagctactgatgttaatgaatatgttacttctgcggcaaacagcaacgaggagaatcttgatattacatcagtacagcaatctgaagtcactagagctgatttcttggatgtcacaagcaatactgaatacaacctaacatcaactccagattatgcaacttcaagtgcaccgttgcaggattctgcttcacagagtttacaggaaaaccgacaattccagaacatctctcctttctcaagcttcatgcaaatgcaaaatggtctcctgccaccagcaattccaccattgcgtgaatttgatccagcattttcactattgctcacccatcctcctatgatgcatggtacaatgtcatcatccatgagcaatacaactgtttctacacagccccaagagaatgccaatccagttggtttacccaaccctcaattgactcaatctcagcaaagcaccagcattgcttcagggcctccactccctcagcatcttcttcatccctatgctcaaccaacccttccacttggatacgcaagcatgattggctatccatctcttccaccaagctatgcatatctcccgcctgccgcttttcagcaaccatacatgaacagtggcttgttccaccaggcagcagccgcagttcccacctcaagtgtgaaataccctctaccgcagtacaaaagcaacattgcccttgctagcttaccacagccaggctctttgctctcaagctacgttgggggctttggaactgcaagcaacatgcctggaaatttccctctgaatcaaagcacagcagcagcaacaacaactcttgggtttgatgggacggtcccttcacatttcaaagatggaaatcaatttatttctcttcagcagaatgagaaccctgcaatgtggatgcatggtgctagttcacgagggatgcccccacttgcagccagtaccatgtatggctatcaagggcagagtcatcaggccggccttcggcagggccaactaccttcacaatttggctctgcgcttgggcagtcacagccaggcctgggccctgaacaccgaaaccctagcgatagtaacctaagtggcgctgctcaggctaaccaaatgtggccaaatacctactgatccatcccccttgtcgacttctgtggaaggcggtcctgttgtgtgtgcaacgccggtgaggccatgcagtgcttgtgttctgatccaggcacgcggataccagctgtgcctgtgcgcatgagtcgctgtcgtgacattttgaggcacaagagacatatgttcgagcatgctctacctgtagggtttctaggatatggcaaaagaaaatgtagctcgatctatttattcaaattctgatagagaaaggacttcctcttttctattttattctcttttgtcattcacatatcatgtgacaaataaaaccgaaatatctaacagcagcgccattagttcccgaggaagtgaaactttacatcacacgtcttgcgtgcctcttggcttcaattttatgattgaggtgattaattgatggatgagcatttcccactcagtgctttgtcaagagaggatgccagattgatcgttgttttgaacatgaacctgtccttgatcaattagtagctagctaggctatgataggcgaggctactctgtccagagccttttaatgttggaggtcagagcgtgacgtacgcgttcttgcagccgcgtgttgacgaatcgtaaaggagtggagtggttgagatcaggggtgcagtctagtttcattgcaaaatggcatgcaagaacaaagaatatcatcatctgtactgtacacatctgcctgctaacaagggcaacgctactgaatgccagtgccagagacacgacgttactggtcgcaa

SEQ ID NO: 15211 - DNA, 4443 bp, Zea mays
  misc_feature (1340)..(1340): n is a, c, g, or t
  misc_feature (1536)..(1536): n is a, c, g, or t
tagctagtcttatctaacttactccagactggtattgtagtcattgaaattgttgcattagttttagttattccctcgtacttatttactagttagttacccgtacattgccacaacttctatatatcttatatgtagaccttgtatataactatatatacaacatctattcatttgtataacacaaatgaacttctgacttcggctgcagtggtagagacacaactctcatagtgactggtcgcgggtttgaatctcccaccccgtcccttttttgctatttgacgcgggacgcggggcctgcagggcagtcagcctcacgcgcaggcgtgcgggacgcacagatgggaatggatgggcgacacggggccctcagggcagtcggcctcactcgcaggcacgcggggcacacgagcgggtgcggatgggagacgaacgaaggaagaaactcacatttagatctttgatcttgatggctatagtcatgaaagggcctccagctgaattggttaaatgatcttagcgctcttcaggtcctgtatggatgaggtaggggttcgggagttttctcgacctgcatgagaaggtcctatctttataacaatattcaggggatgtctcacctccgcaggtcaaataacattcttcattttctgatttaacttctgtgggagcaaattttgggctggggttaaaaaaaccttcccacacaaaagcttgtgtctaatgcctgatcctggtcgtgatcgttctcacatgggctacaacccgtgtgtttggttgcatgtggtgcttgcatcgtgggttgcaatgagctggtgtttggttgttgtcaaccaggctctactcgtgcgaggtgtgtgtttggttacctgcgtgcagatgtggagccaggctcacatgatactcaaagcaccctgggccaggctctgtaggcgcgagcaaattggtcgcatctctggagccaggctcccgccggcctagctcatgcagccaggctacgaagagaagccaaccaaacatgcccatatcgtcgtgtattgccatattggtgaggcagaggttcggggggttttctcgacttgcttgaaaaggtcttctcttcataacaatgcctagggtccgtctcccccctaggtcgagttttttaatggctataacccatagcgttctctttatgagacacatgttcaaaggtggataccacagatcatataagtcaaatgtaggtcctacagagcagtttggactgtggagtagtttttgataaaccagaacataattgttgtttttacttgtcatcctagatagcatgcaattgaagcatttaatctatcacncgaaaattacagtagtaattctatcgctaaacttgggttaagtgccattatatattttttcttatgtttcactaacatgaagggtagacctagtgcagtggtgacagctatcttgccgagtcaccaggtcacgggtttgaagcagcctctccatatttacaggggaaaggtttgcctcggtttatcccttccctangccccactcatgtgggagcttccggcactgggtctgcccctttatgtttcactaccataatgctagagaagggaatggtagaaaaagtttattgtgatattgttctgatgtccttctctacaagtaacttgttacggcattgaaggacctgatactttctagcttgaatattatgaagggatcatcttttgcagtctcagagtttcatatactttgttttcttcatttttgcatcatctgtgattctgttctgtatttttgcactgtttatattattcactaaccattttccagggcaaactgccactctctttaactttgacaatgtatagcttcgctcatgcaaattaaatatgttcacttcatctggtaatttgtaaatgtagcttcaaggtttcctaggcaggcttcctaatttttttaggcttattatgtttgcagcaatgttgcccaggctgatgctaagaacactttccagcctccatctcaagtgaaacatggttggggtggtgttccaggtcgcccttccatggctgaaatagtgaagatgggccggcctcaagctaaagttgggagcagatctgttgcaagtagcattgtcatgccagctattggtgattcagccattcccaatacaccaaatcttgcgcccaatgaatacaaccaaactgtatttgcatcagaagtaggccatggtgcagcagataaattgccaaatgttgccgatgaggtgcactctgtatctaaagatgcttcctcacttgatatgttaccttcagcagagggaacagatgttgaagccccttccatgagtgctaacatgcaaggttcatcaacgccagatgccaatgaagatgacgttgaaaaagacacaaatttggaagagggcaatacagaaagcttgacgactcctggacaagtttctgcttctggtaaaggtatacattcagaatatactgaacttgtcagtcatctggatgaaggctcgatggagaaaacagatgactttcagctcgatgctctttcatttgaacacaatctaaatctgatggatgatgtgtctacaacgacaacacaatttgatcatttgactctgcttgatggaccaaaattgtctgatgagaatccggctgtaataatccctggccatcttcaggtttcaaacgctgattgtgcgcacttgacatttggtagttttgtgtatggaacacttgatgcgtccttgacaacaaaacctcttgagagtcatggggatatcgtaacaattcctgacgatgattatgaccaatcagagggcagaatccatgacgatgaaagcaaggtaacattagcgcctgctgctaatgaatatgttacttcgtccgcaaacagcaatgtagagaatcttgatattacatcagtacagcaatctgaagtcactagatccaatttcctggatgtcacgagcaatacggaatacaacctatcatcacccccagattatgcaacttcaagtgcagcgctgcaagattctacttcacagagttatctacaggaaaatcgacaattccagagcatttctcctctcccaagcttcatgcaaatacaaaatggtctcatgtcaccagcaattccaccattgcgcgaatttgatccagcattctcactattgctcactaatcctcctattatgcatggtacaacgtcatcatccatgagcagtgcaactgtttctacgcagccccaagagaatgccaatccagttggtttacccaaccctcaattgactcaatctcagccaagcaccagcattgctccagggcctccactccctcagcatcttcttcatccctatgctcaaacaacccttcctcttggatacgcaagcatgattggctatccatctcttccaccaagctatgcatatctcccacctgctgcttttcagcaaccatacatgaacagtggcatgttcctccaccaagcagcagcagcagttcccaactcaagtgtgaaataccctctgccgcagtacaaaagcaacattgcccttgctagcttaccacagccaggctctttgctctcaagctatgtcgggggctttggaactgcaaacaacatgcctggaaatttccctctgaaccaaagcacaacgtcggcaaccgcaactcttgggtttgatggaacggtcccgtcacatttggaagatggaaaccagtttgtttgtcttcagcagaacgagaaccctgcaatgtggatgcatggagctggttcacgagggatgcccccacttgcagccagtaccatgtatggctatcaagggcagagtcatcagaccggccttcggcagggccagctaccttcacaatatggctctgctctagggcagtcacagccgggcctgggccccgaacaccgaaatcctagcgatagtaacctaagtggtgctgctcaggctaaccagatgtggccaaacagctactgatccacccgaccaccccccttatcaacatctgtggaagacggtcttgttgttgtgtgcgcaaacgccagaggccatgcaaatgcctgtggcctgatccaggcacgcggataccagctgcgtgtgcatgagttgctgtcgtgacattttgagaggcgcaagagatatatgttggagcatgttccacctgtagggtttgtaggatatggccaaaaatgtagctggatctgttcattcaaattctgatagggaaagggccggtcgtttttcgttctatttcccccttttttttgtcgtttgcatatcttgtgacaataaaaccggaatatctaacacatcagcaccattagttccccgaggggagtgaaagatagtctgttgtctttgcatcaccagtattgcgcctgcctcgcttaaattttatgatggagatggttatttgatgg

SEQ ID NO: 15212 - DNA, 2636 bp, Zea mays
  misc_feature (2474)..(2474): n is a, c, g, or t
gatgcataagattttttgttagcttgctatttgtttgtgattatttgtaatttatcatgctacatgtaaatgatgaatgttatgctcatgaaattttcaaaaatggtatagttctttttcttaacctgctagattgtgatttggtttatgctaactgcaccatgtcattatgagcaagctgggtagtaaactagcagtcttcaaatgtgatttatatttggacaaatccttataatgaacccggctacattgtacttttttagtctcctattattgtggaaactggaactaccacggtctccagtttgaactttggagggacttgagtttcatctttatgcatctgttgtgttttctctgatttccatctctgtttttttaaaagaagatttcgtagggttaaaatttccattcggtaacactattgtttacactactacacttatgttaattccagtgatgattctgctactgactgctttagtgattggtccctgcaagttgtgccaaaacgttacttacaccttattttccatttaaaacttgtagttagttgtctttgcctaatggacatattcatgtagttttcctagtttatatttttcttggatctgatgtatacatggcacaattcttgttgtgtgtttgattctcgcagaatgccaatccagttggtttacccaaccctcaattgactcaatctcagccaagcaccagcattgctccagggcctccactccctcagcatcttcttcatccctatgctcaaacaacccttcctcttggatacgcaagcatgattggctatccatctcttccaccaagctatgcatatctcccacctgctgcttttcagcaaccatacatgaacagtggcatgttcctccaagcagcagcagcagttcccaactcaagtgtgaaataccctctgccgcagtacaaaagcaacattgcccttgctagcttaccacagccaggctctttgctctcaagctatgtcgggggctttggaactgcaaacaacatgcctggaaatttccctctgaaccaaagcacaacgtcggcaaccgcaactcttgggtttgatggaacggtcccgtcacatttggaagatggaaaccagtttgtttgtcttcagcaggtaaactacatggcgcctgcgctttccgtacgaggctggcgaattgtatgatcactaactttctgtctgctgccgacagaacgagaaccctgcaatgtggatgcatggagctggttcacgagggatgcccccacttgcagccagtaccatgtatggctatcaagggcagagtcatcagaccggccttcggcagggccagctaccttcacaatatggctctgctctagggcagtcacagccgggcctgggccccgaacaccgaaatcctagcgatagtaacctaagtggtgctgctcaggctaaccagatgtggccaaacagctactgatccacccgaccaccccccttatcaacatctgtggaagacggtcttgttgttgtgtgcgcaaacgccagaggccatgcaaatgcctgtggcctgatccaggcacgcggataccagctgcgtgtgcatgagttactgtcgtgacattttgagaggcgcaagagatatatgttggagcatgttccacctgtagggtttgtaggatatggccaaaaatgtagctggatctgttcattcaaattctgatagggaaagggccggtcgtttttcgttctatttcccccctttttttgtcgtttgcatatcttgtgacaataaaaccggaatatctaacacatcagcaccattagttccccgaggggagtgaaagatagtctgttgtctttgcatcaccagtattgcgcctgcctcgcttaaattttatgattgagatggttatttgatggatgagaatttcccaacctgtgccttgtctgatgagatgtatcgttgtatttgaacattgaatgcataaaaaagagagattgcagcacacatttgccagccaaatgttgattattcgctgaagtatgtaaatagctctcattatattgattgatttggtcaaattgtttggttatcttgcaaatattacagtggctcagtgttatcataaaaaaaattaaggctagtttggaaaccatatttttaagtgattcttatttttcctttccaaggaaaaatgaactaatttctttttaaaaaataaaaattccttagaaaaatgatgttaccaaatagccctaaaaagagattatgacacgatttttaagagcatctcgaaaagagcgctaaaataatctttactctgcagggctacatttcatgttctgccatcaatcacagttctgtcattcacattccttattctatcttttttattcatccctccccgcacaacccattttcatgttctaccaccatactctgatatgtcattctcattccttgtcatgtctttcccgtttntctcttcccgcaaagctcattctcatttccctgtaaaacccacatctagctaaaaaattaaaaaaataaacatggtcccaaggggattcaaacccgtgaccgcaaatacgagcagtagctaccgctacaccacatgtgtgtttatgtaatatatatttttac

SEQ ID NO: 15213 - DNA, 610 bp, Zea mays
taattttttttgttgtgggtggtgttgggcagatttgagatcgagcgaagctaagcttttcatcaagatggcgcttgtaagtgtttattcaattagtagttgtttaagtagcctctatctcttacttttttatatgctagaggtgtgtttaagttgattgcattggtgagattattttattgtagtttcgacttgtggtgtggcatgtcatgatggcctcaaatcatcagtgttacaggtggcccccacaagcgaggggtctgcttcaacttcttgacagagacagatcggaggctttcttggcaatggaaagttttgttggtagtagtattagctttatagggggacatgtcattagggttgatcttgtgcttttgaggccttgcttacaggcacggtactactgaaatagttagcaaaagatggcaatactgatgtaatccagaatgtagcagtacatatcaactgccgtcttagtttcagttcatgaagtgaataatgcataccaaactatgtcccagttcaaagcatctagaacagtgaagtattatgtctgtcgcgttttctcattctgataattcatatcaactgcttgtgatgctttgccatt

SEQ ID NO: 15214 - DNA, 1980 bp, Zea mays
tggcggcttccggcgtcaccggtgtgccgaaaatggcgtggtggtgataggttgtcgcaccttgcacgccgagcggattgaggaatgatggaatgacggcactagtgccaccgctggcgccactatcgacggcgccgacagccgcctgcaggttattcctctcggacggcgacgggagggacgtgccgccgccgtcagtggtgtctctgttgtacccatggaacctctttgccggcggaagaatcgtgagtgccgacgcgtcgagccagttgaacggggtggtggaggacgggacgaggagctgcttggtggtgtctgttggagcagctgccctggctgccgcggctagctggctcagggagctgccgcccgcgtcctctgctgtgagcagcccatccaccaggaagctgtcctcgtgatggtggtggatcagcgaagtgtaattgccggtatggtaagcccctccttccgcctgcgactgcgacggcccatggcagcagccgcggcatgcgtcgggtaggctgccaccgcattctccacggagtcctcgccgcactccatgatccgcggcggatcgccgactccaagtttgtcgatcttcttgtagatgcggcataacacccagtcgtcgagcctgagagacgtggccttgcctccggcgttgcaaggcggcggcggccggctggtggttgagctcgccgcatccgcgaggcggtactcgtgcatgatccagttggtcttgaggccctttggcggcttcccgcggtagaacacgagagccttcttgacgccgaccttctcgcggttgccgccggacgccatgatgggcttgtctgtgccagtcgccttccagtagccggacgtcgtccgccctgttcggccgcgctccgttggggtacttgcggtccctcgggctgaagaagtaccactcctgctcgccgaatgtcgccttatcaggtagctcccacggatcgaacttgtaaaggtcgacctccgcgatgatggcgacggggagtggcacggacgcggccttcttcttgaggtagtggacgaccagctcctcgtccgtgggatggaaccggaagcccggcgggagatccggcgccgagctcggctgcttctgcggcggtagctcaccggacgacgagtccgtgctctccatggacctcatcaccgcgtagtactacgacgccggctggccggccccgcgggacgatggatccctgcagtttggcagagccgcctctagtagcgtgaaggagagcagacagcgaagaggatagccggggtttttgttacgctgtcggttgggagaggatctgctggagcaggcggccggcgagtgatctgcgctgggattttttgtggtttcgtccgggggccccccctgaaatcgtagcgatcgaggagagccggccggagacggaggcgcaggcgggcaggggaagagtgggaggtgccgaaggcattgccccgagaaatatggctccgttgcaccgaacccagagccccgggcccgtcgtccgtcgacacgtaccccgccgccgcccgtaccgcgtgtcagctcgccaacggccgcgcccttgaacccgctcgcgcgccgtggccgcgattccgtgaagccttcgcccggtcgccgcccatggccctccatgcgctcgcgggctggaacagtgatcctttcgtggcctcgtttcgggccgcgttcgtaaacaaatggggccggtttcttctcagttagcccgtccagaggcgctaccgtggcccacgtgctgtcatggatctgggagcccagtaccagactgctagcatatagtagaaaattagaaattgtctgaagtgagttagcccccgtcttctcttttttttcccctaaactaaagaacagagagagataggagtaaacttttgccagattcttcgaatgttcctgcgctgaatttcaaattttgagctcgcttcgtacggcgtccagtccag

SEQ ID NO: 15215 - DNA, 1977 bp, Zea mays
tggggactgatagtaacttggcttcactctatgtttggttttgtatcgcgacaaaactttgtgccccatttctgtgagagcctacttatagttatagcccacggctgaccttggagcaataaccagtgaatcttcaaaaatctgtgtctgacgcttctgtaaccttcgaatctcagaccacactggatataatcaataatttttatgtttgatacttacataacacttccaaactctatccatattggatgatagcttgcagcttccatttgtagagatgaaatttgtcatttgtcaatacttggaagctgactaaatccagaggaaaaaaatcctaatcgctgttatcaatgtactggcatataatatcatgttaccttttgctctactcaactgtgatatttttgagcactgcaatgttaatgtgatatcatttttttcatggtggaagtatctctgttaacttatctatgtgtaaacttgtgaacctggcatctatactttttagtcttcacagctatttgccatgttatgtgcacaactatcacaggagataatgaaacatattcatatctttctcttctcgtttaggaaactctttctgattctggagaagttcatagttgctgcttactacctgaagcgcgtccatatgatggatttggttgcctggcaaatattgtctctatgctggtaaaaactttttttgtttggcgaaaactatatcattgtttcactctgctcacttcagttttatgtttagctagtattgtctcatatgtggcctgtgcatttctggcggaccagtatgagtatcaggttaccaaaacttatatcttttgtcatccttttcaggttggtttccttgatttctgcagcgactatgtcaaacactcagctggcaacatcctcatttccgtatctagtaccctaattaagtttgtacgcttctcatatgcttcccttttcctcttttggtgcattcagtttcattttctgtctactaactgttgactccacggctgttgctctattcctaggaatccatttggattcagttcattgagcttgcctggggggctatacatgcagcatcaaaatgtgttcataacacttcacgttctacaaccgactccaacagtgatgacagcactagttcaggcacaagaatcacaagcttcatgacagcacttagtgagcatcgtcttaataccagtgggcaaaccatgtccagtctctttcgagtattgcatgctatcctgaagttccttaaacagagtgacagtgacttgaaagacgacttcatttgtctatccattcatcaaattcataagatgccttggaatttgttccatcaattacatgctggaggacttgccagctgtgccaaggatagcagaattagcaccagtaatgattccgcacagtctggaattctgactggcagtcttctccagctgttgggctctttacttgaccaaagttacctgagagacacagacggacaagatatgtttgtgaaacttgtggatgtagttcccaagatagcattgttgtccttaggaggacagcatgatggatccaaaagtctttatcagtacttaaagcacaaaattctgatgggcttggtcccgcggagccctttcgtgcagcaagattgttcgcatattgttagttggctgaaattgcttcgacgttactttggagaccttcttcatcagcctatctcacaacatattgctaaaccagaaaattgtttagaaggttctccgtttttattggacatggtagatttagttgagagtcaggataagtcaactcggcacttgcaaaggcaaactatctatttgttccttagttgttccatatgtttgtcttacaacagaaatgatggtgcacttcagtgttcatgcaagcgtgatgagtgtttgttgggtcacaaagtacaaggctgtagtaatcaattgcactgttttg

SEQ ID NO: 15216 - DNA, 1416 bp, Zea mays
gcccgggcagaactctacactaagtcgtagttatggcgttcgagagctacggctacctcaccaagagcggcgtcatgtcgtcgtccccgaccagcacgctggtctcgcccccgaggtcgccgccgtcggagtccccgccaatgtcgccggacgccgccgccgcagcgctccgccgcggcgcgtggccgggtgtcggcggctcgcccgtcaacgaggtcctcgcctcgctgcgccagctccgcctcagcggcggcggcggcggcggctcgccgaggtcggcgccttccggcgggtcgttcttggcaggcggctacccgttcgggtccccgaagtcgccggccggtctgtacagtctcccgtccacaccaccaaccaggccgtgcccggtgatggtgaccaccgcctccggcgccaccatcatgaccgtggaacgcctcaacctcgggctcctcgtggatgaggagccggtcatggagcgggttgagtccgggagagccctccgcgagaaggtgttcgaacggctcagcaaagaaaccgccgtgcccaacgacaccgctgcctccgtcaacgtagagggagcggctccggacgtcggctgggtctccgacctcatcaactgagggaaagttctgaaactatcctctgaacggtgcttatccatggtaagtgcgtgagggaagcttattagaggcgccactgctacacagcagcaggaggagaaagtttgtgggaaaaacaaaaaaaaaaaaatatttttctagatttgtactaagatgatccttgtacatattttcctccatgtgtgaatattcccggatggctgttggagggaggggaggcagggaaaggttgatttgttgtggggtttcagatgatggcatgccagtggggaggtagaagggatggccagtaaaacacaaaaggatcaaaggagacatggtatgcgaccagaccatgcatgaggtgtctagatgtacatagcgtctgtgtagtgtacctgtgtgttgtgtgtgtgtggaggtagagcgtggagaggcgaccatgtcggcgatccaagactggaagtaaagatgactggatttttttctatggccgcactgcaccggcggcggctcccggtgacgtttccggcaagaaggcctggagcggttccagaacaacatcatcgtctcgactctcgagtacttgtcattccaccgttcattctgttatttattatctggtattactgctctgtaattttctcaatgtatttccttattgatctcgtctgctctagctaggggccgggagcatctatgtaccttgcactactatgtgctactgtttctgctgataaggaaataattaagaccggccttgttaaaaaaaaaaaaaaaaaaaaaaaaacctcgagagttcgcctcgtgcccaatt

SEQ ID NO: 15217 - DNA, 982 bp, Zea mays
gaatgttctctcgcactatctacgccgcccgcggcgccggcccccgctctctaccctggtaatgttgttaaccgaactgtggttccacaacttggactggcaaggaagtttggtggtggaggtacaaatggccagcagtctggcccatttgataggccgagggaactttggaccaggccaccgcatgaaacacctgaccaaatgaacttggatcagtttgagactagaagaccttcagcgcctgtagatgctgctaagcttgggtctggtggaggggaggttcgcaaaactagctgcagactttttggtttctccttgactgaaaagatcttgccagcagatgatgatgacgtcaaggaagtgagctatgagacggagtgccagaacccacggatgctggacctgttcgggtacaactgctcaaccccgagtgctgctcttccagctctgtgtgctgccgccccctttggaatgtgatgctgcttcgaatctttcgataactttgctccatgtactcttagaagttttacatcattccctctggtctgcttataagctgctttttgacatcattccctctggtctgcctcaagttaagcagtcatttgcacaagtaaacgaaggttcgttggtgaaccactcctcgacatgcctcaccctgtcacccaaactattgtggttagtctcaggatacccagagacaccacattgtaacttacgtcgatgatccttcagaactgttgtgcgatgaagctaaccatttgctctaaaagtactttgcttgctctaaaagtaccggctatgtatatttaaatcagcacctgtatgagtttttttagccctcacaagccctggttgcagtcgactaggccgtgtgattgtattagtgtgctatctttttaaactgtcgcttatgagtctttattctagtgcattgtgtgaatactctgttcatcgcatgcaagtcttgtcttctgtttct

SEQ ID NO: 15218 - DNA, 2581 bp, Zea mays
  misc_feature (10)..(10): n is a, c, g, or t
  misc_feature (2523)..(2523): n is a, c, g, or t
cgcctctggnttataatcagctcaggccttctcaaaagctggttgccaaggatttgcatggagccaagtggaagtttcgtcatatatatgcggggccgcccccgaggcaccccgggactactggatggagttcatttgtcaataaaaagaaactggtttcaggggatgctgtgttatttctccgaggtgatgacggtgaactaaggctgggtgtgcggagggctattcagcttaaaaatgaggccctttttgaagatttcaatagtgacagcacaaagcggcattctttgacggctgtagctgattccttgaagaacagaagtgtttttcacatttcttacaatccaagagctactgcttcagaatatattattccatacgctaagttcctgaagagcctcaatcatccggtctgtattggagcaaggatcaactttcagtgccataatgaagatgttagtgaaaggcgatctggagtggttgttcgcattagtgaaatagatcccatgaaatggcctggctcgaagtggagaagcctgctggtaagatgggaggacggtgctgaatgtaatggccaagatagagtatctccatgggaaatcgagatagctggtggttctgtctctgtttctcattccctttctgcatctagttctaaaagaaccaagttgtgtcctcagggaaatttggacgttccagcaatgtggaatggttgtactggctccatggaaactggaaagttacccagggtcttgcaaggtcaagaattggtgagttttaggacttgtcatgttccgtgtgctcctcaaactgctgaggctgcaaaacttcaatcttctgatgctagtaggttccttagtaatgcacatggctgcgcattgggtggtccaacaagcagactcgcagtgcatagctctggttttacctaccaatgtgtaggcttcaatgaatctattggattctcagaggtcttgcaaggtcaagaaatttctcgggcggttcctaagttccaaggaatgatgtcggaagcttgttcactgaaagacagatatgggctgcatagttatatgcgtgccccagttgctgttaatggattatcagctacaactcaagaatgttctctcgcactatctactccgccaggagcacaagtgccctctctctaccctggtaatgttgttaaccgaactgtggttccacaacttggactggcaaggaagtttggtggtggaggtacaaatggccagcagtctggcccatttgataggccgagggaactttggaccaggccaccgcatgaaacacctgaccaaatgaacttggatcagtttgagactagaagaccttcagcgcctgtagatgctgctaagcttgggtctggtggaggggaggttcgcaaaactagctgcagactttttggtttctccttgactgaaaagatcttgccagcagatgatgatgacgtcaaggaagtgagctatgagactgagtgccagaacccacggatgctggacctgttcgggtacaactgctcaacaccgagtgccgctcttccagctctgtgtgctgccgccccctttggaatgtgatgctgcttcgaatctttcgataactttgctccatgtactcttagaagttttactttcccagtaccccagtgtagtcataagctgcttttgacatcattccctttggtctgcctcaagttaagcagtcatttgcacaagtaaacgaaggttcgttggtgaaccactcctcgacatgcctcaccctgtcacccaaactattgtggttagtctcaggatacccagagacaccacattgtaacttatgtcgatgatccttcagaactgttgtgcgatgaagctaacaatttgctctaaaagtactttgcttgctctaaaagtaccggctatgtatatttaaatcagcacctgtatgagtttttttagccctcacaagccctggttgcagtcgactaggccgtgtgattgtattagtatgctatctttttaaactgtcgcttatgagtctttattctagtgcattgtgtgaatactctgttcatcgcatgcaagtcttgtcttctgtttctgttggcttggtaggagatactctgattttataacatgtcagatttttattggtcaattcaactttgaccatcaatatacaaggaatttggtgaatacttgagggccttgttgaggactactttgttgaagaaccattatatcctgagggctagtttaaaaacttaaatcttctcctgaacatagggtattaaggcggaaattatttcattttccccttaacccctcgaatcctgaggaatttaagtttccaaactaatcttgattgtatgttctgtacaggattttgtattaataagcacctctttaatttaataagttttcaaactaatcttgattgtatgttctgtactggatttcgtattaataagcacctctcttgtacgtactctgatgtacttgagctgtggtctccctgtttcacttatangacatgttgtgttccctgtttcacttataggacaggttgtgttagtcggttaggtttt

SEQ ID NO: 15219 - DNA, 1835 bp, Zea mays
taaaagaaccaagttgtgtcctcagggaaatttggacgttccaacaatgtgtaagccctcatagcacaacactaatgcctgtacatatgtatgctatcctttaacctctgctaattgactgttccattagatgttacagggaatgggaatggttgtactgactccgtggaaactggaaagtttcccagggtcttgcaaggtcaagatttgatgagttttaggactcgtcatgttccgtctgctcctcaaactgttgaggctgcaaaacttcaatcttctggtgctagtaggttcctcagtaatgcacgtggctgcgcattgggtggtccaacaagcagactcgcagtgcataactctgattttacctaccaatctgtaggcttcaatgaatcgattggattctcagaggtcttgcaaggtcaagaaatttctcgggcagttcctatgttccaaggaatgatgtctgaggcttgttcactaaaaggaggatatgggctgcatagttatatgcgtaccccagttgctgttactggattgtcagccacaactcaagagtgttctctcacactatctactccgccaggagcacaagttccttctgtctaccctgataatatttttaaccgaactgtggttcgacagcttggactggcaagcaagtttgatggtggagctacaaatgcccagcagtctgtcccatttgataggccgagggaaatttggagcaagccacagcatgaaatatctgatcaaacgaaaatggatcactttgagactagaagagcttcagcacctggagatgatgctgctaagcatgggtctggtggagaggtggttcgcaaaactagctgcagactttttggtttctcgttgactgagaagatcttgccagcagatgatgatggcatcaaggaagtgacctatgagcctgagtgccagaatccacggatgctggacctgttcgggtacaactgctcagccccaagtgctgctcttccagctctgtgtgctgccccctttggaatgtgatgctacttcaataacgctgctgagtatttccatgtactcttagaagttttactttcctaatacccaagtgtatgtcataagctgccttttgacatcattccccctgttggtctgcctcaagcgaagcagtcatttgcacaagtaaacaaaggatcgttgatgatccacttctcgccatgcctcaccctatcgctaagatattgtaattagtcttaggatacgaagaggcagtacattgtaactgactaacttctgtggctgatccttcagaaaagttgtgcgatgaagcaaacaattttctttagaagttcttcgctggcagattttagattcatgtggggaggtttgtcagctcagctttaatgtactggttatgtatctttaaatcagctgctgtacgacttttttttagctccaagccctggttgcagtcgcctaggccgtgtgattgtatcagtatgtaagacatgctatattttaatattcttatcgatatttattctgatgcattgtgtgtgaatattctgttcttcatcgcatgcaatgcaagtcatgtcttctgttggcttggtaggagatgctctgattttgtaaacatgtcattctagatttttattagtcaattcaactttgaccatcaatgtacagggaatttgacagaggattatgaagttgagattttggaaatacactcgacggatggtcgcatggtcccgaggtgtcacgagagggttatagctgcacggaatgttcgcggctcatttggtttgtggtatatttggtttggatcgacttgtttgaatttt

SEQ ID NO: 15220 - DNA, 1335 bp, Zea mays
gtatagccagcggttgacctggcttcttcacatacactattatacgtacattgatatatacgaaccgtcctggttcttgcaccaccgccgcaccgattcgcgcgaaagcgaactccgtgccttagggccgaatcatcaccgtcgtccgatcgatccgggaccgggactcgggaagcatgttgttaaatggcgacagcaggcgggccgcggcgacagcagcagcgctgctggctctcgccgcctgcttctgcgcagctactggagacggggatatggcgggcctgcggccgctcgtcctcgtggttgaccagtccggcaagggcgaccacaggaggattcaggacgccatcgatgcggcgccggcgagcaaccgctccgccggcggccgcggcagcgtcgtcatccggatcaagcccggagtgtacagagagaaagtggtggtggacaagccttgcataactctcgtcggcgcgaccgccgccagctcgaccgtcgtcatcacctggaacgagtcctgggtcgccgccgacagcccgacagtctccgtgctggcctccgacttcgtcgcgaagcgcatagcgttccagaacacgttcgggactagcgggccggcggtcgccgtgagggtggccggagacagggcggcgttctacgggtgcaggttcacgtcgttccaggacacgctcctggacgacacgggtcgccactactaccgtggctgctacgtccagggaggcaccgacttcgtcttcggcaatggcaaggctctgttcgataagtgccacctccactccgtctcgccggccggcggcgcgttcacggcgcacagacggtcgtcggagtcggaggacactgggttcagcttcgtcgggtgcaagctgacggggctcggggccggcacgtccgtcctcgggagaccctggggtccctactcccgcgtcgtctttgcgctcagctacatgtccggcacggtgaggccccagggctggggacgactgggagcgactcctccagacagagcaggagcaggacagcgttctacgggcagtaccagtgctacggggaaggctccagaactgacgggagagttgcgtggtctcacgacctgtcgcaggctgaagccgcgccgttcatcaccaaagtttgggtcgggggacaggagtggcttcggtaggaaacactagctagctgtgtgtgctctgtttggttcgtcaacagtgacgctgggaataataagctagagctgcagacgcgttatggccggttggtgccgagaatacgcttgccctgaaaaaggcgagcaatgcaagcaatgaaataaaaaaaaaaaaaaaa

SEQ ID NO: 15221 - DNA, 2335 bp, Zea mays
gctggaatccagactctgaatctttccaagctactggtgccccccgtccgccctgcgcccgcccagccgcccagtgtgagtgccagcaacttctgtgtgaaattttgcgggcaactccagaagctgctactgctgacgcagctgtccagacagctaggcttgcaaataaggatccagtgaaggaaaagagggatggatcagaaggcctttcttttgccttccgcattactgatgcagcaaccccagcgtcaaatgaaggtcaaggatggcgaagaaattccaatgtgcctcaagaagggtatggaacagcaagtgtcatacctgaccaaggaattttcctagccgcgtctgtttaccgtcctgtttttgagtttatgaataaaatagggttgatgttgcctcagaagtactcacaacttgggagtgatggcttattggcttttgtgaataactttctgaaggagcacttcttgccagcaatatttgtagattaccgaaaatgcgttcagcaggccatatctagcccagcagcatttagaccacgtgtacatgcaacatcagcatatagttcatcggtggaacttggacgccctgtgcttcaagggcttctcgccattgatataatagccaaagaggttcttggatgggttcaattgatgccaaactatgcgactgagcttgtggagtatgtacgcacatttttagaacgtgctcatgagagatgtcgtgcatcatatatggaggctgtccttgaaaagcaaagttatattctcctttcaaggaatgacattgagagtttaatgcgcctggaaccagcaaacatttctttgcaaaattctactggtgaacatgataacaatgcaacaggtgcagaggcagtcgaagtagagattgaactaagtgatctcttattagatatgtgcccaataaaacaggaaaacttgatccatgacgaccagaaactgatattgttggcttctcttagtgactcattggaatatttagcagattcagttgaaaggcttggggaatcattcataagtccaccaaccacttcagagagcataaatcatagccatggtcgacatgcccgctcatctagtgcaattccaaaaagtctcgcgtctctggctaatgagtacagaaggttagctgttgattgtgtcagagtattgagattggaaatgcagctagaggcgatataccacatgcaggaaatgaccaaaagagaatacgtcgaagatcaagatgctgaagatcctgatgactttattatctcccttacaactcagattgcacgacgggatgaagaaatggctccttatatcacggaatcagaaaggaattacatatttggtgggatttccagtgttgctgctaatgcatcaataaaggcacttgctcaaatgaagtcaataaacttgttaggagtccagcaaatatgcaggaattcgatagctctggaacaggctcttgcagccataccttcaatagatagtgaagcagtccaacagcgattggatcgcgttcgaacgttctatgagttgttaaatttgccttttgagtctttgcttggattcatcgcagaacatgaatatttgttttctgctaaagaatacctgagtgttctaaaggtcaatgtgccgggtagagaaatacctgcggatgctgaacgacgcatctcacagattttgggtcactagatctaatcagacacaatggtgctatttttgactggttatgccttatgtgggctttggctaccaaatggttctccacctgtttccatggcggtgtttgtgtagatttagctggtttttgctatttagtaattttgtttccttttgtatttcacgtgatatattcttttgtatgtcttatcagttatcattgattgtaaatttgtagtgttccggataaaattttcattattgattattgtaaatgtgttatctgtctggatgcgatatttaataagctcatcagattcagtgtcctgtatggtgcacagacgagttgccagtcatgaacttttcagtcttgtaaaattgggaaatttattgggaatggttgaacaagtggaacgccataaaaatgtgacagtgaagtatgcactacactatgatgtttggtttacgaaatgtaaggtaaatagcaatagtaataattcacatccgagtatcagtggtaataagtttgtatagtccggtatcaatttctagtgtggtatctgattatggttggatttaaataaatatgatttaacgttaaaaaaaaaaaggtcgagagtaatgtgtcggatgtattgtgttgagttgggtaaaaatgaaggggg

SEQ ID NO: 15222 - DNA, 1346 bp, Zea mays
tagaacatcctaatcgaaaaaggcgggcccaaggtcgtgactaggcacagtcgcacagaccactagaccagcacacggccacagtaccacacagaacagtagcaccgggctccgggcaccagggcaggcgaattcctaggttcgctggagcctggagcgagggatggccgccgcctcgctcgcgttggcgagtcctttccggcttctcctccgcgcccctcacccgcgcggagccatccccgtcccgtgctactttatctcgcgaggacggtatagcaccgccattgccgtcgcagcagcgagggattcggcggtgaaaggaagcgtggacaggaattcagcggaggaagtcaggaacattctgaatatggcagaaagggcttcccaacgaagagatgtttttcacaccaattttcttactccacctatagtgaaagagactatgctggcacttgaaaagtttgcagataccaaagcagtagctcagggtggctaccctcaggctgagaggtgccgaatatctgttgggcacccggacgtcatgacaagtaacccagatgtggttgctgctttgagcatctcagggaatttccggttggaatcttgttctcatggtgactttcttggtgctattcttgggacaggaataacaagggagaaagttggagatattcttttgcagggggaacgaggtgcccaggtccttgttgacccagaacttgttgactatctgatttctacccttgaaaaggtggggaaagttggtgtttcatgcactcagattcctttgcttgctctagaatatgaaccaccaaggaccaattcatttaaaactgtagaatcatcgctcagggttgatgcccttgccagtgcaggatttaaaatctcacgcacgaagcttgctagcttgataagttctggtgatgttcgtgtgaattggacaccaacaacaaaaaatggagttaccctcaaatctggagatgttgtttctgttagtgggatgggaaggttaaagattggggaaattgtgactacgaggaaaggaaaatatgcggttgagttgattcgctatttgtaatcatggaactggtctactttcatgtctgaaactctgaatttaacggtacacattttctcctatatgtgatgagaatcatgtattaagtattacttctcagtgaagttgaaagtgatgcacaaatctgagtatatttgtagtattcattgactgctttagcttcgtaatgcaaatattcttataggtcaagaatttcataaagtcgtcagtgtacattcattatttcaaataataagccccaaagggccaggttgctttggatcttccc

SEQ ID NO: 15223 - DNA, 3788 bp, Zea mays
  misc_feature (3220)..(3220): n is a, c, g, or t
  misc_feature (3222)..(3222): n is a, c, g, or t
  misc_feature (3229)..(3230): n is a, c, g, or t
  misc_feature (3246)..(3246): n is a, c, g, or t
  misc_feature (3250)..(3251): n is a, c, g, or t
  misc_feature (3253)..(3253): n is a, c, g, or t
  misc_feature (3263)..(3263): n is a, c, g, or t
  misc_feature (3266)..(3266): n is a, c, g, or t
  misc_feature (3275)..(3275): n is a, c, g, or t
  misc_feature (3286)..(3286): n is a, c, g, or t
  misc_feature (3291)..(3291): n is a, c, g, or t
  misc_feature (3294)..(3295): n is a, c, g, or t
  misc_feature (3299)..(3299): n is a, c, g, or t
  misc_feature (3304)..(3305): n is a, c, g, or t
  misc_feature (3308)..(3309): n is a, c, g, or t
  misc_feature (3314)..(3314): n is a, c, g, or t
  misc_feature (3317)..(3319): n is a, c, g, or t
  misc_feature (3321)..(3322): n is a, c, g, or t
  misc_feature (3327)..(3327): n is a, c, g, or t
  misc_feature (3332)..(3334): n is a, c, g, or t
  misc_feature (3336)..(3336): n is a, c, g, or t
  misc_feature (3339)..(3341): n is a, c, g, or t
  misc_feature (3343)..(3344): n is a, c, g, or t
  misc_feature (3347)..(3347): n is a, c, g, or t
  misc_feature (3353)..(3353): n is a, c, g, or t
  misc_feature (3355)..(3355): n is a, c, g, or t
  misc_feature (3357)..(3357): n is a, c, g, or t
  misc_feature (3367)..(3367): n is a, c, g, or t
  misc_feature (3375)..(3376): n is a, c, g, or t
  misc_feature (3378)..(3379): n is a, c, g, or t
  misc_feature (3381)..(3381): n is a, c, g, or t
  misc_feature (3384)..(3384): n is a, c, g, or t
  misc_feature (3390)..(3390): n is a, c, g, or t
  misc_feature (3392)..(3393): n is a, c, g, or t
  misc_feature (3395)..(3395): n is a, c, g, or t
  misc_feature (3401)..(3401): n is a, c, g, or t
  misc_feature (3420)..(3420): n is a, c, g, or t
  misc_feature (3430)..(3436): n is a, c, g, or t
  misc_feature (3438)..(3439): n is a, c, g, or t
  misc_feature (3445)..(3453): n is a, c, g, or t
  misc_feature (3455)..(3458): n is a, c, g, or t
  misc_feature (3460)..(3460): n is a, c, g, or t
  misc_feature (3464)..(3464): n is a, c, g, or t
  misc_feature (3467)..(3467): n is a, c, g, or t
  misc_feature (3475)..(3475): n is a, c, g, or t
  misc_feature (3478)..(3478): n is a, c, g, or t
  misc_feature (3492)..(3493): n is a, c, g, or t
  misc_feature (3497)..(3497): n is a, c, g, or t
  misc_feature (3499)..(3500): n is a, c, g, or t
  misc_feature (3504)..(3504): n is a, c, g, or t
  misc_feature (3513)..(3513): n is a, c, g, or t
  misc_feature (3519)..(3519): n is a, c, g, or t
  misc_feature (3521)..(3521): n is a, c, g, or t
  misc_feature (3524)..(3524): n is a, c, g, or t
  misc_feature (3526)..(3526): n is a, c, g, or t
  misc_feature (3531)..(3531): n is a, c, g, or t
  misc_feature (3534)..(3534): n is a, c, g, or t
  misc_feature (3537)..(3537): n is a, c, g, or t
  misc_feature (3542)..(3542): n is a, c, g, or t
  misc_feature (3547)..(3547): n is a, c, g, or t
  misc_feature (3551)..(3552): n is a, c, g, or t
  misc_feature (3554)..(3554): n is a, c, g, or t
  misc_feature (3560)..(3561): n is a, c, g, or t
  misc_feature (3566)..(3566): n is a, c, g, or t
  misc_feature (3571)..(3573): n is a, c, g, or t
  misc_feature (3575)..(3575): n is a, c, g, or t
  misc_feature (3577)..(3577): n is a, c, g, or t
  misc_feature (3579)..(3579): n is a, c, g, or t
  misc_feature (3581)..(3581): n is a, c, g, or t
  misc_feature (3583)..(3583): n is a, c, g, or t
  misc_feature (3589)..(3591): n is a, c, g, or t
  misc_feature (3593)..(3594): n is a, c, g, or t
  misc_feature (3597)..(3597): n is a, c, g, or t
  misc_feature (3600)..(3601): n is a, c, g, or t
  misc_feature (3606)..(3606): n is a, c, g, or t
  misc_feature (3608)..(3608): n is a, c, g, or t
  misc_feature (3614)..(3614): n is a, c, g, or t
  misc_feature (3616)..(3616): n is a, c, g, or t
  misc_feature (3622)..(3622): n is a, c, g, or t
  misc_feature (3626)..(3626): n is a, c, g, or t
  misc_feature (3631)..(3631): n is a, c, g, or t
  misc_feature (3633)..(3634): n is a, c, g, or t
  misc_feature (3648)..(3648): n is a, c, g, or t
  misc_feature (3650)..(3651): n is a, c, g, or t
  misc_feature (3664)..(3664): n is a, c, g, or t
  misc_feature (3683)..(3683): n is a, c, g, or t
  misc_feature (3689)..(3689): n is a, c, g, or t
  misc_feature (3691)..(3693): n is a, c, g, or t
  misc_feature (3696)..(3696): n is a, c, g, or t
  misc_feature (3702)..(3702): n is a, c, g, or t
  misc_feature (3707)..(3707): n is a, c, g, or t
  misc_feature (3709)..(3709): n is a, c, g, or t
  misc_feature (3715)..(3715): n is a, c, g, or t
  misc_feature (3724)..(3724): n is a, c, g, or t
  misc_feature (3726)..(3726): n is a, c, g, or t
  misc_feature (3728)..(3731): n is a, c, g, or t
  misc_feature (3738)..(3738): n is a, c, g, or t
  misc_feature (3742)..(3743): n is a, c, g, or t
  misc_feature (3753)..(3753): n is a, c, g, or t
  misc_feature (3756)..(3756): n is a, c, g, or t
  misc_feature (3764)..(3764): n is a, c, g, or t
  misc_feature (3766)..(3766): n is a, c, g, or t
  misc_feature (3769)..(3772): n is a, c, g, or t
  misc_feature (3777)..(3777): n is a, c, g, or t
  misc_feature (3782)..(3782): n is a, c, g, or t
  misc_feature (3784)..(3784): n is a, c, g, or t
agcgactcgtttctcgtctctgcgctgcgagcgaggctcctgctcctcgcggtctcgcttccctccaagttccaatccagcaccgggcgccaccgctaatcagtgctgatatatgaaccccgcatttggacatttggtggtggcaaggcaacgccaaccttccctgttgctgctttgaatgttctggtggttgtcggatggatcgccgcagttggctctggaagcgcaagtcattggataagagccctggggagagcgatagctctggctctgcttcatcacactctgagccttccttcgatgatcaggaacctaaacctgtgtctagtaattcttctccaaatcatagtcattcgcctgatgtttcttctagaataatttataatgagaatcaagaagctgaaagagcagaatcattgaatgagaagctggtgttagcaactagctcgaatgattcttctccacaacatgatcaatcgatgaagccagatatataccaatcacctctgctattcccaaatatcaggaatgatgatgttccagattctgtaaagaatttgaatgagaaggtgtccccaaagtttaaggtcgatgatgtccaggattctgtaaagagtttgaatgagaaactttctgctgcccttttgactatcaatgataaagatgacttggtaaagcagcacactagagttgcagaagaggctgttgcaggttgggaacaagctgaagctgaagttgcttctctgaagcaactacttgaaactgcatcaaagaagaatacctctctggaggatcaggtcagccacctagatgacgcccttaaagaatgtgtaaggcagcttcgccaagcacgtgaagaacaagagaataaaatccatgagacagttgctaagaagtctaaagaattggagtctgagaagtttgagctccagcaccatattgctgaactcagtaagcagttgcaagccacgaaactagaagctactacggtgcgtgtccagcgtgatctgcaggaaaagcttcagatagtggagaaagaaaacaaagacctcaaggtagaattactcgcactgtccaaggacctgaagatacttgcacgggaaagagacctgagcaaccaagcagcagaaacagcaagcaaacttcacctggaaagtgtgaaaaagataacaagagttgaggcagaatgccttaagttgcgtcatttaacgcggcgtacgtccttgaccaatgattcaaggctgataactaacagtgcttgcatggaatctcagactgacagtcagtctgacagtggggagcacatgctagttgatgagatgaaaaattctgattcatgggcaacagctctgatagctgaacttgatcagttcaagaatgccaacaacgacacaagaaatcttgtgaataattcggttgaaattgacctgatggatgatttcctcgagatggaaaagctggctgcactgcctgaagtagactgtgtaagctctagctttggagctgaaactgattctgaccaaggtgtgagtagagataaatcatcaaaagttaaaactgaaccattgcagtgtcaggtgacagatttgcacgcaaagatcgagaagattgaaggtgagaaaagggagcttgaaatggcccttgcagatgccagagttcagcttggcacatcatgtgatgctctaatggtggccaacaacaggttgattgatttgcagatgcagttggacttggcaaatgagtccaaacatgctgctttcggagaagctgagcgactgaatggtgagaggaaagatttggcattgcaactggagtccaggtcttcacaagttgatgagcttcagctgatggtggcatcgctggaaaagaatgtagacaggaaggtgttggaattgcagttagagttagtttctgtggaggctgcagatctgcgcaagacagtggcttccctggaagagaagattgatgcagagataactctctctatgcagcacaaaacaaatgcagacctggcagaggcgtccaaagaatcattagaggcgcagctgcagtctgcaaacacagagatagggaaactgaacgggattgtgcaaactttagagaatgaggtgaggaaagagacagattctcgtgaagaactactgaaacagatagaggctatgaaaattgagtcagagagatcactatctgtggtgtctaccaaagagtcattagaggtgcagctccaggtggcgaattcagaagttgcaaagttgcgtgggatggtgaatgctctggagtgtgatgcggcgaacgagaaggcatattcttcagatctccagatgcaacttgaggcagtggaaggtatcaggaaggtgttggaatctgagcttgagtcttcacaccaggaggtgatgaggctgaaggagaaagtttcgtccttggaagcaaggatcaaggaccagacctcgttgcttgtagaatatacagctaaatcagaggatgcagtgtcccggaaaaaggcaatggagggtcaactagaagcagcaaatctggaagttacaaaactgagaaacaaggtgagcctgatacaaggcaaggtggagcaggagaagcttctgtcagaagagtacgaagcaaaatgccgcaagctggaggcgcaggtgttgagggacagccgagaggcgaaactttggcgcctcacgaactcaaacggagacctgaaggtgaagcaggagaaagaactagtcagtgctgccgggaagcttgcggagtgccagaagactattgctaaccttggccgccagctgaaatcgctaacagatcttgatggcgtggtggccgatcctgaaaagctggaatcgagggacacgcacctggacttcagagatggcggagacgtggctgatggactgtatgaactgggtcttcctaagaggaacggtagctgcctctcaccccttcggtcggatccgtcgccgaggggtttgccgtcccttagtagctacctgagcaaaacaaaaaggtgaaaagtctgatgggatcattcaccattgtgcttgtgcataaattatttgacagtctatggatgatgccagttgtgacctggtggtagatcggtgtacatttacagaacttgatggttgctcacatgtgtactttctccttttgttgtgctctcattttgcgagacaaaaaaaaaaaaaaaaaaaaaaaaaaaaaaaaaaaaggaaaaaaaagnanaaaaaannaaaaaaaaataaaaanaaannanaagaaaatanaanaaaatagtntaataaaaaanataantgnntggnatacnnatnntatantgnnnanngattntggtnnngntannntnnttnatatcntncnggggggggcngaacacanncnncncantatgtntnntntaatanatatacgcgtgggcggttntataaaatgnnnnnnngnnaaaatnnnnnnnnngnnnnanaatnagngtgtatanaanaaattatatatttnnaatntnnggtnaataaaaanataggncncantnttgtnttnacnataanattgntccnncnttatgnntgatntggannntntncncncntatatnnngnnaanaannggaananatgtgngnaaaaantgantattnanngacacagagcggananntgtgagcgcgttnatatatataaaataaaaanagtggntnnntgngtgtgnggtgnanacagtnaaaaaagtncncnnnnaaaaaanatannatattatacntgngtgagtgngnatnnnngtaanggcantnaatg

SEQ ID NO: 15224 - DNA, 2841 bp, Zea mays
gtaccctcgggttggccggggcgttcgagttcacgctaagcatcgtcatcgccccatcggtccgtcgttagtgcccctcgctccctcggaaaaccctctcctctcccctatcctctcgtctccccccaccccgccgcgatcaaccgagacccaccgccatggcgagcgacgacgaggaggcgtgcgactacttctacgacgacgacgacgacgccgaggaagacgccgccgccggactggaggaggactcttcgcttccaacgccggagggccgcgcggactactgggctatcacacaagataccgttttcgctgcacagaaacaagatctgtctacggtgatgaacttgctcaatataaatcaacatcaagcacgagccctcctcatccaccaccgatggagtatggatggcatctatgattctctagacatggggcgagaacgcatgctcagaaattcagggatcgtgctgcaggaggtcaacagcattgcagcagctggctcaatgacaccatggagaacagtgacctgcaaagtgtgttttgaggacttctccatggatgctgtttcgaccatggactgtgggcactgcttctgcaatgactgtaagtttccacattccacctcagagcttgtttggttaagggtggattgaggggactagaggagattaaatctcttcctattcaaagttgaatgaaaagggatttaatctccttcgatccatgtgcgatccatgtgcaaccgaaccgcgaacaaggcctctgtggtttacgttttcatatgtatagtatagatgccttaattaatatgagcttatttatttatttttggtgtgtgagtttctctatgaagtttcatctaccaaatatatattacaatccttgagtattcaaataaatgatcaaaagagatttcaaatagatgaatgatttgcttaccatagcttgactgctactgctactctctttttcctccaggttggacggagtatttccacgctgcggtagagagcgggaaaaagcaaattcggtgcatggaggtcaagtgctccgctttctgccatgaggacctcgtgcggtttctccttgtccaaaagtatccagacatggccaagaacttcaatcgcttcctgcttgggtcctaccttgaggacaatgcctctgtgaaggcgtgcccggccgcccccacctgcggccatgccattcgcgtgggcactgatgagcgctgctgtgaggtggaatgcccctgcggcttaagcttctgctttaactgcatggggcatgcgcactcgccttgcccgtgcaccatatgggagaaatggaatgccagccggtccgagggagagaacatacaagtggatcctcgctaacaccaagagctgccccaaatgcttcaaggccatcgagaagaacggcggctgcaaccttgtccgctgcaagtgcggacagtgtatgtggtatgcttttggagctcttacacttttatgcgatcgggcggcgggcatgtctataaactttctttgttttcggtgaaaaaaaaattggattgctgacctctttttttcgtggctcagttggctctgcggcggaggtaccggccaagatcacacgtggaacagcattaccggccacagctgcaaccgctacgaggaggagatctgtgtagagaccgtgcacaccggcaggcagcagatgcagcggtacaagcactaccacgaccggttcaagatccacggcgactcgtcgtacggcgtggagaagcagaagcttggggcggccatcgaggagcgggtgcggcttcttgagtcggaccgcgagcgcccgctcgccatccgcgacggcgactggctgacccgggcgcaccggcggctgctggtttctcggcaggtgctgtcgcggtcgtacgtgttcgcgtactacatgttcggcggcctcgagctgcggacgcgcccggccgagcgggcgaacctgggcgtggcgcgtaacctgttcgagcaccagcaggagcagctggagcggcacgtggagcacctgtccaggtcgctcgcggagtcggccgacctggcgggggctccggacgcggagatcgtgaagcagaagcagacggcgatcacgctcaccaagaccgtggagcggctgtgcggggagatgtacaagtgcatccaggacgagctgctgacgctgctcgtggagcccatgagcatcgcggcgtacaggccggacggccccgacagagcgaagcccgcgatctgatggggtggggccgtggggggctgtcttttttactcgctgccacattttgccattagggctaggcgtaggattttgatcgccttggtttgataaaaagctgcctgtcaggcagcaaccaacacgccatatacagcgtgaacgtgccgtgaaatgattttaggctgttagcacacaagggttaggtactgactgaaagttaaaaaaaggctggacatgtttatttttttaaaaaaagctgattcatccgtccatttgaactccattctttttttttggagaccacaagatgaatccttgtgtctggtagttcgcctctattgtcttgatcttagcttaaccgtttaagcttctgctttgaacttgatttgtatggtatccaccttttctaaattagaagcatcttaagtttggccaaattcatacaaaaatactaatattaatgatgcataataaatagggacacaaagacatgtgatataatagcttattgatggccaagcatgctaacattcaaatattttcgctaactcttctgctatagagttctcatggtacttttgaagtttgcccaaaccaatcattctc

SEQ ID NO: 15225 - DNA, 1396 bp, Zea mays
agcgatcctcaatctggtgtcccacggccgtccgatctcacattcactaccacctgtcccgtcctcccgtcccagtcaacaccaccgtcagttcagctgagcctgagcatggcgtcgccggcggccgtgctcgtcagcaatggcggtatctccccacacgctccaccttccgccgccgccttcctcgtctccactccgggcgcctacaccaccgcccccggaaccctcctctggtggacacgtcacctccgccgcctcgccgaatccgccacgctcctcgcccgttcccgccccaacctgctcggcctccccctcccccgatcgcgcgccctcgacctcgatttactatccatccattctctcgtgaacccctccgtgcgggtcgccatccgcgagatgcgcacaaggctgcccatgaccaaggacgaggatttggcgctcacggccctggtcaggggagccgatcccatttctggcggtggcggggctggcctcgacgtcttcgtccacgtggggacgtattccccgccgatctttggagaatcgggggccaggcttgccgcggccggcaggggaagggacgccgctgccgccaagtacgcgtcctgggccaggatccggaagagtttggaaaagatgaggcctcctggggtcactgagctcttgctgactaatgacggggatcacattcttgaaggcgctgttacaaacttctttgttgtctgccaacaggaggaatgcgagagcaacggaaaattctctaatcaaacaatggctactaagtttgaagtgcaaacagcaccactgagtgacggagttctccctgggattatgcgtcagatagtgatcgaggtgtgccatgatattggaatcccagtacgagaggtctctccatcgtggtccatgaatgaattctggaaggaagcctttgttacaagtagcttaaggtttatccagcatgtagagtcagttcaagtgcctttattttgggaggacatacaatctaaaacctggagtgatgtaccttgggcggtgaagaagtttcagggtgttggatgcattaccacacagattcagagggaattactgaagagagcaagaagtgatgagtacggcgttaacggtctcctttgactcgtgacccggcttgctggttcattgggggggacttcttttccaggcacttaattatttcatttctgctgggacgacactgttaagactgggtttcttgtgtgtataattcagacattttttgtctgctcagtgctgtgtcggccttctacaagctgcagatagatagccactgagcagtagcgaagcaattccatgcttgtttattactgtaattatgaggatggatcagatttagctacctgtcggagtcctttttttt

SEQ ID NO: 15226 - DNA, 826 bp, Zea mays
gtttggaaaagatgaggcctcctggggtcactgagctcttgctgactaatgacggggatcacattcttgaaggcgctgttacaaacttctttgttgtctgccaacaggaggaatgcgagagcaacggaaaattctctaatcaaacaatggctactaagtttgaagtgcaaacagcaccactgagtgacggagttctccctgggattatgcgtcagatagtgatcgaggtgtgccatgatattggaatcccagtacgagaggtctctccatcgtggtccatgaatgaattctggaaggaagcctttgttacaagtagcttaaggtttatccagcatgtagagtcagttcaagtgcctttattttgggaggacatacaatctaaaacctggagtgatgtaccttgggcggtgaagaagtttcagggtgttggatgcattaccacacagattcagagggaattactgaagagagcaagaagtgataagtacggcgttaacggtctcctttgagttatgatcattgttgttgattcatttgaagggacttcttttccaggcacttaattatttcatttctgctgggacgacactgttaagactgggtttcttgtgtgtataattcagacattttttgtctgctcagtgctgtgtcggccttctacaagctgcaggtagatagccactgggcagtagcgaagcaattccatgcttgtttattactgtaattatgaggatggatcagatttagctaactgtcggagtccttttttttacttgtacctgcaattaattgatctgatctgtttgccgggtaggtgttaaaaaaa

SEQ ID NO: 15227 - DNA, 1071 bp, Zea mays
tttcgaactgtcagatgctcagtacgtgcatgctctgtctgtagagcaccttgtgccaggattatcagatttaaaggctcagatttgctctactgacatgactgaagcatgtttctggaagatctactttgtgctcctcccctccgcgctctcttggcggggggctggggggctgtcgacgccacagatcctagaagcaagggagcagttgttgcaaagtttagggtctgagaaaaagcggggatccaagtttcccgacgagtcatccgccgagagctcgaacgcatcctccgctcctgctgaagagaaggtgattcaacctccagtcatccaagacaaagcagacgcttgggagaaatcatcgtccgaagaaccttctgaaaccgtgtccgagaaattcccagtctcaaccaccgaagtggaaatggtggacaagtcagtggttgaggaagagctgactgtggcaaatgagagcaagacctcaccggtgaagtccaagcttccctacgaggctgatgaagaggaggaagtcgacgagtggcccgatgacgatgacgaccccaccgatgaggctggccaggcggcgggtgacaggactttgctagggcgggaggaggaggacgtatcgttcagtgatctggaggacgacgaggacgatgataggaggtagaaggggatgatgggcagtagccaagttggctaggggaagctcgtactatggtcccggcgcaaccacatgctggcttcattggagtagggccgagaacgcactcacacccaaggatcaatgtttcgttagttattattattattagagtccggaagtaatgagtcccaagcagtagcaataagcatgtatgtatctgccgcgcgtgttagtgctaatggcaagtcctgctgcttctgtattattggccccgtcctgtagcttgtacatagagcgctcacggctgggttgggcctttgtgtaataaacctaccgtccgggaacttgagcttgtgtttaaaaggacctgttcattagggagggacctggggttccagttccaaaaaataaaaaaaaaaaaaaaa

SEQ ID NO: 15228 - DNA, 797 bp, Zea mays
ggcccgctcgaaaggccggcccgttcccgcggaaatgacacaccatctggcgatcagttacttaatgctagtaaagacttgcatggccttcatagtcaaatagatgcttcaactagtctacagtcagaccagaatgcaactgctgtgctgtatggtgtagacaacgagacaagcgcaacaataaagaccgagtcttgctactcgagtaatgctgattttgccttctgtgggaacactttcctggaatcatgccagtcgataggtgatgcatctggtggtggatccttcagcagctcagagttgaatgggcaaccactaaacgattcaattttggatatggagtcatcatcatttagcttcttgaaccaaatgccccaaagcttcatgttttcagacctggcagatgatttcaaccaaaatgcaggttgagcgggtcatgcacagcgtaccaaccatttgtacataggcacatgggcagtcgaatctgcattggtgaagaacttgaggaccttttgatctagcttgtttatttctctagtttttgcgtcttgatattgtggtagtttggggcttcgggtctggtgggttgtctagcccatcagaacgcgtaatgggtacggagtattggtcttccagtatgttttcagcgttaatttggctaatttcccccgcttggcttgtacaacaaattttatcagtactgagtaccatgagttgtactgctgtatatgctgcttcccactctctgaattggcagaatgattgatgagaagacactgcttggaggaaaacaaaaa

SEQ ID NO: 15229 - DNA, 763 bp, Zea mays
gattgatcgcacagaagaagaattcacacccacacacacagaccgagctgccgcccgctgctctctccacccctcctctcctcgcggagcaggcaggcagggattccccgtccgcggggggaggtggcattcgccgctagggcaggacggggaaggctggcgtccggcatggcgaccgaggaggtactccataaggtccagagtcttatattgcgctgccttcagatgtacatggaccagaaagaagtggtcgatgccctctcccaccactcgaagatagagccctgcattactgaacttgtttggcgacaacttgagcatcaaaatcctctgtttttcaaggcgtattatatgaggctaatgcttaagactcaaataatggtcttcaacaagcttcttcaggatcagtttgaggttatcaataaagaattttcttcagggatcccttctatgtcgcttcctaatggctctaactccaacctattgaagcaaaattcatgctttttgccagagactgctcctggatctgcaatgccagatggtataatgcacaatggaagttcacgtggtataataaatggcacaccatctggtgatcaattgctcaatgctagtaaagacttgcatggccttcataatggaatagatgcttcgactagtctgcagtcagaccagaacgcagctgctgtgctgtatggtgtagacaatgagacaagtgcaacgataaagaccgagtcttgctattccagcaatgctgattttg

SEQ ID NO: 15230 - DNA, 1603 bp, Zea mays
  misc_feature (1591)..(1591): n is a, c, g, or t
aggaacagtgggtggggccgggagcgcctctcgctctccactaccagtccaccacctcgctcgcagctctttcctcctccttttccttccttttttctttttttcccagcccacctcgctcgctcccttcccttcccagtggaagtggattggttgattgatcgcacagagctcgcctcacatccacacagcccgagctgctgcccgcccacccgcctgtagctcccctcctcacggagcaggcaggcaggcaggctgggattcccgtcgaagcagggcaggagctagggcgggtggaggagcctttgcccgggaacgaggagaggaggtggcagtggcaccccgcggctagggcagcgagagaggggcgaagaggaaggcggcgggcgcgtccgccatggctagcgaggaagtactccacaaggtccagaatcttatagagcgctgccttcagatgtacatgaacaagaaagaagtggttgatgccctctcccaccactccaggatagagccttgtatcactgaacttgtttggcaacaacttgagcaacagaatcctctgtttttcaaagcatacgatatgaggctaatgcttaagaatcaaataatggtcttcaacaggcttctccaggatcagttcgagattatgaataaagagttttcttcagggatcccttctatgtctcttcctaatgactctaattccaacctattgaagcaagattcatgctttttgccagagactgctcctggaaatgcaatgccagatggtataatgcacaatggaagttcaagtggtataataaatgacacaccatctggcgatcagttacttaatgctagtaaagacttgcatggccttcatagtcaaatagatgcttcaactagtctacagtcagaccagaatgcaactgctgtgctgtatggtgtagacaacgagacaagcgcaacaataaagaccgagtcttgctactcgagtaatgctgattttgccttctgtgggaacactttcctggaatcatgccagtcgataggtgatgcatctggtggtggatccttcagcagctcagagttgaatgggcaaccactaaacgattcaattttggatatggagtcatcatcatttagcttcttgaaccaaatgccccaaagcttcatgttttcagacctggcagatgatttcaaccaaaatgcagaaataacaccatttctcactcctgagacaaatttctccgattcaacagggggagaccatacaggttgagcgggtcatgcacagcgtaccaaccatttgtacataggcacatgggcagtcgaatctgcattggtgaagaacttgaggaccttttgatctagcttgtttatttctctagtttttgcgtcttgatattgtggtagtttggggcttcgggtctggtgggttgtctagcccatcagaacgcgtaatgggtacggagtattggtcttccagtatgttttcagcgttaatttggctaatttcccccgcttggcttgtacaacaaattttatcagtactgagtaccatgagttgtactgctgtaaaaaaaaaaaaaaaactctgaattggcangatgattgatga

SEQ ID NO: 15231 - DNA, 1516 bp, Zea mays
gggtacctcgaggccggccgggtgtactagtatattactcggatcggccagtgctgacatatgcaaaaaaatggttctgtcgttatacattggttccagtattattgtcttaccaaacaagaattcacacccacacacacagaccgagctgccgtccgctgctctctccacccctcctctcctcgcggaacaggcaggcaggcaggctgggattccccgtccgcggggggaggtggcattcgccgctagggcaggacggggaaggctggcgtccggcatggcgaccgaggaggtactccataaggtccagagtcttatattgcgctgccttcagatgtacatggaccagaaagaagtggtcgatgccctctcccaccactcgaagatagagccctgcattactgaacttgtttggcgacaacttgagcatcaaaatcctctgtttttcaaggcgtactatatgagactaatgcttaagaatcaaataatggtcttcaacaagcttcttcaggatcagtttgaggttatcaataaagaattttcttcagggatcccttctatgtcgcttcctaatggctctaactccaacctattgaagcaaaatccatgctttttgccagagactgctcctggatctgcaatgccagatggtataatgcacaatggaagttcgcgtggtataataaatggcacaccatctggcgatcaattgctcaatgctagtaaagacttgcatggccttcataatggaatagatgcttcgactagtctgcagtcagaccagaacgcagctgctgtgctgtatggtgtagacaacgagacaagtgcaacgataaagaccgagtcttgctattcgagcaatgctgattttgctttctgtgggaatactttcctggaatcgtgccagtcaataggcgatgcatctggtggtggatccttcagtagctcagagctgaacgggcaaccactaaacgattcaattctggatatggaatcatcgtcatttagcttcttgaaccaaatgccccaaagcttcatctttccggacttggcagacgatttcaaccaaagtgcagagataacaccatttctcaccccggaaacaaatttctccgattcgacagggggagaccatacagcaggttgagcggggtcatgcacagcgcaccaaccatttgtacatacgctcatgggcagtcaaacctgcactgatgaagagcttgaggaccttttgatctagctgtttcttttttctactcttctcgtcttatattgtggtagtttatgggttggtcttctggtatgccctgcgatggcgtcgttatcgtgccttgtacattgccgtgcttgtgtaagaaacattaggagcggcgttgttcgcgtcagcattgatttggctaattcctccgcttggcttggcttgtacaacgaattttatcaaaatattaactggattctgaaatcgagattttcgcccaaaaaaaaaaaaaaaaaaaaaacaaaaaaaaaaaaaaaa

SEQ ID NO: 15232 - DNA, 2978 bp, Zea mays
tctgttaatcctgtttttgaggaccttcgtaagccgaaggccccctacacctacgtttcacagagggccttaactaaccatgctttaccaaaggtctcttggtatttcaaaaagcccaacaggctatttggtccgtatagaccatgacacattggcactccatctcatggagaaagaacgctaaaacgtgatcccatcatgcgcgtctctccgcatcatttcagatctatctgtgtgagagatgcacatggaactgcgttaccaaacgccctgtgctgcttgtaaaagacaaacaagaaactttccttttgttagaaaggatggtaaaagttttgtgtgtgtgtgattttattagtctaggaaagaaaaaaggccaaatgtcaggttagctttttaagggattgttcggttattcccaatacacatggattggatgagattgaaaaaaattgagaagaagtttgacttgtttaggattcaaacccatccaatctcactcaatctatatggattgagagctaaccgaacaagccctaaaagaaaaccagtcctaaatctatacaactaaaaaggtatctcacacattctgtacaactgagtctatgacacaacttggcgcactacttgctcacatttgattaaaatcgatccaactaaacaactcaactaacggctcaattacatgttcatattgaaccagcattgttgacacaacatacaagaaactcttcaaaaaaaactaacaagtaaatgaccaaagctcgtctttttgtgatatataacactccatgttccatttcattatctaaaaaaacatatatgtaacacttacgtgtgtccctccaaaacgtgaatccaagatcaaaatgaggttgcagatctacatttgaggtcaacagaaaactcttatactacattggtaatatgtgacaagagaaacaaaagttatatttaaaaaggctctgctagctccctattcagctataaacatttcagaggcaatatacattagaccgtggactcaaatccatctgttcactagctatatgtattagcagactgaatcaactcaagggcttgatgagcgtgtgctcttgcttgtcagagacgacctcattgtcacaatggcagattcgtttgcgcccaaccgcaccgcctgcttgctcgcctgcagaaagctcgtgatggctcgccgcacgtacgcatcggcctgtttgactgtcatcttcttcttacggttctcctgcgcaaggctcgtcagcatgtagtcgccgtttaggaagctcgcgagctcgacgagctcccgctggaaatctgagagccagccgtgttctttgggtggagttggtctctcaaatggcacctccggtaatgtctctgaaagtaacaaagggtaacctgagaagttaattgaagttcatttattcgatggaactgaagttcattttgtaactaaaagccgtgcattgtgttcatgtcttcaatcaaatttagtgctcgctcgagctcgatgttgagttgttggtagtgaacagaattcagattgaagagttcgttcctggtatgtatacctacctgggcaatctgttcttggttggtcgagctcggtgaagatgtggtcgaaggtaccggcccacgcgtctctcttggtgaggaaatcggacgagaggttgaagatcttcttgatggtggccggaatggaggagtgttcgaactcggaggtgtccgtgggcccgagggcgcggccgacgacggtgcccttcttgatccacggcgagaccatgatggtgggcaccctgacgccgaggcggtcgaacttgaagaagaagggcggcgggccccggatgccgtcggggctgggcacgccggcggtgggcgtggcgacgtggtcgtagaagccaccgtgctcgtcgtaggtgacgatgagcagcgtctggttccactgcgggctggcccggagcgcctcgtacacgtccttgacgagacgctgcccgttggcgacgtcgtgcgccgggtggtcgtcgtcggcgggggtccccgtgaggtcgaagtacctgggctcgatgacggagagcgccgggaggacgccgcgtcgggcgtgttccttgaaggcggcgtcgtagcggtggaaggcgcgggcggcgtagcggagcgcgcggaggcggcggtagaagagaacggtggggatggtcttgaagtagacggcgaagtcgtggccgtcggcggcgagggactcgaagatggtgcgctgcgggtagccgaggaggaggtcgagcttgtcgtgcgcgacggcgccgcgggaggtggcggagtagaggaacagccggttgggctgcgtgggccccgggatggaggagaaccagcggtcgaagacggcgaattggggcgcgagcgcggagaaggccgggaggagggaggggcggaaggcgcgcatcacggcggaggagaggaccgcgttgacggagagcgcgctgcggacgaagcccgacatggagggctgcggctgcgcagcggcggcggagacgttgccgaacacctgctccaggacgtcctcgaaggagtggcccgggtcgtcggggacgacgaggtcggcgtcggcggacacgcagatggaggatgtggagttggaattggggttgcactccgtgccgttgagcccgtcgacggggaggcccaacaggcggcgcatccagcccagcatgtggtcgaacgaccggttctccagcgccagcaccaccacgttctttatggggctggggccgccggggcgggcggcattggccctgccgttggcggcgaagaggagcaggaacaggaggaggagcggcagaggacggcggcgaggggatccggttgccatgtccggtatggcgcttgttcgatgaaatggcagccgtgctcgtgccgcccgaccacgacgccgccgccccggccggtgggcatgggctggcggcctttggcagcattcgcccggtcac

SEQ ID NO: 15233 - DNA, 1982 bp, Zea mays
gaccaaaggtattcaatttgtgatatataacactccatgttccatttcattatctaaaaaaacatatatgtaacacttacgtgtgtccctccaaaacgtgaatccaagatcaaaatgaggttgcagatctacatttgaggtcaacagaaaactcttatactacattggtaatatgtgacaagagaaacaaaagttatatttaaaaaggctctgctagctccctattcagctataaacatttcagaggcaatatacattagaccgtggactcaaatccatctgttcactagctatatgtattagcagactgaatcaactcaagggcttgatgagcgtgtgctcttgcttgtcagagacgacctcattgtcacaatggcagattcgtttgcggccaaccgcaccgcctgcttgctcgcctgcagaaagctcgtgatggctcgccgcacgtacgcatcggcctgtttgactgtcatcttcttcttacggttctcctgcgcaaggctcgtcagcatgtagtcgccgtttaggaagctcgcgagctcgacgagctcccgctggaaatctgagagccagccgtgttctttgggtggagttggtctctcaaatggcacctccggtaatgtctctgggcaatctgttcttggttggtcgagctcggtgaagatgtggtcgaaggtaccggcccacgcgtctctcttggtgaggaaatcggacgagaggttgaagatcttcttgatggtggccggaatggaggagtgttcgaactcggaggtgtccgtgggcccgagggcgcggccgacgacggtgcccttcttgatccacggcgagaccatgatggtgggcaccctgacgccgaggcggtcgaacttgaagaagaagggcggcgggccccggatgccgtcggggctgggcacgccggcggtgggcgtggcgacgtggtcgtagaagccgccgcgcgcgtcgtaggtgacgatgagcagcgtctggttccactgcgggctggcccggagcgcctcgtacacgtccttgacgagacgctgcccgttggcgacgtcgtgcgccgggtggtcgtcgtcggcgggggtccccgtgaggtcgaagtacctgggctcgatgacggagagcgccgggaggacgccgcgtcgggcgtgttccttgaaggcggcgtcgtagcggtggaaggcgcgggcggcgtagcggagcgcgcggaggcggcggtagaagagaacggtggggatggtcttgaagtagacggcgaagtcgtggccgtcggcggcgagggactcgaagatggtgcgctgcgggtagccgaggaggaggtcgagcttgtcgtgcgcgacgggcgccgcgggaggtgccggagtagaggaacagccggttgggctgcgtgggccccgggatggaggagaaccagcggtcgaagacggcgaattggggcgcgagcgcggagaaggccgggaggagggaggggcggaaggcgcgcatcacggcggaggagaggaccgcgttgacggagagcgcgctgcggacgaagcccgacatggagggctgcggctgcgcagcggcggcggagacgttgccgaacacctgctccaggacgtcctcgaaggagtggcccgggtcgtcggggacgacgaggtcggcgtcggcggacacgcagatggaggatgtggagttggaattggggttgcactccgtgccgttgagcccgtcgacggggaggcccaacaggcggcgcatccagcccagcatgtggtcgaacgaccggttctccagcgccagcaccaccacgttctttatggggctggggccgccggggcgggcggcattggccctgccgttggcggcgaagaggagcaggaacaggaggaggagcggcagaggacggcggcgaggggatccggttgccatgtccggtatggcgcttgttcgatattgaaaccccctcaatccctctccccggcaggcctggagtggtaccc

SEQ ID NO: 15234 - DNA, 2365 bp, Zea mays
tttaaaaaaaatacaaacaagataaaacaaaatgaaagcgagaggagaaaagaaataacgaaggaagaggccggccgggagtgatgtcgtgtttgaccccctcctccctcgctcggctcggctcccaccttcctccgttgcctcctcttccgcggccccgtcgatgggcttggctttaccagtggcgggttcccacacgggggctagacgccgccaccgctgaccccgtctacaccgaatcccccgcgcgatttaacccctcgcctcgctcgccgcctccgcttccatacaaccgcgcactccaaacgcgcacgcgctgttcgttcctcggccgctctgtccacccccgtccttctccgccctcaacagatctccgccggccgtgcggttccttaattcgccttctccgggactgtcggatctccgcggcggctggggatgggcaactgctgcgtgacgccgaaagcagccgacgacgccggcggcggcaagaagcccaaggagccgaagcagaagaagggtaagaagccgaaccccttctcgatcgattacaaccgctcggggcaggcgagcgcgccaaagctggtggtgctgcgggatcccacggggcgggacatcgcggcgcggtacgagctcggcgcggagctcgggcgcggcgagttcggggttacctacctctgcacagaccgtgcctcaggggaggcgctggcctgcaagtctatctccaagaagaagctccgcaccgccgtcgacctcgaggacgtgcgccgggaggtggagatcatgcgccacctccccaagcaccccaacgtcgtcacgctcagggacacgtacgaggacgacaatgccgtgcacctcgtcatggagctctgcgagggcggtgagctcttcgaccgcatcgtggcgcggggacactacactgagcgtgctgccgccttggtcttacgcactatcgttgaggtcgtgcagatgtgccataagcatggagtgatgcacagggatctcaaaccagaaaattttttgtttgcaaacaagaaagaatcagcggcacttaaggccattgattttggcctgtctgtatttttcactccaggcgaacggttttctgagattgttggaagtccttattacatggctccagaggtgctaaagagaaactatggcccagaggttgatgtttggagtgcaggagtgattctgtacattcttctttgtggtgtccccccattctgggcagaaacggaacagggtgttgctcaggcaatcattcgatctgtcattgatttcaaaagagatccatggccaagggtgtctgataacgccaaagaccttgtcagaggaatgctgaatccggacccaaaacgacgattgacagctcaccaagtgcttggtcacccatggttgcagaacattaagaaggctccaaatgtcaatttgggtgaaactgttaaggccagactccaacaattctctgtgatgaacaagttcaagaagcatgcacttagggttatagctgagcatctttcggtagaagaggctgctgacataaaggatatgtttgagaagatggatcttaacaaggatcaaatgcttagtttcgaggagctgaagcttggtctgcataagtttggtcaccaaatgcctgatgcagatgttcaaacactaatggaagcggcggatgctgatggaaatgggtccttgaattatggagaatttgttacattatttgttcatctaagaaagattggaaatgatgagcatctgcataaggcatttgcatacttcgaccggaaccagagtggttatattgaaattgatgaactccgtgagtcattagctgatgaccttggacaaaaccgtgaagagattatcaatgccatcatccgtgatgtagacaccgataaggatggcaagataagctacgatgagtttgcgacgatgatgaaggccggaacagactggaggaaagcatccagacagtactcgagagagcggttcacgagcctgagccttaagctgcaaaaggatggatcgctgcagatgacgagtacacggtagcccgataacaccacataggcaagttgtgaattacagatggaaaccatgtgtagatttttctggttgtttgttgacagctcttctgcttgtcctgatgttccattgctttgtattcttcgcttgcggcctgtttgaaggattaggggggattgtttatgctatgattgtatttagactgcatgatccatgcctcgctcgtttccaaagtgtactgtacaaaagaaagaggagaaagggattatgaggctctgctcatttcttaaaaaaaaaaaaaaaatttgaaaaaaaaaaaaaaaaaaggccccta

SEQ ID NO: 15235 - DNA, 3289 bp, Zea mays
gccaacctgttcccacccatgtagccaccccccacccacccacaccacacacacacccaccgcgcgcagcgcagtccatccatccacgcacacgcgcacccgtccctctcggcgcccctctcccccctcctccactccgctgctgcctgcttgcctcctccttgccgccgcgaccgcgaccgccgttcgctgtcgaggccagaggagaggagtggtcaagtccgaggccacctgcccaggctcagacctcccccgccacaacgcgagccgcatcgcctcgtctcctccacgccatacacgcccgccttcccttccccggcgaccaggacccctcgcccgcggcgccagcgagctcccccggccagtcgtaggcctcccggagctcagcacgcacgcaggtgggtccagtgaggcctggttgtgcgcgttcctgcgggcgtcgtcggggcagatccatggaactcagccgcccgcagcgcggatagtactgcacttgtgcaccagccaccagcggatcgccaggactgcccacctgctgctgcttgtgtcgctagccatttttcgggcgtctggcttggaggatatggccgcggcgatggacgcgcccaaccctggagcggctgctggcccaggaatgcctagtgacgccctgtaccaggagctgtggcatgcgtgtgctggcccgttggtcacagtacctagacaaggcgagcgggtctatgacttccctcagggccatatggagcagctcgaggcgtctgcacaccaccagcagcttgatcagtacttaccgatgttcgatctaccacccaagatcctatgcagagtagtcaacgtggaactacgggccgaagctgattcagatgaagtttatgctcaaattatgttgcagccagaagctgatcaaaatgaactcaccagcctggacgctgaaccacaagaacgtgaaaaatgcactgcccattccttctgcaagacactgacagcttcagatacgagcactcacggcgggttttctgttcttcggaggcatgctgaggaatgtcttcctcagctggacatgtctcaaaatccaccttgccaagaactggttgccaaagatctccatggcactgaatggcattttcggcacatttttcgagggcaacccaagaggcatctccttaccaccggctggagtgtctttgttagctcaaaaagattggtttctggggatgcattcatcttcatgagaggtgaaaatggtgagctacgggttggtgtaaggaggctcatgagacaagtaaatagcatgccgtcatctgtcatatcaagccacagcatgcatcttggagtattggccacagcctcccatgccatctccactggaaccctcttttctgttttctacaaaccaagaactagtcgctctgattttattgtgagtgtgaacaagtaccttgaagctaagaagcagaaaatatctgttggaatgaggtttaagatgagatttgaaggtgatgatgctcctgaaagaaggttcagcggaacaatcattggcatcgggagtttgccggcaatgtcaaaatctctgtgggcagattctgactggagatctctaaaggttcaatgggatgaaccttcatccattcttcgtccagatagaatctcaccatgggaagtggagccactggatgcagctaatccacaatcccctcaacctccactaagggctaagcgtccacgacccccagcttcaccttgtatggtttcggaactgccttcaggttttggactctggaaatccccaattgaatcatcctgtacactctcattttcggaacctcaacgggctcgagagttatttccttcaatccccacgtcaaccttgtcatcttcatcaaatgtcagttttaattcaaagaatgagccgtccatgctaaccagtcagttctactggtcagcaaggcatacaagagctgactcctgcgctgctagcaccaacacagtcgtaattgaaaagaagcaagagccaagttctggtggttgtagattgtttggaattaatatatgctcagctgaggaagaagtattacctgaggttactgctccaggtgttggttatgagcagactgctgcctctgtagagttgaactcggataagctctcacagccatctgatgtcaacaattctgatgccctagcagctagcagtgaacgttcacctcttgaatcccaaagccggcaagtgaggagctgtaccaaggtaattatgcaaggaatggcagtaggaagggctgtagacctgacaaagcttagtggctacagcgatctttgccagaagctggaggagatgtttgacatccagggggagctgggttccacactaaagaaatggcgggtcattttcactgatgatgaggatgacatgatgcttgttggagatgatccttgggatgagttttgcaggatggtgaaaaggatttacatttacacatacgaggaggcaaagaagctgacatccaagtcaaagttaccggttagcagtgacagcagcaagctgagcgctgcgaactcactgtctgaatgactatgaacaaaaactgcagagtgctaacgtccctctaattttgttatttccatcatttgattatgggggtgaatgctcacggttgctccgtgggctgaagttgtggttggcattcaactgccttgagttttggaggcttttggactgccttgccagcatgagcctcctggaagaggcaccctggcatctgcgtgccatttcccatttgttcgtgccgtttggtaggagtatccattggcttatttagcaggtccctggtttgaagaaagaagcggtcagctgcaagatggacggtgccttgcctcttcttcgactacttagctagtaattaggactatgtatgtaatgaatgtatatagtgccattaagacgcccatgccctggtattgaggtcccggcatttgtatgaatcaattgttcggaaattgttacctttagcagcaacgaacctgagggtgtagggtggccaggtgggagaagttgtatgtttctttcagtaacaatctttgtgcaagtgatctgtatatagtctactgttttaataagcaatgttgtgcaacttgcgctcctacaccctacagtacagtggggcttttcttgtgctaaaaaaaaaaaaaaaaaaaacccaaaaaaaaaaaaaaaaaaaaaaaaaaaaaaaaaaaaaaaaaaaaaaaaaaaaaaaaaaaaaaaaaaaaaaaaaaaaaaaaaaagggcggccgc

SEQ ID NO: 15236 - DNA, 897 bp, Zea mays
  misc_feature (21)..(21): n is a, c, g, or t
gactcctatagggcgattggngtcatagaggccggccgggaatcccccacggcacccatggcttgcgtggccgccggcgggtgaccttgaccttgtgctcgtcaaccgagtcccgactgcatcgatctgacggcctttctacgcgcaacgacgaagcttcgcgaatcccctccttccttcggcctcaccttcttattctccgccgaacaagtcttagacgcctaatccgtagtttacatcccgaagggcggcaagggtgatccaggccgaccatggcttacgtcgagagaggtgttgtgaaagacaagcggactatatggcgactgagcataatctcagacttctttcgggctattgtcaacttcatcagaatcttctttgacacactgttctcagtggacaaaactgacagctacaagaaagggtatggtgctggtaagaagtgggatggtggacctggtggtggtggtgggcggggcccatatggaggtggaggtggtggatttggcggcggaggtggaggtggtaggggtcctcgcactctatctgacatccaatccaatgaccacagttctctccctgcttgtggatcctgctgcggctaatgagcgcacagccgttctgcctgatgactgcttaacagatgaatacacatgcttcaatatgttctgaagaacatcatagctatcaatatgtatttcactgtcagacgattgtattatatataattagtgtgtcgtttattaacagttaatttacctgtaacttgactctggcatgattcacatggcacattcatggttttatctttaaaaaaaaaaagaaaaaatgcccaacctcaatttattaaaaaagtttaacttgttaaggcagcaaaaaaaaaaaaaaatttgcggc

SEQ ID NO: 15237 - DNA, 902 bp, Zea mays
gcactcgatcatgaataggtttagatacacggctgcccctgtacacacggacacaccaggttcgagggttcgagcggtcgagcctggtgacctgatccctgtgctggtcaaccgagtccgaaccgcatcgatcggacggtctcacgacgacgaaggttcgcgaatcccctccttccttcggcctcgccttcttattttgtccgccggacaagccagtagtggctacatcgcgaagggcggcaaggcagatccagggcgatcatggcttacgtcgagagaggtgttctgaaagacaaacggactatatggcgactgagcataatctcagacttcttctgggccattgtgagctttatcagaatcttctttgacacactgttctcattggacaaaactgacaacttcaagaaagggtatggtgctggtaagaagtgggatggtggacctggtggtggtgggcggggcccatatggcggtggaggaggtggaggattcggcggcggaggtggaggtggttcacggggtcctcgcactctatctgacatccaatccaatgaccacagttctctccctgcttgtggatcctgctgtggctaataagcgtgcaaccgttccgcctgatgactacttataacagatgaatacacatgcttctgtatgttctgaagaacatcgtagctattgatatgtattttactgtcagacgattgtatcataatcgatatgtcgtttattaacagcctatttacctgtagcttgactctggcatgattcgcatggtacattcatggttcaaaaaaaaaaaaaaaatgcctgattgcataataactagatcagttacaaagtttaataaattgtctggtgtgctgttctgttaaaaaaaaaaaaaaaaaaaagtggtc

SEQ ID NO: 15238 - DNA, 4905 bp, Zea mays
  misc_feature (3666)..(3666): n is a, c, g, or t
  misc_feature (4529)..(4529): n is a, c, g, or t
cgagacagagcgcccctcttctaaattgggccccccccgcggctcgcccgggggtctttcagaattcagagggccgcacacgttccctgccgctgcctctacccctctccgggctctccctccccctctccgccgtctctacaccgccgccgctcacaccccaattcctctcgccccattgccggccgcctccctccgtcctctcgcctcgcttgctgcaggttcaatcgccgccgccatttctgcagtttttaattcccacgtcctgttccggcccggccgtgcactccaaattcttccaagaaggccagcccacgccacccggccgggatcccagaaaagttgcgctcggccttcgcgcgttacgtctcccacccagcccttcgatcccgtgatttcagaggcgcccctgtaccgaaagcctagctcccaatcttccttggattcgtcttttttttggatcttggggactgcactgcacacagtttgcctctcttacctttttttggatcttggtggtgccgagccgacaagcaatggggaggaagtactactgccacgccgtggccgcgctggccgtcgtgttcgcggcggccgtcgtcgtcgctgccgaccggcgcctgtcgctggtggtcggcgccgcggtggcgcccgaggaggtgagtctgctccggaaggtggccaatctgatgtggaacggcgatggcaactcgtaccagcacgtgtggccgccaactgcctttcaggatttctttgttttatttttttcacaaaagaacaatttgtttgtttttaccagcgctcacttgctggtttagcagttctgcgtcggattaagtttacaaagttggcaagatgttgcatacaaattttggtaggtccggagctcatctgctgctctggatttgtcatgaaatccagtttgggccatgcagatagaactgatcgagctatactatactacaacatcctattgaatgtgcgatgacctacatatacttttcaatagttttattactctttaatgctttcaaggcatggcgttttaactcggtgaatcttgtgggggttgctttctgcagccaatggagtttgggtggcaaattgtgctggggtcactgatcggattcttcggtgccgcgtttgggagcgtcggcggagttggtggcggcgggatcttcgtgccgatgctgacgctcatcattgggtttgacccgaaatcatctactgcgatatcaaagtgtatgattatgggagcctctgtttcaactgtttactacaatctcaagctaaagcatccgactttggacatgccagtgatcgattatgacctggctgtgctcatgcagcctatgctaatgcttgggatcagcattggtgttatttttaatgttatattccctgactggctggtcacagttctgctgataattcttttcctaggcacatccacaaaagcctttctgaagggcattgagacatggaagaaagagacagtaatccaaagggaggctgcgaaacttttggagcaaactgcaggtgaggaagcagagtatgcagcacttcctactggaccagatgttgcagcaaacaaaaaagccctcacatcagatgaggcgccatcgcttataaagaacatacactggaagaaggttggtcttctttcatttgtatgggtggcattccttgttcttcaggtcacaaagaattacactgctacttgctccccatggtactgggtcttgaaccttctccaggttccagtgtcagtaggagtgacactgtatgaaggatttgggctgatgagtgggaagagggtgttatcatcaaagggaagtggacaaactaccatgaaatttcatcaggtagtcgtatacggtctattcggtatagccgcaggactagttggtggactccttggtctcggaggtggcttcattatggggccactgttcttggagcttggcatccctccccaagtttcaagtgctactgctacctttgcaatgatgttctcatcttccatgtcggttgtcgaatactacctcttgaaccggtttccagtgccttatgctgtttatttcatcgttgttgcatttgttgctgccatcattggccagcatgtggtgaggaagttgatcaactggctagggcgagcatcacttatcatcttcatactggctttcatgatctttgtcagcgcgatttctctcggtggggttggcgtctctaacatggttcacaagattgagcgacatgagtacatggggtttgaggacctttgcaagtacgatgcataagaagcagggaagctgaagatgtgagctatgtggtgtgcagttctccgcaagcagaagtgggataattcaaggatagaagggttccatgatgcaatttggtgcgtaggaccgaagaggttctagcagcgacagttcctcgaagggaggctagctgcatggattggcttaagatgaattttgggcactgaattttcaaaacaaatgtagagatgattttctgccacggcagaatgtcgtcagtgcatttcgttgtaggaaatgtacactgcacatcttcagataaccatcctatagtactacgcgatatgaaatatcacatgatagacatgagatgggtgcctcttatggatttaacgtctttagcctagcacaacgcccgttctttgtcccgtcgggggaatcttggagctgaatcccacagcatgaatcttctgtcagcattagaaaactgaacaaaacctgaagattcaattttctaacaaacctaaccgaacgaaacccagtagtgcagcggctcatgtgaaatgaaattgggggcgatctctaagaattcacctgactggtttctaatactcggttcatactagttcaccgcagcgagtggtgtgaggccttattgcatttgtaattgtagggatgtcccttctctgagcaatctgaacatgctccccgtttgtctgtgctgcaaattgcaatgtatcatccagcctcgctccaaaaaagaaaaagaaaaaacgtacgtctgagaacaatgcctgatatcgatgagatttgggggagaacatgacatgattccacctggcgagtggtgagtcccgatataagtatataaggatcgatgtgttatgatgatggcggcgcaggagaatatggtggcaccggagactgaagatgagaatggcggcgtcacgaactgaacaccagcgagctgaggaagaaggtagggtgcgaagagtgtttgggttgaagtaatggccggttagcaggccgtgtaattgtggtacatgggccacgtcatataattattgaactatgttgttaaccggtaacgatgaaaatagaaccttccctcgcgaataaaaaaaaaaaaacttcctctgttcacgttcctcattctcttctccactgatcgtcggaaactcatcgactgtcttcacaattgatatcagagctggttcactacaaggaatccgatcgtcatctagttcctatcaccgcgaggtgaaccacgtagtcccaaagacgaatgcttttgcgtaaggggtatgctacgactccaagtcgaccatccgcacaaacatgttacgtgatcgcaacaatggaggtagtggagaagcgaatgtccgagaagttctagtaggctttngaggcattaactatgatgctcaaggagctacctaagaagttggatggattggacacgctatttgttggggcctctttggccaaaggtccttaaaacactaatttatcagatattcctaagcctgtttcaagtataaaggtaatagccgaaggacaccttcttttggagacggtgtgtagtcatcacaattgcaaagacgaagctataagcttcagattagtggcgtaaatgcatgacgacgaagctagcaagagcaaggggaaatcctcaagacttgatcgacaagactgcaaagggaaaaaacagcagtgcccttagttgatttcatagttcatgagtaggcatgattgtaatttttacgaagttgtatctcgctactataaatagttgtacaataccatatattgcggacaccttttttggtggtagtaacctatatcactttgcctatgaagttgtatcgcctttatttcttcttctatgcacaaaaggtatattcgtaattatgtatgatgaagaagtaataaaaatattatgataaccactatctctctctttaaacattcttgtcttgttcgaaggtttaatcacctttttaaacttcttcgaatagattaaaggaatgaaggtcccttgccgttgatcatgttgccctattttggtccttccttaggaatcaaagcaggtgatcaacattggcgcccacctccaatgaatcaaggacatcaagagcacctttatcatgcctccgaacaagcctataattgttggttctgttcttgctcccatagatcagaatcaagttgaagacacacctctttgcgaagcacaaagccaaaagagaaaagtcactgatccccatnacataatgaacatgacaatcagatgggggctcgatggtcgccgaacttcgactactggatagggatggcaatggatgggcacccgacggtggaacaaacacccacccgtattgacacttattacattaagacacacccgcacatgtgatacctaatgggtgtatttgcacacccgcattcgttgggtgttgggcacccattgggtgaccaacatttgtaagtattgcaatcttagaaagtagcaccacacattacactacaaataaaatataaaacatacataaatatatagatagtcaatctatcaacacaacatgtaataggatgacaattcacatgataacattgttttaaactcaatttagttcacataata

SEQ ID NO: 15239 - DNA, 2247 bp, Zea mays
cattgggtacctcgaggccggccgggaccgtctctaaccgccgccgcacacaccccaattcctctcgccccattgccggccgcctccctccgtcctctcgcctcgcttgctgcaggttcaatcgccgcccccatgggctcctcgtggccggcccccaagcccgtcccggcccggccgtgcactccaaattcttccaacaaggccagcccacgccacccggccgggatcccagaaaagttgcgctcggccttcgcgcgttacgtctcccacccagcccttcgatcccgtgatttcagaggcgcccctgtaccgaaagcctagctcccaatcttccttggattcgtcttttttttggatcttggggactgcactgcacacagtttgcctctctcacccggtggtgccgagccgacaagcaatggggaggaagtactactgccacgccgtggccgcgctggccgtcgtgttcgcggcggccgtcgtcgtcgctgccgaccggcgcctgtcgctggtggttggcgccgcggtggcgcccgaggaggtgagtctgctccggaaggtggccaatctgatgtggaacggcgatggcaactcgtaccagcacgtgtggccgccaatggagtttgggtggcaaattgtgctggggtcactgatcggattcttcggtgccgcgtttgggagcgtcggcggagttggtggcggcgggatcttcgtgccgatgctgacgctcatcattgggtttgacccgaaatcatctactgcgatatcaaagtgtatgattatgggagcatctgtttcaactgtttactacaatctcaagctaaagcatccgactttggacatgccagtgatcgattatgacctggctgtgctcatgcagcctatgctaatgcttgggatcagcattggtgttatttttaatgttatattccctgactggctggtcacagttctgctgataattcttttcctaggcacatccacaaaagcctttctgaagggcattgagacatggaagaaagagacagtaatccaaagggaggctgcgaaacttttggagcaaactgcaggtgaggaagcagagtatgcagcacttcctactggaccagatgttgcaccaaacaaaaaagccctcacatcagatgaggcgccatcgcttataaagaacatacactggaagaaggttggtcttctttcatttgtatgggtggcattccttgttcttcaggtcacaaagaattacactgctacttgctccccatggtattgggtcttgaaccttctccaggttccagtgtcagtaggagtgacactgtatgaaggatttgggctgatgagtgggaagagggtgttatcatcaaagggaagtggacaaactaccatgaaatttcatcaggtagtcgtatacggtctattcggtatagccgcaggactagttggtggactccttggtcttggaggtggcttcattatggggccactgttcttggaacttggcatccctccccaagtttcaagtgctacagctacctttgcaatgatgttctcatcttccatgtcggttgtcgaatactacctcttgaaccggtttccagtgccttatgctgtttatttcatcgttgttgcgtttgttgctgccatcatcggccagcatgtggtgaggaagttgatcaactggctagggcgagcatcgcttatcatcttcatactggctttcatgatctttgtcagcgccgtttctctaggtggggttggcgtctctaacatggttcacaagattgagcgacatgagtacatggggtttgaggacctttgcaagtacgatgcgtaagaagcagggaagctgaagatgtgagctatgtggtgtgcagttctccgcaagcagaagtgggataattcaaggatagaagggttccatgatgcattttggtgcgtaggaccgaagaggttctagcagcgacagttcctcgaagggaggctagctgcatggattggcttcagatgaattttgggcactgaattttcaaaacaaatgtagagatgattttctgccacggcagaatgtcgtcagtgcatttcgttgtaggaaatgtacactgcacatcttcagataaccatcctatagtactacgcgatatgaaatatcacatgatagacaagagatgggtgcctcttatggatttaacgtctttagcctagctcaactcgctttctttgtgcattcccgttaatcttggagctgaatcc

SEQ ID NO: 15240 - DNA, 1126 bp, Zea mays
  misc_feature (993)..(993): n is a, c, g, or t
  misc_feature (999)..(1000): n is a, c, g, or t
aacgttccctgccgctgcctctacccctctccgggctctccctcccccgcgccccccgcggccccccgccgccgcacacaccccaattcctctcgccccattgccggccgcctccctccgtcctctcgcctcgcttgctgcaggttcaatcgccgccgccatttctgcagtttttaattcccacgtcctgtcccggccgtgcactccaaattcttccaacaaggccagcccacgccacccggccgggatcccagaaaagttgcgctcggccttcgcgcgttacgtctcccacccagcccttcgatcccgtgatttcagaggcgcccctgtaccgaaagcctagctcccaatcttccttggattcgtcttttttttggatcttggggactgcactgcacacagtttgcctctctcacccggtggtgccgagccgacaagcaatggggaggaagtactactgccacgccgtggccgcgctggccgtcgtgttcgcggcggccgtcgtcgtcgctgccgaccggcgcctgtcgctggtggttggcgccgcggtggcgcccgaggaggtgagtctgctccggaaggtggccaatctgatgtggaacggcgatggcaactcgtaccagcacgtgtggccgccaatggagtttgggtggcaaattgtgctggggtcactgatcggattcttcggtgccgcgtttgggagcgtcggcggagttggtggcggcgggatcttcgtgccgatgctgacgctcatcattgggtttgacccgaaatcatctactgcgatatcaaagtgtatgattatgggagcatctgtttcaactggttactacaatctcaagctaaagcatccgactttggacatgccagtgatcgattatgacctggctgtgctcatgcagcctatgctaatgcttgggatcagcattggtgttatttttaatgttatattccctgactggctgggcggcctgctggtgataattcttttcncttgcnncctctcccttgcctttttgctcggccttgtttcctgggtgggtgacgccggtgtcccccggggggctgcgcttcttttggtgctccccgctgcccttttccctcgtcctcctcctcttccctcctg

SEQ ID NO: 15241 - DNA, 886 bp, Zea mays
ctcttctaaatgcgtttccctcccggcggcccggccccgtctttcagaattcagagggccgcacacgttccctgccgctgcctctacccctctccgggctctccctcccccctccaccgtctctacaccgccgccgcacacaccccaattcctctcgccccattgccggccgcctccctccgtcctctcgcctcgcttgctgcaggttcaatcgccgccgccatttctgcagtttttaattcccacgtcctgtcccggccgtgcactccaaattcttccaacaaggccagcccacgccacccggccgggatcccagaaaagttgcgctcggccttcgcgcgttacgtctcccacccagcccttcgatcccgtgatttcagaggcgcccctgtaccgaaagcctagctcccaatcttccttggattcgtcttttttttggatcttggggactgcactgcacacagtttgcctctctcacccggtggtgccgagccgacaagcaatggggaggaagtactactgccacgccgtggccgcgctggccgtcgtgttcgcggcggccgtcgtcgtcgctgccgaccggcgcctgtcgctggtggttggcgccgcggtggcgcccgaggaggtgagtctgctccggaaggtggccaatctgatgtggaacggcgatggcaactcgtaccagcacgtgtggccgccaatggagtttgggtggcaaattgtgctggggtcactgatcggattcttcggtgccgcgtttgggagcgtcggcggagttggtggcggcgggatcttcgtgccgatgctgacgctcatcattgggtttgacccgaaatcatctactgcgatatcaaagtgtatgattatgggagcatctgtttcaact

SEQ ID NO: 15242 - DNA, 1285 bp, Zea mays
gctatctcaaaataaaatctgtagtgtatgtctcctctctatcctctcaatgccagtaaagaagtatctcaatttcagatgcacgctccctggtcagccttatctcgtaccgctcttggcatcttcaagaactggattttttccaagccatctccacagccgctggatatttgtttacgtgcctcatctcggacagctacaggcatgcttccttccttatctcctccccacgctcgagcccacaacagcgctcagtctcctgcgcatggcacgcgcgcccacccagcccttccccttccagcagttgagcacaccgtccctccccagccgtgagctcgcgacgcccattttcctggtgccgagtttcctttgcgtctctcccacggccgtctccctcccttcagctcgccctgtccctgccatggacgccggtgtcctctgctcgccgcggagcttcctgctcggaccgtgcctccatggtgtgtcgacatggagctcgggccgcgtccttggtcgcctgtttctctgctgtcgcagccctgtcatttgccagcgcccctctgctcgcctgttccagtttgccatcgtgtgcccctggtctcggctccacaccaagctccgttcatggccgcgtcccgccaagttccgtcctccatggctgcgtgcaggcttctctgttcgccgtgaccctctgctcggcgtcctgctcgcccccgacactgcgctcggcctagccatcttcacggcgttcgccggccgcgattttgcctgagtttcctgttggctcgccgggtgtttctccctgcagctacgccatcggcgcgcccagcctgctcgtcgtggacgtgagccactgcccatgtcgagctccctttcgtgcgttctcctgtgtttagccttgatgcgcgcgctcctctgcttgccagtgttcccagctcgcccgaccgtagtgttagcactcctcgacgtcggcgttgagtttgggaccctgctcgctgtcgcggccgccgttaaatcgttggagtcgctcaactcgtcaatcgcatctgagtcggtcgtcgattttctattcgccatggtataacaccgttattaaatccgttcttcaacccgccatggcgttcgtcgttctctgatcccagcccgaaccatccgtgcgctcgctccttatccattaggttttggcgtgttcgcgtttatcgtcgagtcgtcgaacctgtcatcctctactcgaccccctcatcagctcgctcctgaatgatctcgtcgacgttccgtacggacc

SEQ ID NO: 15243 - DNA, 2893 bp, Zea mays
accaccaccaccatgttcaccacgccggtgagctagttctgaggcagggccacgatggggactctgagactctggaagtgcagggccaccaccatgacgagcttgacttgtcggagagccacgagctgacgcttgccgagacacaccacctgggcgttgatcagaatttcgatcagctctcgctggcgcgcgcccctgtgctcgccctgcagccgcatgatctctcccaggctcctcttgcagtcgctcctgttgtccagtcacggaccttggttgtgagccctgagtttcagctcgcagtgggacagcagtttcccgatgttgtcagctgccgcagggccatccgcaacactgccatcgcctgccactttgagatacagacggtgaagtctgacaagtcccgcttcaccgctaagtgtgctgccgagagctgcccgtggcgcatacatgcagcaaagctccccggtgtgcccaccttctccattagaaccatacatgacaaccacagctgtgtcgggatcaaccatcttggccatcagcaggcatctgttcagtgggttgcgaacactgtcgaagagaggctacgtgagaacccagaatacaagcctaaggaaattttggaagaaatccacaaggcccatggcatcaccctatcctacaagcaagcttggagaggtaaggagcggatcatggctgcggttcgagggtcttttgaggaaggataccgtctcctgcctgagtactgtaggcaggtggaaagaacaaatccaggaagtatagctcgagtgtatggaaacccagatgacaattgctttcggcgactcttcatatcattcagtgcatcaatatttggctttgtcaatgcatgccgtccacttattgggcttgataggacccttctgaaaaacaagtatcttggcaccttgtttcttgccactggttttgatggggatggtgctctctttcctctggcatttggcgtggttgatgaggaaactgacgagaactgggtatggttcttgtctgagctgcatgagttgctggagaagaacacagagaacatgccaaggctgaccatcttgtccgatagacggaagggcattactgatggagttgaattcaacttcccaactgcattccacgggtactgcatgcgccatgttagtgaagccttcaaaaaggagttcaacaatcctgtgcttgccaaccttctctgggaagctgctcatgcgctgactgtgattgagtttgaaactaagctgctagagatagaggacgcttcaccagaagctgttgtttggataaggcacctaccttcacgtctttgggccacggcttactttgaggggacaaggtacggtcatctaacagcaaacatcgcggagtcgctgaattcctggatactggatgcctctggccttcctatagttcagatgatggaatgcatccgtcgccagctgatgacttggttcaacgagcgacgcgaagcaagcatgcagtggaacacaatcctcgtgcctgcagccgagcgtcgtgttcaggaggccattgagcgtgcacggggttaccaggtggcccgggccaacgaggcggaattcgaggtcatctcagctcacgagggaacaaacgttgtggacatccgcaacaggtgctgtctgtgccgggggtggcagctctatggcgtgccgtgtgctcatggtgtggcagctctcctctcctgcaggcagaacgtccaccgctacactgagagctgcttcaccgtggcaacataccgcaagacttattcgcagaccatacacccaatccctgacaggaccctctgggatgaaacagcagatcaaggccaggtcaaggtggagatgatcatcaatccaccgaagtcactgaggcccgcagcacagccaaggaagaagagggttagagcggaggaccgtgggcgagtcaagcgggttgttcattgcagccgctgcaaccagactggacacttcagaaccacatgtgctgctccaatatgaacaacggccaaccgaactgggcacttcagtccagaacttgttggttattaattagagctgcagcattcctgtgacaagttagcgtctacttgtgcaagcttcttgcttgcagatgggtcttttccttccgttttcggaaattcagtgttaaatggaaatggttaccggaaatacggaaacgaaatcagtaaaaaaaaaaaacggaaacggaaacagtttgagtcatataaaaaaaaaatcagcaattaccgtatttattcgttattttaccatcagtaacgaattcagtaatttttcaaaaaaaatattaaatctgaactgatcttttatacattcataatcaattcgtcttagcttataaaaatatgaactaatttttattatttttctaaaatcaagatctatctagtgatatatatctaatgatatatagtttagagttgtttgaaacttttatggatcttatttatagtttacttccaattattacttttgatacatatattcataatttgcacgagtgtctgaaggaccagtatgatactaattatgttgacttttttgaagtcaattgtgggttcataatacgatttttactggtgtaatttatattccgaccgtaaccggtatgttttccgtaccgaactttcgttagtgatgttttcaaattatcgatgttatttttgtttttggagttattgttttcgctttcgttcatgaaggaaaactatgaaaatgaaaatggttttagtgtttaccgtccgttttcatccctacttttggccccagtctccacgcacttgtcctactcccctgtactgaagctcgatggttagcaacacgtcgctatcctctctgctctctactgccgttgcctg

SEQ ID NO: 15244 - DNA, 1865 bp, Zea mays
ggagcaatctgaggagctccgaagctggctcttgctgggcttcattatttccaaacatatgattggttcatgttaatgactacaattacccttggatatattggatggatggtgaacctcattatacatgtgctacagtcttatacatcatatcctgtaattcttctcaagagggctcaattgtatcctaacaatacctccatgaaagtttacatttgtggatgcttctttatgggtttgtcatccattttgctacttctagagaaatcaccacttctttaccatgcttatgtattgtgcacaatattcctttggacaagaattgtacaaaaatttgattttttgaagtccgtatggagagaactagctaatatgcccttcaagtatatttttaatctcctgaccagttcagttgttgcactgcttgtattggagtttctggttatgagcttctttgataggaaaatttatacgtggtgcttcttggtccttgggatactcggttcaacatatgtagcattgtttattcaagctagtgctgcacttgcgatatacatatggcttgcttgctggttcctgtctgtatttactttgatgccagctgaaattccagaaaacaacaacttggtaatttttagtggagggctcataatacttattggattagcttcaagatggattaaatcaaatagttccagcttttggctatatctcactcgagcaaataaacgggatcctcaatcttttaaactctattttgttcaggttattttagtcgcaatatcttcgataatggtgtggctatctacctcacaccggtcccagaacagagaattgctctcactaccccagtttatcaattggtctgtagctggtgttgctatggtgctacctcttttctcaccacctagtgttctatcccgtcttacatctatattcttgggttttgctcctccatttctgctgctttccattggctatgaagcagttttctatagcgcttttgcaatggtactcattggatggatatttgtggaatctgccaacctgtattgctcagaagaaagtggttctgcacgtcgcagaagccttgcggataactcagtttttggctatgaagaaagacacctgcgactatctgatttaagaatccctttgttatttgtgatattatttaatgtcgccttctttggtactggtaattttgcaagtattgcaagctttgagatctcgtctgtgtacagattcattacagtttttagtccatttcttatggcaggacttcttatctttaagttgtttattccgtttatgcttgtcatatgtacgtttagtgcgatcaccaaggtcgtccgtatcccacggctgggctgttattttcttgtaatactgctttcagatgtaatgactattcatttctttttcctggtacggaataccggtagttggatggaaatcggcaacagcattagccatttcggaatagtgagcgcccaagtggtcttcgttttgctgctttttgccctcacgaatatatacactagagatattttggtctcgtctcggcaactaaccgcacggaaagttatgtaaatcgttcagtttatttagaaatccaaatacatccatccttttatttattcatttttgggtcgactttcattttgggatcaagtttgtagcttagcttttggctaaagttttgtagcttagcttttttgttttctgtgaatggaccttggtgtcaaatttttgtgctaatttcattcgcttacttacagcctgaacagattttacgtaaacaactataactatattagctttaaaaaaaaaaaaaaaaaaaaaactcgagggggggggccggt

SEQ ID NO: 15245 - DNA, 1794 bp, Zea mays
acaggtgggccatgggctaacttgctttgacatggtctaatagtaaaggaggttgagttgatgttgtaccatgagtcatcattttagtcctttggcagcagtaaaattttgtttctagaaaccctgaatttttgttccttcccaagaaaagtttggacctaactgcatataatctattgacaagtaggaatttgtttcatgcaggttgaccaagcttaccaagtctttgaagatatgaaacaaaactactgtgatccagatgcatacacatacactatactaattagaatgtctggaaaggctgggaagaccactaaatttgtctcattgttggaggaaatggtgtccgaaggatgtgttcttaatctgattgcttataatactgttattgaggctcttggtaagaacaagatggttgacgaggcgatttttatgctttctaaaatgattgagagtgactgtcggcccaatcaattcacatatagcattatgctggatgttttatcaacagggggacaactccacaggttgaatgagattctagatatttgtagtggatgtctgaataggccagtttattcttatttgatcaaggcactctgcaaatctggtcatgcaagtgaggctcatagtgtattctgccgtatgtggaattcccatgaaaaaggagaccggtatgcttttgtatcaatgcttgaggcactatgcaatgcagaaaagacaacagaggctattgatctactgcatatgatgcctgaaaaggggattactacagatgttggaatgtataatatgatattttctgctcttgggaagctgaagcaggtgtctttcatgagcagcctctatgatacgatgagagccaatggtgttgttcctgatgttttcacgtacaatattatgatttcaagttttggtagggttggcttagttgataaggcatctgaactttttgaggaaatggaggatggcagttgcaagcctgatgtcgtcacctataattctatgataaattgtcttgggaaaaatggagatctcgatgaagcccacatgcttttcaaagatatgcaagagaaaggatatgatcctgatgtcttcacttacagcatattgattgagtgctttgggaaatccaataaggttgatatggcatgcagcttgtttgatgagatggttgcacaggggtgcattcctaatattgtaacctataacattttactagactgtttagagagacgagggaagacaacagaagctcataaattttatgaaactctgaagcaacagggattgactccagactcgataacttactcaatacttgagagattggaaagtagatctcaacgaacagtaagaatacgtaaaccaagccggaatacaggctgggttataagtccagtgtgataacctaccctggatctttcagttgcatacctccggtgtagtggggctgaggacaaatagtctgtatgcattatgcaaacttgcaagtatattgctggtcaataatgtcagcaagtgactactcaattaccgtgaaaacaatatagtagtcctgactcatcagaattatatgtatataatagtattgcatggctgctgatatttgatatcttggttctgaacaattcgtggaagatggacatcttgagaacaggtaaaaacatctctactttgtcatcgtattagaggaatgatttcaagatgtgaggatctatctttggaagctcagagttagtacctagattcatatttgttaaaaccagatcaggccagcagtttaactcggaa

SEQ ID NO: 15246 - DNA, 986 bp, Zea mays
caaatcttcatgcgagtacacgccactttgcaaaagaaacgtaccagcagtccagccagcacagcctacgcgcctacgacggtggcacagccgccgtgaagctcgccgccgcagatcccaaggcacatgcccggcaccggccctaccctgctgcactcgcctcgctcacgcgcagcacaccactctcgtctggctcaccaaaagccgagccgggcaaagcgaggaaaaagtactggtcataccgacccaccatggccgtgccagtagaatctagccaatccagttgcaataaagtaatgttaccgtaccactaccaccctcgtgacagtcgtgagccggccgggcccgcgacggggaaaggcgcttccagcagctcgcatgccatgccatgccatgagcccatgacccagagcagtgccgcacacagacaggcagcagccctctccctccctccctcccgcccgcccccactagtcaatactgagcacaatacgccacccaccacccctccatcaaagaaaagggcggcaggccgggggaggggaaggggctgagcatcagagcatgacgtcggggagcggcggcggtgggaggcctcgggcggacgccgacatggaaggagcgggagaacaacaagcgccgggagcgccggcggagggccatcgccgccaagatcttcacgggcctccgcgcgctcggcaactacaagctgcccaagcactgcgacaacaacgaggtgctcaaggcgctgtgccgcgaggcggggtgggtcgtcgaggacgacggcaccacctaccgaaagggatgcaagccgccgccggggatgatgagccccgtgctcgtcctcgcagctgctgagcgcgccgtcctcgagcttcccgagcccggtgccgtcctaccacgccagcccggcgtcgtcgagcttcccgagcccgacgcgcctcgaccacggcagcggcagcaacagccacacccccggccccgcc

SEQ ID NO: 15247 - DNA, 1494 bp, Zea mays
actactacagcgcgccaccaggcagtacactgcagccagccagccacctccctcctctcagttcagttggctccctcccggctcccgccccactagtcgttgtagtcaatactgtgcagtacgccacccaccacctctccaagtctccattaaagaaaaggggaggcaagtcggggcctcggggagaaggggctgagcatcagaccatgacgtccggggcggcggcggcggcaggaggtctggggcggacgccgacgtggaaggagcgggagaacaacaagcgccgggagcgccggcggagggccatcgccgccaagatcttcacgggcctccgcgcgctcggcaactacaagctgcccaagcactgcgacaacaacgaggtgctcaaggcgctctgccgcgaggcggggtgggtcgtcgaggacgacggcaccacctaccggaagggttgcaggccgccgccggggatgctgagcccgtgctcgtcgtcgcagctgctgagcgcgccgtcctcgagcttcccgagcccggtgccgtcctaccacgccagcccggcgtcgtcgagcttcccgagcccgacgcgcctcgaccacagcagcggcggcagcagcacccacaaccccgccgcggcggccgccgccgccgcctccctgctcccgttcctccggggcctgccgaacctgccgccgctccgcgtgtccagcagcgcgcccgtcacgccgccgctctcctctcccacggccgcggcggcggcgtcgcgaccgcccaccaaggtccgcaggcccgactgggacgccgccgccgaccccttccggcaccccttcttcgcggtctccgcccccgccagccccacccgcgcgcgccggcgcgagcacccggacaccatcccggagtgcgacgagtccgacgtctgctccgcggccgactccgcccggtggatcagcttccaggccaccacggcgcccgcgtcgcccacgtacaacctcgtccacccggcctccgactccatggagctggacgggacgacggcagccgtcgaggagttcgagttcgacaagggccgcgtcgtcacgccatgggaaggcgagcggatccacgaggtggccgccgaggagctcgagctcacgctcggcgtcggcgccaagtgaagcgaagctctcaagcaaagctcggatctttgagctcccgtactgcaaatgccgcgattggcagaaaaaaaaatgtgtacgtactacgtagcgtcgtagccgcgtgaagaaatcgtggatgcattcgtgctgagtttcgatcggaggcacattcggtgtagggcgtaggtgttgtttcattcatggacagctgatcaggtgaaagaacaatcgttgttcgtccgtccctccgcctgtattgcattgcattattgatcacagactgtatgctgactccattcggatgtagtactaggtggatctttggcatctacttactgtttgttctgcaaaaaaaaaaaaaaaa

SEQ ID NO: 15248 - DNA, 4263 bp, Zea mays
aaaaaaatccccctcgctgtgcctcatctgctctcgggttacgatgttctgtgcgccacccttcggttggattgttgcagagtggacggttgacgccggcccgttagtgatgggaggccagggttccgggattttctcggccgggaccaatgtttcggtctcttcttaatattataccgggagggcgacaatttcctccctggtcgagtttttttaaactatcttgactttgaccaaattgatagtaaaggttgttaccccctccggttcagtttacggcctcccaagttacactttgactattcatttattttacattatatttgtttatgattttgaacctatgattattggatactgcatttgatttcaaatcaaatattattaagcttgtatgcaatagttaaaacttgttagccagattattggtcaaagcttatgaagtttgactcttgacgtaagtgaaatgccttataatctggaccggagggagtaacacttatggcaccaaataggtatactatgaaaatgttcgaccataataagtataatcatacttgcttggctatataaatatttgtatttttttcgtataaacttggccgaaattaagataatttgacttaagacaaaactagaatgcaagttttttttggtacttcagatgctatgaagtggactatgacacattgccacaattttcacaaaattaaacataggacaaaattacactggttctgcattcattacataagtttatttgcttggaatgcaagtatggtttattacagtctgctttgcatatttatgtagatttttttctaggctaatttatgatgaattatgcccattctgtctgttatgtcgagtattatcaactaatattggcttgcatccactggtatttgtttgtttcattttctctacagaatgtccccagtttctgaaaaattgaagttgctctctggttcatgttacttgcctcaccctgctaaggaggcaactggtggtgaggatgcacatttcattagcattgatgagcatgtgataggcgtagcagatggtgttggtggttgggcagatctcggtgtcgatgctggactatatgctaaggagctaatgagaaattcaatgagcgctatcaaagatgagccagaagggaccattgatccaaccagagttttggaaaaggcttatattagtacgaaagcaagggggtcatctaccgcgtgtatcatcactcttaaagatcaggtgaaggctcatccttgtttgatgtttagcgtcctcctgttttatctgcttatttgctgtatcctagtaaacagtaaaacacagcataaagacgtgatttaagattggttggtacaatacacagaaaatgattcttcacatcatttattgagtatatgaattgcaaactgagttcttgagaatagtaaattctttacccatctatttgatgatgccagttctagattcctactttggaaaagtttgtgtatttagtcccttttgtgtttttgcaattgatatgctagttcattggtgacttccactaataccacaacgtttgatcttgcagggtatccatgctgtaaatcttggggatagtggtttcgtagtagtccgagatggccgcactgttctcaggtcaccctcacagcagcatgatttcaattttacttatcagcttgagagtggaggtggcagtgatcttcctagttccgcacaagtgagtaaatcacagccttttcctttgaatattctgtatataattttgataacacagatcaattcagatgcctattcttcttcccctgttgaattccttgtgcaagctctgcatcttcaaactactattatataatacttgtgcttccggccgcgtcgtttcatttagttcaggtatttcactttccggttgccccgggtgatgttatcgttgctggcacggatggactatttgacaatttatacaacaatgagataagtggtgttattgttgaagctctccgggttggacttgagcctcagattgcagcacaaaaaattgccgccctggctcgacaaagagctacggacaaaaataggcagtcaccttttgcatcagctgctcaagaagctgggtaccggtattatggtgggaagcttgatgacataacagtcgtggtctcatatgtgaaaagcgctggagccccatgatctgagcctttcttttattagatgtaatgtacataaatcattgtcccgaactggcggcgtatgtatgcaccagggcatagaagcttattctcaaggtgtggaatcccctgatcctagaagcacctgtgctgggttcagtatggttgcgctttagccctggaacatgttagcaaaccattgcaccattttacttgtttgccactgtgagaaatcattttctctaattatctgaactcctgaagccagggtgggtttgtttccccccttggagttggaggataatgaccagctggaaccaaattttgttgtaaacagcgttgattgccgaatgatagttatagacatcttggactaaatggtgaaccagcgatgctgtttgaaatgcctttttggtctcggggtctttttgtttcactgctggcttaaaaattgttgagttgtgtgctgtaaaaaaatgttgtgagttttgtgatgtgaaaatatgtcatcctagagatttatatttgtatgtgtttttgtaaggatgcacgtgcccccccggagctaccattatctaattatgattgtggtattcaatcgagacatctagatacaactgtacattatttctacacatacagtcattttaatattagtaattgtttataaatattttgttttgttgttctttaatattagacgaggagaaaccagtgaacgacttgagaacactatgattgtgtaggttcaactgttcttgtacctaggggtttacttgggtttgggagagattagctttaagcaaaacatgcacaacttaattagctcagtttcacaaaaaaaaccttgaagttggagagaacttcacggttttgttgatgcaacagaagaggagcttcacaaaccctcgtgaagttgaatggaaattactcacctcacctatgccgctagttacaaagggtaaacgacccattctttatttcttcgacccccaccaaacggatctgtccgagtcctctccatcctgctcgactcccattcaatatagagtcgaaaccaaacgatgacatctgacgacgtggcttccgaatcgatcgatttcgaagcgtttcttttctcccatttccaagttccgggcactcccatggcgcatggcgccggtggccatggtccgccccacactggcggcgagggtcgatctcccccgggccacaggcggctggcagtgccaagggagaggactctttgcacgcggtggccgtgggccgcacatagggccagggcacagctgaaggagaccagtggcgtttggcggctgtatggcagcgatggccggcgaccgccgactccaagatcctgccccctgatgggcatgacatgcaatgttggcggtttcgacgacgcacacagaaatcccttcggcggtcagtgcctccctgactcactcccatcggtgaccgacggctcctggctcactcccatcggtcagtgggcatgacatgcaatgttggtggcttcgacgatgcacaaccatcgattcttcaatatactacacctacgaaggcaattactatcaaattgctgcaatacgcggtagtgaattggtaggattataatttggttaatcgaggctagctaccgattgatagttggtactaatgcactttgaagaacaaaccagtggatcactgtaggtgttgtattaagaaaattactaaaagatatatttggattgatgttggcaggtagagagaacttggttgaatttaggatttgtttggttgctaattaaacagtactgtcctcccataaccatgccatggttttttttcccagtacgtaagataatgtttggttgtataaacagtcacattacactcctatatggctatatgtgtcaccctgtttgaataaattaacagtcacattttactgtttttgctttgcttgtttgaagtttgaacacaacaatgacattgtgcctctggctgatataatagtacgtagtagaaaatacgatcaatgcaaagggctcatggatagttaatcatagctagccaatccgaagatataataatc

SEQ ID NO: 15249 - DNA, 3233 bp, Zea mays
tcgccgcggcgcagctcggggcgctcggccggtggaagggctcggcgaggggccttcccgagtacacggtcgtccacaacatcgatggtgccgtcgtcgccgcccctgggagagccaaagccaagcagaggaggtcgcggtcgaccggatttgggaatcctgctcctgccaaacgggatgaacggaaggaagcagaatctttctggggttgatttggcttgaaggaagcgggatctttctggacaatggctgtctagcttcatccattctggtaacaaagaaaaaaacaagaaacatctggtatctgagtccagtagaaagttgtgcaaagagaagagcaaaatatctacaccagacgtctcttttaggtacagagggatggagtcttgtaagaaggtagctgcaagcttgaagtcgtgtgagccatgggggaacatggcattctggacaaacgccgctgggccaggttggaagttgagctttgttgttgagccatggactaagggctttagcgcgtcgtgtgcggcgccatattctgctggagccacagagcatcaattatcgctcgatgagaaggtggataactccaccgttgcatctggttttgatgggtaaagttatctatcagctagattcatggcaggaaaggttttttctattgtcggtatccagcacctaagtaggcctaggattttttcttctatctttaattagcaattgcctttttcagcaaccgttcttatgaatttcttttattgacaacatgaattagtctattttagttcatctctttcttgtcacaaatttaaatgaatataattgtttctgtgaagcccaaaggttccaagtcaccatgaaaaaattgaaatgacgagatctattaatctaattgttgcaccttggaaagtctgaaccatcagagtttaattgtatcacccatttacacaagttcctaccatcagagttcaactgtatcacccatccataagcaattccttttgttgaaatttatgagaagacatatgcctctgttaaggtaaaccttattcttcagttacaaatacttattgttaatgtgatggtcttaattttatggtcgcctccagggcttgcagtctcaggaacttttttgctgggaagccaattccttactgatctaagggacaacatttttgtttgcctgatataaggcaaagtgtgaaagggaaacgcgaaaagaaacgtgtcctggtcccaagtcacctgccatactgaacacgattgatcgcagaaagaaacacgttctggtctagactgacagttttggagctggagccggccatgcgctcgatcagagttccgctgcagccacgacctctctcccgaacgcgcacgagaagaccaggtggaacatatgcaagcaggttctagagcaataaccccatgaatccacatcgggggtctgcatctacacgggcgtgtactccgcaccgctcccctccggccccgaccgccgtgtgctcgttgtagccggggtcgacctcaaccacgacgacgatgcggtctccttgccctaggctcgacctcctcgctgacctcgccctgctccacctcaactcgcgatgaggattgtcggcacgttcacaccgcgccgttgcagaacgttggagcctctcagaactctagaagctgcctaccaccacgcaccctaagataggggcatatctgtgttagtcgcctgcacacatactgaaatatgggcatatccaccatgtattctactcttagttatgttagataaggcttttactctatcatttactgatctggtctgtttttagctccattagcttgttcacaagcttatgttagagaaggcgttatggcttttctcaagattataacatttctgaataactgttctgcataggcatggtaccatcttcatcatgtagctgggatgagctggcaccatgaaagaattcaagtggttaaatcatgcatctgcagaaatattgtactctcaaatggtgggttgctgcgtcacgggagtttgggtgaaggcctgaaggatgtgatgcaaaacgtcgatgcaggtctgggatgtccgcctcattatggatcaaaattcatgacgttctaaaggtgtcggatgagtacctatatactccctcccagaaacaaggcgcctcattacactattggaagctggacgacatggatgactctggcaagatgcggtgggagcacgacgacatggatgactccgaccatgagttcgacaggaagcctagcaacagtacgcagtagcaaggttgacccagaggggcagtggagagtaacccaacaccccctcctccgaccgtcatagcgcttctttcctctggcttcatttcttacctatgtatggatggtcttcaccgctggttacatctagcaagtcctcccaggggtgatctcaattttctcctgatttgctctctcctttgtttttttattgattcatctatgcacatttaatgatctatggcgtgccttcaatgcaattggtggaggcagtgacatgaaggagattgtcatgctgccaaagcacatcaaggacaatgcaaacaaggacagaggaagaccggacatgccatttccaggtggtgacatttctattctcacgcgcccacccaacatttttgcttttactaaatgactatgtgcacgaatgctttgtggatgttgagagggattatctgtgcttgacaaaacagtatcccagacttgcaattactccagaattttctaaggttgggcattttgtacattgaacttttgttgctgatcgatattcaatgtggcttttggcattctctgtcactctagctaggtccttggatgagccacactattgacatgggtttaggtgagtgactcatcacggtgcctttatatggctcgatcaattccaaatttgctatagtctggttgtcactagaatttcctcatttggcatgcaatatttacaattgatttgcctggtactctgatcgaaatgggaaagttgagtgcttacatatgtcgatccaccaatatttctttattgtcaagggcagagttaacgtgaattgtgtggattcacaccaactgcacctttgggatctcttctgggtcgtttcatttcaaaaaatcctggccatctccccctctatctctggtaaacatagaggactagatagatcaggataaacgaggcgtgttaattgttg

SEQ ID NO: 15250 - DNA, 2453 bp, Zea mays
tcctcccggccggccgggcccgcattgtcctcctcgtcgtcctatcttctcttgctcttctcctccggcctcctcggtcctcgctcacccgaaccagcaaccctaatccgtggccgcggacccgccgcaagctccatcgcgcgaatagattggggattcagtcgaggctacgcgggaactggtcgcgctcgagatcttagcctccgcacctgaaaccattggctccattgctattgctgtcgtggttcaggtgatgaaatcttggggagcccgcctcgctcggtcctaagatgctggcgagctacggaggtggtggccgcggcgtccatctctcctcccacaaggacatcctcctcggtcgcggcggccggagcttcctcttgggcaacacgtggtttctcctctccacctacccggcgcgcctcctgcacaccacggaccgccgcgcgcccgccgctttcttggccgcgatcaaccgggccccctgcatgcggccgcaccgcgctgggcagggcctgctgcagaggggtggtattgtcatggctgcttgcggctatgctcttgggcgagctgagctaggtactgccaagcgccagcagccggataaggatccatctgcagggacgcgctcctcgaatgttgcagccactggatcactgggcaatgcagcgcggccagacgtctcttttaggtacagaggggcggagtcttgtaagaaggtagctgcaagcttgaagtcgtgtgagccatgggggaacagggcattctggacaaacgccgctgggccaggttggaagttgagctttgctgttgagccatggactaagggctttagcacgtcgtgtgcggcaccatattctgctggagccacagagcatcaattatcgatcgatgagaaggtggataactccaccgttgcatctgattctgatgggaagtcaccagtttctgaaaaattgaagtttctctctggttcatgttacttgcctcaccctgataaggaggctactggtggtgaggatgcacatttcattagcattgatgagcatgtgattggtgtagcagatggtgttggtggttgggcagatgttggtatcgatgctggactatatgccaaggagctaatgagaaattcaatgagtgcaatcaaagatgagccagaagggaccatcgatccaaccagagttttggaaaaggcttatatgagcaccaaagcaaggggatcatccactgcatgtatcatcactcttaaagatcagggtatccatgctgtaaatcttggggacagtggtttcgtagtagtccgagacggccgcactgttctcaggtcaccctcacagcagcatgatttcaacttcacttatcagcttgagagtggaggtggcagtgatcttcctagttccgcacaagtatttcacttcccggttgcccccggtgatgttattgttgctggcacggacggactttttgacaatctatacaataatgagataagtggtgttatcgttgaagcgctcagggttggacttgaacctcaagttgcggcacaaaaaattgctgccctggctcgacaaagagccacagacaaaaataggcagtcaccatttgcatcggccgcccaagaagctgggtaccggtactacggtgggaagctcgacgacataacggttgtggtgtcgtatgtgaaaaccgcttgattcgagcctttctttttattagatgtaatgtcaaaatcttagtcccgaatttaatggcacatgtgttctcaaggtgtgaaatcccctgagatactagaagcactcctgctgggtttagccctggaatacgttagcaaaccattacaccattttacttgtttgccactgtgagtaatcttctttttatatataattctctaaaaccagggcggtcgtttcgcccttggagttggagggggaggataatgacctgctggaaccaaattttgttgtaaatattgtcgattgccgaatgataacatgttggactccatggtggattgttgatgctgtttgaaatgtttctcttgaccccggagaacggcttctcaatatattgtcagtatgagttccatagaattgaaatgcaagagccaagaggggtgagactgatggctctatcgatctatttattagtatttattacggagcacaagaattttacgagcatgagaagagtgatggcctcgaaacaccatgagcctacgatgcagttgcagtccaaacgcctaggcgggcgagtttgatgctgcgaattgtggagactgaggctcgcttctcacacattctctcagtatactatgttgcaaattagcaaacattgtctcagtataaaaaaatgttttgatattctcaaatgccatagttcagaatgtgggcccccggtgcaagttccatgtgaaaaaaaaacttcaatacttcttgaaagatggtctt

SEQ ID NO: 15251 - DNA, 2143 bp, Zea mays
cattttatcacaataatataacacacatttgtatataaattatcatatcattatatgttcacgttgcagtacacggtcactcatctagtgtaagaccataaggagggaactttctagtgcccaaataataatcacattgtcctcgtcgtcctatcctccttcgcctgctcgctagtgtcgctagccgctccccccaacaaacaaccctaatccgtgaccgtggacacgccgcaagctccatcgcgcgaatagattggggggattcaatagaggctacgcggggattggtcgcgctcgagatctcagcaccctcgcgcctgaaatctttctattgttgtcgtggttcaggtgatgagatcttggggagcgcgactcgctcggtcctgagatgctggcgggctacggcggcggtggccgcagcgtccatctctcctcccacaaggacctcctcctcggccgctgcggccggagcttcctcttcggcaacacgtggtttctcctctccacttacccggcgcgcctcctgcacaccacggaccgtcgcgctccctccgctttcgtcgccgccatcaaccgggtcccctgcgtgcggtcgcactgcacggggcagggcctgctgcagagaggcagcattgtcatggctgcctgcggctatgttcttaggcgaactgagctgggtgctgccaagcgccagcagccggataaggacccatctggcggaacacgcgcctcccgtattgcagccatggggtcactgggcagtgctgcgcggccagaggtgtctttcaggtacagggggctggagcattgtaagaagattggtgcaagcttgaaatgccgtgagccatgggggaatagtgcgttctggacaaatgccactgggccgggttggaagttgagctttacagttgagccatggactaaggactttagtacggcgtgtgcagcgccgtattctgctggagccacagaggatcaattgccgctcaatgagaagatgaatagctccactgttggaatgtccccagtttctgaaaaattgaagttgctctctggttcatgttacttgcctcaccctgctaaggaggcaactggtggtgaggatgcacatttcattagcattgatgagcatgtgataggcgtagcagatggtgttggtggttgggcagatctcggtgtcgatgctggactatatgctaaggagctaatgagaaattcaatgagcgctatcaaagatgagccagaagggaccattgatccaaccagagttttggaaaaggcttatattagtacgaaagcaagggggtcatctaccgcgtgtatcatcactcttaaagatcagggtatccatgctgtaaatcttggggatagtggtttcgtagtagtccgagatggccgcactgttctcaggtcaccctcacagcagcatgatttcaattttacttatcagcttgagagtggaggtggcagtgatcttcctagttccgcacaagtatttcactttccggttgccccgggtgatgttatcgttgctggcacggatggactatttgacaatttatacaacaatgagataagtggtgttattgttgaagctctccgggttggacttgagcctcagattgcagcacaaaaaattgccgccctggctcgacaaagagctacggacaaaaataggcagtcaccttttgcatcagctgctcaagaagctgggtaccggtattatggtgggaagcttgatgacataacagtcgtggtctcatatgtgaaaagcgctggagccccatgatctgagcctttcttttattagatgtaatgtacataaatcattgtcccgaactggcggcgtatgtatgcaccagggcatagaagcttattctcaaggtgtggaatcccctgatcctagaagcaccctgtgctgggttcagtatggttgtgctttagccctggaacatgttagcaaaccattgcaccattttacttgtttgccactgtgagaaatcattttctctaattatctgaactcctgaagccagggtgggtttgtttccccccttggagttggaggataatgaccagctggaaccaaattttgttgtaaacagcgttgattgccgaatgatagttatagacatcttggact

SEQ ID NO: 15252 - DNA, 3176 bp, Zea mays
  misc_feature (2784)..(2784): n is a, c, g, or t
agtatgcgaggcttctgtttgatcagatgccctgcagaaatgttgtctcatggactgggctgattgatggatatacacatgcttgtctttatgcagaggctcttactcttctccgccacatgatggcaggaggcattagcccgagtgagataattgttttagcagttattcctgcgatatctaatcttggagggatcgttatgggtgagatgctgaatggctattgtgagaagaagggtatcatgtcagatgtccgggttgggaattcactcatagacttgtatgctaagattggctctgtgcaaaactcgctaaaggtgtttgatgaaatgctggatagaagaaatttggtgtcatggacatcaataatttctggttttgcaatgcatgggctgtcagttgaggcacttgagttgtttgcagagatgagaagagcagggattaagcccaacagaatcaccttcttgagtgtcatcaatgtctgcagtcattggggtctggtacagcaagggttagcatttttcaaaagcatggtttatgagtacaatatagatccagagatcaagcattttgggtacatcatagacatgctaggtagggctggacgtttgtgtgaggctgagcaaataatagaagggttgcctatggaggttaatgtaactgtatggaggatactgttaggttgtttcagtaagtatggagaagttgagatgggggagagggcaataaagatgatatcagacttagaaagagaatctggaggtgattttctgcaggtgctccgtgcagctgtggggcatatattagcaagagttcaagactttttggtttaaagcaccatttcttcggcgcatcccagcatttgcacgcttgatcatagaaaatcttacaccgtttcctccaatccacgctgtatcagacctaaaaatgcttaacagcctcgatcaatctgtatagcgcccgatagggcgctgctgattctagtatcatcaatccatgatagcgcatccaactaagtcctcaattgaaacttcaccttacgtgagccgttggatctaaacccaacggcaggaattcgcgtgcccggccgcgatgaaaacatgcgacacggaatagtagaaactcacctcaagcagcaagcacccgagcggccagctccagccccaccagagaaatacggcgtaaacgccgccggggaccaacccaggcgaccggggtgcctagctcgccgtttcttttcgccttctcctcgcaatttcttaggatcaacgccctactacacgacgggggttttccccttcggccgccactccgtcctttcgcagcctgccgccggcgccatgctgtacatcgtgggcctcggcctgggcgacgagcgcgacatcactgtgcgggggctcgatgccgtacgcagctgctccaagatatacatggaggcatacacatccctcctctccctcggcctcgacccggccgcgctcgccaacctggagaagctgtacgggaaggagataacggtcgccgatcgggagatggtggaggagcgtgtcgaccaggtgctaagcgaggctgccgacactgacgtcgccttccttgttgttggcgacccgttcggggcaactacacatactgatctggttgttcgtgccaagaaaatgggagtagaagtgaaggtgatccacaatgcatctgtcatgaatgcaattggagtttgtgggctacaactttaccgctatggagaaactatctcaataccattcttcacagacgaatggagaccagatagtttctatgagaagattcagaacaatcgccagcttgggctgcacacactttgcctgcttgatatccgtgtcaaggagccaacatgggaatctttagccagaggaaagaaagtctatgaaccaccaagattcatgactgtaaacactgcaataagtcagctttttgaggtggaggaagcacgtgggggatatgcatatcgcagggaaacattgtgcataggagtggcacgacttggaagtgatgatcagaagattgttgctgggcctatggagaagctactagatgttgattttggtccaccccttcactgcctgatcatagtgggagagactcatcctttggaagaagagatgctagagttttacatgatcaagtagtgatatacacaccctacacatgtgagttttcacttgtattgactaagggaatgcttagacttctgtccttgtcaatattggattgttgaatacttagccatttggatgtagaaccccaggaaatggtgcagtatgcgatttggagtgctggcagcttgtaaaacaaatctgtgctagcagtctaccattagtttacgtctccgaatcttgtttgaaacttgcatgtgaacgcaggcctccgtctcaaaatataatttgttttagattaaacatacaaaaaaaaaaaaaacaaactccgccggtgccccttaaacctacattcattaatcatcctataaatataatttttatatatatctacatttattatcgttcatttgaatgtgggcataaaaaggttataaagaactatattttaagatggagggagtagtttttttatgatattaagggttagtttaacaatattttcacaaggggttattatttttccaaaggaagataaactaatttctcttgagaaaataaaaatttcttgaaaaaatagggttgtcaaactagccctaactctaactctagccactagaaactaaggtagtgtttggttcggtgtcaacgaggnatgggacgggatcaaccctgggctgaccccgtcccttattttttgagggatgacctcatccaccatttttgaagaatatttcttgaccctgactctggacctttaaaccaaacgcgggttaagttaaaatgatctcatcccatccatcttcatcctttctcgtccctccatccaaacacaccctaaagaatcgaatcgaagaagatagctttaggattgagaggagttgtcataggaaggataactttggtggtcgacgtcaaagtgggtgactctattagagtaaaggtgcggtcttccttcacttcgttgtagagatggattagatctcgtttggtctatgcgagtgaggaggtactataaatattggttcgcgtgcttgtattgctttt

SEQ ID NO: 15253 - DNA, 2227 bp, Zea mays
ttttttttttttttttcagacacatcttttcatatataaattgcttcacaattattttacaaatatttgtttagacaacttaaaagtcttacatgtctatagatagatagatagatagcgccgttcgagaaaaaaaaaacctatgatatgatgagcacggctcacactttagaaggcccgccggggaagcgagcccaccaccacggtcactgacgttcacaaaaaaaatcgcacacaaaattcctagaccacgttttttttagtcgcacaaatcctacaaaccaaacagcaagagcggaagaagaaacgaaaaaggttcactggaatcgaccaagaaatccgccttgccatctccgtttcgtatatgccctgagaatttccaaacgaaatttccgagcttttccctcgccgcgcgaccttcgatctcgcttgaaagagatgccccagatcacgggaccggtgtgaggactgagacgccgacgtccgacctcaccgaagcattcgattcgtcgcaatcctcgccctcactcgcgtgttcaggtttgtcgggctgccccgggataggaatgcttctgtcgacatgctaagccgcggagccgtgcggttgctgctgtatcgtctccggcctccgcctctgcgtttgagttggaatccgagcggtgctatgcctccgccaccgccatccgccgccgccaaccgctcctgcctctgcaggtttgcctactcgaccgctcgcgtcgagaggggcaggaccctgccgggcaaggcggtatttcttgatctgggagccgggaggaggttcacgccgagcggcgcgcttagcttgaggggttgcttgggttggcgggatggtggcggcgacggcgagttcaggaggagggtggacggggaggcggcggggatgaaggcgcaggtgctcaccacgcagcggcagctgatgcgcgatccggaggtgctgccgctcgaggaggccgccacaggcaagagcatgaacgtgaatggtgcctgtcggcgagggaagccgctagggtttccggagcaggcagcggctaagatggtggttgctgttgatgtagatgaagttcttggtagcttccttgcggctctgaacaaatttattgctgatcgttattcttggaatcactcagtatcagaataccatgtatacgagttctttaagatatggaactgttctcgagaaagagctaattttcttgtccacgagttcttcacaacccattacttccaagatggcattcatcctattccgggggctcgagatgctctccaaactctttcttctttctgtagcttgtctgtagtaacatctcggcaggatgtaattaagaatcacacattggaatggattgagaagtattatccaggcttatttgagcagatccatttcgggaatcatttcgctttggaaggtcaatcaaggccaaaatcagagatttgcaggtctttcggcgctcaggttctaattgatgacaaccccagatatgctctagagtgtgctaatgatggcatgagggtccttctgttcgattacgaaagctcgtatccttggtgcaaaactggagccgatgaactccatccgctggtgacaaaggttcacaactgggaagaagtcgaggagaaacttctctcttgggtagtacctgatagctgacactcttctgtcttgtgagaagcactgcttgagaccagcaaatgattccttttgcctggtttctaaaggaacctgatagggtgaaagactgcaatgttcctagagcttgattttcaatacagatgtcgatagcctctccaagagtcattctaaaacccactctaaatcatcatcagaagagtcatttgcataaatttgactccaactccaacagtttttctatatcctgggatatttttcattaaactctctattcacaataattagttaggatatggagagtcttggggatgttgtcaacgtaagctaggatattcagcttcattaccgcagcctggttgaggcatattcgactgtacttggtcagtctgagctgtaggcgcttctgctctcacacatcagaatcttgttttatccttttgccgcagccgggtgtactatgtatatatcgacgctgccatatggctaagatggtatttgaattgttctaatacagcaaaaaaaaaaaaaaaaaaaaaaaaaaaatgggtccttggaccaactgatttggagcac

SEQ ID NO: 15254 - DNA, 2833 bp, Zea mays
cccccaccccgtgaatttgagatagactaatatctgaactttggaaagtggtgtaatgtcaaattccaaactaaataagttactttattgagtgaattccaattcctctaaaataaagggatccaaacgctccgtaagagaaattagattattacttcacaatttttcatttttcatactatatatttatataagaaaaataaagccgtctattaatacttgagttacgagccaggtgtcagacacatcttttcatatataaattgcttcacaattattttacaaatatttgtttagacaacttaaaagtcttacatgtctatagatagatagatagatagcgccgttcgagaaaaaaaaaacctatgatatgatgagcacggctcctttcccgaaaaagaagcgagcccaccaccacggtcactgacgttcacaaaaaaaatcgcacacaaaatacctagaccacgttttttttagtcgcacaaatcctacaaaccaaacagcaagagcggaagaagaaacgaaaaaggttcactggaatcgaccaagaaatccgccttgccatctccgtttcgtatatgccctgagaatttccaaacgaaatttccgagcttttccctcgccgcgcgaccttcgatctcgcttgaaagagatggcccagatcacgggaccggtgtgaggactgagacgccgacctccgacctcaccgaggcattcgattcgtcgcaatcctcgccctcactcgcgtgttcaggcaagcgattccgtcggttattgtgatctgcgcttttgtttcttctcgattgcggggtgtgacgaatctgatttgccgaatgcgaggcgtccaggtttgtcgggctgccccgggataggaatgcttctgtcgacatgctaagccgcggagccgtgcggttgctgttgtatcgtctccggcctccgcctctgcgtttgagttggaatccgagcggtgctatgccatccgccgccgccaaccgctcctgcctctgcaggttcgcctactcgaccgcgcgcgtcgagaggggcaggacctgccgggcaaggcggtatttcttgatctgggagccgggaggaggttcacgccgagcggcgtgcttagcttgaggggttgcttgggttggcgggatggtggcggcgacggcgagttcaggaggagggtggacggagaggcggcggggatgaaggcgcaggtgctcaccacgcagcggcagctgatgcgcgatccggaggtgctgccgctcgaggaggccgccacaggcaagagcatgaacgtgaatggtgcctgtcggcgagggaagcggctagggtttccggagcaggcagcggctaagatggtggttgctgttgatgtagatgaaggtatgtgaattgattacatcatagagttgtttgtttgaaattgtcagctactcagctgtgcatttgtagtgtctgtagtcgaatgcactgtttttgtattattagtggttgatttcgtggtccttagtctagaaacaattgatggaataaccaacatttaacagacttgaaaattttgcatctttttcgattaggatgttctaggtaatggtctcgtgcgttgaccttttctcactaccttgtactgtatatcttgcttgcagttcttggtagcttccttgcggctctgaacaaatttattgctgatcgttattcttggaatcactcagtatcagaatatcatgtatacgagttctttaaggtgaacatgaagtcctgattcccttaaaaaattgactcctgtaatatttgttttttgattagtcacattttcgcttgaacttttcaagctgaatgtttgttcaccatgtagttcttacatccttttttttttgcaaaactatatgcagatatggaactgttctcgagaaagaggtgtgttgatgttacttatctttgttttatttgggattacacttattgttgtaaatatacaagtcatcatatgaagccaagcactggtctgaattctgcagctaattttcttgtccacgagttcttcacaacccattacttccaagatggcattcatcctattccgggggctcgagatgctctccaaactctttcttctttctgtagcttgtctgtagtaacgtaagtcatttatttgatataaaagacagatcagtttgtcttccattatacgagtttgcctaatatatccttcttttaaaagatctcggcaggatgtaattaagaatcacacattggaatggattgagaagtattatccaggcttatttgagcagatccatttcgggaatcatttcgctttggaaggtcaatcaaggccaaaatcagagatttgcaggtaatacacgggggaacatagtgtcccaatcatttttaggagactggtaagtggtaacatagcttaacatgcactgaagcataagagcatctccagaacacttcaaataccaccctccatatcactgtgtggctatccactccataagatcccctttccatatttcagcacactagcagactagcaaaatctcgatccgtaccatgttgatctatgttttcttggtattcaaattgccatgaatcgatagtttttttttcttgattttaagattcacgtgccagaaccctgattgatagtttcgcttttcctccttaatcgtttgaccttttcttgtgtccattttagatcttgctggtcattgtgggttttatctcttttatatgtttccctgtttcgttgttttcggttctcctttgcctttgtttcccttttctgttctttgggggttgagctctgaggttttcatatggggtttcatct

SEQ ID NO: 15255 - DNA, 1798 bp, Zea mays
gcgcgaatcgccttttatctctggtcaccaaatcagcccttattggctagtttggaaactcacatcctcttcgggattgaaggggattggagaggaaattagttcatttccaccccaatcccctccaaccctgaaggggatttgaggttcccaaagtagcactaagggttagtttggaaactcaaatcccttcaagattgaaggggattgaagagaaaattagtttatttctacctcaatcccctccaatcccaatggggatttgaggttcccattgactaggaggggatttaataccctccaatcgccttctggattggtgtgcctgaacatgcgttaattggagatggggacccattggggacccaaaacccgaatgaggatgagtatgagatgaattttgcacccataatgggtatgaggatggactaaatatgataggaatgagtttgggatgctataacccgatggagaattctccattaacatctctagatgagttagagatagctttagaagtacaagctagttgtgccgaaacatttttcaacaaaattcgggagacaactgatcgttgtaccaaaagaaatatattatgtacccgtgagcctcattttgttttgttgaagcttcatcaacggcacatcttagaccacggaattttataatataaaaaggtgacatggcattttatgataagaagagggcaggggactaaacaattacaagttttttttaaaagaagtggagatataaaaaaggaaaaacactcgatgagtgagcggtcagatgatcgcacatagtgtgggccagatttcgctcagcgtagcaaatcccgcaatcacaaaaccccctccgaggccggccggcccgggatcttatcccaaacacaacccacactactaccctacccgtccgcctctctcgaaagcgcagcaccagcgagcatgtcgcctgtcaccgcactcctggcgggcacggtggtgccgccggcctcggccccgtcgccagcgaggcacgcccgccattactccgtcggcttctccccgctccacggcggcgggcgcgcggcgctggcggtggagtgctcgtcgcggccgcagaagaaggggaccaagcaccacatgaagacgcggcccaagaagacgcagccgtgggacatcaagcgccgccccacgcagtacccgccgctgccgccgctcccgccggactggacgctcgtcgcctccggcgccacggtcgacgtggaggaggcggaggccccggcacccgccgcgactctcgtcctcgacgtggccgcggccaccgactgaggccgccgcggcgtgtcgccaaagttgttcccttgaacctccgcataagctgtttttctttgagatttattatataataacaatggctgcccagattttgtgattataaattaagaatctttcattgctgtccaaaaaaaaaaaaaaaaaagcccctaaggagtgcgttgctggcccctttcttggttgcatgctgtgtgcaacgcttattccatgccgtcagtggcagtgcagactgcagagtgattagctactccatctccatagtttgccagttaagttatgatgggatatggattacgcaaatatagtcttcaaaagggggggaaaacaagcagcccaacgaagacatctgcctcttgtttgactttaggagctggctctgtttgatttggacaattgcctgatattggggaaggttcggtaaacagtaaactcagcttagatggcaggaacagccatgaacactgcaaatgataggaaat

SEQ ID NO: 15256 - DNA, 1396 bp, Zea mays
aagcccattcgcgtcccgtcccgtcccgtcaaacaagcactcaaacctccctcccaagccctcttttttccctcgccgcggcgcaggcagagcagaggcagcagcatgccgccgttcgccgcccgcctggccgcaccggtcgccttggccgcgctgctgctcgccctcctgctcgcggcgccggcctcggccgccaacttcacctgcgccacggtgggcaaaacgtgccagtcggcgatcgggtacgcggtgcccaacgcgaccacgtacggggagctggtggcgcggttcaacgccaccacgacgctggcggagctgctgggcgccaacggcctccccgccacgacgccggcctcgacgccgctggcggccaaggccacggtgcgcgtgccgttccggtgccggtgcgggagcaacggcgtggggcagtcggacgggggacccttctacgtggtgtacccgctggacgggctggaccacatcgcgcgggaggtgttcggcgccttcgtcacctaccaggagatcgccaccgccaacaacatcaccaacgtcaacctcatcgtcgtcgggcagaagctcaggatcccgctgccctgcacctgcgaccaggtggacggcgccgacgtcatgcacttcgcctacagcgtcgccaagggggacgacccgcccggcatcgccgccaggttcggggtcaccgagaccacgctgctgagtgtgaataagatcaccgaccccaagaccagcctgcagcaggggcagatcctggatgtccccctccctgtgtgcaagtcatcggtcggcaacgcctcggctgactacaacctgctcgtcccgaacggcacctacgtgctcaccgccgacgactgcatccagtgcagctgcagcgcgagcaactacgagcatctagactgcactccggtgaaaggcggaaggtgcccggcggtgccgccgtgcagtggaggcctgacgctcgggcaggtcaacggcaccggttgcgcgtccaggatgtgcgcttacagcggttataccaacaccacgtccctcaccatacataccagccttgtgcctgcaaatgagactgcgtgccagaacggaggagctgcgagagcggagtttgccgggtccgtgttgaggacgtctctcatcgccttcctcatgtcgctgatcctcatctgcttgctatagacgttagagcagtagatggtgtattatatgccactgtcagatactcagattgctgttgtggtctattcattggcgattggtctagctgtttgaataaagcaaacattaaagtttgcatctgtgagtgaatacgtatttattagaattgggatgatccaataaagcattccatgaatggccaagtcctgcaaaaaaaaaaaaccgggcggcc

SEQ ID NO: 15257 - DNA, 1112 bp, Zea mays
  misc_feature (1)..(1): n is a, c, g, or t
ngagcattgggtccctcgaggccggccgggaaacaagcactcaaacctccctcccaagccctcttttttccctcgccgcggcgcaggcagagcagaggcactagcatgtcgccgttcgccgcccgcgtggcctccttggccgcgctgctgctcgccctcctgctcgcggcgccggcctcggccgccaacttcacctgcgccacagtgggcaaaacgtgccagtcggcgatcgggtacgcggtgcccaacgcgaccacgtacggggagctggtggcgcggttcaacgccaccacgacgctggcggagctgctgggcgccaacggcctccccgccacgacgccggcctcgacgccgctggcggccaaggccacggtgcgcgtgccgttccggtgccggtgcgggagcaacggcgtggggcagtcggacgggggacccttctacgtggtgtacccgctggacgggctggaccacatcgcgcgggaggtgttcggcggcttcgtcacctaccaggagatcgccaccgccaacaacatcaccaacgtcaacctcatcgtcgtcgggcagaagctcaggatcccgctgccctgcacctgcgaccaggtggacggcgccgacgtcatgcacttcgcctacagcgtcgccaagggggacgacccgcccggcatcgccgcccaggttcggggtcaccgagaccacgctgctgagtgtgaataagatcaccgaccccaagaccagcctgcagcaggggcagatcctggatgtccccctccctgtgtgcaagtcatcggtcggcaacgcctcggctgactacaacctgctcgtcccgaacggcacctacgtgctcaccgccgacgactgcatccagtgcagctgcagcgcgagcaactacgagcatctagactgcactccggtgaaaggcggaaggtgcccggcggtgccgccgtgcagtggaggcctgacgctcgggcaggtcaacggcaccggttgcgcgcaaaagtagtcggctcggattcttgcatcaccgctgatatggtcacgatggattcgaacacgaccgggaatggaaccagcataccgacgctcgttaagtgcacgacgcctacgatgttggt

SEQ ID NO: 15258 - DNA, 2672 bp, Zea mays
  misc_feature (394)..(394): n is a, c, g, or t
cagctggactaggtagtggggccgttcgtcagcgacagacgaaggtgcaaggaactgaccagtgggccatggctgtctgtgccatgccaggcagcagcggggttggccgcgtggaggaaaaaggccaggtgggctgaattgaggatggcggcccacttaggttagttttgttttcttcttttcttttctgttttcttttttttttattttgaattcgaaattttaaatttcaaattttgtggcaaatttgtactcaatttttggaggtatgattcaaacatgccatggtgagatgaatttatttatttataaatttattttgtattggctaaaatttctctctcccttttctattttccattttttttctaaatttaaggagtatttggttccngactaaagttacttatttaaggagtatttggttccggactaaagtttaatttgaatatcaattataaatataaaatataggattagttagatttaataaaaacgtcttatattttagtcttatctatataattaatattataatcaaaccacatttagtacccgtaattatgttgacagaggagcagcggcggcgggagacatgtttttgatttggatctaggcggggggaggggagagcaactcagaaagagagagcgggacggcaactttggttggcgccaagacgaagaagcctcgaccgtccgatctgtggattggctgccaggtgctatggatttccaattctacaattttttggctggcttccctcctcctccccccgccgcctgcaatttgggctgccgcctcccgccgaatccttcgtcgcctcccctccgtctttattactccgatctcctctccctgcctggacatccatcaatcctcatcgccacccaacccgccgagtccccaagcaagttgagcatccatccatccatggcgggaggcaagtccaccggcaatgccgcgcgcagcaggaagcgcgtcgaggcaaccgtcctcaagcgctccagggacgggagcgccttcaccagatggtaaccacctggcctgcctgcctctccaactctcccttcctcctctccctgctcgaccggaccgctatctgatgattctgatgcgagcgaatcccatcatgcatgcagcgaggcctgcaacaaggatgtccccgtcgtcctcatcgacatgcacagctgcagcctcgacgagaagatcaggatgacgctcgaggcgcaggtcgtcgagaagaccgtcgaggtcgccagtgcggaccgcaagaagtcctccgccaagggaggtggtaacaaggacgccaagcgcaagcgctcgcccaccgccttcttcctcttcatgtatgctgcagacgcagcgcgacacgcacattcgcgcattctcctttgttcctcgccctcctgatgtatacgcgtttcgttacatcgtcgatttatttcttccagggacgacttcaggaaggagttcaaggccacccatcctgacaacaagagtgtcgccaccgtatgggcttttctctacgcctcgcctgcattccattccattccatcttttgcttcatcccacccaatttattctgctaatcttttttttttctgttgattgaaggttgcaaaggaaggaggggagaggtggaagtccatgacagacgaggtaagtcctgaatctgaatctgtcgagtttccaactcttgctcttcattcattcattcacgctatgctgttcatttttctggaccaggagaagaagccttacattgaaaaggccgcggagctcaaggctgaggccgagaatggcgagggcagtggtgtaagtccatcttcttttctctgccttctcctctccttttgtgggcactgtcatgtgtaatctgtctctgccagctagtctgctactgctgctacctgtgtatttccctgatggcaattcggtggctgtgatgcaggagaacaatgttgccactaagaaagccaagacagatgaccaggaggtggatcagccagcaaagaagctcagaaagtgcaaggctcttcacgaggacgaggatgacgatggtgaccaggaagacgaggatgagaagaacgagttggatgacgacatgtagatggcagaggccactctcccatctctgtaaatggatggcagatgtgagcgtcttgttagaaatgtcacttgtttcaagctagagggaagagggagagtagtcagtagtgaatatcccccgttatcgttgctacatgaatgaactattctatgatgcagttctgtctgctttcatctccaaaaaacaaatgtactcaatgcccttttcttttctggcattgtcctatattacatccattgctcctgcccctagaattgaaggttggttcatgtttggtggaagactaaaaaggacaaaggaaggaggcgttgtatcagtagcaccgttgcctagttacattagcatcaccatcagcatcaaccaaacagtacaatagctgcatttcacaaacatattatcggaatacttaatggtcctagttttacaatacttgcctagattattagaatcctcggatctgtactttaccggacggtcaccaaaatacttagcttaacatactagtaaaatatgaaattcttctaacgatttttagaatgcatactaccctccactttag

SEQ ID NO: 15259 - DNA, 1044 bp, Zea mays
tcgtgtcagtggctcccgccggcccggcccggatccatcaatcctcatcgccacccaacccgccgagtccccaagcaagttgagcatccatccatccatggcgggaggcaagtccaccggcaatgccgcgcgcagcaggaagcgcgtcgaggcaaccgtcctcaagcgctccagggacgggagcgccttcaccagatgcgaggcctgcaacaaggacgtccccgtcgtcctcatcgacatgcacagctgcagcctcgacgagaagatcaggatgacgctcgaggcgcaggtcgtcgagaagaccgtcgaggtcgccagtgcggaccgcaagaagtcctccgccaagggaggtggtaacaaggacgccaagcgcaagcgctcgcccaccgccttcttcctcttcatggacgacttcaggaaggagttcaaggccacccatcctgacaacaagagtgtcgctaccgttgcaaaggaaggaggggagaggtggaagtccatgacagacgaggagaagaagccttacattgaaaaggccgcggagctcaaggctgaggccgagaatggcgagggcagtggtgagaacaatgttgccactaagaaagccaagacagatgaccaggaggtggatcagccagcaaagaagctcagaaagtgcaaggctcttcacgaggacgaggatgacgatggtgaccaggaagacgaggatgagaagaacgagttggatgacgacatgtagatggcagaggccactctcccatctctgtaaatggatggcagatgtgagcgtcttgttagaaatgtcacttgtttcaagctagagggaagagggagagtagtcagtagtgaatatcccccgttatcgttgctacatgaatgaactattctatgatgcagttctgtctgctttcatctccatccaacacatgtactcaatgcctttttcttttctggattttctatattacatccattgctccaaaaaaaaaaaaaaaaggggcggccgcctccgcggggggaataaaaaggacaaaggaggcgttgtat

SEQ ID NO: 15260 - DNA, 738 bp, Zea mays
  misc_feature (24)..(24): n is a, c, g, or t
cggacgcgtgggcggacgcgtggngaaaggaaggaggggagaggtggaagtccatgacagacgaggtaagtcctgaatctgaatctgtcgagtttccaactcttgctcttcattcattcattcacgctatgctgttcatttttctggaccaggagaagaagccttacattgaaaagccccccgagctcaaggctgaggccgagaatggcgagggcagtggtgagaacaatgttgccactacgaaagccaagacagatgaccaggaggtggatcagccagcaaagaagctcagaaagtgcaaggctcttcacgaggacgaggatgacgatggtgaccaggaagacgaggatgagaagaacgagttggatgacgacatgtagatggcagaggccactctcccatctctgtaaatggatggcagatgtgagcgtcttgttagaaatgtcacttgtttcaagctagagggaagagggagagtagtcagtagtgaatatcccccgttatcgttgctacatgaatgaactattctatgatgcagttctgtctgctttcatctccatccaacacatgtactcaatgcctttttcttttctggattttctatattacatccattgctccctgaaggttggttcatgtttggaagaataaaaggacaaaggaggcgttagatcagtagcaccgttgcctagttacattagcatcagcatcaaccaaacagtacaatagctgcaaaaa

SEQ ID NO: 15261 - DNA, 2766 bp, Zea mays
cgagtgggaatattgacttgtaaattgatagggcagcagcgtaggattttgattgcagtagtcccacctatgtcgatcaagaattgtttgttgttagtgttattggacaagtttgagcacccacgtatgagctgaatgagaccagaaaattgatgtaccttcttaccataatgactaatttgtgagtttaaaacccggaggagattggatggactaaaatcctctctttatttaaaattgaataagaaggagattttagtcccttcaatcttctccggttttgtggtttctaaattagatctaagggtactagctcaatcgtcgctcttaagacgacaaacttattttgtatgaagaaaaaattatgagtagatttatattcataatgtgtttaagatgatattgataccttaccaacgggaagccattgtcgcatttcggagccaaatgagcaataagacgattgactggtcacctacctccagttgcgccgcacacgagagatatcccgtcgccgttggagcatccgttcgtgacggtgacgtggcttgaacatcacgggcctcacggaacggagtctctaatcccagctccggaaagacaccagtgtctgtccctcggataccgatccaacggccggcaggagcgtctgggtgtcggtcatcgccggaagcggcaaaggaacgcccggcagaaccgcattcaagtgcggtccacggtggcgtcggatggcgaagcccagcccacagcccaggactatcctctcaaatgccttgcagaatcttcgaaatgcccccctcaccttatccgtcggcgcgtcgccttttgacgtggtagcccgtcgcctcggccctcggctactatgccctgtgcgagtgcgatctgcgatgcacatggacaagtggaagcagacacaacgttcgtttcagtggcctctgcagatccaggaacgaacccgagaggcaaacagaacagtgaaaagggatggttcagcggggccccggatggcagcctcaaacggcgctgccatcgtccccactcgccaccggtgctcgcctcgtcagtcgccaagaggccagcactgtccagcctggtgtatcaccatgccagacgcacctaccgtccagcgtccgagacgagacctcaccacacctgcctccctcgccgccccatagtttaattagccaggctagcagtagcagctgtggtcgtcctcgcttgcttgcttgctaccagggtttgtgtgagtgtgttagtgagagagaaccatggcgacgcagcggttcacggcggcgctggtggcctgcctcctcctgctcctggcgctgccggcgcgcgggcgcaacatcacggccatcctcgccgggtacaaggagtacaagctatacaaccagtacctgtcggagacgaaggtgtgcgacgagatcaactcgcggcagtcgacgtcgatgtccgtcctggtgctgtccaacgacgccatgacgacgctggcctccgacgccggcgactcgctccccgccatcaagaacgcgctgcgcctccactcggtgctcgactactacgaccgcaagaaggtgaagaagtacggcgacgagagcgccgccacgctgtaccaggccacgggcgacgccgccagcaccacggggaacgtcaaggtggtggaccaggaggacaagaactacggcttctcggccgccacgccgggcgccaggatctgcaccgtcaccaaggaggtggagacgcaccctttcaagttcgccatcctcgaggtcacggcgcccatcgagttcgacggcctcttcgacaccccctccaccgacaacctcacccgcctcctggagcgcgccggctgcaaggtcttcgcgtcgctggccgcctccacgggcgtgctcaagacgtacgaggccgccatggacaagggcctcaccctgttcgccgtcaacgacgacgccttccaggccaaggacgcgcccgacgtcaaggccatgtccaaggccaacctcaccaagctcctccagtaccacgccctgccttcctacaacaccaagacctcgctcaagtccgtcaagggcccgctccgcacgctggccgccaaggccgacgtcacggtggtcgccaagggcgacgacgtctcgctcgacaccggcaagagcaggtcccgcgtcgcgtccaccgtcgtcgacagcgtcccgttctgcctgctcaccatggacaccctcctggtgccgccggagctctacgtcggcgccccggaggcggcaccggcgccggcgccagcggacgcgccacaggggtccccgcccgcggcggacgccccgtcggtggccgcggaccacgccgaccacaagtccaagaagccgtcggcgtcgtccgccgtcgcgtggcgaccggccggcgcgctcgccgcggtggccgtgtgctccgtcgtgctggcctccctcttgtgatgcattgttgcttgacagctcctccgacctctgcttcctccgatccaagcagatacccgtttctctgtgatctctctcccccgctctgttccggtccttgcttcattgaatctgttggtgcattgccatttccacatgtaatttgagcaaacatgtacatttcccccttttttcatgatagtttcagaacacaatattctaagcagctgcgccattccatttcgcgcaacggctttctctcggatcctgagacccattcatgtagtgaaaggagaagtcaaacgagaagaacaaatctgaaagctaagatttttttttt

SEQ ID NO: 15262 - DNA, 1435 bp, Zea mays
cattgggtacctcgaggccggccggggatcagagcccaggaggacgtgcgcacgcgcggctcggcagcgtcctctcgtcagccgcgtccaggataacattcggtgcctcccgggaggccggccgggactggcgtgcggccgagccaagcgggagtagcgcgtcaggcaatggctccggcaccggtggccgctcccgtggcttcggtctcccgcgcggcagctgcgctcgcccccgccggcgccgtccgctccgccagggtagcctccctgcaccctttccactcttccaccaaaatcgtgctgctgccaccacggaccggcctgctcagatccgccaggcagaggcggcgcttggcggcacggagcagcacctcggagagcagcacggatgactcccaatccccgaaacaagagaaggcgccgttcgggtacacgaggaaagacgtgctgctgatcggcctcggcgtcaccgccttcggcgtcggcctcaagtacgggctcgagctcctgggagttgaccccttgcaggccggcaacgtcgtgcagctgctggtggtgctcgggatgacggtggggtggatctccacctacatgttccgggtggccaacaaggacatgacctacgcgcaccagctcagggactacgagaagcaagtcatggagaaacggctggagagcttgtcggaggctgagctgcaagctctgctcgagcaagtggaggaggagaagcagcgcgtgcctcaggtcccggaagagcctaacgctattaccttcaggaagaaatgatgatcgttctattatctgccaaatggacaccgacctagcttgtttatagcatagcttcgccttcaatagctagctccatcgatattttaagatctgtacaatacgccccgctaagccactagtgctgtcaaacatgaaattatccattttctgccgcgcgccgttatgggacaataccgtagcaccaagaaccaaatccgttctttgagatatcattgtcgttgtaactatatcatccgcaaagctacagtttgggaggtcttcagcattgcctgtttgatcttccattggttcgttgcattgcgttatgatcacgattacataagccaggcaaacactacacaaaacataccaatttccgaaggccacataaatttctgaaggtttctaagataatcgtcgaacatatggtatttttttacggccatcgaaaatatcgtcgtcgcatagagtcgtcaaaaataagcttatgtttagagtcattaaaaataagcttatgttcaacggccctctgtgagcgccgtcagaagttaggtttcacggagttatcctaactcacaacatagaccatccgcattctattgttctcccaaccgtatgtagttcatgtcacagcctacaaagcatcaatttatgataatccatgaac

SEQ ID NO: 15263 - DNA, 1523 bp, Zea mays
  misc_feature (82)..(82): n is a, c, g, or t
  misc_feature (594)..(594): n is a, c, g, or t
cattgggtacctcgaggccggccgggaggggggatccatataggaaaaagcggggtccgccccgccccccgccgttcttttntggttccccactcctcagtccccgccgccgccgaaacccgcagatggaggtcgtcgtcgccgcgaagcagaaggcgaagaaacacatacacctcttctactgctcggaatgcgaggagctcgccctcaagatcgccgccagctccgacgccatcgagctccaatccatcaactggcggagcttcgacgatgggttcccgaacctgttcatcaacaaggcgcacgacatccgtgggcagcacgtggcgttcctggcctccttcagctcgccgtcggtcatattcgagcagatctccgtcatcttcgcgctgcccaagctattcatcgcctcattcacgctcgtgctgcctttcttccccacgggctcattcgagcgcgttgaggagggaagggcgatgtcgccaccgcgttcaccctcgcgcgcattctctcgatgatccccaagtcgcgcggcgggcctaccagcgtcgtcatctacgacatccacgcgctcccaggagaggttctacttcngggggacgacgtcctgccatgcttcgagacagggatcccgctcctgctgcagcgcctccgccagctcccggacgcagaaaatatcaccattgcctttccagatgacggttgcggtggaagcggttccacaagctgctacagcactttccaatgatagtctgtaacaaggttcgggaaggtgacaagagaatagttcgtataaaggaagggctacctgaaggccgtcatgttgttattgttgatgatttagtgcaatctggggggactcttagagaatgccagaaagttctagctttgcatggcgctgcaaaagtcagtgcttatgtgactcatgctgtgttccctaagcagtcatatgaacgtttcatggcgtctagttctgctgggccaggcgaccaatttgcttacttctggatcacggactcatgcccacacacagtaaaagctattgggcaaagacctccatttgaggttctgagcctcgctggctctattgcagatgctcttcagatatgagcgtacactggtagatgggcatgggcttgaattgttgatgtccaccagattgaaacttgtactatgagaggtggaatgctcccgcttttcctaaatgtaagagttggtttccagttcctggaaaagcaaataatgtgtagtaagttaaattaagtacctgaaggttccataaacagccctgtggtttgtaataaaaccaggcattggatactcaattgttgacagctgcgtatctgtcaatgttcacttctgtttgaagtgcgcgagaccagtgctttactttcctgacccgtcggagtatcggtttagcaacttcaggtactgggctttgttgtgaacaaatagtgcaatgtaactgaacttgaacctaattgaatttctattagattggatggtcatattgcaaccatgac

SEQ ID NO: 15264 - DNA, 1627 bp, Zea mays
ctcgaggccggccgggaggccgctttgattctctagcgcggctggggactgggggtctagggtttaggcttccaaaaatcaagcaaagaaaatattcgcagtgttgcgcacttcgcgtctcgataaagccgttggggcccccccgcccgccaggcgtcaaagcagagtctgcccctccccgcgccgttctttttggttccccactccccagtccccgccgccgccgaaacccgcagatggaggtcgtcgtcgccgcgaagcagaaggcgaagaaacacatacacctcttctactgctcagaatgcgaggagctcgccctcaagatcgccgccagctccgacgccatcgagctccaatccatcaactggcggagcttcgacgacgggttcccgaacctgttcatcaacaaggcgcacgacatccgtgggcagcacgtggcgttcctggcctccttcagctcgccgtcggtcatattcgagcagatctccgtcatcttcgcgctgcccaagctattcattgcctcattcactctcgtgctgcctttcttccccacgggctcattcgagcgcgttgaggaggagggcgatgtcgccaccgcgttcaccctcgcgcgcattctctcgatgatccccaagtcgcgcggcgggcctaccagcgtcgtcatctacgacatccacgcgctccaggagaggttctacttcggggacgacgtcctgccatgcttcgagacagggatcccgctcctgctgcagcgcctccgccagctcccggacgcagaaaatatcaccattgcctttccagatgacggtgcgtggaagcggttccacaagctgttacagcactttccaatgatagtctgtaacaaggttcgggaaggtgacaagagaatagttcgtataaaggaaggactacctgaaggccgtcatgttgttattgttgatgatttagtgcaatctgggggaactcttagagaatgccagaaagttctagctttgcatggcgctgcaaaagtcagtgcttatgtgactcatgctgtgtttcctaagcagtcatatgaacgtttcatggcgtctagttctgctgggccaggtgacagatttgcttacttctggatcacggactcatgcccacacacagtaaaagctattgggcaaagacctccatttgaggttctgagcctcgctggctcaattgcagatgctcttcagatatgagcgtacactggtagatgggcatgggcttggattgttgatgcccaccagattgaaacttgtactatgaggtggaatgctcccgcttttcctaaatgtaagagttggtttccagttcctggaaaagcaaataatgtgtagtaagttaagtacctgaaggttccataaacagccctgtggtttgtaataaaatcaggcattggatactcaattgttgacagctgtgtatttgtcaatgttcacttctgtttgaagtgcgcgagaccagtgctttactttcctgacccgtcggagtatcggtttagcaacttcaggtactgggctttgttgtgaacaaatagtgcaatgtaactgaacatgaacctaattgaatttctattagattggatggtcatattgcaaccatgaaaaaaaaa

SEQ ID NO: 15265 - DNA, 2214 bp, Zea mays
gcatgggattgacccacacacccgccctccgccccgcaagccaaatacgccgtggcacgcgtcgccatgccgccccagttccccaccgcccgcctcctcctccctagtcacaggctgctcccgctcctctcccctctcccctccgcgtccctgtcccctgctcctcgcaccctccgcctcccgccgccgcagcttcttcaccgagtcgcccgccgccgcccgctgctgcgcggcatggcctccgccgccgcccccgggtcacacgccgccgcggaagcgccccccgtcgacgtggggggagggggcgctggcgccccgcggcggctcgtcctggaggagctaccctgggaccattccttcgtccgcgagctgcctggcgacccgcgatcggacactatcccgcgggaggtcctgcacgcctgttactccagggtgtctccctctgccaaagtggacaaccccaagctggttgcgtggtctgattccgtggccgatctactcgatctggatcacaaagagtttgaaagacctgatttccctcagtttttctcaggagcaactccactagtggggagtttgccctacgcacagtgctatggaggacatcagtttggtgtatgggctggtcagttgggggatggaagagcgatagctcttggagaggttgtcaactctcgaggtgagagatgggagttgcagctcaaaggttgtggaaagactccatacagcagatttgctgatggtcttgctgtcctacgcagcagcatccgtgaattcttatgcagcgaagccatgcacggcctaggcattcctacaactcgtgctctttgtctagttgaaactggaaaatcagttgtccgagatatgttctatgatggcaatgcaaaggaagaacctggtgcaatagtttgtcgtgtagcaccgtcttttttacgttttggttcgtatcagatacacgcttcaaggggcaaagaggacattgagattgttcgtcgtttggcagactacacgatacatcatcactttccacatcttgaaaatatgaaaaagagtgaaggtttgtcattcgagacagctataggagattccccaacaatagatctcacatcaaacaaatatgcagcttgggcagttgaggtggcggagaggactgcttacttgatagctagatggcaaggtgttggcttcacccatggtgtacttaacactgacaacatgagtgtgctgggcctaactattgattatggaccatttggatttctcgatgcatttgatcctagctatactccaaatactactgatcttcctgggaagaggtactgttttgcaaatcaacctgatgttggcttgtggaatattgctcagttcactggaccactgtcctctgctgaacttatcagccaagatgaggcaaattatgtgatggagaggtatgggacaaagttcatggatgagtaccaatctatcatgaccaaaaaactgggcttaactaagtataataagcagctaattagtaagctgcttagcaacatggcagttgacaaggttgactataccaacttcttccgtcttctttcgaatgtcaatgcggatcctggtattccggagaatgagctgcttgtcccactgaaggctgctctcctagatattgggaaagaaaggaaggaagcatggattagttgggtacagacttatattgaagagctggtggagagcggcgttcctgatgaagaaaggaaagccgcgatgaactctgttaatccaaagtatattctccgcaactatctctgccagtctgctatcgacgtagctgagcaaggcgattacgaggaggttcggcgggtgcttagggtaatgcagaatccgtatgacgagcagccgggaatggagaagtatgcacggttgccaccagcctgggcatacagacctggagtgtgcatgctgtcctgctcctcgtgaaccccatgatgcaagacgtggacactacaaaaatgcttgggtgcttatagtcttcctcctgtataggggtccatctttgtgctgtaatgtgtcaagcatcgcatgctatttttttcccggtgatgcaagtgtgtaagaaccatgtcgttgcaggaatagtgaagcagtgggacctgttattgtgactacctaaaaaaaaaaaaaaacggagatggaaatttggcggtttactagtctatatagtgaagctctggc

SEQ ID NO: 15266 - DNA, 1710 bp, Zea mays
tacttatcagccctctctcttcttcagaaaccttccactgtttcaagaaaagcagacccaaaaaatactaaagtttgcaatggggcttgctctgcccccagcccctcccggcacttattgaatcatcatggcaagtgcaataactcaaagaaaaagagtcctttactgaatcatcatggcaagtgccaggattgctcatctaccaaattcaatggtgctagtttgaagctcaatgtaagaaaggaccgttctaaagctaattcaaccagaggttcaagtggttggatttctataaaagcacgtacttctgattggaactccagagaaatggcaaaaaagcgacgtctatcagaaaatgcacaaactgctttgagtaatggtggtgatgatccatttgcatttgatgataccgatcaagaaccttcaaattgggatccatttggtccaaaaaggaaatcaccacagaagcgagcgaaacgatctaatggtgaactagtgctggatgattgtgacactgcagtaacgggaagtcctgaattatgtcaacctgaaggtattaatcagtcaggtgcaacttctgattctaaggctgcagatgagtccaaccttttagaagattgccttttggcatcagttaaggttcttatgaacttggcaaatgacaacccttctggttgcgaacaaattgcgtcatgtggtggaattaatacaatggcctccttgatcattaaacattttccctcatttgatttctccatggacagtaacaatcaaatgaaagaaagagtatcctctggtgatctgtcgtcttcccagaacagcaagtcactccaaatcaaaactaagcaattgcgagcctatgaacttgattttctggtcgccatattgggattgcttgtcaaccttgtggagaaggataaccttaatagggtacgacttgcgaatgcccgtgtttctgtcaatctatctcaaagtccagatactgaagaggtacagagggatgtcataccccttctctgttcaatattcttagcgagtcaaagtactggggaaactgctgaagctatatcaccggatgacgaagaatctttgttgcaaggagaacgcgaagccgaaatgatgatcgtggaggcctacgcagcacttgtgctcgcctttctttcaacggaaagtatgaaggttcgaggagccatttccagctgccttccggacaacaacttaaaagttcttgtaccagtgctagagaagtttgtggtatgtccccaaaatttctagacgttctgtctgaagcaacggtggatagatacatggactgccactttttgggaaccatcatttcacctgcagctcaacatgatgacaagggaaacacattcagctgtcaccgaatcattgaaagatgcaggcagtcatagaagttggaagaggccgccctgtacagattaaccgacctctctgcagtgcagccgaagccacacacaggtgttgctcctcacctggccagggcgcaacgaattgattgatgccagaggctgccttgggagctaacagtgtttctattctgccctttgcccctcctgctgttctgatcctgtcatgtgcatctcctttagtttcttctccacacactcccccccggaaatcatgtagtccatattatgagtggaacaataacagtgtaggctatagggaatgtagttgtggtgcttc

SEQ ID NO: 15267 - DNA, 5362 bp, Zea mays
  misc_feature (170)..(170): n is a, c, g, or t
ggcaggcaaggtttgtaacttaatgtttttgcaacatcttttctttttgtcagttttctgtttcttgctaccttaactacacatttttctgcgtgcagttcattaaggcctgtgaacttaaaggtcattctgattggatcagaagtttagatttttctttacccgtgatnatggacggtgaaaggcacaaccttttccttgttagctcatctcaggacagaaccattcggatatggaaaatgacttcagaagctgctgcttctggctcctccttacaattgaggaaagaaactattgagatgacctcctatattgaaggacctctatttgtggccggcagtacaagctatcaagtatcactggagtctcttcttgttgggcatgaggattgggtatattccgtagagtggcagccacctacattgttaattggggatgaagctcatcagccaatgagcatattatctgcatccatggacaagatgatgatgatatggaggccagagaaaactactggcctttggattgattcagtgactgttggtgaattaagtcactccgcacttggattttatggtggactttggcagcctgatggcagatccattctcgcacatggttacggtggatcctttcatatgtggcgagatgttggactggattctgaaaattggcagcctcagatagtcccgtccggtcatttcgcacctgtgtctgatttgacatgggcaagatctggccaatatttgctatcagttagccatgaccaggcaagtttctctacttaatgtcagttttgactcatttctagaactcatgtttgtttagttgttgcgttctctctaatgctgttttacatcaatgctaaacatgcagacaacacgcatatttgctccttggagaaatcaagttaaccctggagacatgatctattggcgtgaaattgcccgtccgcaaattcatggtcatgatctcaactgtgtgacattcattcagggtagtgggaaccatcgttttgttagtggtgctgatgaaaaggtctctagagtctttgaagctcccttatcatttttgaagaccctacaacaagcaactctgttgaaacctgacatctccgaggattttgacaatgttcaagtccttggagcaaatatgtctgctcttgggctttcacagaaacccatatatacacatggtcagtatctctcacatgacccatctgtatgtttaattgaacaataacatgtccttttatttggcatgaaaaacggcacttctatataatcgagctcttttccttttatttgatgttgcttttttgcatggtggtgtatcaggagtcaaggaatcctcaatcagtaattctaacgatggtccagattctatggagacaattcctgatgcagtgcctactgtattcactgagcctcctgtggaggaccaacttgcatggaatactctatggcctgaatcgcacaaactatatggtcatggaaacgagctcttctctatatgctgtgattatgagggggagcttgttgcttcatctttgcaaggtatgggcgctgcatgttttcctgtgctaatcgtggaaattgttaatagagcaacaacaatacaaataatcacaagcatcttgtgatctgatggaaacacttgtgatgttggcaaaaaaatgttgtcttgttttttggtaataattgacatgttgacataattacatcagttgatgctggatatgcttaattattaatggtttgattttactgtatgcatgggaaatatgatggaatttcactcccattcaggctcaatcagcagcagttgcagagatctggctctgggaggctggaacatggaaagctgttgcccgctcgcactctcacagtctaacagtgacacaaatggagttctctcgtaataatgcgtttcttttaagtgtttcgcgggatcgccatttgtctatcttttcaatcaggaaaactggtaggcataattcttatgataatgtagttcctttgaaattatttcataacatttgtcttttcactcatgctgtttcatttgtgctggagctgatatgatatcacttgtgtaattctagaaggaggagcagagcatcgtctggttgcgaagctcgaagcacacaaaagaattatatgggcatgctcatggaaccccttcggctatgaatttgcaactggatcaagggacaagagtgtcaagatatggtgtgttgaagatgcatcttctgtcaagctacttgcaacattgcctcagttccgtgacagcgtaactgcattagcatggatgggccgtgaccgtgcttctaatgctggtatcgtcgctgctggcatggacaacggattgatcgagctctggagcgtttcaggtggaagagcttcttcaggaacccagctcagcgtggcatgcgtgcttcgatttgaccctctcttgtgtcacgtgtcaactgttcaccgattacggtggcggtgctcaaccgatgagaaatcgacacttgagctcgcgtcttgtggagctgatcacactgtaagggtgtttgaggtctgcggcagcatataggtttatgtccaacctagtaaatcaaaactgttatgtgcgtggcaggtttttattgatatcggacaccgttgggttgtaaaactagtcctggagaatcgagaaaagagtgttttcatgaagcatgtgctgtccatatgtaaccccagtttagtggtaatagattcagtgttgccctcatttgagaagctatgaaattatggttatagatggtgatgtatttgctaaatcacctatatccaaaactctgtgtatcatctcaatctgcaatcaatacaaattcgagaaaaaaaatccactgtaccgcttacactcaagcaaagagttctatgctgtacattacacactttgttgaactctgttcaggttgcttacgatctaagctactgacctactgtgtgttgtgcagctagccactaggacgcagcaacaactgagcagccaagagatcgacaaagctgaagaaccaacttcgaattcacatgaatcaacaataggtatgttccgctgttctcgggccatttccatcatcagtataaaaaatagctaagatttgatatataataacaaaagaaaacgaggggattttttctagagccagtcattttgttgtgcatctccgggcaacaagaactccagaaggaggggcagtgagttccagctgacagaccgtgtacatccagtacgagtagtggccgaacctgaacctggcctccactttgaaggcgcctctgatcgtgtacaccaccctgttgctcctcacctggtccaccatctttaccgccacctggggcggcagcaggacccggctggagagcaggtgcatgttcaggagctgggactggcctcgccgctgcgcgaacggaggcagcgcctgcacggccatgggcctgtcctggaagaagagctcgacagtggcggaccggaacaccaagtcgatctcccggttggggttggagacgttggcaacgagcgtcatgtcgttgttgaagtagggggccggcgagtccacgtagacgctgttgaggatggcgttggcggcgtcgaaggacggcggcctcggcttcaccgccaggaagacgaccagggtgacgacgcctgcgacgatgaggaggatgctgaaggcgaagcaggcgatggccgcgcaccacatcgccggcgaggtccgctggcgcggttgcaggattaccttggaaggcgcccgcgctggctgccggggcgcctgtggctgcctggttatcgtgggtggatccaccggctgcgaccgtggcagcaccggtgtctgctcggtcacctcggactgatccaccggcggcggcggcagctgtggcagggccggtggcagctgcttcatgctcattaccttggttatgatggttcttggtgattggaggtggtagggagcgcccatttcggcaacgccacagctaccaagtccaacaaggcaaagaagctcaagagtgcagagaggcctattgggggaaagcaagctagagaagagcagcaacaacaacagcaacgagaggcagccagggaatggacaatggagtggtggagttaaaaggagtctgatcgattgagcctagtggtggtgtacctccttccaaaatacgtaaagagagagaggcttcgagcgtggggccactgtctcgtgttcctccactgaaaaaaatagagctgcttccagcaaaggtgtggggtgggacagcgttgccggctgccagcaattgatttgttatcttagaaaagcatatttcttaaggtggacaaaggtaaagcttgggttattcttggcactaacaaatagtagtactaatctgatgctcggtgtttcatgattgtcgcttggaatgtgctgttccctaccaacacatgcatgcccagttgaagcagtgggtcgtctgcccatgctttcgtcgtgcagtttttaagattggccaagcagattttaagattggccaaaggtgaagaagaatcaagcaataaaatgtgttacaatcgttgatcttcctgttgacgaagcagaggcgaggtgagatgagaagcagagaaggaagggacaagttgccgcttagccatggaaagaaagaaagaaagaaagaaagaaaggcgctcctggaccagttccgtttcgtctcgaatcgaaataaagggcagcagctatggggggttaattcatgactaaggaacccagatgtgctgacacaaagaccggcctcctgggggggacatccatccatggcttttctttggtgcagtgccgtagtgcccctgcttttgtctgcgacgtcgtcgaaagcagatgccgcactgcgcggctttacatgggtatcttcgcctcctttcgtggcaattaatcttttgtacccagcgcaaaaaaattgatgaatataacattaacttgcatcactcagtgattaacatattacaaataacgtaaacatagacaaaaataacaccactgtacttgttgctcctgatacgtcggcccaagcaatcaagaccaagtgacacggcccaagcaatcaagaacatgtcccattcaacaatcggatgaaggtattactgtaatatgtccattcaacaaaggctaggacctaaagtatgttcgtaactttggttattttaattattttggattttttttgtaaagctaataaaagctctacaacttagagctgaaatcacgtcaaatcgaggacatccaaaattatgagataataccaattcatccaccttacggagaaaaaaaaagaattttaactattatataattttttta

SEQ ID NO: 15268 - DNA, 3294 bp, Zea mays
  misc_feature (3224)..(3224): n is a, c, g, or t
  misc_feature (3243)..(3243): n is a, c, g, or t
  misc_feature (3258)..(3259): n is a, c, g, or t
catctccagcccccgcgccgctcctcatcttacctgggctagctacagcgacacctgcgtgggtggtggtgtccgactacttcattactcactggccgtccattgcagccctaagcgcggttcccttccagctccgctgcggggagcctggtttcgctcgtgatgtcgccggccgccggagagcagctctctggagcccaccgagagggcagggccgtggaggcgcggagggtcttcataggcgccggctgcaaccgcgtggtgaacaacgtctcgtggggagcctgcggtctcgtcgccttcagcacccagaatgccgtcgccctcttctcccccctggtatgccggccttttcctgcagttttgattaccagatgagtatatctcacttgttcgtgtcacccaaatcgtccaaacacgtgttcgtgcgagcagagaggtgagatcgtgacaactctcccggggcacaaagcgccggttaactgcacgctatggcttcccacgaagaaggatgtgctccatgttcgaggtagggagacacactatctactctcaggaagtgctgacggtactatcatggcttggaagattggttctggcaaaggagagtggtttcatgcgttgcagctcccaggaatgcataagaaagggatcacctgtcttgctggaaggatggtgtctgatactattgcaatttttgcttctacttcttcggatggtattgttgttatttgggagatggcaattgagcccaccactggtggtaagattgcttccttgtggattgccaatattactgctaggagcctaatattttgtcatgatggtttaaactattcaaactctaattcttttttattatatgattttgacggttctgggtaatgtgcactacacttctacttaagttatttgctttctcttcgcaggcgattgcaaagtgacttgcttgcattctctgtccgttggtttgaaaccaatggtttcactttcattagctgtattgccaggacaaggaggctatctcattttggcgatgggcggtttagatcacaagatccacatctattgtggggataaggcaggcaagttcattaaggcctgtgaacttaaaggtcattctgattggatcagaagtttagatttttctttacccgtgatgatggacggtgaaaggcacaaccttttccttgttagctcatctcaggacagaaccattcggatatggaaaatgacttcagaagctgctgcttctggctcctccttacaattgaggaaagaaactattgagatgacctcctatattgaaggacctctatttgtggccggcagtacaagctatcaagtatcactggagtctcttcttgttgggcatgaggattgggtatattccgtagagtggcagccacctacattgttaattggggatgaagctcatcagccaatgagcatattatctgcatccatggacaagatgatgatgatatggaggccagagaaaactactggcctttggattgattcagtgactgttggtgaattaagtcactccgcacttggattttatggtggactttggcagcctgatggcagatccattctcgcacatggttacggtggatcctttcatatgtggcgagatgttggactggattctgaaaattggcagcctcagatagtcccatccggtcatttcgcacctgtgtctgacttgacatgggcaagatctggccaatatttgttatcagttagccatgaccagacaacacgcatatttgctccttggagaaatcaagttaaccctggagacatgatctattggcgtgaaattgcccgtccgcaaattcatggtcatgatctcaactgtgtgacattcattcagggtagtgggaaccatcgttttgttagtggtgctgatgaaaaggtctctagagtctttgaagctcccttatcatttttgaagaccctacaacaagcaactctgttgaaacctgacatctccgaggattttgacaatgttcaagtccttggagcaaatatgtctgctcttgggctttcacagaaacccatatatacacatgcaggagtcaaggaatcctcaatcagtaattctaacgatggtccagattctatggagacaattcctgatgcagtgcctactgtattcactgagcctcctgtggaggaccaacttgcatggaatactctctggcctgaatcgcacaaactatatggtcatggaaatgagctcttctctatatgctgtgattatgaagggaagcttgttgcgtcatcttgcaaggctcaatcagcagcagttgcagagatctggctctgggaggttggaacatggaaagctgttgcccgcttgcaatctcacagtctaacagtgacacaaatggagttctctcgtaataatgcgtttcttttaagtgtttcgcgggatcgccatttgtctatcttttcaatcaggaaaactgaaggaggagcagagcatcgtctggttgcgaagctcgaagcacacaaaagaattatatgggcatgctcatggaaccccttcggctatgaatttgcaactggatcaagggacaagagtgtcaagatatggtgtgttgaagatgcatcttctgtcaagctacttgcaacattgcctcagttccgtgacagtgtaactgcattagcatggatgggccgtgaccgtgcttctaatgttggtatcctcgctgctggcatggataacggattgattgagctttggagcgtttcaggtggaagagcttcttcaggaacccagctcagcgtggcatgcgtgcttcgatttgaccctctcttgtgtcacgtgtcaactgttcaccgattacggtggcggtgctcaaccgatgagaaatcgacacttgagctcgcgtcttgtggagctgatcacactgtaagggtgtttgaggtctgcggcagcatataggtttatgtccaacctagtaaatcaaaactgttatgtgcgtggcaggtttttattgatattggacaccgtcgggttgtaaaactagtcctggagaatcgagaaaagagtgttatcatgaagcatgtgctgtccatatgtaaccccagtttagtggtaatagattcagtgttgccctcatttgagaagctatgagattatggttatagatggtgatgtatttgctaaatcccctatatccgaaacagggggtatcctctcaaaatgnacaaaatacaaattcgatnaaaaaaaattaaaannagggcggcagatataaaagctccgagcttaagtcg

SEQ ID NO: 15269 - DNA, 2149 bp, Zea mays
  misc_feature (283)..(283): n is a, c, g, or t
tgtaaatatgtttaggaccgtcagtatagagcttatctgtactagtgttaagaacatggtcaccgacgacgaaatgtattattatacccttgaagtagtactagtgcaaatgcttgggcctaggctttagagctgatgcacaatgtgcatgaaggcacatgcgacactgtattaattaggagctcgccgacacacaccaaggctcactagataaagtggttaattaggaggtccgattactattggccgacacttctgctagaagatttatgtctacgagaangtcgtcgccgagtgtgagtgcgagcacgacctaaacgtcgagaccctctctgaccccacggtcgtgcgagtaacgataatctttgccaaagtaggtatggaaaagcgcgttaaggtgctagtagtgtacgggtgtacaatatctgaagatcgttttacggcattattctcacaactccatgttcttcatctatatatcatgatatatttttattcttgacgtaaaaaatgttatacaaaaataaataaataactctacacccctgctacacatcgcagaaagcacgtccaatatctcaccaagcatctaggacgtgtcccttgatccgcgcgcatgaggccacgcgagacacacaagtactattggcttttaggggatgcatgctgtggttctcgtcgccaactcgaacacgcaacgtggacaaaaagtctctgaatataagataacgcttgcgtcgtctggaggcgccacgcagcatctagacgcgtcccatgcacgcttcagcagttgcatgcccctcccccaggccaggtggacacaatacacgaacacatcgcatccaaactcacacacactgaagcagaagtcggcacgacgaactataaaaaacaagcaggaccacgccaccagaagcccaaatacacaagaacacatcgcctatccagtatccaccgacctagctcatcgcgaccaaagaaaaggacacagcaactcagcaagacccccatcttccatagctctagctactagctactagtttcaggcctgcggctcgtgaacacctcatctttttagccacttttgccaccaccgacgacgaccgatcgatcagctagcagctaggccatcccgcgcgcgtcacgaggaacccacggccggcgtcgccattgttgtcgctgtaacttgcaagctttccctagcatcggcccttttccccttccttttccctcgctcgtcctcgtgctagctgtgtataaaagcgcgtcgctagcgcgctcatggagcagcagcagcatcaggaggtgaggaggaacaggaaaggcgtgctgcaggtgcaggacggctctgagatccgggctctcgtggagaacaaggcggagttcgctaggttcgtcgacgacaggttccggaagctcgacgccgatggcgacgggaggctgtcggtgaaagagctccagccggccgtcgctgacatcggtgccgccatcgggctgccggccagagggtcgtcgccgcaggcggaccacatctacgcggaggtcctaaacgagttcactcgcgggaagaggtacgtacacatatacgagaatacagtgattctagcttctcgtaaactccgttctagcttctcgtacacatatatcttaaaatagtgttttgctttaggctgtagccgaccaaaaacaatgtttcgtatgtagactgtatttatttaaggaggtgttttgtttttagagactaatttttagtttatctattttattcgattctagtctctaaatttctaaattattaaatacggaagctaaaacagaaattctatttcaatcaatagaggtagaactttgtctctattaacaattaattgagagaggtgggcatttgctttgtgtctgcacgttacacttacacagaagctatcttcaataacagcggttgtgaacctattttcgctggcgtttcttagaaccgctagtgctagagatcggtagaaatcatcatttttgcagcgggtaattgaggacgatttccacaataaaaatcgatttccgctagtgactagaaacataaaacaggttttaaaaacaaaaaaaaattatttaaggacaggcctttggtccgtcgaagtcacccctaacctcaaaa

SEQ ID NO: 15270 - DNA, 3164 bp, Zea mays
  misc_feature (12)..(12): n is a, c, g, or t
  misc_feature (2388)..(2388): n is a, c, g, or t
acgtcaataganatcgtatttctaccggcgggtttttaagaaaaccatttttaatggcgatttttaaagaactgccgctaaaaatagtacagtcggttgataaccgaatccgtctgtaaaaatatactgtaacgcagattttgagcccttttctactagtgtaatcagggtctgtctttaaagtctttaatattgcttgcgatccaaaactatttgatggtatgtattatagaatttcaattgtttgcaaaagtaagaaacaaaagtagatgtcaaaattgacaattatatacaaaccacataattattgtaaaattcaaccgtatcatgaccaagaccaagtgcgcgcacttattccttgtcacatacatcaatttgctaatgagatacaaactaagggctcctaacatctctagaagcgatcggtaaacatcaacacatttagcttcctaagggccagtttggtaactctatttttctaaagaattctatttttctaagttcgttaaaaaatgaaatcctttttaaaagtaatgttgccaaactagccctagaggatgataatgcatgcgaaagtttgtgcgcgtattgctgttgacatagctttcccgaaagtaaattgattacgaaatgcatgccgagtgtcctggaacgtgtctgtttcaaatgcaaaatgtcgattctctcgccgaaaccagctaaccagctagattgaaaaaaaaaaccagtgattagtgaagtctctgagctgcgtcaccaggccaggcaattaccctttgctggggcacccatcacatagctaatctgcattgtgtgcgctgcaggtcctaaacgagttcactcgcgggaagcaagagtcggtgggcaaggccgagttccagcgcgtgctgtccgacatcctcctcgggatggcggccgggctgaagagggacccgatcgtcatcctcaggataaacggggaggacctgagcgagttcgtggagagcccgaggtacgagcctgaagccgtggccatattttcgcaggccgtggggggccctaccaataccaacgacgccacgctgcgccagtgcctgctggccgctgtcggagagctcaccatcgaccacggcatgccaccggcttctgatccctgggtaatttttctgaaaacggcagtagagttcgtattgcgcgcgcgtgctttgatttttgggtgggctcgctctttcattggatatattggatgtatcatatgttgtaggtcatggagaacgtcgtggagcccgcgttccaagagctgcctgctagtgctacccagcagctcgacctcgaccagcctgttccctcccaggaagcctttctccaggaattcaggagacttttgggcgccatcaccctgagactgcgacagcaccctgtgatcgtcgcccataccgagaacaacttcgacgggagtggcgtcaggaggctactgtcgaacaagttcgagttcgacaaggtactactacgacgggagtacatgagaagcacacactcgatcgacaccgcgctgtcagtttaataatcactggttgcttgttgtagctgctggactctgtgtggagagaggtcccgaaagaacgcaaggacaagcaggcgtcgaaagagtacctccggatcgcgctcgacaggatcgccgattcggcgggcctgccgcctctgggggccgtcggtcaggtggatgccgtggtgaacgaggcgttcaagatggcgaaagccgacgacctcagggcggtggacgaggcggagttcaagaagctgctgaccgaggttcttggggccgtcatgctgcagctggacgccagccccgtcgctgtctccaccaacaccgtcgtccacgagcccatgtgcacctcctcctcctcctccgcgctgctgtcgcccacgccgctgtctccgatggtgtcctctcctgctagtgaataggagaagacttgacaactgagtgaggagatgacgatggagatggatcacaccggcccgtcacgctcagtttttctttttctgtgtcaccgggtactaataacatgttaggaacttgtgggtttttatgtcgcttataacttctcgtcgaaataaggcttttctaagcttttgagtagttgtgaacattttaagcaatcgtgaacagatggtggttgatatgtgtccagtatggttttttaattgtgaacatgtggtggttgattaattatgaacactacttaaacaacatttagcatctagacgtcggacaatccagcttatacgtttataattgacaaaactaattaaaagaggcgggtattgcaaccgcggttaactactttttatttacgtttataatggacaaaattaattaaaagaggagggtattgcaaccgcggntaactactttttatttaaaaaatacttaggggtgtttggttgctcctgctaaagtttagtccgggtcacatcaagcgtttgactttaaataggagtatgaaatatagacccaaccaactggactagattcgtctcgtcttttaatcttcggctgacaaattagttttataatccgactacatttaatacccggaacggaggttcaaacattcgatgggacatgagctaaattttagcggggtgtaaccaaacaccccccttagatttaaatttgaattgtactcgtgcaaatcaaacaccaataaaagggcaataaatataaatatagctaactatttgttagttaccatgtaactattttttatttaaaacataattggatttggatttaaagttgaattgtactcgtgcaaatcaaacaccaatgaaagacaataaatataaatatgaaaacaccaatgaaagacaataaatataaatatgaagtagatatatatatacgtatgcacatttgtatcatcacatctgattatatacatatagctaatcaattaaagtgttgtctttacaataaatcgatcatcgatcacctgccatgacatagtaattctaaaaagatgtcgggacacttgtaatcttgaaggcgtagcatgggggactagggactagttttggagcttctcgtactcttctagcatccataagtcactttccttgttgagaaatggtgccccttcatgcacagttgtccatgataaacttacagatgtccccca

SEQ ID NO: 15271 - DNA, 1865 bp, Zea mays
cattgggtaccgcgacccccgccgcggccggaaaacacaagaacacatcgcctatccagtatccaccgacctagctcatcgcgaccaaagaaaaggacacagcaactcagcaagacccccatcttccatagctctagctactagctactagtttcaggcctgcggctcgtgaacacctcatctttttagccacttttgccaccaccgacgacgaccgatcgatcagctagcagctaggccatcccgcgcgcgtcacgaggaacccacggccggcgtcgccattgttgtcgctgtaacttgcaagctttccctagcatcggcccttttccccttccttttccctcgctcgtcctcgtgctagctgtgtataaaagcgcgtcgctagcgcgctcatggagcagcagcagcatcaggaggtgaggaggaacaggaaaggcgtgctgcaggtgcaggacggctctgagatccgggctctcgtggagaacaaggcggagttcgctaggttcgtcgacgacaggttccggaagctcgacgccgatggcgacgggaggctgtcggtgaaagagctccagccggccgtcgctgacatcggtgccgccatcgggctgccggccagagggtcgtcgccgcaggcggaccacatctacgcggaggtcctaaacgagttcactcgcgggaagcaagagtcggtgggcaaggccgagttccagcgcgtgctgtccgacatcctcctcgggatggcggccgggctgaagagggacccgatcgtcatcctcaggataaacggggaggacctgagcgagttcgtggagagcccgaggtacgagcctgaagccgtggccatattttcgcaggccgtggggggccctaccaataccaacgacgccacgctgcgccagtgcctgctggccgctgtcggagagctcaccatcgaccacggcatgccaccggcttctgatccctgggtcatggagaacgtcgtggagcccgcgttccaagagctgcctgctagtgctacccagcagctcgacctcgaccagcctgttccctcccaggaagcctttctccaggaattcaggagacttttgggcgccatcaccctgagactgcgacagcaccctgtgatcgtcgcccataccgagaacaacttcgacgggagtggcgtcaggaggctactgtcgaacaagttcgagttcgacaagctgctggactctgtgtggagagaggtcccgaaagaacgcaaggacaagcaggcgtcgaaagagtacctccggatcgcgctcgacaggatcgccgattcggcgggcctgccgcctctgggggccgtcggtcaggtggatgccgtggtgaacgaggcgttcaagatggcgaaagccgacgacctcagggcggtggacgaggcggagttcaagaagctgctgaccgaggttcttggggccgtcatgctgcagctggacgccagccccgtcgctgtctccaccaacaccgtcgtccacgagcccatgtgcacctcctcctcctcctccgcgctgctgtcgcccacgccgctgtctccgatggtgtcctctcctgctagtgaataggagaagacttgacaactgagtgaggagatgacgatggagatggatcacaccggcccgtcacgctcagtttttctttttctgtgtcaccgggtactaataacatgttaggaacttgtgggtttttatgtcgcttataacttctcgtcgaaataaggcttttctaagcttttgagtagttgtgaacattttaagcaatcgtgaacagatggtggttgatatgtgtccaaaaaaaaaaaaaaaaaaaaaaaaaaaaaaaaaaaaaactcgagagggggccggtac

SEQ ID NO: 15272 - DNA, 1373 bp, Zea mays
ctttggtcattgtgtgcaacaagactgacggagagccacttagaagggctggggggaggatgacatgaagctagtcatggagatgaaggcagaggctttgaagactataacccaagctggtggtcctaatgaagagggtgttttattgactatgagcactttaacagatgatggtgtaatggctgtgaaaaatgctgcatgcgagaggcttcttgaacagagggtggatgtgaagatgaaatcaaagaagatgatggattgcttgaataggtttcatgttgctgttccaaagcctcgtgacaacaaggagcggcctgtttgcatccctccggctgttctggaagctagggcaaatgctgctgctaaggaaaagaagaagcttgagaaggacattgagaatgagaatggaggtgctggggtatattctgcaagtctcaagaaacattatatattggctaatgatgaatggaaggaagatattcttccagagatactggatggtcacaacgttgcagattttctggatccggatatcctagtaaggtgtgaagagttggaaagggaggaagggcttcgcctggaagaacaagctgcagaagatgctttccagattgatggccatgaactaactcaggaacagaaggagattctggctcagattaggaagaagaaggcattacttatccaagaacatagaatgaagaagagaactgcagaaagccgtcctattgtccctagaaagtttgacaaagataggaaattcacaactaataggatgggacggcagctttcctctatgggtgtggatcctattgctgccatcaatagagctcgtagccagtctaggggccgcaagcgtgagaggtcagtgagcagagctgcagctgatggtgacggtatggagatagatggccagcaatccaacaagaaactgcgtcgtacatcaaggtcgaggtcgaggtcacgggctcctgaggaggtcattcctggagaaggattcaaggactctgagcagaagaagaaggctatcaagaaagcaaaggcctctacaaggaacaggaacaaggaagctcgccgtggagaggctgaccgtgttattcccactttgaaaccaaagcatttgttttctgggaaacgcactcttggaaagacaagcaggcgataagctcagtacctcactggatctggtagtaaaggactggtgcaattttggtgtgagcaatttgatgaaacgggagcttttatgtctagcacttatgtatgctacttatttatgaaatgtcttgctgtcgctgtatcatggtcctctttaagacagttttactagtttatacatgtattacttcgaattggttgggttactatatattagc

SEQ ID NO: 15273 - DNA, 1518 bp, Zea mays
aggtaccggtccggaattcccgggtcgacccacgcgtcttggatgacatgaagctagtcatggagatgaaggctgtgcccgcgtccgctataatccaagctggtggtcctaatgatgagggtgttttgttgactatgagcactttaactgatgatggtgtaatggctgtcaaaaatgctgcatgcgagaggcttcttgaacagagggtggatgtaaagatgaagtcaaaaaagatgatggattgcttgaatagatttcatgttgctctgccaaagcctcgtgacaacaaggagaggcctgtttgcatccctctggctgttctggaagctagggctaatgctgctgcaaaggaaaagaagcttgagaaggacattgagaatgagaatggaggtgctggggtctattctgcaagtctcaagaaacattatattttggccaatgatgaatggaaggaggatattcttccagagatactggatggtcacaatgttgccgattttctggatccagatatccttgtaaggtgtgaagagttggaaagggaggaagggcttcgtctggaagaacaagctgcagaagatgctttccagattgatggtcatgaactaactcaggaacagaaggagattttggctcagattaggaagaagaaggcattacttatccaagaacatagaatgaagaagagaactgcagaaagccgtcctattgtccctagaaagtttgacaaagataggaaattcacaactgataggatgggacgccagctttcatccatgggtatggatcctagtgctgccatgaatagaattcgcagtcagtctaggggtcgcaagcgtgagaggtcagtgagcagagctgcagcggatggtgacggtatggagatagatggccagcaaagcaacaagaaattgcgtcggacatcaaggtctaggtctaggtctaggtcacgtgctcctgaggaagtccttcctggagaaggattcaaggactctgagcagaagaaaaaggctatcaagaaagcaaaggccgctactaggaacaggaacaaggaagctcgtcgtggagaggctgaccgtgttattcccactttaaaaccaaagcatttgttttctgggaaacgcactcttggaaagacaagcaggcgataagctcagtacctcactggatctggtagtaaaggactggtgcaattttggtgtgagcaatttgatgaaacgggagcttttatgtctagcacttatgtatgctacttatttatgaaatgtcttgctgttgctgtatcatggtcctctttaagacagttttactagtttatacatgtattacttcgaattggttgggttactatatattagctttctggtgtttgattctcttaatggtacgaagttattcaactctcctacttaaaaatgtttgtaatgcatctgttggatctcaccatcggttcttccctccgcagctttgaggcaggaacttctcataatgattagttgcttaatgatttggttcttt

SEQ ID NO: 15274 - DNA, 904 bp, Zea mays
gccctctctcgagtttttttttttttttttttttttgctcttttgtttttttttttcttttccaaagttgcaagccttctattatgaacccgcatcagttccatttacaatgttcagattaatagttacaggtcagtggcaacctatttacctaaaaattctatctaggaaaactgtggctcgctcttatctagcaagaatgcccccacaaaataagtttatattacactcaaatgcacccccattactaactagctaccaccctacaaatatcaagagtatcatattgaaggtcctatccccttgctcttgtcttgaacatgaaacatcaatctactttagttaccatagtatgtgttttgcagttagaagaattatcctcttgattgtgatcggcacatgcactcttcagaatggtaaactcgatctgatgacgtatgtacatttatacaggagttatagaatcttctctgttataattattgcggattgataacctttatttgaaatgcagcaagaagttctggtactgttttgatctacacctctaaccaccaatggaaggttttgccttgtgccgttgcatggcgtttttacgaagcaaagggttttctattgaaaaaacaatcaagctaccatccttggttcccgccaagaagcactcctcaggagtcacaactaaggaagttattgttttcccagctccctcgtacctccaaacaacatcaagagaatgcatggagcggagaacaatttgaccatgatcaccagcacataccataaactctccacagcaacttagctccatgcaattgagacgacaattggattccgaagaagcaatatgctttccatttatggaatacatatgcaaagaaaggtcactatcagagtatatcactaa

SEQ ID NO: 15275 - DNA, 1922 bp, Zea mays
ccgggaagcctaaaccccgaaattataaagaaaaccgcctcggccgccactcggctatcttcgtgaggaccttcaaccatctcaggcggaatggcggcttctggtgagggcgcgtcgctgccgtctccggcgggcggggaggatgcgcaccgccgccgcgtcagctatttctacgagccgtcgatcggagactactactacgggcaaggtcacccgatgaagccccaccgcatccgaatggcgcactcgctggtggtccactacggcctccaccgcctcctcgagctctcccgcccctacccggcctctgaggccgacatccgccgcttccactccgacgactacgtcgccttcctcgcgtccgccaccggaaacccgggtgtcctcgacccgcgcgccattaagcgctttaacgtcggtgaggactgccccgtgttcgacggtctcttccccttctgccaggcctccgctgggggaagcatcggcgccgccgtcaagcttaaccgcggggacgccgacatcaccgtcaactgggcgggcggcctccaccacgccaagaagagcgaggcctccgggttctgctacgtcaacgacatcgtcctcgccatcctcgagctcctcaagttccacaggcgtgtgctatatgtagacattgatgtccaccatggagatggcgtggaggaggccttcttcactacaaaccgagtcatgactgtttcctttcacaagtatgggggattttttccctggtactggacatatcactgacgttggggcagccgaagggaagcattatgctctgaatgttcccctgagtgatggtatcgatgacaccacctttcgtggtctgtttcaatgcatcattaagaaagttatggaggtttatcagccagacgtggttgtcctccaatgcggagctgactctttggctggagacaggttaggttgcttcaacctgtctgtgaagggtcatgctgactgcctccgtttccttaggtcgtacaatgttcctatgatggttttaggtggtggaggttacaccatcagaaatgttgcacgctgctggtgctacgagaccgcagttgctgttggagttgaacctgataacaagctgccttacaatgattactatgagtactttggccctgattatactcttcatatccaaccaaaaagtgttgaaaacctgaataccacaaaggacttggagaacataaagaacatgatattggagaacctgtcaaagatagaacatgttcccagcactcaattccatgacagaccgtcagaccctgaagctccagaggagaaagaggaggacatggacaagaggccacctcagcgcagcagattatggagcggaggagcttacgactctgatacagaggatcctgacagcctgaaaagcgagggtaaagacgtaactgctaacttccagatgaaggatgaaccaaaagatgatctgtagaagtttcagaagtgcccccaaagttactgagttgtcaatgggatcgtcgacatgcatgttgaagagtggggacgcatctgaacctgtccgtgctgatatctgccgctgtgcatctgtaacagactgaacgttttgctggttccagctttcctgcgtgttggtaactagactagatatatggccctttggtgggtcccaaactgttgagctggagaaatgaagtgattattctcgcatgatttactgtagcatgcatgtaatcattacccattagttcattaggctatcaacagtagtttactcatccccatattcaaacttcactatgcgcgcatacagtgatttgagtgaccatatggataaactttgaagatgatttttgggtagtgtttggtttcgaagtgtaatgggatagagccgccccgctcttaattcaaaaaaaaaaaaaaaaaaa

SEQ ID NO: 15276 - DNA, 1884 bp, Zea mays
tcggtacccctggaagtgtgaagctgagctgctgcactaacgtgtcgacactatggcacatctgaagcgtgtgtggcacgtacggattttccctgtggacggccacgccgtaccaggttcactggcggaccatgcatgcacatgggccaaaaaaaaaaccggcccgaaacggagaaccaggtcgctaccgtctaccggtaccgactgtcccgctcgcgtgcttgcaacttgcagtgcaacggtgcaagtgggcagtggccacaatttcctcgtctccaccctccaaaattccacggaacggaacgaacgatcacctcgcccatccccacgcgggggcacccaccagccccacacgtcagccgatcaaatcaaaatcttggcccgcgcggcagccggcagcgcccgcggtcccgaagcgcctctcgtccacacaggcacacagccaagccccgtccggggccctccgcccacacccacccgcgtgccggggcggaatggcccggaggcgggcgtgatgcgcgctgcgcgatttatacgcgccaaccccgccagttgctggctctgctttgctcccgttcccatgctgatttttttaggcggctgctggcctgcctgtctccactggaagctccggattacgtagaaaaggggcgggcggcatgaggatccagtgcgacgcgtgcgaggccgcggcggccgcggtggtgtgctgcgccgacgaggcggcgctgtgcgcgcgctgcgacgtggagatccacgccgccaacaagctcgccagcaagcaccagcggctcccgctcggcgacgccgcggcgctccccgccagcctcccgcgctgcgacgtgtgccaggagaggccggccttcatcttctgcgtcgaggacagggcgctcctctgccgcgactgcgacgagcccatccacgtccccggcacgctctccggcaaccaccagcgctacctcgccaccggcatccgcgtcggcttcagctccgtctgcggcgccagcgccgagggcctcccgccggcgccgcccaagggaagctccaagcccacggccgtcgtcagcgcgccagctgccgggacgaccaccaaaacaaggacggtcaaggacgcgctgccgcaggaggtgccgtcctcgccgttcctgccaccgtccggttgggccgtcgaggacctcctcgagctgtcggactacgaatccagcgacaaggcaaggacctaaccatccaaaaccttttttttttgtcggcggtgatgatgatgagatcaaccacaagcttttcacgttcttattcttatctcagttttccttttccatctgttttgtgtttgctgttccagaaagactcgtctcttgggctcaaggagctggagtggttcgaggacatcgacctgttccacgcccattcgccagctaaaactgccatggcggagttcttcgcctcgccgcagccagtgagtaacgccgggttctacaaggcgaacggggcgcgcctgttcaagaagtcacggatggaggtgcctgacgacgacgacgaggactacttcatcgttcctgatcttggctgagaatgagatgagagatctctgcatgattctccagtcatgtgatgtgtgtatgtatgcaaaatatgtatgtatgccatcatggggtgcactgacgcttacgttggacatatgtaattatccagtcatgtgatgtgtatgtacgcaaaatatgtatgtatgccatcatgggatgcactgacacttacgttggacacatatgtaattataaaaggcagggccatgctttcagcctgataaatgaggtcagtttgatgtatgagatgaattcacttggtaaaaatgttcttcagggggcccctctggcgtccgctggc

SEQ ID NO: 15277 - DNA, 1133 bp, Zea mays
tcgccagcaagcaccagcggctcccgctcggcgacgccgcggcgctccccgccagcctcccgcgctgcgacgtgtgccaggagaggccggcctcaggggcgaatctaggggggtttatcggggtcagccgaccccgataaattttataaatcctttagtaaaatactgttaaagttcataaaaatttatatgatatagcaaagctgctcttgacgaccccgatcatattatcgcattgggtacctcgaggccggccttcatcttctgcgtcgaggacagggcgctcctctgccgcgactgcgacgagcccatccacgtccccggcacgctctccggcaaccaccagcgctacctcgccaccggcatccgcgtcggcttcagctccgtctgcggcgccagcgccgagggcctcccgccggcgccgcccaagggaagctccaagcccacggccgtcgtcagcgcgccagctgccgggacgaccaccaaaacaaggacggtcaaggacgcgctgccgcaggaggtgccgtcctcgccgttcctgccaccgtccggttgggccgtcgaggacctcctcgagctgtcggactacgaatccagcgacaagaaagactcgtctcttgggctcaaggagctggagtggttcgaggacatcgacctgttccacgcccattcgccagctaaaactgccatggcggagttcttcgcctcgccgcagccagtgagtaacgccgggttctacaaggcgaacggggcgcgcctgttcaagaagtcacggatggaggtgcctgacgacgacgacgacgaggactacttcatcgttcctgatcttggctgagaatgagatgagagatctctgcatgattctccagtcatgtgatgtgtgtatgtatgcaaaatatgtatgtatgccatcatggggtgcactgacgcttacgttggacatatgtaattatccagtcatgtgatgtgtatgtacgcaaaatatgtatgtatgccatcatgggatgcactgacacttacgttggacacatatgtaattataaaaggcagggccatgctttcagcctgataaatgaggtcagtttgatgtagaaaaaaaaaaaaaaaactcgagactagttctctcctcgtgc

SEQ ID NO: 15278 - DNA, 3726 bp, Zea mays
tttgttggagtgttgcagcgaacagccagtgtgtgccaatatgtacaaaactttgctaaagctgaacttcatcacatcgtagagggtgggcattatcggctaattttacaccaacaggtacaagatcctctatcagctacacaatttgtctggagcttgagaagctctgatcaacgaatacgctatttacatacaatacagccccactttcttccgcaacgcctgcgctattttgcgccttgggattaatcaagctgtctcacattttatttacctcttttggaagttgaatatcttgagcgagaggccaaagagcaaggcaaagagcacaggaaacgcgaccaccaccacagcgaccacccacagcaagtcgtgatggtacccaaagtagtcctcaacgaagtcagatatacgcaccccaccgtcactgaacgtctcggatacatctccaaactgtgaagtgaccagcccgttgagcgtccatgcgatggggcaaatccagtagaaccatctccaccagactggaattctcggcctgggggggacgcgccccgtggagcggtgccggattagcatatatacaatgaaaaataggagcaccacagattggctactagacctatgaaagaaaaagaattactgcactcacagttcttggtattaagaatcccgagaagaggttccaaatggcatagaacgccgtggaagcaacggaggagacgttgtagttcggagtcaggccaaccaccatcatcccgtagaacgtgtagtatgctagggtgaaatacatgaagaagaggtaccaaaagaacttgtcagctgtccattcaaacccgatcatagcatacaccagcacgccatatattaaggactgaacaaagatgtatgggagttcgattacgacctgcaaaatggaggtacaagttagaacagctgtttcttctgtctcccttcctacttcccttgttgtactttgatttgacgggattttactgtctgaagtgagccaccttttttatggaaggaatagagtagcttatgcattcttgaatcttgttatgatttgttacagccaaattaatttttttttttgcattcatttgaagcgattgttggatgatgtagtgattagtgaatgccagtaaactttacctgtcccaaggcatacggcaatggcgagtacatatgagccgccctttccctgtaaaagactgttcgctcaaccgatacaactggctgaactgaaccagaattctgtactcccatgaaaataaccgaggcatacatggaaccaatggcattgaacaggtcctgttgactatccctgcaagagtagaaataatagctccagtgaactgcaagtttgtggtgaatgggggactactaggggtgggtggcctctgaaattgaaggaaatttgacggttgcattttttttctacttcattttttgattattattatctttacctttttctgcccacaccccagaacattgttccaaacaacagggcaatcactgtcgtgtagaagtatttgactccagtatatggagggtttctccaatatgacatgctttgcttccacaggcaagccaaacactgtgtgaggaaagcctgtgagtattcggttggaaaggataggtcacttgaaccttctggaggcgtgcttagctcctttatcaaagttttattcctcctgaaatacagcaaaattaccaagttagtgttgcctgagacatcgcttttttgcggaattaaaatatcagttccaaaatagggttacatattagtattttgcccttttgaaatgagatgtatatgctttcagaactatttttgcagaactatttatgaacatattagtattttgcccttttgaaatgagatgtacatgcacatacctgtgcagttctgaatgcttgtatacttcactgaagttaataccagttatctgctcttgcattgtactagtcacttccagcatccatgtcgaggggttgtagccatcttttatcttgttgacaccttcgatgccctgggtagaatcaatgaaatcccagttagataatgtgcagttcaatatgaaactgtaattcctggaaatatacaatattaagttgctctttccttacctcaaaatatttgaccagttcacatgaatgcatccctagtgggcctacataaatctcttcacctccacgtttcataaggaagagctgcagttgtggacagagccattaggtgttaaagttctggatcttataatgcaaatagcgaaagtgttggttcacactttccttctgcattctaaaaagaagaaactatgttttgtatggttttcttcacctcatcaaaagattcaaatatatctatacttggttggtgaatggtacaaacaaccgttcttcctgtgtccacagtattccttattgccctcatgacaatagctgctgctcgagcatcaagtccagatgtcggttcatccatgaaaattatagaaggattagcaacaagctcaacagctatggttagccttttcctttgctctgttgatagtccactgacaccaggcaatcctaccaatgcatcttttaagggtaaaagctccacaagctccataacctcatcaataaacatctgccctgagaaaatcagaattcatgtgtcatagtcaatagtgaaaatcaccagcaagttcgatcatgtctatctaaaatgtttcaatgaattggagcaaatttcaggttaaaattaaaaaatttccttatctatctcacgccaaaacataggtataagctctatatgggttagggtgcagctatttatggatgaggcggaacttcaagagttttctataactgtatgtgttggtgtgtgtgtgtgtgttattagaagattttgtaaggatccaaatgcataaaatgccaataaaagagagagggggaggtgtgttcaggaagtctgaaccgacctcaacccatattctacagacttccacaggcttcaacatggtatcggagccgaggttctcggaggcgattgtggtggcgacgagtcggtgtacttcgaggagaaggaccggctgatccagcagcgtgcggcggagcgggtggaccggtgcgtcgagaagtgcgtggaggggtgcgccggctcgtcctgcgtgcatcgccaggggtgacgctgggccaaggtcagcacgtcgacgtccggctgggcggcgaggacgagcgcagcagcaggcgaaggaacccggcgcggagaaggcggcctccgccaccaaagagctgcttctcctgcttggcctccttctcctccacttccgtcggcgctgcacagcggtcgtccgcgcgcgagatccggctgccggaggacgagcgggtgctggtgatcagcgacgagcggcgccgctgaagacgaccaagtccgtgcaggcggccaacggagagaggtctgcggtgagtgcggcaagaaaaaaagggggtggctctgtaggtttggctgctgtctgggcacaaggcaaaggaggagaagaacaggcagcggcaggggcgaatctaggggggtttatcggggtcagccgaccccgataaattttataaatcctttagtaaaatactgttaaagttcataaaaatttatatgatatagcaaagctgctcttgacgaccccgatcatattatcggctagattcgctactgggcagcggagaagctgcaggcatgca

SEQ ID NO: 15279 - DNA, 820 bp, Zea mays
cgaccggcggcggcggcgaggtgatggcgatggacccggacgcggtgtcggccaccggcatccgcgtcggcctcgcctcggcttccgcctgcagcgacgcctgcgacgcccacgactccgaccaccacgccccgcccaaggccaccatcgagccaccgcacgccgccgtctccgccgcggtgcagcaggtgccctcgccgccgcagttcctgccgcagggctgggccgtcgacgagctcctgcagttctccgactacgagtccagcgacaagctgcacaaggagccgacgctcgggttcaaggagctggagtggttcgccgacatcgacctcttccacgagcaggcgcccaaagccagcaggacgttggcggaggtgccggagcttttcggataccaggcggcgaacgacgcggcgtactacaggccggccaaagccgccggcggcggcggcgctggggttcgccagagcaagaaggcccggatcgaggtcaccgacgacgaggactacctcatagtccctgatcttggttaaataagagagcgcaggagttttgtttcttctcctgatgtgtaccagagaagaattttactgtgtacaagctagtgtcatgtgttgtgcatctttgactgtagtatcgctcaattgtgaactgaacatctattaagccacttttgttgctatgctaataccagcctgagagacactgatgttttaacagaacatttgtctgatttagctgacacttccaattaaggtcatgtcggccaatcccgttaaaaatggactaaacaggattggaaaaaatttgaagaaaatca

SEQ ID NO: 15280 - DNA, 1281 bp, Zea mays
cacccgcgtgccggggcggaatggcccggaggcgggcgtgatgcgtgatgcgcgctgcgcgatttgtccgcccccgcctccccccacgcgtgctctgctttgctcccgttcccatgctgatttttttaggcggctgctggcctgcctgtctccactggaagctccggattacgtaggaaaggggcgggcggcatgaggatccagtgcgacgcgtgcgaggccgcggcggccacggtggtgtgctgcgccgacgaggcggcgctgtgcgcgcgctgcgacgtggagatccacgccgccaacaagctcgccagcaagcaccagcggctcccgctcggcgacgccgcggcgctccccgccagcctcccgcgctgcgacgtgtgccaggagaggccggccttcatcttctgcgtcgaggacagggcgctcctctgccgcgactgcgacgagcccatccacgtccccggcacgctctccggcaaccaccagcgctacctcgccaccggcatccgcgtcggcttcagctccgtctgcggcgccagcgccgagggcctcccgccggcgccgcccaagggcagctccaagcccgcggccgtcgtcagcgcgccagctgccgggacgaccaccaaaacaaggacggtcaaggacgcgctgccgcaggaggtgccgtcctcgccgttcctgccaccgtccggttgggccgtcgaggacctcctcgagctgtcggactacgaatccagcgacaagaaagactcgtctcttgggctcaaggagctggagtggttcgaggacatcgacctgttccacgcccattcgccagctaaaactgccatggcggagttcttcgcctcgccgcagccagtgagtaacgccgggttctacaaggcgaacggggcgcgcctgttcaagaagtcacggatggaggtgcctgacgacgacgacgaggactacttcatcgttcctgatcttggctgagatgagagatctctgcatgattctccagtcatgtgatgtgtgtatgtatgcaaaatatgtatgtataccatcatggggtgcactgacgcttacattggacatatgtaattatccagtcatgtgatgtgtatgtacgcaaaatatgtatgtatgccatcatgggatgcactgacacttacgttggacacatatgtaattataaagatcaggctgctggccaggaacactcatcgttgaggtgggagggcttaagtgaataaaaagcactaatcgttggattaagaaaaaaaaaaaaaaaagggcggccgc

SEQ ID NO: 15281 - DNA, 4263 bp, Zea mays
gaaccccctctcacgaagttagatcgactggcgtggcgagcctccgtgacgcctccaaacctccagcgatcagagcataagatgcggcgcggcgctgtgtgtgtgagagaactaagatggcgttggtgcttggcggccaaccagttatactccgtttaggtgtagaatccatttttctaaattttattgtttggttccacgtggaattaagatttaaaatcagagtcccaattctctcaaattagactataaatagaaacctactctctcccaatacaaagtcttgtccatcggtattgcgtggaattagactgcacaattccaaactttaattcagtgacattcaaacataaaattataattacatttcatttcaatatcatatcggatttggtatttaacctaatttaattccatcatctccaatatcgacatccaaacggagcgagctgggccacggccaatgaccatcttttcttattttgggctgccagctagcggacttagcatttcttaaccattaaggtaataagaggattagtactacctttgttctgcaatatttatagatctctagcttatttttgaactaaaatataacaaataaaaaaaacggataaaatatagtttatatataatatatttttgctagccgatgttggcaggggccattcaatacaaatattcatgtttatcaggaatccaaaaatctcaattttgagagagcagtacagtaacaattaatgtgctggtatggaataggaatacttctgtaactttccgtgttggtccatgacatctaattaatgtgtatgacataaaattaagggggatattgattaagacacatcttgattaagctaaccagttgttgttttaaaaaaaacgtacaacagcctaaaagtgtgcatatattaagacacgtggatatggatgtatacattcacaaaaatcagatcagccaactaaagccctgtccgggaggcactcatcccgttccgccgagtgagcacatcacatcagatcaaaatcggcgcgtccaagcgtggttccggcgtgtagctagtacacggggagacgagccgggagcccctggccacaagtctccccggcgagtcctccaccacaagctcgcccggcagcggcagctcactgattgctccagttgcgtgctcgcgcgcgcaagctcgtcctcctccatcgcagtcggtggccttatcttgttcgtccttgcctccctcgttgttgcgacttgcgagacgacaggacaggatagcgagctgggcctgggagtatagaccgcagacagagaggtggagcggccatgaagatccagtgcgacgcgtgcgagggcgcggctgccaccgtggtgtgctgcgccgacgaggccgcgctgtgcgcgcgctgcgacgtcgagatccacgccgccaacaagctcgccagcaagcaccagcgcctcccgctcgaggctctctccgccagcctcccgcgctgcgacgtctgccaggagaaagcggcgttcatcttctgcgtggaggaccgggcgctcttctgccgggactgcgacgagcccatccacgtcccgggcacgctctccgggaaccaccagcgctacctcgccaccggcatccgcgtcggcttcgcctccgcttcgtcagcgtgcagtgacgcctgcgacgcccacgacgactccgaccaccacgccccgcccaaggccgccgtctcctccgcggcgcagcaggtgccctcgccgccgcagttcctgccacagggctgggccgtcgacgagctcctgcagttctccgactgcgagtccagcgacaagctgcacaaggagtccccgctcgggttcaaggagctggagtggttcaccgacatcgacctcttccacgagcagacgccgaaagccggcaggagattggccgaggtaccggagctttccggaacccaggccgcgaacgacgcggcgtactacaggccagccaaagccactgccactgccggcgccggggtgcgccagagcaagaaggcccggaccgaggtcaccgacgacgaggaccacctcatcgtccctgatctcggctaaaataaaagaaagggcaggagttttgtttcttctcctgctgtgtgtacaaccagtgtcatgtgtcgtgcatctttgactgtagtattgcacagctgtgaacatgataactctaagcacactttgtgtctttgttgctacgctagtagcagtctaagagacactttgatgtttttaacataacatttcctcgaacacctgacactttcacttgggtacagagagctcgagtgacaagtactacaaacggtcctgagttctgaccaaattttcttcaaatcaataacaaaaccatgtaaaaagtcaatacattaggtgacagggaacttcctgtaaactaaacccaaaaaaaaacatgacagtgaacttcctgtaaactaaaccgatggcaccacgctttgaatcagatgttaccagcgtcttgattcatccaccaacatcttcaatggttatatgacaccccagaatcatcagcacatttgctatttatttggtaaagctccaaaaaaaactgcaggtggatgagtaaaaacttcaggagcacaatatcagcatggcatggtctacttggcaactgattcgatgtgattttcactgtcccccttaagacactccatgggtagcttgaagcttaaacaaaacatagccttgtttggtgcaacatcacgaaccctatggaatattggttctgctattgtagcacttaatttattctgagcttcagagagaattgattcttcagattcacaagaacggatgaaacaataacagtgtatccaaggtagtgatcccgtccagtatttcttttggatgagaccatcaaaacaatcgaggaactgcaaagcggaagcaggtagattcatcagtacctcggccgcgaccacgcttggcttggatggcagtggccctaatcctctcactctctttttgttttgtctttttgttttattagcatctgcatcttggcaatcaggttcatcaccttcttctgaagtttgttgtcgctttttagtagtagtgcttgccgcagaggattcattagcaccatttttaatgtcctctcgaacatcattatggtttccatttgaagaagaaatttcattaggtggaaccccttctttagaataggattcatcagtggcaacttgagagtctgatctagtttccaggccaggcacagtcatcaatttttgcatgaacactctagcatccatgttgtaggcgaatatatagtcctccaccttgttaatctttgcattagttcttagataatgaacactatctggattcaagtcatttgcatatacaacacaacctttctgagcagacgggattgaaaatggacctataccagcaaacatgtcacatataacatctccctttcttgaacagggaaactaatctgatatgctcatgctcgagccttgaattccagtagaccaaaccataatcaagtctgaatgttgcaccatattgtttaatttcagtaaccatatcatttttccctgctaagatctcaaacttcgggactctaaattcatttgttattgtccccactttattcaccacggtctgaatccttggataatttttgtcatagataacctttgctatgacatctttatatgctagcaagtcatcagatatgttcagatgagcaacatgaccaattgtctcaaacgaagagggtacctccactccagcaggcaggattcgcttcaaaatgtgatctgcactccaatatgaataacctagggtcaatgtgtaaggtacaacttcaacattgcatagttgcttcaatgaatcaagcgcctgctgtgacatgtcagataaatcgggcttctgaatcctttcagacagtatgacgagccggttcttgtcgccctcggggtcctcaactacaggtttaacccttggcttgtcgagcagataaccggagcgaaggaggcgggtaactgcggaggcgagctcacgggggatgcggagcgccaagagctctaaccgctgctcgaacttgctctcatccagcttctccatagcccctctccggctctccctctctttctctctcacacactctctctctcttgaactcctccctctggctggaggtttctagggttttggccgctggggaatcgggaaacggagcgggcgtggcggtggccgctcggtgcccc

SEQ ID NO: 15282 - DNA, 1241 bp, Zea mays
ggccgggccgggatctcgcccggcagctcactgattgctcgagttgcgtgctcgcgcaggcgacttatatgcaccactcgcccccgctggatctccactcccggcctcccctcccttgccgtccacttcttcctccaccacagtcatcagtggcgttatcctcttcgttctcgcctccctggttgttgttggctgggtgttggcgagctgggagtagagaccgagaagtggagcggccatgaagatccagtgcgacgcgtgcgagggcgcggctgccacggtggtgtgctgcgccgacgaggccgcgctgtgcgcgcgctgcgacgtcgagatccacgccgccaacaagctcgcgagcaagcaccagcgcctcccgctcgaggcgctctccgccaagctcccgcgctgcgacgtctgccaggagaaagcggcgttcatcttctgcgtggaggaccgggcgctcttctgccaggactgcgacgagcccatccacgtcccgggcacgctctccgggaaccaccagcgctacctggccaccggcatccgcgtcggcctcgcctcggcttccgcctgcagcgacgcctgcgacgcccacgactccgaccaccacgccccgcccaaggccaccatcgagccaccgcacgccgccgtctccgccgcggtgcagcaggtgccctcgccgccgcagttcctgccgcagggctgggccgtcgacgagctcctgcagttctccgactacgagtccagcgacaagctgcacaaggagccgacgctcgggttcaaggagctggagtggttcgccgacatcgacctcttccacgagcaggcgcccaaagccagcaggacgttggcggaggtgccggagcttttcggataccaggcggcgaacgacgcggcgtactacaggccggccaaagccgccgccggcggcggcgctggggttcgccagagcaagaaggcccggatcgaggtcaccgacgacgaggattacctcatagtccctgatcttggttaaataagagagcgcaggagttttgtttcgtctcctgatgtgtacggtgtaccagagaagaattttactgtgtacaagctagtgtcaagtgttgtgcatctttgactgtagtgtcgctcaattctgaacatctattaagccacttttgttgctatgctaataccagtctgagacactgatgtttttaacagaaacatttggctgattgtgctgacacttctacttacag

SEQ ID NO: 15283 - DNA, 1786 bp, Zea mays
gagcacatcacatcaaaatcggcgcgtccaagcgtggttccggcgtgtagctagtacacggggagacgagccgggagcccctggccacaagtctccccggcgagtcctccaccacaagctcgcccggcagcggcagctcactgattgctccagttgcgtgctcacgcgcgcaagctcgtcctcctccatcgcagtcagtggccttatcttgttcgtctttgcctccctcgttgttgcgacttgcgagacgacaggacaggatagcgagctggacctgggagtatagaccgcagacagagaggtggagcggccatgaagatccagtgcgacgcgtgcgagggcgcggctgccaccgtggtgtgctgcgctgacgaggccgcgctgtgcgcgcgctgcgacgtcgagatccacgccgccaacaagctcgccacttcgccagcaagcaccagcgcctcccgctcgaggcgctctccgccagcctcccgcgctgcgacgtctgccaggagaaagcggcgttcatcttctgcgtggaggaccgggcgctcttctgccgggactgcgacgagcccatccacgtcccgggcacgctctccgggaaccaccagcgctacctcgccaccggcatccgcgtcggcttcgcctccgcttcgtcagcgtgcagtgacgcctgcgacgcccacgacgactccgaccaccacgcccggcccaaggccgccgtctcctccgcggcgcagcaggtgccctcgccgccgcagttcctgccacagggctgggccgtcgacgagctcctgcagttctccgactgcgagtccagcgacaaggcaagacgatagcgcaagctccggtccatgaccaacaacctgcctgcgtgccacccaccgtctcatgcatggtcttgtgtgtgtgtgtgttttgcagctgcacaaggagtccccgctcgggttcaaggagctggagtggttcaccgacatcgacctcttccacgagcagacgccgaaagccggcaggagattggccgaggtaccggagctttccggaacccaggccgcgaacgacgcggcgtactacaggccagccaaagccactgccactgccggcgccggggtgcgccagagcaagaaggcccggaccgaggtcaccgacgacgaggaccacctcatcgtccctgatctcggctaaaatcaaacaaagggcaggagttttgtttcttctcctgctgtgtgtacaaccagtgtcatgtgtcgtgcatctttgactgtagtattgcacagctgtgaacatgataactctaagcacactttgtgtctttgttgctacgctagtagcagtctaagagacactttgatgtttttttcttttcttttcctcgaacacctgacactttcacttgggtacagagagctcgagtgacaagtacaacaaacggtcctgagttctgaccaaattttcttcaaatcaagaacgaaaccatgtaaaaagtcaatactttaggtgacatggaacttcctgtaaactaaaccaaaaaaaaacatgacagggaacttcctgtaaactaaaccgatggcaccacgctttgaatcagatgttaccagcgtcctcgtgcatccaccaacatcttcaatggttatatgacacctgatcactcacatttagcatcagaaatagcttgttaaccctccttgcggatggtgatccagatcagatataactacaactactaaccccagaatcatcagcacatttgctatttatttggtaaagctccaaaaaaaactgcaggcatgca

SEQ ID NO: 15284 - DNA, 3643 bp, Zea mays
tgtctagaatataaaatatatgcatacctatgtaattgaagaacctacaatcatagttggctcaatgaagtcgaaccgtttagacacacaacattgtcttaaagtcgtagtcacttagtagctaatgccattctgccactctaaatgtgttggacctctagaaagacatggttgtgcagtagaagtatgatggcttgaggtggaggctttgtcacgaaccttggcacaaagatccctgacaccaagctcgatgttaagatccacaggtcgagattgatgctaggtcaacacaaacctccacggtagctccgagtcgcacaactcgacaccaaggctagggtccgaagaataaaaataaaacctccaaatgtctaaatgtgtatacttttcaaaaaaggttaaaaatcggtaaatatactgtaagagaaattcagagttaagatctgttttgtatgtaaatatttcttatccataagtgcacgtattatctttgtcctatgataaactaacctttagacttgtcctaagtcaaattattttaaattaaattacatttataaaatttaatatttacgacaagcaattaatataattagatatgtcacgacatatattttcataatgtatttatttgatgccaacctaactatcctacttactcctatccctaacatatatatctattcaatatgaagacttggttcagggagaatccacaacctaaattttgggagcgtagtatagtaagactgtgctcaacataccatatattataatcgtgcaaaacattttgtgcccaattgccctgctcacaaagttgagtttgaaataggaggtagttaagattgctgacagcctaacaatatgtcatctatctctatggaacaggaatacaatgtgtttgtacgtaccatctaccatgtatcctcctctataaacatacttgttttgaaatatcgtttggttcacaaaatgcaatgtaaatggcaacggtaataattcacactcgattactagcgggaacaagattgaataggacgtcatcgatttctagtgtgatatctgattacgattggacttaaataaatatggtttatcgttatcggttaccatttccgtaaaccaaatatcagttaatagacagtatcgtacataaatagttttatagtcgatgtggcattaaattaataacgagagagatacagtatcctttgatgatataacgcactagaaataacctaagtgagccactgatgtggcaataaaatatgcacagcgacgatgtggcacattgccggcctttactactaccgaattaacatctccagcggatcctcgcgaaaaaattccatccacaagctaagagcaacttggcattgaagaatggcgattggcgatgtgctcatggcctttcccgagcggaacgactgggccactgcccactgagctcttttttctcacgttgacaggggtgttttgttgtctaaactaatgaatatctgctaagaaacaaatgcaagttcacgaacagctgaggaatagttgagtgatacgtacggagagaagataaagaaatacacgatcacgcatatcggcatatgacagcatcagcagcagaaatatttatcatgatttagttcaaatattcgagaacggttcagaggacaagaaatcagaaatgcacagcacggtcacgcatgctacgcattaatttaataatagcattgatttaataataacacatgccgcatggcagtatggcagtactatagccgcgatgtactttttttccttaaaagggaaaagagtatgttacagcaaattttaaaagtgatctagcagatacacatcttgattacgctaaccagtttcttaaaaaaagaatccagtactgcagactatatgcacaattagggcacatggcagagaactgagagcaaagctcctacggccatgggttgtttgagattttttttttcgttaaaaaataacactagtacggttgtgatcccgtcccgccgagtcagcagatcacatcagatcaaaatcagcgcgtccaagcatgctcccggcgtagctacagtacacagagggagacgaaccgggagcccctggccacaagtctccccggcgagtcctccaccacaagctcgcccggcagctcactgattgctcgagttgcgtgctcgcgcaggcgacttatatgcaccactcgcccccgctggatctcccctcccggcctcccctcccttgccgtccacttcttcctccaccacagtcatcagtggcgttatcctcttcgttctcgcctccctggttgttgttggctgggtgttggcgagctgggagtagagaccgagaagtggagcggccatgaagatccagtgcgacgcgtgcgagggcgcggctgccacggtggtgtgctgcgccgacgaggccgcgctgtgcgcgcgctgcgacgtcgagatccacgccgccaacaagctcgcgagcaagcaccagcgcctcccgctcgaggcgctctccgccaagctcccgcgctgcgacgtctgccaggtacgtacgtcgtcacgcactagctagtatttagctaaccagcgcatgcggcggcggcatgcgcagatgcgctacacgcacgacgtacggcgcaagcaagctaaccttgcttcgcggtcgcaggagaaagcggcgttcatcttctgcgtggaggaccgggcgctcttctgccaggactgcgacgagcccatccacgtcccgggcacgctctccgggaaccaccagcgctacctggccaccggcatccgcgtcggcctcgcctcggcttccgcctgcagcgacgcctgcgacgcccacgactccgaccaccacgccccgcccaaggccaccatcgagccaccgcacgccgccgtctccgccgcggtgcagcaggtgccctcgccgccgcagttcctgccgcagggctgggccgtcgacgagctcctgcagttctccgactacgagtccagcgacaaggcaagacgatagcgcaagctccggtccatgtccgcgtgcacccaccggatcccgtctcacgttcttgctctgtttaatgtgttttgcagctgcacaaggagccgacgctcgggttcaaggagctggagtggttcgccgacatcgacctcttccacgagcaggcgcccaaagccagcaggacgttggcggaggtgccggagcttttcggataccaggcggcgaacgacgcggcgtactacaggccggccaaagccgccggcggcggcggcgctggggttcgccagagcaagaaggcccggatcgaggtcaccgacgacgaggattacctcatagtccctgatcttggttaaataagagagcgcaggagttttgtttcttctcctgatgtgtaccagagaagaattttactgtgtacaagctagtgtcatgtgttgtgcatctttgactgtagtgtcgctcaattctgaacatctattaagccacttttgttgctatgctaataccagtctgagagacactgatgtttttaacagaacatttgtctgattttgctgacacttctacttacagagaccacaagtgaattagctgagataaggtatttttcggtaggctcaccaacacagaataa

SEQ ID NO: 15285 - DNA, 1520 bp, Zea mays
ctgctctcgaaagaacaaccgaacaaacatataacagttctaaaagggcataccttctaggggtaaatctgactacctaatcctaaccactaatctagtgcttgaataaatgagatctcttttggcgaagaggtgatgtttcacaacagattgcatgcagatcccgcaccatctgtacaagatcatgcatgcatgcaatggtccatccctgccagaccagaaaaagatcagatggtcggcgactgggatctggagacattcacacaatggttaatatgaaaaggtaggttgcccgtacagggcaacactcttttttttttttttttgcatgaatacaacattcaatacgtagaatcatgacagtacaatgcatgcagtcaggacgatgaattgtgagccgctgcaagagtagcttagagaatgaattcacccaggccacagcaaaggatagtcgtcttacatgtcatgtgtccctgaacccaaactgaatgagaaaggatgttattctatagcggttggtacagacaatgtctctccagtgatatttcttcattttgttccttcgtatctttacttgaagcccatagcttgtctgaatccactatcacattgaaacctaggggacagatgaccaaaaagcaagccaagaactagggacggagctgctggagggctgtaccacctaaaggtacaatgttatcagctctgaagtatttgcagcgcctcctactcgtctggctttgaggccaagatcttgcagacgggcatggtctcgtttttactcagcaacttgagcgatggatggacgggaatgtcatgcatcaataccctatctccgacatcaagatttgtcaggtccacctcaatttttggagggatgtgctcagctgggcagagatacaccaggctggtccttattttctgcaaaaagcctcctttcttcaacccagggcaagcatcctctcccttgaactctacaggcaaatccaccttcagcattgttccttcatctgccttcaccattaccaaattcagtatattcccagaattttcatctctatgcaccttgatggggaggacggtgccggcgtggaggatggcgttggatcgctcgcccgcgcggacctggaggcggacgggggtggagaggaagtagggcgactgcttgagcatctccgcgagctgcctcctgtcggcggtaaggaggtgccggtgggcaattccgttccctggcgcggcgcccgcgagcgtgagcaggaccgccgggacgcggccgtggcggcgctcgcgcgccgcggcgcgcgggccggctgtctcccgcggtacagcctggatcgtgtggtggtacgacgcggaggccgtccgccgccatggcgccggagacgacgcgcgcagcgccgccgccccggtggcggcggcggcggccttgccgcgaaggaactgcgccattctcaggttctgggttttggtcgtgctgggctttggctggagcctggagggatggcaatcccggccggcct

SEQ ID NO: 15286 - DNA, 2642 bp, Zea mays
tcctcttcttcgctctgtctccggctctccgctctctctctctctctcttcccctcctcgttctcccattctctctctcctctcccgagtccctccccctatccccccccctctccgcctccgtcgctagggctccattcccctgcgcatccgccgccgccggatcccgcctcgcctccgccgcagcttcggcatcagaatcaccggattcggtggtgtttctcggctgcctcagcttccgccggcggaaggccccaggcggcgctccctgcagccctccggccttcactgagtcctccagaagccaaacatcgttgatacttcgaaggcagctgagtatatggtatttgtgggccattgtgctgtccatgcgagcggagagcatgcgtggcacctgtgcttcgggtgatgcccctgaccagagtagctgccgatgcattcggtgtgctgacaatcgcactgtttgctctgtttgctgctctgggcctcttctgcatcttccagtcggtctacttcaggtgtcggattcggagaggaccctccttccttccgcttggttattttaacggcccatgggtgactcgcattgctctgattctgatcacaatttggtggggagtaggtgagatagtgagattgagcttcttgaagaaaaagttgttctccagcttaacatggcagaggaacatatgtgatgtgtacatactttccaacctagggtttgcagagccagggatcttctttgcgtttgcttttctgctccatggctcgttacaaaagagggagctgggcacattaaaccaaagatggaattggaagaccatggcctacttgttggttttctgtattccagtgttctcggtgcaggcaatcctagtgtttgttgggcccaagtttgttagagaggagaaccatgatctcgggagaaggaagattgctaaatacttcatacggacctacacgccggttggagataccagtgtttgcacttacccattgtttggcaccctttttcttggacttgtagatgctttcctgatgagctatgtatcatatgttggattacgggtgctgtccttggttattaacaagtcactgcgaaggagagtttatctactgatgctgtctgtgctgtgcttccttcctatcagggtgcttctcctcgggttttcggtgctgctcaagccaggacatgttgcctttgagggtattatcttcctgtcattcttgatgatgctgtcctgcacgactgttgggatactcttgctggtttactaccctgtagctgattcattggccctccgagatataggccagagggacatagcagaaatggtgccttatgatgattactactatgaaggcacatcgcttgtggccaaccagagtttccgagaaatcgagcggaattctgacacttcaacgaagccgggatccatatccttccggacaatgatcagggaagaccaactccagcaggacggtacggatgagatcggattctcttcgcgcagtggtgtccatattggatcgccctcaggctcttcgccaagcgcagcagtgccgatgctccctctcaaggaaatccctagatactaagaagtattcacctgtgactttgcccctctactgtgttctccttctccccccctttttctcccttctctttcctcttactaccttaatgataacagttttgtggcaatcaaaaaaggtttttgtccaaaaataaaaaaaaaaaaaccaaaaaaaaaaaaaaacatcattagcccagcactctaattccattctatgaaagtagcaagtagctagatcttgcactggttgatgggctgtgttctggcattggctggaagaggctgtgagttggagttcacttttggttggttttgctgctccacaactcataatatctcccagccaataggttacaccatggactaggctggaatggggcctctgctgtgtcgtcgcctactattccttagctgtttctctttgtgacagctgtgccactgagtatatattatacgtatatttgcttgtggccttgaattaaaagcaggggctgccggatataaatggaccgggagatgtttaggagtagtatataaaatatatgccgggtaaaggaccagggaccaccgccaaggccttccatattcgctcagccctttcttttttctatttgaaaaaaaaccgtttaactgcgaagatatcaaaaagtgactgaagttcacttcgaattcgttttcaccctggttttggcgtatcgtcttcacctgtgtattgttcaatgaatttggtaccatcagtgtatcgctagatgtggatggccgatggggccatatacctgcagtgcagtgctcctagctgacagacagcttgtattcgcgaggattttgtcgcgagctggcctggagcccggcgtggttccaccgctcctgtctttacgcctgttgactatgcgtagccaggtctgcggatgtttctggcgtaaaaatgtttgcgcgtgatcttgatgcccgttgcctggaatccaaagcgcgcaacgctggaattagtcaactggacaggtgcaggccgcgttattttttttttgttgttgccgtcggcttctttcctgccgcaaattctacggc

SEQ ID NO: 15287 - DNA, 1817 bp, Zea mays
ctgggcacagattcaaagacacctgccaagtcgtcgctcgcaaggcattgagggccctgtgtcagatctatgaagaagaagtggctgacactccactcagattctttccgccctttcagagaaaccgtcccgcttggatggccaggatgcgtgcattggtagggcagccgcctgcttgaggacgaccccacagtcgtgtacctcactgcatacctgctcaccctggatgcacattatgatttcttggctcggcaccaccgtcagatgattgcccgagcagaagatgcagagaagctcaaccgtaagctccatgtggatctcacctcagctcaagcccgtgtagctgccttggaaagtcgtgaagtcattgctgttgaagccctgaagcaagccaaggatgagcacgtccagaagttgatggaggcctacttggtaacccataaccaacgtagagccctgcggatccaagagcccgcttcatccaacccagttcaacccatgagagctgaagacccccagattcttgaaggtcacccggtctctatcagaggagaaaagaaggcttgggaactcccggaaggagccatagtcttggaaggaattccagtcttccctcaggctatggataagcaagagcaccctgaatcctcccaagatcccccgccggagttgtttgagcccctcaccatgaagaagattccagcaccatcccttgaagtcaaggaagaagctgcaagcaccccgccagcaccgccgccctctgaggagctacaagagccagtcccgcttgaagaagagttcgaccccgtcctgccatctcagtcgccgccagaagaagtcatcaacatcagctccctcttgacccatccaggagatgtctcagattgaagttgtgcgccagccttgccagaagagaagctgcctggtctgaagttagttatgcccagtcctctgcatgcattgggtagtgaagtttttcttcactttggctagagccctgcatgtatgagaggtaatcgtgtagactcgtgttttgcaaaactctaattgtgtggccccctagggcatttcaaaatgaatttcgcttgatgttttctccccttttgagtgcatatgtgatgctttaacgttagtgctcataagttgcatttagcatagttctcaattcaggagccaagcaatagtagttatgcttagcccccgaatctgagtagtccgtgctttggaaaaactctattcttcccttattcaaaacatttgatttgtttgtgcttatcattgctgagcttgtgtgttttcttttcgtttttcttaaaaaggttttctctaaaaacatagatcacaaattagagctaatcctcaccttatgcttccattctcatcttaacccatctcaagagaaaagcaccttaccctagaagataccgggaagctcacccttgaagcctggaacaagctacagaagcaaccagtccagccgctcagtcaaaaggaccgaccgtgagaatcaaagcactgcccctgagtcaaagtaaacaggaaaagaggacagaaggagttattaccatacagagaggcaaagattcttggaaccagagaccacaaacatcagggtcattgaccccaccactcactcgtgccccccgcatgcgtgccccacctccaaccaccgccccacgccccctttgcagcgcactaccgccacccacgcccccttttgcagcacacccaccgccatcgtcgtcggcaacatgcccccctccccatgttgcgcctgctgcctcgtgtcacttgctccatcaccaccactccacacc

SEQ ID NO: 15288 - DNA, 2753 bp, Zea mays
  misc_feature (50)..(50): n is a, c, g, or t
  misc_feature (129)..(129): n is a, c, g, or t
gatggccagtgagctcgacgacgaatgacgcgacgacgaacgacgacacnccgacatggaagacccgacgtgactgaggaaggggtcgacgattcgatgacatcggcgagggtcaacgacgagccgacncaacgcgcgccaggaaaactctgaccgggcgagctggggacactgacgagcatgcgcgcagcagcggggacagagcagaggccgagctgggcgactgcgcgcgaccactgacaagcacgggcatgggagtgacgccgagggagctcgatatgggcgggctcggactaaagcacgcgcggcaaggatagtcgacggcaagctaaaaccaccggaaggcgacgacgcttgagaccgtccaaggaggatcgacggcggccgagcagaaggacacggccgacgagctggagcaaggagaaggggcggccggcgaacaggaacgagatccgggctgggagagcgacggccgtgaaaagcaggggcacgacgagcttgagggagctccggcatggcaacggatctcggcgaacttgaagccacggcaccggaggaacagagcgcgcgcaggaagggatcgagctggagctgggcacgagctgaaccgggcgccatgggagcccggggcacggaccaaatcccagcaggggaagcaggcgcgacggccatggtgagcactgggaagggactcagggaggaagacacgcgcgaagctccgatccgcggccagcgcagagcaccagagagacgcggcaagggaggagcgcgcggcggtgaagaacactggctggcacattcgtgcggtcagtctgcagaaatagcaggcgaagaaatgaggccattggccgtacgcagtgaaagaaaatcagaggagaacggtgagcggtggaagaaagaaaaaaaatctccacggcggcggcagggcatagagttgaagagatttttttgtgctggagatcgagcgtgcgacacggagaagatgaggctgagcgctgtgcggtgtccacgtttagtgaagaagaaaaaaaaaatattaagccttcaacggtgggagaggatgaggacggcaaccgtgaagggatgatgtgggggcggggccccgccggcctcccggaggtccagctcgtgaagaagataggagaatggctgggattttttttttccacgagcggcattgggaggataaggattagaggatattttctttttttatttttttaaagaatttcgtagatatttttgaatcccgatttttagcaatgggtaataggtcgaagcgctacacggctatacattttatttttcgaatcatgaaacagaaagtcagaggaataacagcttagacggttctgtccgaatctcgtttggataattttcgtgactattccggccacgctgtacccggaccagattgaaacgagttcggcttcggtattttaatctgctctgcgtgattcgaccgaaattagccgaaaccagatccgcaaatgcatacgcgatttcgtcgccaaacagcgtgccgaagaataaattgaattatatcctcgcacacgatttcactcagacgacgcacgattcggattattttgcaccgagtattttagccgtcgagttcaaattaatctgtccgggataaaaaggcgtaaaaggaggtcgagcttctgaattcggattcgcgcggcgatgaattttaattaatcatcggacgcaccgattttcggaacgacgatgtcccgaacatcacgaaaattttggaagagcccgatcagatgaaaataaaaacgacgtcgcactcgcgttagacgaaacagatgcgatataaaaatcgtggtaggcgaagatgattttggcattcgttttatccattgattacgtgcttacacccatactcgctgtcgagcggaatataaacacctggggtgttacagtgtacctcacagcatacctgttcacccttgatgcacagtatgatttcttggctcggcaccaccgtcagatgattgcccgagcagaagatgcagagaagctcaaccgtaagctccatgtggatctcacctcaacccaagcccgtgtagctaccttgaaaagtcgtgaagtcattgctgttgaagccctgaagcaagccaaggatgagcacgtccagaagttgatggaggcctacttggtaacccataaccaacgtagagccctgcggatccaagaacccgcttcatccaacccagtccaacccatgagagctgaagatccccaaattcgtgaaggtcacccggtctctatcaaaggagagaagaaggcatgggaactcccgaaaggagccatagtcttggaaggaattccagtcttccctcaggccatggataagcaagagcaccgtgaatcctcccaagatcccccgccggagttgtttgagcccctcaccatgaagaagattccagcaccatcccttgaagtcaaggaagaagttgcaagcaccccgccagcaccgccgccctctgaggagctacaagagccagtcccgcttgaagaagagttcgaccccatgttgccatctcagtcgccgccaaaataagtcatcaacatcagcttcctcttgacccatccaggagatgtctcagattgaagttgtgtgtcaggctcgctagaagagaagctgtcagatctgagttagttatgcccagtcctctgcatgcattgggtagtgaagttttttcttcactttggctagagccctgcatgtatgagaggtaacc

SEQ ID NO: 15289 - DNA, 1739 bp, Zea mays
cattgggtacctcgaggccggcccttggccccttctccctttctctctctcctcctctcccccctgtcttcccccattccccactcccccacctctccagctccgtcgctagggctccatttcccctgcacctccgccgccgccgccgcttcaacatcagaagcaccggattcggtggtgtttctcggctgcctcagcttccgccgccgggaggcccctggcggcgttcgccgccgccctccggcctttgctgagtcctctagacttgacaaggctgctgctgagtatatggtatctgcgggccattgtgctgtccatgcgagcggagagcatgcgtggcagctgtgcttcgggtgatgcccctgaccagagtagctgccgatgcattcggtgtgttgacgatcggactgttggcgctgcttgccgctctgggcctcttctgcatcttccaatcggtctacttcaggtgtcagatccggagaggaccctccttcctcccgctcggctactttaacggcccatgggtgacccgcgtcgctctggttctgatcaccatctggtggggagtaggcgaggtagcgagactgagcttcttgaagcaaaagctgttctccagcttgacatggcagaggaacatatgcgatgcgtacatactttccaacctagggttcgcggagccggggatcttcttcgcattcgctttcctgctccatggctcgttgcagaagaaggagctgggcactttaaaccagagatggaactggaagagcatggcctacacgctggttttctgcgttccagtgttctccgtgcaggcagtcctggtgttcgtcgtcgggcccaggcttgttagagactcgaaccatgatctcgggaggaggaagatcgcgaaatacttcgtacggacgcacacgccggttggagacaccagcgtctgcacctacccgttgttgggcaccatctttctcgggctcgtggatgccttcctgatgagctacgtgtcgtacgtcggatcacgggcgctgtccttggtcatcaacaagtcgctgcgaaggagggtgtacctgctgatgctgtcggtgctctgcttcctcccgaccagggtgcttctcctcggcttctcggtgctgcccaggccaggagacgctgccttcgagggcatcgtgttcctgtcgttcttgacgatgctgtcctgcacggccgtcgggatactcttgctggtctactaccctgtggccgattcgctggccctcagagacatgggccagagggacacggcggcagagatggtgccatacgatgactactactgctacgaaggcgcgtcgctcgtggccaaccggagtttccgagaactcgagcgcaactccgacacctcgacgaagccgggatccatatcgttccgcactatgatcagggaagaccagcttcagcaggacggcaccgccgacgagatcggcttctcttctcgcagcggtgcccatatcggatcaccatcacccgcaggctcttcgccgagcgcggcaatgccgatgctccctgtcaaggagatccctagatactaaggagtattcagctgtgctgtgcgttttgcccctctgtgctatgtcctctccttcaccctctttttttcccccttctcttcctcttactaccttgatgataacagttttgtggcaatcaaaaggtttttttttgtaaagttttcgaagtagcttaactcaaaaaaaaaaaaaaaa

SEQ ID NO: 15290 - DNA, 2258 bp, Zea mays
gccgctccagccgcccccctcttcgtctccgctctctctcctccccgcccccttggccccttctccctttctctctctcctcctcctctcccccctgtcttcccccattccccactccccccacctctccagctccgtcgctagggctccatttcccctgcacctccgccgccgccggatctcactttgcctcgccgccgccgccgccgcttcaacatcagaagcaccggattcggtgctgtttctcggctgcctcagcttccgccgccgggaggtccctggcggcgctcgccgccgccctccggcctttgctgagtcctctagacttgagaaggctgctgctgagtatatggtatctgtgggccattgtgctgtccatgcgagcggagagcatgcgtggcagctgtgcttcgggtgatgcccctgaccagagtagctgccgatgcattcggtgtgttgacgatcggactgttggcgctgcttgccgctctgggcctcttctgcatcttccaatcggtctacttcaggtgtcagatccggagaggaccctccttcctcccgctcggctactttaacggcccatgggtgacccgcgtcgctctggttctgatcaccatctggtggggagtaggcgaggtagcgagactgagcttcttgaagcaaaagctgttctccagcttgacatggcagaggaacatatgcgatgcgtacatactttccaacctagggttcgcggagccggggatcttcttcgcattcgctttcctgctccatggctcgttgcagaagaaggagctgggcactttaaaccagagatggaactggaagagcatggcctacacgctggttttctgcgttccagtgttctccgtgcaggcagtcctggtgttcgtcgtcgggcccaggcttgttagagactcgaaccatgacctcgggaggaggaagatcgcgaaatacttcgtacggacgcacacgccggttggagacaccagcgtctgcacctacccgttgttgggcaccatctttctcgggctcgtggatgccttcctgatgagctacgtgtcgtacgtcggatcacgggcgctgtccttggtcatcaacaagtcgctgcgaaggagggtgtacctgctgatgctgtcggtgctctgcttcctcccgaccagggtgcttctcctcggcttctcggtgctgcccaggccaggagacgccgccttcgagggcatcgtgttcctgtcgttcttgacgatgctgtcctgcacggccgtcgggatactcttgctggtctactaccctgtggccgattcgctggccctcagagacgtcggccagagggacatggctgcagagatggtgccttacgatgactactactgctacgaaggcgcgtcgctcgtggccaaccggagtttccgagaactcgagcgcaactccgacacctcgacgaagccgggatccatatcgttccgcactatgatcagggaagaccagcttcagcaggacggcgccgccgacgagatcggcttctcttctcgcagcggtgcccatatcggatcaccatcacccgcaggctcttcgccgagcgcggcaatgccgatgctccctgtcaaggagatccctagatactaaggagtattcagctgtgctgtgcgttttgcccctctgtgctatgtcctctccttcaccctctttttttcccccttctcttcctcttactaccttgatgataacagttttgtggcaatcaaaaggtttttttttgtaaagttttcgaagtagcttaactcatcaccattagcccagtactcttgatcctatttaacaacgtagcaagtagctggatcttgcagtggctgttgagctgtgctcctggccgtactggccgcaagaggctgactggctgagttggaattcacttttggttggtttggcttttgctgctccacaactcataatatcttagctgagaagttttacaccgtggactaggctggaatggggggcctctgctgtgtcgcttgttcctctccgcgacagctgtgcgaagagtgtatcttgctacacttggccttccatacctgtacagccctttcttatctgtctgaacaaacagtttatcggtgaaggtaccaggataattacaaatgttttatcagattaattcaaattgttttttgcccttggcgtggtgtttaacttagatgtggatggctgaaaggatcaaagggcccaactgcccaagacccctgcaggcatgcaag

SEQ ID NO: 15291 - DNA, 1266 bp, Zea mays
  misc_feature (1255)..(1255): n is a, c, g, or t
aatgagactctgaggctctgagctgagcgcgctccgtttcagtttcagagagcggttgctgtgcatgtgctggtgctgcgacttgactgttcgagcacagctgcgtctgcgtccccatggtgtagataggaggggaggaagcaggaagagggggaggcagcctgtgtgtgtgagagagaggcagaaagtagtgaggaaggaagcaggaagatggcttggaatgcccgcttcggcgatgacgaggaaggcagcggccttgagctcagcctgggccttccgggctacttctccgggtcgccagaccaagccgcaggtttcgaggagaaagcgagccggggttctgctgctgctcctcctcctcctcctcccgctgctgctcgagcgaaaggaagcgacggcttcaaggcgaggccggcggcagctgctccggtcgtgggatggccgccggtgcgcgcgttccggcggaacctcgccacgtcgtcctccaagccgtcgagccacggaggcaaggagcccgccgcgagcgccgacggcggcaacaagggcctgttcgtcaaggtcaacatggacggcgtccccatcggccgtaagctcgacctggcggcgcacgccggctacgacacgctctccgccgccgttgacagcctcttccgcggcctcttcgctgctcaagcggcggggccaggcggggagcagcaggctgtcgcgggtatcctgagcggcggcggcggcggcgagcacacgctggtgtacgaggacgacgagggcgaccagatgctggtcggggacgtgccgtggccgatgttcgtcgccaccgctaggcgtctgcgcgtgctcaagagctccgacctgagcccgtcgtcgctgagggcagcgagagccgcagctgagtgctgaacgcaccctggacctggagcctgaacgttttgcggcctctccggagggcccatccgtgtaaaatcgaagcagttttcgtcgattttgcttttagcaagggattatatgtcctagtgatcaagtagggaagcaagaatctatctagaggtgatgaggggtgtcgtagaaccatgcaatcctagtgctagattttttttctgaaagtttaacaaggtttcttggcgctggctaggacagcggatacgttatcgagctcgccacggcccatgggctactacatgttttgtgagttgtgtgacctggggcgacctagttcttttgtattattttttctggaaaaaatttatagctagatttngatttaaaaaa

SEQ ID NO: 15292 - DNA, 966 bp, Zea mays
  misc_feature (43)..(43): n is a, c, g, or t
  misc_feature (57)..(57): n is a, c, g, or t
  misc_feature (80)..(80): n is a, c, g, or t
  misc_feature (84)..(84): n is a, c, g, or t
  misc_feature (108)..(108): n is a, c, g, or t
  misc_feature (128)..(128): n is a, c, g, or t
taaaatccaacccatcagtaaaccttggcgtgtggtggtgttnggagcagctgaaanagcagtatgtcgtgttgcacagnaagnattatttaacttttgaaggtatangaaagctcttgccaaccagnaaaaaccacactcttcctgatgggcaggtttttttctttttaaaaagaggggtacattgttggtgaagctttatttcaaccacgtatattgggcttggcggattatggtatcgttcaccagctagtcactagtgtctcaaatgtttcatcagagtaccatcgtcagctgcttgaaaataccatgttatgtggtggcacctcatcaatgactggctttgaggataggttccagagagaagcaaatctgtgtgcttcagcaatctgtccatcacttgtgaagcctcctgaatacatgcccgagaacctagcaaggtactcggcctggttgggtggtgcgatattggctaaggtcgttttccctcaaaaccagcatgtgaccaagggcgagtatgatgagacggggccgtccattgtgcacaagaagtgcttttagaggcaaatgccttgaactagcacggttggtgcaccatttgctgctgttcatgtcgcaggtgtgctcgtacctgaacgttgcggcctttcgggtgctgatgcagcgatgcttgtgtctacaccttactccagccacagttcatacctgacggttgctaagtgttgatgcatctagctagctcggttaggatggattggcccttaggtttatttagagtggaatagagtgtagtgtcggcatgtactccttaggagttttagccaattgcccatttgtacctgtagtaccagagaatttgttgagatttccttttaaatttacattatgatccattacctgttcagctgctactagtgaaagagttcttcgaagcatgctcacaaaaaaaaaaaaaaaaaaaaaaaa

SEQ ID NO: 15293 - DNA, 1759 bp, Zea mays
ccggccgggttgggcacctcgaggccggccggggggttatccccgtttctacgcgctcgctcctgtacctctccccagtgcccaagaatccaagatctggaagggccaggtgggaggaccaagcttcgtcgacgtcgactcctcgtcctccctcacctcgctcgcttctctgcaattctccgcagccctcctctttcggtctttcccgctggcctcctcttttcaaaaccctcgctaatctcgtgccccgtcccacccacctctagcttcgaatcctagcgcctcgcctccgcattctagggtttccccgcctccggcgccggccatggaggcggtggtcgtcgacgcgggctctaagctgctcaaggccggcatcgcggcgcccgaccaggcacccccactggtaatgccgtcgaagatgaagctggatgttgaggaccaggagctggctgacggcgcggtggtagaggaggtggtgcaccctgtggtgcgcggcttcgtcaaggactgggacgccatggaggacctactcaactacgtcctgtacagggacattgggtgggagattggggacgagggccagattctcttcaccgaacccctcttcacgccaaagactcttcgggagcaattggtgcagcttatgtttgaaaagttcaatgtttcaggcttttatgcctctgaacaggctgtattgtcactctatgctgttggacgcatttcaggatgtaccgttgacattggtcacgggaaaatagatattgctccagtttgtgaaggagctgttcaacacatagcttctaagagattagagattgggggagttgacttgacaaacctgtttgcacaagaactgaaaaaatccaacccatcagtaaaccttgatgttgctgatgttgagctgctgaaagagcagtatgcgtgttgcacagaagattatttaacttttgaaggtatagaaagctcttgccaaccagaaaagcacactcttcctgatgggcaggttataacaattgaaaaagaggggtacattgttggtgaagctttatttcaaccacgtatattgggcttggaagattatggtatcgttcaccagctagttactagtgtctcaaatgtttcatcagagtaccatcgtcagctgcttgaaaataccatgttatgtggtggcacctcatcaatgactggctttgaggacaggttccagagagaagcaaatctgtctgcttcagcaatctgtccatcacttgtgaagcctcctgaatacatgcccgagaacctagcaaggtactcggcctggttgggtggtgcgatattggctaaggtcgttttccctcaaaaccagcatgtgaccaagggcgagtatgatgagacggggccgtccattgtgcataagaagtgcttttagagacaaatgccttgaactagcacggttggtgcaccatttgctgctgttcatgtcgcaggtgtgctcgtacctgaacgttgcgcccttgcgggggctgatgcagcgatgcttgtgtctacaccttactccagccacagttcatacctgacggttgctaagtgttgatgcatctagctagctcggttaggatggattggccctaaggtttatttttatttagagtggaatggagtgtagcctcggcatgtattccttaggagttttttagccaattgctcatttggtacctgtagtaccggagaatttcccgagattttcttttaaatttacattatgacccattacctgtcc

SEQ ID NO: 15294 - DNA, 1763 bp, Zea mays
attcagcctaccggcctaccggaagcgactgagcgtacgggttatccccgtttctacgcgctcgctgctgtacctctccccagtgcccaagaatccaagatctggaagggccaggtgggaggaccaagcttcgtcgacgtcgactcctcgtcctccctcagctcgctcgcttctctgcaattctccgcagccctcctgtttcccgctggcttcctcttttcaaaaccctcgctaatctcgtgccccgtcccacccacctctagcgcctcgcctccgcattctagggtttccccgcccccggcgccggccatggaggcggtggtcgtcgacgcgggctctaagctgctcaaggccggcatcgcggcgcccgaccaggcacccccactggtaatgccgtcgaagatgaagctggacgttgaagaccaggagctggctgacggcgcggtggtagaggaggtggtgcaccctgtggtgcgcggcttcgtcaaggactgggacgccatggaggacctactcaactacgttctgtacagggacattgggtgggagattggggacgagggccagattctcttcaccgaacccctcttcacgccaaagactcttcgggagcaattggtgcagcttatgtttgaaaagttcaatgtttcaggcttttatgcctctgaacaggctgtattgtcactctatgctgttggacgcatttcaggatgtacagttgacattggtcacgggaaaatagatattgctccagtttgtgaaggagctgttcaacacatagcttctaagagattagagattgggggagttgacttgacaaacctgtttgcacaagaactgaaaaaatccaacccatcagtaaaccttgacgttgctgatgttgagctgaaagagcagtatgcgtgttgcacagaagattatttaacttttgaaggtatagaaagctcttgccaaccagaaaaacacactcttcctgatgggcaggttataacaattgaaaaagaggggtacattgttggtgaagctttatttcaaccacgtatattgggcttggaagattatggtatcgttcaccagctagttactagtgtctcaaatgtttcatcagagtaccatcgtcagctgcttgaaaataccatgctatgtggtggcacctcatcaatgactggctttgaggacaggttccagagagaagcaaatctgtctgcttcagcaatctgtccatcacttgtgaagcctcctgaatacatgcccgagaacctagcaaggtactcggcctggttgggtggtgcgatattggctaaggtcgttttccctcaaaaccagcatgtgaccaagggcgagtatgatgagacggggccgtccattgtgcacaagaagtgcttttagagacaaatgccttgaactagcacggttggtgcaccatttgctgctgttcatgtcgcagttgtgctcgtacctgaacgttgcggccttgcgggtgctgatgcagcgatgcttgtgtctacaccttactccagccacatctcatacctgacggttgctaagtgttgatgcatctagctagctcggttaggatggattggcccttaggtttatttagagtggattggagtgtagcctcggcatgtattccttaggagttttagccaattgctcatttgtacctgtagtaccagagaatttccttttaaatttacattatgatcaaaaaaaaaaaaaaaaattacctgttcagctgctactagtgaaagagttcttcc

SEQ ID NO: 15295 - DNA, 1665 bp, Zea mays
acctttttggtgtggtgagtgaaagcagattgagcgtcacttgatgacatgcttcttcaaaacaaacaaaaaatggattcacctgcttcctcaaaacaaacaaaaaataaattcacctcatttctctaaccaaacataaagaaagaaccatccaatcctgtgaggaatgaatccattccggatcggctgattccggatggagccaatcccctaaccaaacacgccattagtgttttttctcagctacgtgcttctattctataacacgggaagggctgagaaaaaaccaccactaccaatttaaaaaacccaaaattggatgtctaccgtgttttggacggctctatctactatctcctcgacacatcctatcaaaagaaaacaccacacataaaaatcccgtccctatccgccacggcacactcatcgccatgcccgccgccatgccctctccgccgggccgcctcctcgcttctatccctctccgctgccacgctccgacccagcagccctccaccaccgccgcccgcggcctcctcctccgcggcgcgtgctccccggttgtcaagcgtgtcccggacggtggcgggtggctcctctggcaccagtccggcccccgcgtggcgctctccacctctatggacggtctccgctggagcgccccagtatcccccgacccactgctaccctcagaggattggtggacgttcgataccgcctgtgttcgcccctccgacgtccttctcgtctccagccccgcggcgtcatcccgccgcttcccgtcctctgccgtatactggctctactacacgggctccaccgacgagcggttcggctccccgtttccggatgcggacgtccccgcgcttcccggcctcgctatcagccaggacggccgccactgggcgcgtatcgagggggaccaccacaccggcgcgctgttcagcgtcgcggaggaaggggagaaatcccgagggtgggaagcgcgctgcattgtcgcacccaaggtggtcatgcacgcagacagggacctgcggatgtactaccactcgttcgacgaaatgtcgcagaggcatgcaatcggtttggctaggtccagggatggtatccgatggaagaagacggggaaggtgcttgagggggggcgtgctggttgctttgacgaatgtggggtgcaacatggacatgtcgtccgtgaccgtgctgcccggcagtatgtcatggtgtttgagggtgttgacgcagatggtagagtgagcattggaatggccgtttcagaggacgggctgaaagagtggaggcggtctagcgagatgccagtgctgtgcccatcttacgatgacgaagggtgggatgccgctggggtcggttcaccatacttggtacaaatggacggggcttatgattggaggctgtattacatgggtgttgggagggacggggaggcttccattgggatggcgtattcagagggtcaggctcttctgaaattcgagaaatgtgatgctattgcatataagatgtaaggtgaggtttagtagtttcaggggatgtacatttgaagtggctctggcctttctggtggtgttcaactcacttcagacaaaacacaattttaagattaaaaaacttttgcatcagcgaaaaaaaaaaaaaaaagtattg

SEQ ID NO: 15296 - DNA, 1320 bp, Zea mays
attacattgacatatcggaggaagtacaccacctatgtgcatctcccttcgcggcgcgaacggttcctctgacgtccggccgctgccatgtggggcatgccatccccgatcctgccggctttgcggtctgctcactcgatcgtcgaatagtgcgtcccttcggctcatcgcgcaaagcaaggaggcatggcagctagggttcgtgcgccactcatccccatctccctccgccgtcgactcccttcataccagtagcgccgcccaccccatccgccgaatagtagcgctgcccattccatccgctcggaagaaccgccgccctcctcccttcaccatccaccgcacctatccaaggtaaaagcacaatctgcgtattcgccgaaaagtagcgctgcccactccatccgttcggaagacccgccgccctcctcccctcaccatccaccgcccctatccaaggacattctccgtgcaccgcccttctatccccgtgcggaggttaggcctccacgccgaagcttgtttcaggcttgtcctagtacataatattgctcgcctctcctgtctcctctcctcgtcgagcggttgtgggtggtcgatccataaggccggaatggcaaaccaccaggagaagcccaccacgtccccaccgccccagccggcggagggcagcgtcgctcgcccccgcttgcccggcgtcggcaacgcacacccgggcagtgccggatacccaaacccgccagatgccgcgatccccgatgcggcgactcttcgggaccagtggcggtttgccgtgcggcagtacagccgctggtactcccacgcctggggcaccgccatccttgccggtgccgccttcttcgcgcttgggtggcttgtcaaggggtcaaacccgctcccgtcccgggccgagccacaacacggcgccattggcaaatccgtcgctaaggaggacaattgaccggcttaggtgaaccaccttgagttacgagctacagctttagtacaggatttcaagccgttcggttgctggtcatggtgttggctgttggtacagtatttggtgagagcttgatgtcacagcagcagtagaagcggtgctgtaaaacctggcagccgaacagcgtgaaaggaaggtttgtatttcaaaggatctacaacaatcaaattctgtggttttgattatgtccgttctatcgttgagctgatattgtagttcagttctttcttgtgcttggagtattattacatacatgtatgacaatatgagttaataaacttggagcgctttgaattatgcaaaaaaaaaaaaaaaaggcc

SEQ ID NO: 15297 - DNA, 659 bp, Zea mays
atagtgcgtcccttcggctcatcgcgcaaagcaaggaggcatggcagctagggttcgtgcgccactcatccccatctccctccgccgtcgactcccttcataccagtagcgccgcccaccccatccgccgaatagtagcgctgcccattccatccgctcggaagaaccgccgccctcctcccttcaccatccaccgcacctatccaaggtaaaagcacaatctgcgtattcgccgaaaagtagcgctgcccactccatccgttcggaagacccgccgccctcctcccctcaccatccaccgcccctatccaaggcttaggtgaaccaccttgagttacgagctacagttttagtacaggatttcaagccgttcggttgctggtcatggtgttggctgttggtacagtatttggtgagagcttgatgtcacagcagcagtagaagcggtgctgtaaaacctggcagccgaacagcgtgaaaggaaggtttgtatttcaaaggatctataacaatcaaattctgcggttttgattatgtccgttctatcgttgagctgatattgtagttcagttctttcttgtgcttggagtattattacatacatgtatgacaatatgagttaataaacttggagcgctttaattaaaaaaaaaaaaaaa

SEQ ID NO: 15298 - DNA, 2529 bp, Zea mays
tgtagtaactagtaatttgtcgatttttattaggctttctagccttgtaaatgctgcctgctttttttttgtaacagatgaaacacttggcttttactccgtttatttctaattagcttaatcaactattttattgctgcatatattgtttgtcattcttgtggtcttttggttcttaatcttataatctgtaagtgttaatactactgctacagtttggcttaatatttgagtgtaatgttggtgaatgacgtggttaatgtatgattgcttttggttttttgtgaacctaccgatgtatgtggactcttggacaaacacttagaagccatgcccgatgacttccaacaaacccatagggattcacatgagattgaatggatggtgttgatggatattagaaatatgctatagtcgatgagtaagggtataacattgttctctctttctgagattcacgtttcagatgataacatggttggtgtgatataatttctcacctttgaaacagtgataatgtaaaatttgttagtaatttttacatacgaacaatagcgagttctttaccttttacattttcagtagtatttaaatgattgcaactaaaaatatgtcgatttatttttatggttagtattattttaaagatttgaaacgtatttgaacaactatcctattcaaacaaggtctaccgaaccgtagcaacaagtttgccactcatgctcagaagtttagtttattttttcctcaaaaggttctttcttgttgaggctgtgaggcttgttccaacatttcttattccaaattctgagtagtactatatgtggtcgctccttgtaaattactggaaccaaacaattattttataaattctcaagtatagcattatgcaagctaaattggttgctttctcatcttgtctatgttgtttgcgtcacaggcttaggtgaaccaccttgagttacgagctacagttttagtacaggatttcaagccgttcggttgctggtcatggtgttggctgttggtacagtatttggtgagagcttgatgtcacagcagcagtagaagcggtgctgtaaaacctggcagccgaacagcgtgaaaggaaggtttgtatttcaaaggatctataacaatcaaattctgcggttttgattatgtccgttctatcgttgagctgatattgtagttcagttctttcttgtgcttggagtattattacatacatgtatgacaatatgagttaataaacttggagcgctttgaattatgctatccgatgtagcatcataagagtcattataccttgaattagggtctgtttggatcaatagtgctaaactttagcaatacacttaaactttatcacttggagatccaaaatatgagtgctaaaaggtgctaaaaactgaagtgctaaactttagcactcaatagcagttgagctcttcaagatgtgctaaactttagtactctgttaaaattaagcacatgagatccaaacagtctcttagtagatggctgtagctttaatggatgcatatatgtatttactagataagaaattgcacatatcacttgttttgtacgagggcaacaccgattctagatttttccccgatttttttattttttagctgtcccagattttaatcagtgtagcttccaattagccatccagcttccgtcacccggtgggaaaagaggatgacatgtgcaggttacagacttccttcgcttaggtcttctccaccccgccctgctgcttgccgctgcggtccagacgggccccgcgcgcgggggatcgcctcctgtgatgacttttgctccgcgaataaaatatctatacggtgggttcttctttcgtcagtgcttataaggccattctcatttctcaatgggacttttatattcattaaatgcgataacacataatcacacctggttatattgcagtgtgatattgcactgcaattaataggggacacacacacacattagggttttataaaaactgagttggttctaaacatactagtttatgctccaatttatataaactagagtctcaatttcttaaaatcaagaaactattctcacttagttaaaggcactttatgaaaattaatgttgttccaaacaccattaaccagtttgtttttttataaatcagtttctagaaattggagatagaaactagattattaaaaactaggttgcttccaaacaagtttatagaaggtggtagagttccatgaccatgaaattctgcacacaagatgattataatcgtcatttgacctccaggaagatgcagcatttccctctgtcaatgatccccgtgattatacccattttgtttcctgaaaagtcaggaacctcgccagcctttcagaaatggtgtaaacaaatgtaccacgtgttttgtgagttgtaccctgccggatcccggatactgttgtatttaatctcaagttggacaatgaatgatgaatatatatgtacattagaaaaaaaaaaaaaaaa

SEQ ID NO: 15299 - DNA, 796 bp, Zea mays
ctgtattgttgcctggcccattctcgtgactgcttcctctactcgaaaatcctccgaacagaacgcaggcaggcggcggcggagacaggatcaggttcctcgcagccggcgttaagtagggcggccgccctacatcgtcccacctgtaggtacgacactgcgccgcttgaaggaggctttgcggcgatggaccgggtcggcggcggcgaaaagcaactggaggattgcacagtagccaatgctctaggaacttggttcttctcagttgcgggtgctcttgttgctattcctgtgggcataaagaagaaatccttagccccactcgtcttcttcggcactactggaaccatgctggacattatcatgggcattacccagtgtgagcgagagcatgctgagcgggaaatgaagattttggaagcccagaaattttcggtcgatgcttcagctcagaacgaaagctctgattcctttggcagtgctgacaagtgaaacacttctcctgttttccctcacttgtgacctggcttcacctctgttaattagagttgttgctcagatgccaatttgacacctttaaatttctgaatacactattcctactccctcaataacgtgcaattgtgcatttgatcaaccattagtttttatatatattgtgaattgaaaacaaaatataaaaggttcagtcttgctcctcaagcaagattgccacatggtgaaaatagctcaatccattgtacggcttggtatgggactatatatatataatgtttttttaaaaaaaaacttgtgc

SEQ ID NO: 15300 - DNA, 726 bp, Zea mays
acaatggcccatgagcgtcattctcggagcctacggagtaccaaccacgtcaccgaaactgtagacgaggaggacaagggtcaagccggccggggccaaccgccccaatctcgcgtcccgccggcggccaccaccaccaccgccatgatcagcatcctcgcgcaggagcgcctcctcgggttcgccctgggctccgtctctatgggaggtttcgtcctccaccagcgccgcgccatctaccgctcaatcgctgaagccgatgggtcgtcctacttctaccagcctggtgaaattgccggtcgtagaagttcaactgaactggctcatgtatggaacaaggcggtggacgagactcttgggaaacttgttgtgtaccttagctctcgtggatggtgatccaagcaccatgtcgaacatggcaactgaggaggcacgggtggaggaagactcttttttgaagccactgatgtgctcatatttctctgtatccggattgagcatgttttgttttaaaagaaaagatgctcccagtggccgatttatctcgaactgagccgtgccgcctgcatgtttcccttaactggtgcatgttacttcgaggtcaatgttctggcccctgtaaaggcaggattcgtctaactattttgcatatatctattgcaaataaagcctccgtccaaaaagattgcaagtaaaaaaaaaaaaaaaaaaaaaaaaaaaaaaaaa

SEQ ID NO: 15301 - DNA, 729 bp, Zea mays
cattgggtacaatggcccatgagcgtcattctcggagcctacggagtaccaaccacgtcaccgaaactgtagacgaggaggacaagggtcaagggaaagaaagccaaccgccccaatctcgcgtcccgccggcggccaccaccaccaccgccatgatcagcatcctcgcgcaggagcgcctcctcgggttcgccctgggctccgtctctatgggaggtttcgtcctccaccagcgccgcgccatctaccgctcaatcgctgaagccgatgggtcgtcctacttctaccagcctggtgaaattgccggtcgtagaagttcaactgaactggctcatgtatggaacaaggcggtggacgagactcttgggagacttgttgtgtaccttagctctcgtggatggtgatccaagcaccatgtcgaacatggcaactgaggaggcacgggtggaggaagactcttttttgaagccactgatgtgctcatatttctctgtacccggattgagcatgttttgttttaaaagaaaagatgctcccagtgaccgatttatctcgaactgagctgattctactgcatgtttcccttaactggtgcatgttacttcgaggtcaatgttctggcccctgtgaaaggcaggattcgtctaactattttgcatatatctattgaaaataaagccttcgtccaaaaagattgcaaaaaaaaaaaaaaaaaaaaaaccggccgcc

SEQ ID NO: 15302 - DNA, 802 bp, Zea mays
gcacgaggagagaacctgtctccagcctgcctcgatacttttccttgttttttctatcccacggcggccaagctgtggaaacgagggagacgaggaggacaagggaaagaaagcctaccggctcggcggctccggctcacctcccacacccccaaaaaaaatctcgcgtgccgccggcggccaccaccatcactgccatgatcagcatcctcgcgcaggagcgcctcctcgggttcgccctgggttccgtctccatcggcggcttcgtcctccaccagcgccgggccatctaccgttcaatcgctgaagccgacgggtcgccctacttttaccagcctggtgaaattgccagtcgaagaagctcaactgaactggctcatgtatggaacaaggcagtggacgagacccttgggcgacttgttgtgtaccttagttcgcgtgggtggtgattcaagctccatgttgaacatggtaaccgaggaagactctttttcaagccactgatgtgctcatacttccctgtacccggattgaacatgtttttttttttaaaaaaagagatacttccaatgaccgatttatctgaaattctgaaccgagctgattgattctaccgatgcttccctgagcaggtggatgttacttcgaggtcattgttgtagccctgtgaaaggcaggactcgtctaactattttttacatatatgtattggtaataaagaatgtatgttactttgctgaaaaaaaaaaaaaaacaatggaaactatgctcgttctctaaaaaaaaaaaaaaaaaagcggcc

SEQ ID NO: 15303 - DNA, 1999 bp, Zea mays
gcacgagaccattacctagaacatcctaatcgaaaaatccccttctggccttctcaccacgaacacgcgggacacctcggaagcatccggctcccagatctgccgaagaaccctaccacccaacgttctagaacttcccctctttccccgcatggacggcctcgtggcgccgtcgccatcccactccggcgccacctccggcggcggggcctcccaccgcaagcggaagctcccgccgtcgtcgctctccgacgccaccggcgacgaggacgacgacaccaccgctccgtcatccccctccacggccccatcctcgccctctcgcccgtcatctccatcttcttcgcactccgacgatgacgacgacgactcgctccacacgttcaatgccgcgcgcctcgacggcgcgccgagtgggggctctgcgtccggccgtcctcctaagccggattcctcatcagtgtctgctgctgcggcggcagccgcggctgcggtgggtggaggacctaagccggagcccggctcggcgaacgccggcgacgggaaggaggacacaaaggggctgttcacggacaacctccagaccagcggcgcgtacagcgcccgtgaggagggcctcaagcgcgaggaagattcaggaaggctgaagtttctctgttattctaatgacggcgttgatgaacacatgatatggttggtagggttgaagaatatcttcgcccgacagcttcctaatatgcccaaagaatatattgtacgccttgtcatggatagaactcacaagtcaatgatggttatcaggaacaatattgtcgtggggggcattacttatcgcccttatgcaagccagagatttggagaaatagcgttttgtgctatcacagctgatgagcaagttaaaggctatggaacaagattaatgaatcatttgaaacaacatgcacgggatgctgatgggctcacacatttcttaacctatgctgataacaatgctgttggctattttgtaaagcagggtttcacaaaggagatcacattggacaaagaaagatggcaagggtacattaaagattatgacggaggaatattgatggagtgtaaaattgacccaaagctgccatatgttgatgtggcaacaatgattcgacgtcaaaggcaggccattgatgagaagatcagagagctttctaactgccatattgtttattcaggaattgattttcaaaagaaagaagctggcattccaagaagactgataaagccagaagatatccctggtctcagggaagctgggtggacgcctgatcaattggggcattctaaatcacgatcatcattctccccggactataatacttacaggcaacagcttactacccttatgcagacagcgctgaagaatctgaatgaacatcctgatgcttggccattcaaagagcctgtggattcacgggatgttccagactattatgatatcatcaaagatcctattgatttaagaacaatgttaagaagagtcgactcggaacaatattatgtgaccctagagatgtttgtagccgacatgaagagaatgttcagcaatgcaagaacttacaattctccagatactatctattacaaatgtgcgacacggcttgaaaacttcttctcgggcagaattactgtactgcttgcacaactctcaaccaagagctaggctggcgtgggctcactggactggacactactgtcgcatgttgtaaaattattattggctcactggactggacactactgtcgcatgttgtaaaattattaagttgtattgatatagttgtcaccttgctgaatgttcggcacggtgatgaacttttagtttagcatgtagtttttattttaaccaggagggacactgattgatctttacatttcggtctcaacctggccggcctaataatatagattgaggagattcttcagtttctaaaaaaaaaaaaaaaagatggtttgcatcctt

SEQ ID NO: 15304 - DNA, 1435 bp, Zea mays
caggccggccgggccgggaacaaatctattcttcttgggcgacaagcctaaaacctctagagccaaaaagacataaacaccataaaaaagagctcatttaccatccgcaggagctcccttccagacgcttccgctcttctctctctgcttccggcagaaatcaaggcagtattaggatggtgaccccgcgcctcttcgcgcgactctaccggcattgcgtcggcgcagcggctgcgtcatcagccgcggggcggcaccggggggccctggcagcggcggccgtggagcagttcgccggttcctccctgcctgtcggggttccaaaatttttgaatcatcatttcagatactcaaccagcatttttcaaaagattggtttctcgtctgtttcaccacaacaaagtgatgatgatgttaatgagctgaaagaccacgaaagggccttagatggatcaagtgaagattgtccatctggaagtattgaaggccttgatctgtcgagagatgatttggtgaagctagttcgtgagaaggatggattgttgaagtccaaagatggtgaaatcaaagatatgaaggataaggttttgcgcagctatgcagaaatggaaaatatcattgctcggacaaaacgtgaatctgagaactccaaaaaatatgcagtacagaacttctctaagagcctgctagatgttgctgacaatttggctagggcatcatctgttgtcaaggaaagcttctcgaaaattgatacctcaaaagattctgctggagctgtcccactactgaaaaccctgctggagggtgtggacatgactgagaagcaacttgcagaggtcttcaagaagtttggagtcgaaaaatttgacccgctgaatgaggaatttgatcctaacaggcattgtgcagtttttcaaattcctgatccttcaaaaccaccggggaccgttgcttctgttgtaaaggtgggctacatgttacacgatcgcgtcctccgccctgccgaagtcggcgtcactgccacggagggaggtgcgcatgcaactgaagaggcagagaagccggaggagaaaacagcgagggactaaagttagccgtggtgtagtcaaggaggattgaatgccgtttctgtttagagtttgagaaacatgaatgaatgcagaaaacttttggccgtgttcgacacggggagaaagtttagcaagcaggctggcgcctttttttttttcttgtttggaacttggaatgaaatccattttggggtttggagcaaccctgcatgtcgtacaacaccttctgcctgctagtatgtgaccgttgaccttgagggatgggcatgaggcccttggccgatactaaagagctgtgctgccgtgatcggctttctgtggctcaaaaaaaaaaaaaaaaaaaaaaaaaaaaaaactcgagagta

SEQ ID NO: 15305 - DNA, 1952 bp, Zea mays
ccctcccggccggccgcactcgggttttcttccgcaagctgttatctctcgcacgcaaacgactagcgcagcaaacaccccacctcgctcgcgatcgcggcacggcggcggcaatccaccgcggctcgctgccttcgccagtgatctggcctcttcgagtctcgccatcagataatcatccccagccactcccctcatctcccatcccctcccttccccttccgctgaatcggcgcggagaggatggcgtcccggcggggcagcagcagttgcgcgctctgcgagggatccaacctgccgtcttgttgcgcctcgtgcgtcaacgcgaggctggtcgagtaccacacgaggctgcgcatgatgaggagcctccgcgactccctccacggccgaatcgccgcacgcctcgaagccaagagaaaaacagatgagcagcggatctggagaacaagcaaagaacaggatatcatggagttgaggaatcggctcactgaattgaagagaaaaactgccgtagacaagaccgaggtcgagcaggcatcgagtgatcttaaggcaaaaactgtgccattgaatttggctcttgccacgctaaaaaagagacgagctgatgcagtggccatgcacaccaatgccatgaaagttgctcagatgaatctcatggcaaccacctcagattgtatgaaaatgcaatcaaaatctgtaaagcaactttgcagattgtttccaatgcgacgagtaattaaagagggagaaaagaaagacggctacaatggtccgtatgattcaatatgtggggttcgtcttcctcgtggtcttgatccacattctatttcatcagaagaactgtcggcatctttggggcacatgctacatttcatcaatatagcagttcgtatcttatcagcacctgctcttcatgtatcaggctgtaagggctcatgctcaaatatatggcagcggagttcctactggagcacacgacagtcccagagcaaggtttaccctctttttatacctaggaaaaatgtttgcacaggtggtgaagaaacttcattgacagaaagtggctcgagtaactttggggttgactctgtggattctgtcaagaaaccgtcttttgatcccaagagaagcaatagctttaacttttctggtgcatcttcccactccatggagaggcatcaatatttgcagagaggaatatcactattaaagacaagtgttacagccattactacctactattacaactcactgggcttggatgtgccatccaatctttctacttttgaggcgtttgctaagttgctccatatgttgtcgtcatcaaaggcccttcgaactgcttttgaattggacattgcttcaaggtcagagaagcaagcgcagcagctgaacagatcgatttggaaggcaagttctgccatatcatcggacagcagttttatggacagcatgcacacaaccattatgcccagcactctggacaacctcctcatgaactcagacgagagcctgtacactggtaagctggtgaagcatggtggcgtgccagatagcatattcgacagctgggacatggtagagcgtgaggttctaccaccaccaccctcgcgggttgaagacgtcgctcagtgggaatgggccatgtatgctggcagcaccaaaaagaaatgacctctatttacaaatcctccgtgaagcccaaactgttagacactgcaagagcttcagtttagatatgtaagtacttgatcactaggctcttagaaaccgggaatgtggaacttggccacgttcctcatttctggaacgtgggaataatctcgttcccatagttttaaaacctaatttaaatagcgtactgtgtacaatgttcctatatctcgatccattcatgcggccgatctggggacctggttactaagatcaggctccggtcccatgtg

SEQ ID NO: 15306 - DNA, 3949 bp, Zea mays
  misc_feature (858)..(858): n is a, c, g, or t
ttgttttgcatgtcagccatcgcctcaagccccatcgtctatcagggatgcctacaagtatatgctagcttttgttcttatagattccaaattttagtgctgggtatggctgaatatcaaaagtccatggggtcttcatatgtgtgcatttgtgctagatgagtaatgaattgaacagattgaaaatatcacacgtatgcctagtaacatgcagatatattgtcatttatgtacaagaattagttcaaccttaaaatccatagaaagttttagtttatggcacacataatggtgctttccttctaccagatttctagtagaaatacacttgctgcttcaaggccccattactatatgaattcattgttgactgacgggagcaaagtagcagatcagtttgggtgttttggtcagttttgtggctaaatagtgttgttgtttatattttttattagagcacttgctctgtttgcaattgaaaaggttttcaaaaacagaaactctgctgttcattgaataggtttccaatttgaattggttaaagctcattctagcataattctatcggtatcgaaactctgcagttcattggttaaagcccaatgtgtaatattctgaaactctaaatgctctaggtctacagcatctaccgcccctgtccaggttcctgcacgatccagatgttccctgtcagcttagtctgcagatcagaaaatgctctctgtctccagtgaattgcggtgggatagcgggataggaaaatggaaagaacaagtcgaacatgaaagtagcgacgtcgggtgagggatggcggcaaatcactgaactgcaccagttgcaaactgcacatggtttaangctcactggttggaggctaaccttcagtttgggcctaatcaaattgactgaagtaactaaattaaaatatagggctcaattatgaggcttgtgattggagttgttcttaaatccctacaaaatcaccacacggaagatcaaacatgatgtcttctagtagttactctggagtctacgtcgtcactgcttcagtttggatctcatgcatagatgttactgcgttctcagtgcccagtggctcggtacgtcattggggaaaaaatataaataattcattatatcttctaatttgagataaaatactggtaatgggggagctatgcattctgttcggacttgttatgggctctgaaaagaactcatacagggcccaagtattcgtttcgttgcctcggcccgataggaatcgtgtaatgagaagaagaatggtgttattgatgttttgtttatcaaatgaatctgtgagcttacgtatctcaacaatgttggtatctttatatcagcaatccgatatattttctatacacatagtcaatacaatactgctaacattctcatttttctcgtcagcagattgcaaagctcttattaagtccctataaaatcaccacagggatgtcttctagtagttactctgcagtctacgtcgtcactgcttccgtttgagctcatgcacagaagttgtcgcgttcccagttcccagtgccccagtggctcggtacgtcatcgggaataaaaaaataaataattcattatatcttctgatttgactatttgagacaaaataaataactttcttgggggaactatgcattctgctcggacttgttatgggctctgaaaagaactcttacacggcccaagtattcgattcattgcctcggcccgatccgaatcgtgtaacgagaataagagtcatcgttgctcctatccatatgcctcgggttccccgccgccggccggaatctctcgcacgcaaacgactagcgcaggcgcagcaaacaccccacctcgctcgcggtcgcggcacggcggcggcgatccaccgcggctcgctgccttcgccagtgatctggtctcttcgagtcccggcatcagataatcatccacagcccctcccctcctctcccagccccctcccttccccttccgctgaatcggcgcggagaggatgccgtcccggcggggcagcagcagttgcgtgctctgcgagggatccaacctgccgtcttgttgcgcctcgtgcgtcaacgcgaggctggtcgagtaccacacgaggctgcgcatgatgaggagcctccgcgactccctccacggccgaatcgccgcacgcctcgaagccaagagaaaaacacatgagcagcggatctggagaacaagcaaagaacaggatatcatggagttgaggaatcggctcactgaattgaagagaaaaactgccgtagacaagaccgaggtcgagcaggcatcgagtgatctcaaggcaaaaactgtgccattgaatttggctcttgccacgctaaaaaagagacgagctgatgcagtggccatgcacaccaatgccatgaaagttgctcagatgaatctcatggcaaccacctcagattgtatgaaaatgcaatcaaaatctgtaaagcaactttgcagattgtttccaatgcgacgagtaattaaagagggagaaaagaaagacggctacaatggtccgtatgattcaatatgtggggttcgtcttcctcgtggtcttgatccacattctatttcatcagaagaactgtcggcatctttggggcacatgctacatttcatcaatatagcagttcgtatcttatcagcacctcaaaaacatgtatcaggctgtaagggctcatgctcaaatatatggcagcggagttcctactggagcacacgacagtcccagagcaaggtttaccctctttttatacctaggaaaaatgtttgcacaggtggtgaagaaacttcattgacagaaagtggctcgagtaactttggggttgactctgtggattctgtcaagaaaccgtcttttgatcccaagagaagcaatagctttaacttttctggtgcatcttcccactccatggagaggcatcaatatttgcagagaggaatatcactattaaagacaagtgttacagccattactacctactattacaactcactgggcttggatgtgccatccaatctttctacttttgaggcgtttgctaagttgctccatatgttgtcgtcatcaaaggcccttcgaactgcttttgaattggacattgcttcaaggtcagagaagcaagcgcagcagctgaacagatcgatttggaaggcaagttctgccatatcatcggacagcagttttatggacagcatgcacacaaccattatgcccagcactctggacaacctcctcatgaactcagacgagagcctgtacactggtaagctggtgaagcatggtggcgtgccagatagcatattcgacagctgggacatggtagagcgtgaggttctaccaccaccaccctcgcgggttgaagacgtcgctcagtgggaatgggccatgtatgctggcagcacaaaaaagaaatgacctctatttacaagtcctccctgaagtccaaactgttagacactgcaagagcttcagtttagatatgtaagtacttggtcactaggctctaaaccgggaaatgtggaatttggccacgttcctcatttctggaacgtgggaataatctcgttcccgtagttttaaaacctaatttaaatagcgtaccacgtacaatgttcctatttctcgatcccattgatttgatcctggaacctggttacttagatcaggctccggtcccatgtacagtataagtccagacctaacctcaccctgtggggctgacctgtgaatcatctatactgcaagaatgcacataggagaattgcagtgtagagttgatttgctgccatctctacatcagtacgtgtacatgagggcagccctgtaaatttgtaaatataacccctgtaccgtttagaaatgaaaataaaatacttgaatacaaaaaaaaaaaaaaaa

SEQ ID NO: 15307 - DNA, 2569 bp, Zea mays
  misc_feature (167)..(167): n is a, c, g, or t
aactaattgtttgcgaggtagctaacaattagttgtggtattgtagatggtgtttggaacctgtcaactaatttttagtggctaactattctaactattagttttaaaggtttcaaacagagtctaaatcacatccacgagatgcggtagagtacaaacatggttgnttatctggcggcaacttcggctttccatggtagatcacaaacgacctatagcgaagcaggacagatgggctcaactgctcaactgctcaagtgtccagaagatcatacatataacgtatgccgtacaaaacgttttatacagtttcggtggtccatgatcaccatcactatatcaccatatgcctgcacgatcatcgattgaggcccacgacaaccacttccgctgatgtgagcacgctcacggtaagagtagaatagagcggggtagagtcatatgagtgtagaggggatgagaggaaagagagggttcagtcgttttagtagattatgttagttttcttatggatactttaagagtcgctctgtttctcttttgttagaaatccaaaaactagaaaaatatgagtggaaccgctccattcatatatttctcttttgttagaaatcaaacatctagaaaaatatgaatggaaccgctccattcacaaccaaacgcagttagtgagcaaaattccttactttgtatcacaatcttccgcactcatatcgctctatatatttcctctatattaaccatcacatattttattcatcttaatccaaccgccacatctggttttgctacgaactgcactggtagcgtaaatattcgtttgcgccatatatagtgcaacagcattcttagaaaaaccatgcagggacgtatagcgcacacggctgcacaacttcacaactttctgtatagcgttctctgtatatatgttgcggaagctttaccgcatagcggtgcagatagcctaagactgtgcggtagctagataactgataacatgatcgataagagctagttgcaactgtattgagtattgcagttatcttagctctggctaggtcgataaatgggagcttaaacttcatctagagcttcatctagagtatgtaactatgtaatgtgctggacacgacctgattcctacgtggaagatgaagaaaaaggaaagaaaaggaacagagagcagagccgttctagatcatatcggatattccagtcgccagtaccactctttactcgtgcagagctggtggtcagtggcctaacgccagtctgctcgtatctgcacaagacatgcttgcttcagcagttgatcactcaccaaagaccgcgtctcttcctcgttcatccttttttctctctctctctcaaccaagtcgagcatagactctgcactgcagatgaccaaccaaaagccctgtccggcagccaggcgcacagcgtttctccaaaccgatggtctatcggtctatcctataaatcacagcatcgccactgccacagcggcacagccacaggccacacaacactgaacacccctgcttacgttacgatcaacatggcctcgagaaccaccgcgtcctccctcgctctcctgctgctcctttcctgcgccgccgtgagcagcgcggcgcgaaggctggaggaggtggcgacgcccaaggagggggagccccacctgaccgtgccggacctgccagtgccagagcacgacttgccgccgctgcccaaggtcgaaatgccgccgttcccggaggtcgagctgccaccgctgcccaaggtcgaaatgccgccgttcccggaggtcgagctgccgccgaagcccgagttaccggccattcccggattccatttcccggagcctactacgccatgacgcgccacccctgcgtgctacttcctcggtcgtacgcgcgcgcgcgcgaattatatatgtgttcgtgttgggatatggatgcccgctcgtgtcgtgagtgtgtgctctgcttgcgttcgtgcttgatgtattatatatacaagtaaactttattttctgacttatattaaccagtagtggcttgcccctcgtgttttccaaaaaaaaaaaaaaacagacaacgttctctctggaacaaaaataatatgctctgacaagttcattccacgttgcatgtaatgtactagtgctatctatcggtctggttcctcggtccacataatactgcctcgaccgcagaacgtgtcagtttccattcgaactcgtctgatataccaggtgatcccttcttctaagaagtgtgcacaagtggacgttgcttaggtgtttgttttgtgagatgctcacttagtgaacttaacgagttttattttaggttttgttcaattaggcctagatctacggggattggaggggataaaatccttaaatagaaagtgatttaatcctctccgatccaggtttaaccgaacaggtctttagggctgatttggtgaccagagaattgaagaggatctatgggggagaaaactccttaacaataacaacatagccttttagtcccaagcaagttggggtaggttagaattgaaa

SEQ ID NO: 15308 - DNA, 3303 bp, Zea mays
tgaggaagccgagcgcgatggcgatggagtagccgaggcccaggttggagagctgaggtcgtgccgtcgtggagctgaccgaggggcggccggaacggacggttgagcgctccatcgtgcggacggaggaagaaacgactgctgtgcgcgcgaccatgggccgcccaaacctaattggagtatgggctgcaccaaaaaagcagcccaaaacgcctgcactgctgtattgttgtattgtcttgcaaaactttagtaccatattggctagtaaaggagacatggagcggcttataagctttggcgcggtggctgaactgattagtttcaaatggtggctgaactggtggtcagtttcaactcgcgcatgcataagaatttttgctggacacctgcgtgtacgacctgtgggggcagaaccagagccatggcagaacaggtcaaaggcagaacaagtcaatggcagactactattgcttacttaataagtagtagagattttatttaatcaatgtctacttacatgaaatatagaaaccttaacaaatgtatgggaaattaactagttaattattatagcagcacaaccgatcgcactaattttcggagattggaaagcttatttaatcggttatcattttttaataaaatgataaatatgacgttgaaaaccacttctaaccagatcgtaagctgtccaaacgtaggaagctgtccaaactgtggaaagagattcaaaaaatttgaaaacgtaggaagctgtccaaactcgcagaatcgcgggttccaggcttcgagccaaacgtttgggctttggtctagccgcacgcctgcactccacgggccgtttctctgcacaaccaattaaccaaacacccgggaaaacgcagaaaccccactccgtaaaaccacaggaaacctcacacgtcttcctccgtccagcctgtctccggccggccccccgccttccttaactccgcatcatccccttccaatctcgtcttcccagcacccgaaccgatcaaattcacttccgctcgattctccgggagggggagggtagctgaaggacatcccggggacgcaatgcgcgtcctcgccgtgttcctcctcggcgcagcgttcgcggcggcggccggaggcggcggggagcttccggagttccgggaagctccggcgttccgcaacggcgcagcctgcgcggacgcgccgacgatccacatcgcgatgacgctggacggcacctacctgcggggctccctcgccggcgtcctctccgtgctccgccacgccgcctgtccggagtccgtcgccttccacttcgtcgcctcctcggcctccccggcgcgccgcctcgcctcgctccgccgtgcgctggcggctgccttccccacgctcccggccaccgtgcatcgcttcgacgcacgcctcgtccggggcaagatctcctcatccgtccggcgcgcgctcgaccagcccctcaactacgcccgcatctacctcgcggacctcctgccgcgctccgtctcccgcgtgctctacctcgactccgacctcctcgtggtcgacgacgtggcccgcctctgggcgaccgacctcggccccgacgccgccctcgctgcccccgagtactgccacgccaactttacctcctatttcaccgacgcgttctggagccaccccgagtacaccgccgtcttcgccaaccggacgcgcgtcccctgctacttcaacaccggggtaatggtcatcgacctggacaggtggcgctccggtgggtacaccgcgaagctggaatactggatggaggtgcagaagcaggaggccaggatttacgagctgggctccctcccgccgtttctcctggtgttcgccggcgaggtgaaagccgtggagcaccggtggaaccagcacgggctcggcggcgacaacgtggcggggcagtgccggcagctgcaccccggtccggttagcctgctgcactggagtgggaaggggaagccgtggctgcggctggacgccgggcggccgtgcccgctcgacgcgctctggatgccctacgacctccttcgccgccgcggcgctcgggacgatctcctcgccgccgtctcctgacaatgctgtccgcgcatcgctgcagggcgatcgatttgctcgcgtccgatcggatcatatgccacggcgcttggctgctccgctcgttccgtcgtcccacgggtcggcgtcggtcaccaagtcacagacacgttggacccacctggacactctcctctccgcatgggtccatgcgcaatggcgttagttggtgtggccctgtcggtactgaagtccgtcggccccactcgttggtggcggatggggatttttggggtgggggccaaggtgaaattcagacatgggctgtgtacagctgttgtttttggcctgttgggatattagttctatattctttttattgtgttcttgttgtagattcttgaagaatctacctccatataatagacaatagtgcaggcacaggtttatcaccgtggaataaaattgggtatatttggaattagggtttatatatatttatattgtacatgatcgtcagaggttagggctcagcaggtggaaacaaggagagttgttcttgggaaatgccataaaggttgctgtagttttatttattagttattgtacgaatgcaagctgctattttaaatccattgatcgcagtgcacagctagccagatttgagatgtcgttttgctcccagaatgaaaagaaaagccactcttctaactttagctgaagcaaaaaacaaaaggctaactggatgctgtctggtggcacaaatctcaatcctgcgtctccaaaattcaggaatctgatctggctttctcgcttttgtttaaagcccgatccgcggatgatttcagtggagtttggtgccatgtgattcgaatgggcgcttgccaagtgctcgagcggatcttcgtaaaaaaaaggtggcaaattctttgcttctcccgtgcgcgagcgcgagagggaaggaaagggtgcggttgctttgtgcctttttctcctcagttaacatcaggttgccagaaggggatgatctctcgattgccggtagcgtgcgagcgtgatgttgtcgaccggaatgctgtctcgtgcaggattactgcagcggtgacaggccataaaaaggtgtttaaaagtctaaaattgatggtgatgacatgactccttcaaaactgatccccccggcccccgcccccctcttccctatgtgaggactgacgaatgataccttcaaaa

SEQ ID NO: 15309 - DNA, 923 bp, Zea mays
cattgcgggcctcgaggccggccgggacctccagcctaaacacagtcaccaccacctacacccccgttgtctcctctccttccattgccacagtcggccttctccgtggaagccggcgggccgccgcctcctttgtccctgtcgtcgtgctcttccgtaccgccattccctagcactgtccacgggcgagatctcgcgtgtacggtgtacctcgtttccctcggcgggtggatcagtgacggcttggtcgagatggacgatgtggttgatgacatcatctgtggaacggatgcggcggttgccgtcgaggatggggccagtgggacgcccgcaatgcctagcttagggtgccagggtgaggaagagcataggaagggcaatgaggacaactcaggtgagagcgaggtgattaacccgccagaagaggctggcggggaggccacctcgcccctggaaggcaggaagcctcgcctttccaaggggaatcaaagccatgtacctaaggctgtcaaatctaagagtccaaggagtggagatgaaaatcagacaaggagaaaagctcccaactcttcttttcctaaggcacccattgtccaggagtcccatggtgactctggtgtcggcagtaataaagctggcaagaatgagtctcactcatccccaattgatgcagcattgcccgatgagtccaaggagaaaaggaaaactcaaaagccaccagcacagctctcttccatcaaaagagatgaagaacagtcaaatggtgagagtgcaaagcctcgaaaagttggaagcacgccatcatatggtttcaccttcaagtgtgatgagagatctgaaaaaagacgagagttctattcgaagcttgaggagaagattcatgcaagagagttagaaataagccatttgcgcagccagtcaaa

SEQ ID NO: 15310 - DNA, 839 bp, Zea mays
ccggccgagacctccgcctaacctcgggcacctccacccccgcctcggttgtctcctctccttccattgccacagtcggccttctccgtggaagccggcgggccgccgcctcctttgtccctgtcgtcgtgctcttccgtaccgccattccctagcactgtccacgggcgaggtaaagaaaccatctttccaccttctcccaccccctccggacccataggtgccaccggcatttgtcttgcgattgcttggcccagatctgcgtgcattcggcatttctcgtgcgtagatctcgcgtgtacggtgtacctcgtttccctcggcgggtggatcagtgacggcttggtcgagatggacgatgtggttgatgacatcatctgtggaacggatgcggcggttgccgtcgaggatggggccagtgggacgcccgcaatgcctagcttagggtgccagggtgaggaagagcataggaagggcaatgaggacaactcaggtgagagcgaggtgattaacccgccagaagaggctggcggggaggccacctcgcccctggaaggcaggaagcctcgcctttccaaggggaatcaaagccatgtacctaaggctgtcaaatctaagagtccaaggagtggagatgaaaatcagacaaggagaaaagctcccaactcttcttttcctaaggcacccattgtccaggagtcccatggtgactctggtgtcggcagtaataaagctggcaagaatgagtctcactcatccccaattgatgcagcattgcccgatgagtccaggagaaaaggaaactcaaaagcccccagcacacctcttccatcaaaaga

SEQ ID NO: 15311 - DNA, 1768 bp, Zea mays
aactaaccagctccggcccaaacacagccacgagcacctacacccccccgctgtcacctctccttccatcgccacaggcggcccttctccgcggaagccggcgggccgccgcctcccttacccctctcgctgtgctcctccgcaccgtcattccctagcattccccacgggcgaggtaaagaaacattctcccaccccctccagccccataggtgccaccgggatttctcttgcggttgcttggcccagatctgcggcgcattcggcgtttctgatctcgcgtgcacctcgtttccctcggcggtggatcagtggcggcttggtcgagatgggcgatgcggttgatgacatcatctgtgcaacggatgcggcggtcgccgtcgaggatgcggccagtgggaagcccgcaatgctctctagcttaggggggcagggtgaggaagagcatgaggagaaggacaatgaggacaagtcaggcgagagcgaggtgatcaacccgccagaagacgctggcggggaggccacctcacccctggaagggttgaagcctcgcctttccaaggggaatcaaagccatggacctaatgctgtcaaatcaaagagcccaacgagtggagacgaaggtcagacgaggaaaaaggctcccaattcttctcttcctaaggcacccattgtccaggtgtcccatggtgacgctggtgtcggcagtaataaagatggcaagaatgagtctcgctcatcttccgtggatgcaacattgctggatgactccaaggagaaaaggaaaactcaaaagccattagcacagctcttttccatcaaaagtgacgaagaacagtcaaatggtgagagtgcaaagcctcgaaaagttggcagcattccatcatatggtttcaccttcaagtgtgatgagagatctgaaaaaagaagagagttctattcgaagcttgaggagaagattcatgcaagagagttagaaataagcaatttgcaagcgaaatcaaaggaaactgaagaagcagaactcaaaatgctgagaaagagtttgaacttcaaggcaacaccaatgccaagcttctataaggaaccaactcctgtcaaggttgaattgaaaaagatccccccaacaagagccaaatcgccaaagtttggtcgttctaaaaacaagtccacaccagagactgaagaaaatgctaccgcggaccagcctgcccacctgagcctcgaggagaatgtttctcaaaccggtgtgaaaaaaccaaccccgttgaatccagcaaagaagccccagaggaagtcactccccagactgccatctgaagaaaccggtccgcttgatgccacctcaaggcaacttataaagagcgccaagctggatgcagttagtgctccggagacaggatcagctacaggacaggcacaactacaaggaagtcagacggaaacagattctggtcaggggccagttgaagctggagctaatcctgatgaacaagacgccagcgaacagagtgttgtttagtgaagatcacgatgaccaaaccagctgatttgtgatgtgcatggtgttcctcggctttgtataatattgtgcttgcctgctagagtaacctgtagtctgtattatgttatgtgatatatactactactcctggtttattttcctggaattgagccgtatgttgcttatcaatctagatagcttttgttcaaaaaaaaaaaaaaaatatatccaaattgtcccgagtcaaaaaaaaaaaaaaaaaaa

SEQ ID NO: 15312 - DNA, 1039 bp, Zea mays
ccggccggtctcccacgcctccgctggaacgacgggtaactaaccagctccggcccaaacacagccacgagcacctacacccccccgctgtcacctctccttccatcgccacaggcggcccttctccgcggaagccggcgggccgccgcctcccttacccctctcgctgtgctcctccgcaccgtcattccctagcattccccacgggcgagtggcggcttggtcgagatgggcgatgcggttgatgacatcatctgtgcaacggatgcggcggtcgccgtcgaggatgcggccagtgggaagcccgcaatgctctctagcttaggggggcagggtgaggaagagcatgaggagaaggacaatgaggacaagtcaggcgagagcgaggtgatcaacccgccagaagacgctggcggggaggccacctcacccctggaagggttgaagcctcgcctttccaaggggaatcaaagccatggacctaatgctgtcaaatcaaagagcccaacgagtggagacgaaggtcagacgaggaaaaaggctcccaattcttctcttccggtgtcccacggtgacgctggtgtcggcagtaataaagatggcaagaatgagtctcgctcatcttccgtggatgcaacattgctggatgactccaaggagataaggaatgctcaacagccattagcgcagctcttttccatctaaagtgacgaagaacagtcaaatggtggagagtgcaaagcctcgaaaagttggcagcattccatcatatggtttcaccttcaagtgtgatgagagatctgacaaaagaagagagttctattcgcagcttgaggagaagattcatgcaagagagttagatataagcgttttgcgagcgtcatcaaagggagctgaagaagcagatctcaaaatgctgagatagagtttgaacttcaaggctacacccatgccaagcttctataaggaacctactcctgtcaaggttgaattgatatagatcccccccgccagagccatatcgccgaagtttggtcgt

SEQ ID NO: 15313 - DNA, 878 bp, Zea mays
gggtacctcgaggccggccggggtggcccccaccttccccacgcctggcttccttccctccctccctccctcccctcccaagaaacacaagagccagccagcgcttgcgaggctcaagcgccgcagcaatgtctctggccccgtccatcccttccatcaaggtgaaggtggggcccgtctcggtggcgcccccgcaccgcgcatgccgatccttcgcggtggtcaggagctccaaggcggagggccccatccggagacccgcggcgcccccgctgtcgccaccgccaaagacgccggctctgtccactcctcccaccctgtcgcagcctcccaagcccgctgctccacccacgtcgtcggagtcgacaccaccgtctcctcagccgaaggcggctgtggccacagcccccgcggcagcgctgcagaggccgctggctggggctgtgacgctggagtaccagaggaaggtggccaaggacctgcaagactacttcaagaagaagaagctggacgaggccgaccagggcccattctttgggttcgtgcccaagaatgagatttccaacggaaggtgggccatgtttgggtttgcagtagggatgctaacagagtacgcaacaggctcggattttgttcagcaattgaagatccttctctccaatttcggaattgtggacttggattaataatgccgggcttggtgttttcgttatgtataagtcttttaaatgtaatgtacttaattgatatggcatatagaaaattttatcttgcaccatgaaaaaaaaaaaatccgttcgtgctgccctgtttggatacacatgaataccaatttccagtttccttcccgagacaaaaaaaaaagcggccggccccta

SEQ ID NO: 15314 - DNA, 833 bp, Zea mays
cactcctaagggcaattgggatcctcgaggccggcctggaacattccccacgcgttccttccttccctccatctcctctctgttcatagcctcccaagaaacaagagccaaccagcgcttgcgaagctcaagcgccgcagcaatgtctctggccccgtccatcccttccatcaaggtgaaggtgggggccgtctcggtcgctcctccacaccgtgcatgccggtccttcgcggtgatcaggagctccaaggcagagggccccatccggagacctgcggcgcctccgctgtcgccaccgccaccgatgccacccaagacgccggctctgtccactcctcccaccctgtcgcagcctccgacgcccgtgaagcccgctgctccacccacgtcgtcgcagccgatgccaccttctcctgagccgaagccagttgacgccacagcccagatgcggaagccggtggctggggccatgacgctggagtaccagaggaaggtggccaaggacctgcaggagtacttcaagaagaagaagctggaggaggccgaccagggtccgttcttcgggttcttgcccaagaatgagatttccaacggaaggtgggccatgtttgggtttgcagtagggatgctaacagagtatgcaacaggctcggattttgttcagcaaatgaagatccttctctccaattttggaattgtggacttggattaatggtggacttttggtgttttcgttatgtacaagtcttttaaatgtaatgtacttacttgatatggtatatagaaaatttcatattgcacgttgttcaaaaaaaaaaaaaaaaaagcggccc

SEQ ID NO: 15315 - DNA, 1619 bp, Zea mays
gtcaagcaatcggttgctttgatgtgtgatagtaattgtaaagcaagagcgctacaacaagctgcccaagtgacagggacaatcgcagcaggtcagcaccagaatatctgaatgtgctgcgcccatgctgagttcctgaaaacctcacgaactgacctgaccgttaggagacaacacgttcctgggccctgtgttcgcggacggaaacttggcaccacacactcttatccacaacgagagcgtgggtgcccgccgaaacattctccacgcgttccttccttccctccatctcctctctgttcatagcctcccaagaaacaagagccaaacagcgcttgcgaagctcaagcgccgcagcaatgtctctggccccgtccatcccttccatcaaggtgaaggtgggggccgtctcggtcgctcctccacaccgcgcatgccgatccttcgcggtgatcaggagctccaaggcagagggccccatccggagacctgcggcgcctccgctgtcgccaccgccgccgatgccacccaagacgccggctctgtccactcctcccaccctgtcgcagcctccgacgcccgtgaagcccgctgctccacccacgtcgtcgcagccgatgccaccttctcctgagcccaagccagttgacgccacagcccagatgcggaagccggtggctggggccatgacgctggagtaccagaggaaggtggccaaggacctgcaggagtacttcaagaagaagaagctggaggaggccgaccagggtccgttcttcgggttcttgcccaagaatgagatttccaacggaaggtgcgcctatgccccccttctcatgaaccgaacacttcaaaattccaagcatctgccaacagagacaccagcatgtctaggctgtagacaacacaaagaacttcacgtgtgctaggacgcctaggcggagtgacacgtgaccctgccgtgttcagtactgcctccctgtaacgatcgctgtttatcgctctttccagtacttttcgcctgttctggtgctcgcctgttctggtgctcgcctgttctggcgcactggagcgcaccagcctgatctagtgatgaccaaaagctgctatgttgggcagcccaaggacagtcatgaaaagacaacacctataaattagcaagccgaattaataaattcaattttaattttagatgctacaggtgtaagcttcgagtatttgacagatgcaattatttctttacaaattctatgggttgagggaaaatggaataatagttattgaatagtaaattcatgtcttaggagaaactcgaacagttattttatttgaatatatatatatataatttatatatatatatatataaaaatttatatatatatatatatatatatatatatatatatatatatatatatatatatatgacttaaataagagaaaggtaagaaacatgtacctagcatctggcaatgtggtatgacctgaaatgttaggaactggtgctaaaccaacctttcaaatcagttaccagtaatctccacaagaacacttcccatctttgaaatgatgaaatcggatagaatcccttaaaatgatttgccggctaatcatct

SEQ ID NO: 15316 - DNA, 1556 bp, Zea mays
gcacgagaccattacctagaacatcctaatcgaaaaatctttgcgcttggggcaatgacgcagcttatgaggtcataccgaggcgcgtcaattgctggttgaaaactatttccaaaccccctctttggcccactgggccactgagaatttctggaagggctccttttcctcggataagttcctattgagatcatcgcatcatttaggagaatgaagaaactcgttcaagacctctcagtaattgaagctgcactcaggacatcatcaaagctggttgtaagttcaaatgggaaacgggtcaggaggttacatccattgccacacaaagaattgaaagattcaaagaaaagcactgttttggtcgaaaatctacctccagatttctcaatggagagtattcaggaaaaattcgcaacagtgggcaaagttgtgaacataacaattaatgatccagaatcagtgaaagaattttcaactgctaagaagcctgacttcaatttaagttttaaggctcatgtacttgttgaatatgaagcagtggaggctgctgagaaggctgttactgccctaagtgatgagagcaactggagaactgggatgaaagtcaggcttctgtctaaacaaagtgtaatgggaccaggaaagtataaaaaaccttctaaagaaaatcaagatgcagtttccaaaatgattgatcagaatcaacattcaaaagaagaccagcttaaaaccttggaaaagatctccggtgctgatgcagtggggattaccaaggacagagataatttgaaacctgtttttatcactgagactgagcaccaagatcagaagccaaatgctagaggacgaaaaggatggtacaaaggtcaaggtcagatgcagcaaaatgcaaacaaacaaggcagttgtggttccgagtcattaaacaagcctatttctggaccgaggatgccagatggaacaaggggcttcacactgggacgtggtagatctcttccactacagaagtctgagaaggctgaagagtagagctaccaaaaaaggcctgttaagaaccttatccaaagaagctgggtaaaatctaacagaaaacctttgcttttttttttttgaaacttaagatcatcgaagccgttctttgcatggaatgggacacagaagaaagggaatcttggaatggctttctctctgcaagaaatggaacacaaaagggaatctgggaatgacttgtacagaaacacaattgtctgggggtagttccgagttcactcgtatggaacacagtagaacctttgcatgtttccaaaaaaaaaaaaaaacatatactcgtatcatgctgcatgcagcattgcagccctgtttgcaatttcagcagccgggggctggggccgtgagcccgtgaccctgcaccatccgggtctaccacgagcccccctgttctgcgaggcgtttggcccctcatccctatggatctgtactctgtaggctctccttataacgcatgattgggattgaaaaacacattgaatagaaaataaatgtaggaatacatatgc

SEQ ID NO: 15317 - DNA, 959 bp, Zea mays
ggccgtcctgcccttccctgcccggtgggtatatgtaagctcagaccgccaccggaacctcctcgagcccggccggccgcacacctccgcccgaagccgccagtcggactacgagcggcggcggcgcctcggctcccctgatctccctcaccggaatggacggccaggctccgccgcttctcgacgccgtcgtgctcgagccccttgcagttggcgacgagctccatccgcggcgtcctgtcgaggtggaggacgctccggccgccgctccgccctccggtatggacggccaggttccacctctctacaacgtcacgcgggatcctctgaccgtgtccgacgagctgcagcccacgggcgaggtggtggatgacgccctactcgtcgcgcccgatatcgtcaagggcgaggtgatggaggacgacatcctacccgtcgcaaccgacatcatcaacgacgccgcctcggagtgccccgaggctggcagtgatggcgtcgtgctcaccgacgagctccgcaatcgcatcgtcaagcaggtggagtactatttcagcgatgagaaccttcctacggacgagttcctgctgaattatgtgaagaagaacaataagggctttgttcctattgagatcatcgcatcatttaggagaatgaagaaactcgttcaagacctctcagtaattgaagctgcactcaggacatcatcaaagctggttgtaagttcaaatgggaaacgggtcaggaggttacatccattgccacacaaagaattgaaagattcaaagaaaagcactgttttggtcgaaaatctacctccagatttctcaatggagagtattcaggaaaaattcgcaacagtgggcaaagttgtgaacataacaattaatgatccagaatcagtgaaagaattttcaactgctaagaagcctgacttcaatttaagttttaaggctcatgta

SEQ ID NO: 15318 - DNA, 1683 bp, Zea mays
atcgcacgcacaaggccggaccgcacacgcacagtccgtctcgtctgccaacgccgctactcggcgcaccttggcttgctatttcgccaacaacctcctccctctttaccgcggcgtgccgcgtgcggcgggcgcggatggcaacggccgcctccgcctccccctcccccggcgcgttcggcgccaaaacccctgccccagcccgtgggctgagcacgcacccggtcctgaccccgagccccgcattcgcgaggtcttcgccgcgcacccccgcctgcggcaggtcccgcgccagcctccacatcggcggcctgggctcgaccagcagcagcagcgccgccgccgccggcaacggaaccgggctccacgtgccccccacggtcgcgccgctcgccgtgcctaagatggccggctccatgaagacccataagaacgtcctgctcttctactgcgaggagatgcgggacctcgcgcagcaggtggtcgcccggaacgatgacatcgaactgcgatccatctcatggaggacatttccggacggatacccgaatctgttcatctcgaatgcccataacattcgtgggcagcatgttgcctttttggcttcgtttagctcgcccagcgtcatatttgagcaactatctgtcatatataatctgccaaagttgtttatttcttcgtttactcttatactcccgtttttcccaaccgggacttctgagcgcatggaagatgagggagatgttgcaaccgcctttacacttgccagatttttgtcaaatataccaatatcacgaggcgggccatcgagtttagtaattttcgatatccatgctttgcaggagagattctactttggagactcagtcttaccatgttttgagagtggcatccccttgctgaaaagtaagcttcaggagctacctgattcccataatataactatagcatttccagatgacggtgcatggaaacgcttctataagcagcttcaacattttcctatggttatatgtaacaaagttagagaaggggagcagagaattgtacggataaaggagggagatcctagaggccgtcatgttgttatagtggatgacttggtccagtctggcagtactttgattgagtgccagaaagtactggctgctcatggagctgcaaaggtcagtgcatatgtgacacatggcattttccccaatagctcatgggagaaatttcagcatgacaatggagagggtccggagcatggcctgagccacttttggcttactgattcatgcccccttactgtcaaggcggtgaagggcagacggccatttgaaattctaagtctggccggacctattgcttctgctctccagatttaggcaaatctggtctgctcgatccttcgggatattgtgactattcagttagttcttctttcctttgttgctgttgaggaatttggtgttttcctttgtacagctattgagtgtctcgcaatgtatttactagaaaaccataaaatggcagatcttcactgcagggtctgcttggcagaaagcattcgtagtcgtagtattagctgttaataatttgactgagcaagtcaagcgttgatctgtgttctagtataaataaaactctcgaataagtttcagtaatttgccatcttaaaaatggtgtgtttttgcggcc

SEQ ID NO: 15319 - DNA, 1270 bp, Zea mays
ctcgacagacgagtccgggacctgcgacgtggcggacgcgtggcgcccggaacgatgacatcgaactgcgatccatctcatggaggacattatccggacggactgccgaatgagcttcatctcgaatgcccataacattcgtgggcagcatgttgcctttttggcttcgtttagctcgcccagcgtcatatttgagcaactatctgtcatatataatctgccaaagttgtttatttcttcgtttactcttatactcccgtttttcccaaccgggacttctgagcgcatggaagatgagggagatgttgcaaccgcgtttacacttgccagatttttgtcaaatataccaatatcacgaggcggaccatcgagtttagtaattttcgatatccatgctttgcaggagagattctactttggagactcggtcttaccatgttttgagagtggcatccccttgctgaaaagtaagcttcaggagctacctgattcccataatataactatagcatttccagatgacggtgcatggaaacgcttctataagcagcttcaacattttcctatggttatatgtaacaaagttagagaaggggagcagagaattgtacggataaaggagggagatcctagaggccgtcatgttgttatagtggatgacttggtccagtctggcagtactttgattgagtgccagaaagtactggctgctcatggagctgcaaaggtcagtgcatatgtgacacatggcattttccccaatagctcatgggagaaatttcagcatgacaatggagagggtccggagcatggcctgagccacttttggcttactgattcatgcccccttactgtcaaggcggtgaagggcagacgaccatttgaaattctaagtctggccggacctattgcttctgctctccagatttaggcttcttccctccagatttaggcaaatctggtctgctcgatccttcgggatattgtgactattcagttagttcttctttcctttgttgctgttgaggaatttggtgttttcctttctatagctattgagtgtctcgcaatgtatttactagaaaaccataaaatggcatatcttcactgcagggtctgcttggcagaaaacattcatagtcgtagtattagctgttaataatttgactgagcaagtcaagcgttgatctgtgttctagtataaataaaactctcgaataagtttcagtaaaaaaaaaaaaaaaaaaaaaaaaaaaaaaaaaaaaaaaaa

SEQ ID NO: 15320 - DNA, 1873 bp, Zea mays
  misc_feature (14)..(14): n is a, c, g, or t
ggtaccctaccggncctgccggatctctctcttgtcattgggtacctcgaggccggccgggaacccagtgtgcgcacttcaccccccctctcggtctcaccctcctggcgacgactgggcggccgaccggccgtcgccgccgccccacgccaggtttcaaagtcttcgtcaggcccttctccggcgactcgagcaccacagggtgacaaggatagctttctcgggtcactgaaggaagacatcttctcgacgcgttagaccttctgacggttggctggttgtgctttaagtgttcaaggggtggattaggaccgggaaactctgtactgaagggaaggtcaaaagtgtcaagagagcttgttccaagatggatgaaggtcagggagttaggtattggtgccacatgtgtcaggaggtgatagatcccatgcccgagatgaagtgcccaggctgcgagggcgggtttgtggaggagatggactctgaagactttgagccagctgcgaacgcgaggtctgatcgctccgtctctctcttggctccactgctgcttggtatgatggggggttcgtcgcgcagatcaagactcaggagggaggccatggttgaagctgatgccgaccaggatgacgaagaggatgattcagaccatgagcttgaactttccaggaggaggcggaggaggaggcgctcatcagcgcttttcagtgtgcttgaggctatgcgtgaccgtgatgaagtaaggggctcggatgacaccgacagtgatacagagagagacctggagagagggagaagggagaggatggagaggcagagggagaggttaaggcagatcgagagggtgagtgctcgtggcagagagaggacggaaagcttaatactgatcaactccaacaacgaggctattattctgcagggaacattcggatctgatgacaaccaggaggactcaagcaacacaagttctggtgtatcacttggggattactttcttggtcctgccttagatactctcttgcagcgtttggcggagagtgacctcagtcgttctggcacaccgcctgccaagaaggaagcagtcgccgcgctaccaaccgtgaacatcgaggaagcgttgggctgttcagtctgtcttgaggatttcgagatgggaggagaagcgaagcagatgccctgtcagcataagttccactcgcactgcatactcccgtggctggagctccacagctcttgcccaatctgccggtttcagttgcctactgaggagacgaagaacaacccatgcgaatcagccagcaccgcaggggccgtgaacggcgatggagacaacgctgctgcaagcggcagcgatacagaaagtactaaccacaatgaagatgaccattccgatagccctatcttctctgctctgagcacactcttctctgatccgttctcatccgacgatgatgaaagtgttccacactcttacgagaactgaagatagcgtcggacgcaggcttgcgatatggtgaagccgttctgaggctggcatctttatattgtagcttctgtacatatctctctgaacggtcgctcccccccataagacaaactattacctctccgttttactgaaaactatgtggcttgtaatctgctagtgcttgctatgttcacttgcctcgaataaatgttatcctttagcgtgcttattaccatcaccggacggccctagacgcgcatgtggacgcagatttggttgacagtatatgtatgcagtggcgttgcgtcttactcctatatttgaactgtcaatgagaaggtccttggaagaaaaaaaaaaaaaaaaaactcgagagtcttctagacggccgcgggccctcgtttt

SEQ ID NO: 15321 - DNA, 1852 bp, Zea mays
accccacgtccccacccttgtcgccctttcgcttccgtctcgtttggacctccatccgcggcggccgccgccgcgctgagtttgggccgggctctgttaatctgggcgactttgattttctctgctcccgctgccccggccgtcaggagtgaagcgatgctggagaaagaccggatatcctacttctacgacggagatgttggcaatgtctactttgggccaaatcaccccatgaagccacatcgtctctgtatgacacatcaccttgttctttcatatggacttcatcaaaagatggagatatataggccacacaaagcatatccaatagagcttgcccaattccattctgctgattatgtggaattcttgcaccggataactcctgattcccagcacctatatgcaagtgaactaactagatacaatcttggagaagactgtccggtctttgataatttgtttgagttctgccaaatctatgctggaggaactttagatgctgctcgcagattaaatcataaaatatgtgacattgccattaattgggctggtgggctacatcatgccaaaaagtgtgaggcttcaggcttctgttacattaatgatctagtattaggaattctggagcttctcaagtaccatgccagggttctttatattgacattgatgtccatcatggagatggagttgaagaagccttttatttcactgacagggtaatgactgtgagtttccacaagtatggtgacctgttctttcctggaacaggtgatattaaggatataggagaaagggaaggaaaatattatgccatcaacattccacttaaagatgggatagatgacactagctttactcggctttttaaaacaattattgccaaagttgttgagacatatctgcctggtgctattgttcttcaatgtggggctgattcattggcgagggatcgtttaggctgcttcaatctctctattgaaggccatgctgaatgtgtaaagtttgtcaagaaattcaatattccccttctggtaactggaggtggtggatacaccaaggagaatgtagcacggtgttgggctgttgaaactggggtccttttagacacagaactcccaaatgagattccaaaaaatgaatatattgagtactttgctccagattatacattgaaagttccaaatttgaacatggacaatttgaacagtaagacctatctcagttcaatcaaagtgcaagtgatggagagtttgcggtacatacagcatgctcctggtgttcaaatgcaagaggttcctcccgatttttatatcccggactttgatgaagatgaattggatcctgatgaacgtgttgaccagcacactcaagacaagcagattcaccgtgatgatgagtactatgaaggtgacaatgacaacgatcacgacgacggcacacgctaatctgcttcttctgaggccctggtgtaaatggaaacctgagattcttcactgttgtgtgtagttcagcagccttgagatgtaatagtttgtcagttgacagcagggatctaatttagcaggtcaaagtggtttagacttttataagggattctgacccctcctgaattacacattgtagtacaagtctgcatatttttaagcatgcaaaaattcaaatttctcagtggtattagtatctcaagaaaatacaaattcctcgctcagtaacattgctgatatgtggtgaatttgattatatctagaaccccaaggcctagtttgagtattctagtattgaccttaatctacatgtattgaactggattggattgtaacttaaactaatttatattttaatccaccc

SEQ ID NO: 15322 - DNA, 3400 bp, Zea mays
  misc_feature (1756)..(1756): n is a, c, g, or t
aaacattgagtttgatcaagttgagtcgatgttgttctctggtttgtgctttggtgaagaagactgctggcctcggctgctgggagagccgttcctagacgctcttggcttcatgcatgcattgacgattctgtcatggcctccgactgttgggacgccgaacctagacgcatccagactgagaccttaggagttaggcctagtcctgcaggtctgattgtcctgctatgccagcctcaacccacccggctcttgccactctgctgaccagcgatcaccttgccgctgctcctgttaggacattcgaaggattgatgaccctggagattgcaatggaagtaccttgtttgcattgcagcactgaaaagcgaagtgatcaacgtcaaggcaattgaaacaccttctgatcaggtcctccggaacggtccttctgctactgagttgttccactctgcgtcatagcttcctcgtgcgcctggactcaacttggcgccaaccttcattctttgccgccatctttgtcagtgcactagacgtcctgtcgccaactggccgccaaaccaacttctgccggggagcctggacgcgcaccaccgcctggtctgtaacctcctcgtcggctgcagctgacttcagggtgttcaccactcggtccgtggcgaaagcctatacctcatacgcgatcgccccctggacgctaacaatacgtctcagaagagatggtcgggccacaagctgcatgtagatgcccgtgtccaatgaacttctatgcttgtaattgcaaccgatcgatcttgtatcatacttgtgacttaatgggaagccttgttctattaaattttgaccttatgtatgtacatcaacgtgtaacctcggcaatcaatttattggtttttatttcctttgtgcacagattaagagtttaaaggaccaatactttgcggaattgaatgatgtgtacaataagatatccatgaagatacaaaatattgacaaccacatgcccgctcaaaagtcagcggagcagtatgaaaggctgaaaggctttaaaggaatgttggagcgcatattgcatttcctgcaagctaacaagagcagcattcagccaggttttagggaaaaaatctctattttcgagaggcaaattctcagtatcatgagttcacaaagaaggaagcctgtgcaggcacctggacagcaaacgtttcagcaatctggtgggcaagctcctagctctaatatgtcacagcagcatcagacttcccaaggtttgcagcagcatgatagtcatactaatcagatgcctcaagcaggtttaccaagtatgaacacaggagtaccgacctctggagcacctggcattcagcatgtacctgcgcctcaagcatcaaactttggtgttccaacaacacagcaaaatgtcacaaatgcaccgcaggctgcctctaatccggagaatgctcagggaaataattttaatcctgtgcagcatggttcaatgggtactgcattgcaacagggaagcactggtcccatgcagggtgcattgaatgcacagcatcagtccaatagtaacatgatatccaacaatgcaatgagtacaatgcagactaataccaatgccatgcaagcaaacgtgaattcattgcagcagctaaagcaacatcaggagcatcagatgatgcaaaatcagcaaatgaagcagcgtcagcagatgctgcagccgtgccagcaaaggcccgggcttcaacaacangctcccaatacaacaactacagaaacaacagcagcaagggccgattcaggttcaacaacttcattctggaaatgatgtgaatgagctaaaggtcaggcaaggagctgcaatcaaatctggaatgtatcaaccgctgaaccagcgtaactattatcagcagataaaacggggggatgtctttccaatttcttctccgcaaaacctccaagcatcgtccccacaaatttcacactattctcatgttgatcagcacagtctgttgcaatctcaagtgaaaaccgggacaccgttgcattcagctaactcaccatttgtcccatctccatctcctcctgttgccccatcaccggtcccactggattcagataaaccactctccaacctatcttcactcactagtgctgggcaggctggacatcagcaaacatcccttgcacctctaacacaatctatagctgttaacacaccaggtatatcagcgtcacccttgcttgcagaattcacaagtgctgatggaggtcaggttagcgtaccaactcaagttccaacaaaatcaagcgcagcagaaaggcctctcgatcgcttgcttaaagcattgagaacaacacagcctgagtcccttagtgctgcagttagcgatattggatctgtcgtgagtatgattgacaggattgctggatcagcgcctggtaatggttccagagctgctgtgggtgaagatcttgtcgctatgacaaagtgccgcttgcaagccaggaacttcataacccatgatgggagtggtgcatcaaagagaatgaagcgggacacaggtgctatgcctcttaatgtgtcatccgctggaagtttgaatgacagcttgaagcaatcatatactgttggcactccagagctacaatcaactgcaacctcacgtgtcaagtgtcaaagggctgaggtaaaccatgctctgatagaggagattcaggagataaacaaacagcttatagatacagagctccatgtctctgaggatgatgctgagtccttcactacatctgatgtggccgaagggacagtcattaaatgcacattcactgctgttgctgttagccccagcttgaaatccatgtttgcttcagcgcagatgagtccaattttgccgttgaggttgcttgttcctggtagctacccaaaatgctccccggtgcttctagacaagtttcctgatgaacaatgcaggaactcggatgacctgtctacgaaggccaagtcaaagttcagtgtgttgctccggggtctagctgagcccatgtcattgcgagaaatcgcaaggacgtgggatgcttgcgcccggaaagtgattgcagagtatgcccagcaaacaggaggaggcagtttcagctcgagctatggttgctgggaaagctgcgttggcgcttcataagtttattgtatctattactccgtagtatatttattattctttattacactaagcatttatgtgttgagcaaaagaaaataacagtttatcttccttttggtatcgagtcactgttagcttgataaataagatcgtgtacagtacagtgtatggagcaagcttgggtgcttcagcccggttaatatttactatcttgtaaaaaaaaaaaaaaaaaaaaa

SEQ ID NO: 15323 - DNA, 3446 bp, Zea mays
  misc_feature (3432)..(3432): n is a, c, g, or t
gtcaacacagatgcaatcttcacagcagcccatgatgcaaatgtcatctggtcttcagcctgggcagactgccattccacaaactcagtccatgacgatgcattcagctacacaaagtggtattcaacaaaacccattgaattcagtacaacaatctgtgcaaccattactccatcagcctacacaatctgtagtgaggcagcagcaacatccacagtccatgcaccagcagtcttctctgcagcaaactcagccaactcaacagcccaacattcctttgcaacaacaacaaccacaattaatgaaccagcagtcaaatttacagcaaaatcagttaatgaatcaacagagtggtgttgtggagacgcaacagcaacaaaggctgccagttcagtcaaataatcttttgaatatgcagcaaacacagcagatgatgaaccagcaatctatgtccttgcaccagccacaacaattggcaaaccaaggaaatatgtcaagtctacatcagcagcagcatcagcaaaatcagcagcagcagcagcttctcggaactgggccaaatgcccgtatgcatatgttacagcagcaaaaggtaattcagcaaccacagcagcaacagcatgctcagcagacatcaatgggtttgatacaacctcagtctcagcagaaccaacttcagcaacctcagcaacatatgatgtcgcagttccagtctcagcctaatcaaatgcagcaacaattgggaatgcaacaaaggctccaaacttcagctggcatgctcttacaacaaaataacattgatcaaaagcaatatgttcaggcacagaggggccttcaagaagcacccagtacatctgtggattccactgctcaaactggtcatccaggcataggtgatttgcaagaggagttatatcaaatgattaagagtttaaaggaccaatactttgtggaattgaatgaattgtacaataaggtatctatcaagatacaacagattgacaaccaaatgcctgctcaaaagtcagcagagcagtatgaaaagatgaagggctttaaaggaatgctggagcgcactttgcatttcctgcaagttaacaagagcaacattcatccaggtttgagggaaaaaatccccatttacgagaggcaaattctcagtatcctaagttcacaaagaaggaaacctgtgcaggcacctgggcagcaaacgtttcagcaatctagtgggcaagctcctagctctaacatttcacagcaacttcagacttcccaaggtttgcagcagcatgatagtcatactagtcagatgcctcaagcaagtttaccaagtatgaacacaggagtacaaacctctggagcacctgcgcctcaaggaacaaactttggtgttccaacaacacagcaaaatgtcacaaatgcaccacaggctggctctaatttggagaatgctcagggaaataattttaatcatgtgcagcatggttcaatgggtgctgctttgcaacaggaaaggactggtcccatgcagggtgcattgaatgcacagcagcagtccagtagcaacatgatatccaacaatgcaatgagtacaatgcagactaataacaatgcaaatgcgaattcattgcagcagttaaagcagcaacgtcaggagcatcaaatgatgcaaagtcagcaaatgaagcagcgccagcagatgatgcaacagatacaacaaaagcaaacgcttcaaccgcagctcccaatacagcaactaaagaaacaacagcagcaagggcagatgcagtttccacagcttcattctggaaatgatgtgaatgagctaaaggttaggcaaggagctgcaatcaaatctggaatgtatcaacagctgagccagcgtaactattatcagcagataaaacagggtggtgtctttccaatttcttctccgcaaaccctccaaacatcgtccccacaaatttcacaccattctcctcaggttgatcagcacagtctgttgcaatctcaagtcaaaaccgggacaccattgcattcagctaactcaccatttgtcccatctccatcccctcctgtggccccatcaccgatgccaatggattcggataaaccactatccaacttatcttcagttactagtgctgggcaggctggacatcagcaaacatctcttgcacctcaaacacaatctatagccgttaacacaccaggtatatcagcgtcacccttgcttgcagaattcacaagtgctgatggaagtccggccaatgtaccaactcaagttccagccaaatcaagcgcagcagaaaggcctctggaccgtttgcttaaagcattgcgaacaacacagcgtgagtccctaagtgctgcagtcagcgatattggatctgtcgtgagtatgattgacaggattgctggatcagcgcctggtaatggttctagagctgctgtaggagaagatcttgtcgctatgacaaagtgccgcttgcaagccaggaacttcataactcatgacgggagtggtgcatcaaagaaaatgaagcgggacacgagtgctatgcctcttaatgtgtcatcagctggaagcgtgaatgatagcttgaagcaatcatatggtgttggtactccagagctacaatcaactgcaacctcacgtgtcaagtggcaaagggctgaggtaaaccatgctctgatggaggagattcaggagataaaccaacagcttatagatacagagctccatgtctctgaggatgatgctgagtccttcactacatctgaggggggcaaagggacggtcattagatgcacattcactgctgttgctgtttgccccagcttgaaatccgtgtttgcgtcagcgcagatgagtccaattttgccgttgaggttgcttgttcctgctagctacccgaaatgctccccggtgcttctagacaagtttcctgatgaacaatgcaggaactcagacgacctgtctaccaaggccaagacaaagttcagcgtattgctccggggtctagctgagcccatgtcactgcgagaaatcgcaaggacatgggatgcttgcgctcgcaaagtgatcacagagtatgcccagcaaaccggaggaggcagtttcagctcgagctatggttgctgggaaagctgcgtaggcgcttgttaattgcttatattgtatctattattattattataagtatttatgtgtcgagtaaaatagaaaaaaaaacagtgtgtctgctgtatactccatccttttgctattgggtcaatgttggcttgataaatatggtcgtgtacagtacagtgtatgcgtcagtccggttagtatcatgtatgctttgcctctatttacagaacttggttttataactttttttcgtcaccaattatatataaatattttttaacacgccgcccccctcnaccttattataact

SEQ ID NO: 15324 - DNA, 2082 bp, Zea mays
  misc_feature (1)..(1): n is a, c, g, or t
ngtcataaatactaatggcaaatctctcccgttatcactttgttttcctatgggtgaggtgtgattgtgtgcaaagaaccgcggccggccggcaagaaaaccctctacaagcccttctttttttgttatccggtccgcccaggctcctcccgttctccggccgtccggcgcttccctctgtcccttggctcgctctggcgtggttctcccgtcccctggtgcgtgcgcgcttctcgctcgctcgctctctcgtggcggcgactgggcgactatcgcctccgccctacaacagttgctcaggtcttctttgggcccttcgccggggacaagcacccaccggagaaaatcaataaatacatcggcctgaaagaatgggttatggcatgagtaggctagacgatgaatactatgaggctgaagggcagaatactggtggatctggctcagttcaagtgaacgatgagtttgcaacactacataatgatatttttcatatgacccgaatgagatcaggacttactgaaagctacaagtccatgggtaccaacagaggcataatatcaactgccaagttattatctcgaagggaaattgattgttctggaaaggggatgttctcttctggtgaccgtgcatttgttctaggtcgtcatgttccgatgaacaatcctgaattattggataggatggattctcgtgcttacgtttcacagttttctgctgatggtactctttttgttgctggttttcagggaagtcacataagaatatacgatgttgatagaggctggagcatacacaaagacattcatgctaggtgtttaagatggacaatcagtgatgtatccttatcacctgatcagcggtatcttgcctactctagtctggcacctattatccatattgtcaatgttgggaatgcggcaagagaatcctatgctaacgtcactgacatccatgatggattggatttttcacagcatgaagatgttcaatattcatttggaatattttctgtaaaattttcctctgatggacgggaacttgttgctggcagcaatgatgactcaatatatgtctatgatcttcatgcaaacaaattgacattacgtttatctgctcatacatctgatgtcaatacagtagcatttgctgatgaaaccggccatctcatatattctggaagtgacgacactttatgcaaggtcctgggacaggcggtgtttgtccgcaggacaggctgccggagttttgactggacatttgcatgggataacacatattgatagtcgtggagatggccgaagtttcatatccaatggaaaagatcaagcaatcaaactgtgggatatcaggaaaatgatgtccaatgctgatagttgtgcagatggagccccagcctgggactacagatattcaaggtatccgcatcaacataaacagttaaagcatccgcatgatcagtcaatagcgacgtaccgtggacatacagtcctccggacattgatccgttgctacttttctccttcgtatagcactgggcaaaagtacatatatacagggtcgtatgattccaatgtttgcatctatgatgtggtaagtggatcccaggttgcgaagctgaaatggcatcaaatggcgattcgggactgcagttggcacccatttgagcccacgcttgtgagctcatcctgggacggccgggtagtgaaatggaccagcgcacgtgatgaaggggcttctgatgtcgattgagttgagtcgaccgtgcaggtgcagcgcgagtgatctttactgttcgtggttgtgggctaaaaaaaaacatacccaatcttgcactaaaaaaaaggagagtaagcacagctcgtaataaagaaagaagatcatgtgttgcagtggtaatttgtaaatgtaaatactgaactgaaaccatgtgggcaggaccgagtgcataagcacctttgtgaatatggttgttccataaagccttttccatgtcctttggagggaacgtgttttttgttggcatttggttttcgacgttccgttattattattattattattattattattattccc

SEQ ID NO: 15325 - DNA, 753 bp, Zea mays
tttttttttttttttttttttttttttttttttttttttaaccgaccccttcaattttttttttttttttcgattaacacgaacattcattgcacaggcacattcggttcacagatacattcagttcacataatcacatgcacatttgtttctgaaacaacacataactgaaaggaaagacagatacattcagttaacatgcgttgaagctgtcttcatgccatagatattctgaaacaaaatacagtcgacattcaccattgaagctgtctacatgacatgcatcttcttcttgggagtaagcttattgacagctctcctaattttcctcggggtggacatcaacaaaccaacttcagctgaagaaaacactggtgttggcacctcagttggaatagcagcaggtgcatcacatgaatgatcaataggtctgttgccactcttggcataaggcatggtggcatggcttctcgatatgttgccactcttggcatgaacattctctaagatatacctgggggttcacgagaagggcgttaggaataaatcaggcgctagtgatgcttccaaccgcggataccagcgacgatctcgtcgagcgagatgggggtcggccgagtcaggtggcggcgcctctattggcgccgagccaccgggagcaatcgctgcaacggggaagcatgagggaggaaccgtgtgatccgttttcatcaacgggatataaagcacgggggtaaaagaagttaaccccgg

SEQ ID NO: 15326 - DNA, 1742 bp, Zea mays
atggcacacagcttgcagaatacacacagccttatattgagtcagggcttgtgagggtaccgccgggccggcctgtaacttcaagtgcgtgggctttccttgagcctttcacattggagatgtggtgtgtcacagttgctctttttattttggtgggcatagtagtgtggcttcttgaacatcgtactaatgaggaatttcgagggtctccaaggcgacaagtcataacaatgttatggtttagcttctcaacaatgttcttttcacacagagagaacactgtaagcacacttgggcggttcgtgctgataatatggttgttcgttgtgctgatcatcacttcaagttacactgctagcttgacgtcaatcctcacagtccaacagctctcaactggaattacagggattgatagtttggtttcaagttctttacctattggataccaggctggaaaatttaccaaaagatacctgactgaaaacttcaatgttcccctctctcgactggtaccactgaattcgatccaggaatatgctgatgcccttaaccgcggaccaaaaaatggcggtgttgctgcaattgttgatgagaagccatacattgatatcttcctgtcaaactactgcagcttcagaatagtgggggaggaattcacaaaggaagggtggggctttgcattccagagagactcccccctcgctgcggatttatcgacggcaatccttcaactttcagagagtgggcaacttcagaggatccacgacgagtggttctcacggtctagttgctcctcagatgacagcgaagtgggagcaaccaggcttggcctcggaagcttttggggccttttccttgtgtgtgccctgatatgcctcttcgctctgctggtgttcttcatacgagtctgccggcagtataaccagtactccagttctgaagctgccggcgagcccagcacagctgctgcggatcctgtcctaagacagcggcgaccatcacgccttggcagcttcaaagatctgatccagttcgtcgacaagaaggaggaggagattaagaaaacgatgaaacgaagatcaggcgagaaagatagccaagctgcaggattctcatacgctcagtcagtggcttcagcataggacattgctccaaccatattgaattaggttatctccaaaagcataggacattgctccaaccatattgtaaatagtagtggtgtactgtgatcagaacgaagatcagggttctcatacgctgtttgtatttgacaactgttttcggtgattggtcattgctccaagctgtgcgaagtggcttattttagttttttttttcctgacaggcacccttttagctcccgtgcctctttggacgccgtatccacctcacctcttgctcttggtgggatagattagcgtgaaacttagtttaatttccatagtaattcactggattattgagatagatacaagtacacccaagaacagaacctcctttaattaattgggtagcgttctgaattgtgaaaccctgaagccagaaaccagaagtgagctttaaagtgggaacagatcggccgttggctattacacggatctggtcgccctcgcgtgggcacaagaaaccataatgatccagacatccagtagccttgatggtcctgcgcatcgcatcgaaacaccggcgtcattagcagacaatcccgctcccccaaaatcgcttcttcgagctcgaca

SEQ ID NO: 15327 - DNA, 2701 bp, Zea mays
  misc_feature (298)..(298): n is a, c, g, or t
acgcccagcgtatgatacccttaatgttgttggttctggctcccgcttgattggctattggtctaactattctgggctttccgtgtttgttcctgaaactttgtatcagatgccacgaaatacatctacaagtgcccagcagctgcatgatatggtatggcctggcgattccactacgaagcctaagggctgggtattcccaaacactggcctgcctctgagagttggggttccaattaaagcaagctttaaggaattagtgtcaggtagaggagataacatgagtggttattgcatngagatatttaacgcagtaattaaacttcttccttacccagttccttgccaatttataactattggggatggcacaaaaaaccctagctatattgacctcatttgtttcgttgccgcctagtcacttgatgcagctgtaggcgactttgctatagtgagaaatggcacacagcttgcagaatacacacagccttatattgagtcagggcttgtgatagtagcgccggtgaaacatgtaacttcaagtgcgtgggctttccttgaacctttcacattggagatgtggtgtgtcacagttgctctttttattttggtgggcatagtagtgtggcttcttgaacatcgtactaatgaggaatttccagggtctccaaggcgacaagtcataacaatgttatggtacgtttgttgcatgtttcaactatgtggatatttttctatcctaatttaccataccttgtttgagtcaaagttctggctggcaatacccattatgggcgaaaaatgtttctagctttattcaatccatgcccatcttatgatttactgttatttgttggtgttttttcccttctaaatgcttattcgctaacttgaggaattgatggataatatgtgcttctctttcaggtttagcttctcaacaatgttcttttcacacagtaagtccactagacgcgtccatgattttaacttataaactcttccatgattctttgcctatacggatggaaacgtcttgacgagaaactcgcttcaggagagaacactgtaagcacacttgggcggttcgtgctgataatatggttgttcgttgtgctgatcatcacttcaagttacactgctagcttgacgtcaatcctcacagtccaacagctctcaactggaattacagggattgatagtttggtttcaagttctttacctattggataccaggctggaaaatttaccaaaagatacctgactgaaaacttcaatgttcctctctctcgactggtaccgctgaattcgatccaggaatatgctgatgcccttaaccgcggaccaaaaaatggcggtgttgctgcaattgttgatgagaagccatacattgatatcttcctgtcaaactactgcagcttcagaatagtgggggaggaattcacaaaggaagggtggggctttgtaagttcatcgtgcttgttctctgtcttcattcacttcacttcatttgggcattcctgccatcgcatctcagggaagcacaaatccgtgcctggcactgtactggaaatgatttattctgctccactcttttcctttgcaggcattccagagagactcccccctcgctgcggatttatcgacggcaatccttcaactttcagagagtgggcaacttcagaggatccacgacgagtggttctcacggtctagttgctcctcagatgacagcgaagtgggagcaaccaggcttggcctcggaagcttttggggccttttccttgtgtgtgccctgatatgcctcttcgctctgctggtgttcttcatacgagtctgccggcagtataaccagtactccagttctgaagctgccggcgagcccagcacagctgctgcggatcctgtcctaagacagcggcgaccatcacgccttggcagcttcaaagacctgatccagttcgtcgacaagaaggaggaggagattaagaaaacgatgaaacgaagatcaggcgagaaagatagccaagctgcaggattctcatacgctcagtcagtggcttcagcataggacattgctccaaccatattgaattaggttatctccaaaagcataggacattgctccaaccatattgtaaatagtagtggtgtactgtgatcagaacgaagatcagggttctcatacgctgtttgtatttgacaactgttttcggtgattggtcattgctccaagctgagaaaaaaagcttatttcagtttttttttcctgacaggcacccttttagctcccgtccctctttggacgccgtatccacctcacctcttgctcttggtgggatagattagcgtgaaacttagtttaatttccatagtaattcactggattattgagatagatacaagtacacccaagaacagaacctcctttaattaattgggtagcgttctgaattgtgaaaccctgaagccagaaaccagaagtgagctttaaagtgggaacagatcggccgttggctattacacggatctggtcaccctcgcgtgggcacaagaaaccataatgatccagacatccagtagccttgatggtcctgcgcaacgcatcgcatcgcatcgaaacaccggcgtcgttagcagacaatcccgctcccccaaaatcgcttcttcgagctcgacatatagaggaagtgtcactgca

SEQ ID NO: 15328 - DNA, 2644 bp, Zea mays
aacggaacaatcccgcgttatctttttcccttcccctcgcggccgccgccccgaacgcgcacgcctcctccgccgaagccaagcaaaccaccgacctcgacggagtcttctagccgtcaccctcgttgtcgccctgctcctcctctcagccggtccggccggcggcgtggcgtgaagatcaatccggacccggaacgagttccctcttttgctggttacataaactttggaataggaggatatcccatattgatctttgtgattgagattgattttttttctggaaaatggagatacaaacttcagggaagcccattgatgtgctgatggagaaggttcttagcatgaacattctgtcttctgattactttaaggagctctataggttgaaaacctatcatgaggtcatcgatgagatctacaacactgtcaaacatgtggagccttggatgactggcaattgcagaggcccctccactgcattctgtcttctatacaagttctttaccatgaagcttactgtcaaacagatgcacggtttgttgaagcatcctgactccccacacattagagctattggtttcttgtatcttcggtatgttgcagacccaaaggttctttggatgtggtatgagccctatttgagggatgatgaggagttctcccccggatctaatggccgcaagacaaccatgggtgtttatgtgcgtgatcttatacttggacagtactactttgatagtcttctaccaagaattcctctcccagtaactcgtcagattacagccaatcttgaaaagatgaaattgcccactaagctttctggggcaactggagactccagtcgtcagggatcagaagatactgcacgccgtcctccttcagtgaaagcttctctgtcagtttcctttggacagcgtgctccacatcgggcttccaccagggattcatctccagttcgtcgaacagtcacccgtgatggtcatcgaagttcatactcaccatctcgtcgtagtggtagccgtgagggtcctgatcatgaccgttctgaccgggaactggatcattctagtcgtgaccgtgaaagagcccgggatcgttcaaaccgggatcggtatcattcaagccgagaccttgaccgtgacaaggatgccagagattatcatcggcatgagcgtgatagcagggatcgtgagtactacaggtccaggcattcagaagaaagacgggacgacagaagagatcatgaaagtagcaggcacaggcgctctagctctcgccacaggagcaggagtaggagccgaagcaggagcaggagtaggagcaggagaagccgcagccgaagcacgagcaggaggagcctgaatgagcagcgatccagcccattcagggatgcaaataaagagaaggcagccaccgtgtcgagcaacctagcaaagctgaaggacttgtacggtgacataactgcaaagaaggaagacagtgatgctgaaaagcttcaccgtgattcatgcgctgaggaggtcatcaggctgggaggccctcgatggaggtaactttgagacctgtagaactctggtttccgctttgttctgccagcctctctgtaggccttcttgaaaatgctctttatgttcccaaacttgatagagtcgactggtacttcggtatcttgacttgttgtcgcctgacatttgccattaatgtatgttgtttggtatgttattcctaagaattcctatgacattggaacgtactgtataaaccgtggtatccgagcttcatgtttgcttgatgcttatgcaaattgaaggttgaataagtttcagtttcaccaccccgggagtgcacacttctgtgcccgtttttttatccctgaaagtcctttttttgttaacagtttgatatactcaaattttagtctgtactaactatccagaatgtcctacgagcttgttgtggtgtttgaatgcactagagctagctaatagttagctgctaaaattagttgaagacatccaaacagtataactaatagctatttgttagctagttaattgtacttgtattttttagctatctattaactctagtggattcaaacaatccctacgttagtatcattacatgattgtcgtattttttgctggcggtgaaggctgccatcctcggacctggatgtcagggccttttgcagagtggacagcttggcagagtttgaggatttcttggtctgaaccattgttgtggctttctattaatatactccctcctattccttctattaatatactttcttctattccttttagttctagtttgggaatcctattttcaggattaatacttttaagtgaaattagttcatttttctttggaaaaataaaaatttcttgagaaaacggaattaccaaactagtctttatctgtctttttgccggtttttccaactctcgaaggaagtcgcccgcatgattcaaggcacttttggacatccttgtctttgcagtcagcacgggaattgaatcgacatgcagttatggcaaggctgcattgctgaatcgaggttgcaactcataatgccttatataagtgttggtaactagttcagacaaacaacttgttgggaaaataatgaaacata

SEQ ID NO: 15329 - DNA, 1517 bp, Zea mays
atcacttgtacataattttgtgcttacattttggttatagccactaacggtccgacaacttgtttctttggatggacttgtggctgaatttcttggtcctaggacacggggatgacaaagtttgcaagaagttcatagtgtaccagtctgtgctttggagttgtgagcattttgttttttttgtctttactaagcctgttaaatactaaaatattttgtgtcgaatgactgttttgcgctatttggtgcagattggtttcttgtatcttcggtatgttgcagacccaaaggttctttggatgtggtatgagccctatttgagggatgatgaggagttctcccccggatctaatggccgcaagacaaccatgggtgtttatgtgcgtgatcttatacttggacagtactactttgatagtcttctaccaagaattcctctcccagtaactcgtcagattacagccaatcttgaaaagatgaaattgcccactaagctttctggggcaactggagactccagtcgtcagggatcagaagatactgcacgccgtcctccttcagtgaaagcttctctgtcagtttcctttggacagcgtgctccacatcgggcttccaccagggattcatctccagttcgtcgaacagtcacccgtgatggtcatcgaagttcatactcaccatctcgtcgtagtggtagccgtgagggtcctgatcatgaccgttctgaccgggaactggatcattctagtcgtgaccgtgaaagagcccgggatcgttcaaaccgggatcggtatcattcaagccgagaccttgaccgtgacaaggatgccagagattatcatcggcatgagcgtgatagcagggatcgtgagtactacaggtccaggcattcagaagaaagacgggacgacagaagagatcatgaaagtagcaggcacaggcgctctagctctcgccacaggagcaggagtaggagccgaagcaggagcaggagtaggagcaggagaagccgcagccgaagcacgagcaggaggagcctgaatgagcagcgatccagcccattcagggatgcaaataaagagaaggcagccaccgtgtcgagcaacctagcaaagctgaaggacttgtacggtgacataactgcaaagaaggaagacagtgatgctgaaatgcttcaccgtgattcatgcgctgaggaggtcatcaggctgggaggccctcgatggaggtaactttgagacctgtagaactctggtttccgctttgttctgccagcctctctgtaggccttcttgaaaatgctctttatgttcccaaacttgatagagtcgactggtacttcggtatcttgacttgttgtcgcctgacatttgccattaatgtatgttgtttggtatgttattcctaagaattcctatgacattggaacgtactgtataaaccgtggtatccgagcttcaaaaaaaaaaaaaaaaaaaaaaaaaaaaaaaaaaaaaaaaggaaaaaaaaaaaaaaaa

SEQ ID NO: 15330 - DNA, 2232 bp, Zea mays
gccggccgggtcgcgggcccttaacggaacatacttatcttttccccttcccctcgcggccgccgccccgaacgcgcacgcctcctccgccgaagccaagcaaaccaccgacctcgacggagtcttctagccgtcaccctcgttgtcgccctgctcctcctctcagccggtccggccggcggcgtggcgtgaagatcaatccggacccggaacgagttccctcttttgctggttacataaactttggaataggaggatatcccatattgatctttgtgattgagattgattttttttttctggaaaatggagatacaaacttcagggaagcccattgatgtgctgatggagaaggttcttagcatgaacattctgtcttctgattactttaaggagctctataggttgaaaacctatcatgaggtcatcgatgagatctacaacactgtcaaacatgtggagccttggatgactggcaattgcagaggcccctccactgcattctgtcttctatacaagttctttaccatgaagcttactgtcaaacagatgcacggtttgttgaagcatcctgactccccacacattagagctgtaagtttctgtttcctgcccttctgtttgctgatgctgaatgtcttgcttcatggccctgtatctattcattaggcatgaggttagtgtatgaatctatatgtttattgggatgattataaaacttatttcggaagtattttttgcaatgaaaaatcttacattccttgcgaatcacttgtacataattttgtgcttacattttggttatagccactaacggtccgacaacttgtttctttggatggacttgtggctgaatttcttggtcctaggacacggggatgacaaagtttgcaagaagttcatagtgtaccagtctgtgctttggagttattggtttcttgtatcttcggtatgttgcagacccaaaggttctttggatgtggtatgagccctatttgagagatgatgaggagttctcccccggatctaatggtcgcaagacaaccatgggtgtttatgtgcgtgatcttatacttggacagtactactttgatagtcttctaccaagaattcctctcccagtaactcgtcagattacagccaatcttgaaaagatgaaattgcccactaagctttctggggcaactggagactccagtcgtcagggatcagaagatactgcacgccgtcctccttcagtgaaagcttctctgtcagtttcctttggacagcgtgctccacatcgggcttccaccagggattcatctccagttcgtcgaacagtcacccgtgatggtcatcgaagttcatactcaccatctcgtcgtagtggtagccgtgagggtcctgatcatgaccgttctgaccgggaactggatcattctagtcgtgaccgtgacagagcccgggatcgttcaaaccgggatcggtatcattcaagccgagaccttgaccgtgacaaggatgccagagattatcatcggcatgagcgtgatagcagggatcgtgagtactacaggtccaggcattcagaagaaagacgggacgacagaagagatcatgaaagtagcaggcacaggcgctctagctctcgccacaggagcaggagtaggagccgaagcaggagcaggagaagccgcagccgaagcacgagcaggaggagcctgaatgagcagcgatccagcccattcagggatgcaaataaagagaaggcagccaccgtgtcgagcaacctagcaaagctgaaggacttgtacggtgacataactgcaaagaaggaagacagtgatgctgaaaagcttcaccgtgattcatgcgctgaggaggtcatcaggctgggaggccctcgatggaggtaactttgagacctgtagaactctggtttccgctttgttctgccagcctctctgtaggccttcttgaaaatgctctttatgttcccaaacttgatagagtcgactggtacttcggtatcttgacttgttgtcgcctgacatttgccattaatgtatgttgtttggtatgttattcctaagaattcctatgacattggaacgtactgtataaaccgtggtatccgagcttcatgtttgcttgatgcttatgcaaattgaaggttgaataagtttcagtttccccaaattataaaactaaaaaaaaataaaagaaaaaaaaaaaataagggttttaaaa

SEQ ID NO: 15331 - DNA, 1412 bp, Zea mays
tggaagatatagccatataggaccatttggtcagcctgtagatagacattcagaaggctgttgcaagtccagtcaggcctggagcactggactatttggtcagcctgtagatatagatactcagaaggctgttcccgctggctctgttgttttatccagacattctatgcaataaatacatctggttgtaaatgtcaacacatgcagccgtgagccgtcgtaagcctttgttgttctatagctgttcagtataaataaggctttccttaattacgctgaagcgaacgtatgtaggagcaaatttaacaatagcgccgactgggggccgcgaggccggccgggacggccgtccgcacaataatctgcgctgcgcggaagaagggaaggggaaaagcagttaagcttgagcgcgcgcgacagggtcaagtcgagggccggggaatcgccggagaatggaggtgggcagggctccgcgacgacgggtgtccccagcggcggcggcggcggctgtgccttcgctgcttctgttcgccgttctattcgcgggccgggcggcggcgttcggccacctgcaaggcgccggcgcgacggcgctgtacaagcacgcgtcgttcttcgaccgcgatggcgacggcgtcgtctccttctcggagacgtacggcgcgtttcgggcactcgggtttggattcggcctgtccagcgtcagcgctgccctcatcaatggcgcccttggtagcaagtgcagacctcaaaatgcaacgtcatcgaagttggacatctacatagaggacatccagaaagggaaacatggaagcgattcagggtcatacgacgccgaaggaaggtttgttcctgacaagttcgaagagatattcgccaagcacgccaagactgtcccagacgccctgacgtcggacgagatcgaccagctgctgcaggcgaacagagagcccggggactacagcggatgggctggcgctgaagcggagtggaagaccctctacagcctcggcaaggacaaggacggcctcctccgcaaggacgtcgcgagaagcgtctacgacgggacactgttccacatgctcgcgcccaactggaaatctcccgacgaggaggaggagctgggcccgatccgggtccgcgggacctgaaccgagaggtacaagcaaagtctggttgagagataaggactctgggaccctctgaacatgctgtcaagcaacatgtactactagcggtgtgaacgggtggtgtgaacactcttttcatatcacatcataaaaaaaggtgtgaacagatatttcaatgtacattatcataaaataagataaattcataattcaaataaaaatattctgtgtcttccccaaaaaaaaaaaaaaaaaaaaaaaaaaaaaaaaaaaaaaaaaaaa

SEQ ID NO: 15332 - DNA, 1139 bp, Zea mays
  misc_feature (31)..(31): n is a, c, g, or t
gatcgaaccgtttggctggtgtggcgcgacngcgaggtgacgacggcgacgcttcagttgagtgcgggtgtagtgctcactgctcctgcgacttcggcctgtccactttttagggggtgccgaggggcgtgggggtacggccgtccgcacaataatctgcgctgcgcggaagaagggaaggggaaaagcagttaagcttgagcgcgcgcgacagggtcaagtcgagggccggggaatcgccggagaatggaggtgggcagggctccgcgacgacgggtgtccccagcggcggcggcggcggtggctgtgccttcgctgcttctgttcgccgttctattcgcgggccgggcggcggcgttcggccacctgcaaggcgccggcgcgacggcgctgtacaagcacgcgtcgttcttcgaccgcgatggcgacggcgtcgtctccttctcggagacgtacggcgcgtttcgggcactcgggtttggattcggcctgtccagcgtcagcgctgccctcatcaatggcgcccttggtagcaagtgcagacctcaaaatgcaacgtcatcgaagttggatatctacatagaggacatccagaaagggaaacatggaagcgattcagggtcatacgacgccgaaggaaggtttgttcctgacaagttcgaagagatattcgccaagcacgccaagactgtcccagacgccctgacgtcggacgagatcgaccagctgctgcaggcgaacagagagcccggggactacagcggatgggctggcgctgaagcggagtggaagaccctctacagcctcggcaaggacaaggacggcctcctccgcaaggacgtcgcgagaagcgtctacgacgggacactgttccacatgctcgcgcccaactggaaatctcccgacgaggaggaggaacaggaactaagcgtgatccgggagagctgaaccgagaggtacaagcaaagtctggttgagagataaggactctgggaccctctgaacatgctgtcaagcaacatgtactactagcggtgtgaacgggtggtgtgaacactcttttcatatcacatcataaaaaaaggtgtgaacagatatttcaatgtacattatcataaaataagataaattcataattc

SEQ ID NO: 15333 - DNA, 1114 bp, Zea mays
atcctattcctgcggcctcggcctgtccgcctgtattttagggggcccgtggggcgtgggggcacgggcacccgcacaagctgcgctgccagtgccagcgctcactcgaacgccgagacccgagaggagcaaacagccaaaaagaacggaaaggggagagcaaacagccaaaaaaggacggacttgcgcgacagggtcgaagactcagaaggggaatctccggaggatggaggtgggcaggactccgcggcgacgggcgtccccagcggcagcggcggcggcggcggcggcggctgtgccttcgctgcttctgttcgccgtgctattcgtgggccgggcggcggcagcgttgggcggcccggggccggcgctatacaagcacgcgtcgttcttcgaccgcgacggcgacggcgtcgtctccttcgcggagacgtacggcgcgtttcgggccctcgggtttggactcggcctgtccagcgccagcgccgccttcatcaatggcgcccttggcagcaagtgcagacctcaaaacgcgacgtcgtcgaaactggacatctacatagaggacatccggagagggaagcacgggagcgactccggctcgtacgacgcccaaggaaggttcgttccggagaagttcgaggagatattcgccaggcacgcgaggacggtccccgacgccctgacctcggacgagatcgaccagctgctccaagcgaacagagagcccggggactacagcggctgggctggcgcggaagcggagtggaagatcctgtacagtctcggcaaggacggggacggcctcctccgcaaggacgtcgcgaggagcgtctacgacgggacactgttccaccggctcgcgcccagatggaaatctcccgacagcgacatggagagaagctgataagcgtggtccgggagaactgaaccgagaggaccgtcctattgatgtcgtcttgcgctgggctgctctgaactgaacaagtctggacatgccgtcaagcgacatgtgggtgtgaacactctttcgggtcagattattaacaagaagggtgtgaccgtgtgagtgtgaacagcctcctgcggaactcttggatctgcattctcaacg

SEQ ID NO: 15334 - DNA, 1238 bp, Zea mays
ctgcagactgtgacaacacaggcctgctgtttgctggctaggttagctgacaattacaagattttctggcttgattagctagctacctggccatctgctatatggagaaacctgtctttgttttataaaaaaacttattaattcacttgtgtatattattttaaaactggtgttaaatgctcgaacacacaagcagcaaaacgcaacgtcatcgaagttggacatctacatagaggacatccagaaaggaaaacacggaagcgattcagggtcatacgacgccgaaggaaggtgggccatggactcaaccgctgctgaacaagaacagtagatgcgtcgattatcctaagctaaacaaagactgaaatgattcctcaggtttgttcctgagaagttcgaagagatattcgccaagcacgccaagactgtcccagacgccctgacgtcggacgagatcgaccagctgctccaggcgaacagagagcccggagactacagcggatggtaatcgatttttttttcccagcccccaaaatatcggtgtttaatactcctgcctccagccgtcagctctcacacctctcccgttttctttcctctgctctgccctcgcacgaatcgaaagggctggcgctgaagcggagtggaaaaccctctacagcctcggcataccgggggacggccccctccgcaaggacgtcgcgagaagcgtctacgacgggacactgttccacatgctcgcgcccaactggaaatctcccgacgaggaggaggaacaggaactaagcgcgatccgggagagctgaaccgagaggtacaagcaaagtccgattgagagataaggactctgggaccctctgaacatgctgtcaagcaacatgtactactagcggtgtgaacgggtggtgtgaacactcttttcatatcacatcataaaaaaaaggtgtgaacagatatgatgtccttgtgcggtggtgtgtttgtataccggccggcggatagtggctggcctagtatttagcgataggatatttcaatgtacattatcataaaataagataaattcataattcaagcaaaatattctgtgtcttaccaaaacaaacgagatacaaaacaactaaaagaaattaagggatgccggggctcggatgggtacacggctggttagtgcttgtcgccggcgaaaggcatgatgaacaacttaagaccttggcactcgccttcgtgccctgcag

SEQ ID NO: 15335 - DNA, 876 bp, Zea mays
cctcgaggccggccggccgccacggcccccgcacaagctgcgctgccagtgccagcgctcactcgaacgccgagacccgagaggagcaaacagccaaaaagaacggaaaggggagagcagttaccttgcgcgcgaagactcgaaggggaatctccggaggatggaggtgggcaggactccgcggcgacgggcgtccccagcggcggctgtgccttcgctgcttctgttcgccgtgctattcgtgggccgggcggcggcagcgttgggcggcccggcgccggcgctgtacaagcacgcgtcgttcttcgaccgcgacggcgacggcgtcgtctccttcgcggagacgtacggcgcgtttcgggccctcgggtttggactcgggctgtccagcgccagcgccgccttcatcaatggcgcccttggcagcaagtgcagacctcaaaacgcgacgtcgtcgaagctggacatctacatagaggacatccggagagggaagcacgggagcgactccggctcgtacgacgcccaaggaaggttcgttcccgagaagttcgaggagatattcgccaggcacgcgaggactgtccccgacgccctgacctcggacgagatcgaccagcttctccaagcgaacagagagcccggggactacagcgggtgggctggcgcggaagcggagtggaagatcctgtacagtctcggcaaggacggggacggcctcctccgcaaggacgtcgcgaggagcgtctacgacgggacactgttccaccggctcgcgcccagatggaaatctcccgacagggagagaagctgataagcgtggtccgggagaactgaacccgagaggcccgtgccgtgccatatccgcgtcctctt

SEQ ID NO: 15336 - DNA, 1123 bp, Zea mays
gacgacggcgacgcttcagttgagtgcgggtgtagtgctcctgcgacttcggcctgtccactttttagggggcgccgaggggcgtgggggtacggccgtccgcacaataatctgcgctgcgcggaagaagggaaggggaaaagcagttaagcttgagcgcgcgcgacagggtcaagtcgagggccggggaatcgccggagaatggaggtgggcagggctccgcgacgacgggtgtccccagcagcggcggcggcggctgtgccttcgctgcttctgttcgccgttctattcgcgggccgggcggcggcgttcggccacctgcaagccgccggcgccggcgcgacggcgctgtacaagcacgcgtcgttcttcgaccgcgacggcgacggcgtcgtctccttctcggagacgtacggcgcgtttcgggcactcgggtttggattcggcctgtccagcgtcagcgctgcgctcatcaacggcgctcttggtagcaagtgcagacctcaaaatgcaacgtcatcgaagttggatatctacatagaggacatccagaaagggaaacatggaagcgattcagggtcatacgacgccgaaggaaggtttgttcctgacaagttcgaagagatattcgccaagcacgccaagactgtcccagacgccctgacgtcggacgagatcgaccagctgctccaggcgaacagagagcccggggactacagcggatgggctggcgcagaagcggagtggaagaccctctacagcctcggcaaggacaaggacggcctcctccgcaaggacgtcgcgagaagcgtctacgacgggacactgttccacatgctcgcgcccaactggaaatctcccgacgaggaggaggaacaggaactaagcgtgatccgggagagctgaaccgagaggtacaagcaaagtctggttgagagataaggactctgggaccctctgaacatgctgtcaagcaacatgtactactagctaagtttttacaatatatattcttattgtgtaattaaactttaaatgggttaatttcacaattaaaatcattgaaagggaaatagttttaaaactatttcttatattttggtgctcaaaaaaaaaaaaaaaa

SEQ ID NO: 15337 - DNA, 1077 bp, Zea mays
acggccgtccgcacaataatctgcgctgcgcggaagaagggaaggggaaaagcagttaagcttgagcgcgcgcgacagggtcaagtcgagggccggggaatcgccggagaatggaggtgggcagggctccgcgacgacgggtgtccccagcagcggcggcggcggctgtgccttcgctgcttctgttcgccgttctattcgcgggccgggcggcggcgttcggccacctgcaagccgccggcgccggcgcgacggcgctgtacaagcacgcgtcgttcttcgaccgcgacggcgacggcgtcgtctccttctcggagacgtacggcgcgtttcgggcactcgggtttggattcggcctgtccagcgtcagcgctgcgctcatcaacggcgctcttggtagcaagtgcagacctcaaaatgcaacgtcatcgaagttggatatctacatagaggacatccagaacgggaaacacggaagcgattcaggggcatacgacgccgaaggaaggtttgttcctgagaagttcgaagagatattcgccaagcacgccaagactgtccccgacgccctgacgtcggacgagatcgaccagctgctgcaggcgaacagagagcccggggactacagcggatgggctggcgcagaagcggagtggaagaccctctacagcctcggcaaggacaaggacggcctcctccgcaaggacgtcgcgagaagcgtctacgacgggacactgttccacatgctcgcgcccaactggaaatctcccgacgaggaggaggagctaagcgcgatccgggagagctgaaccgagaggtacaagcaaagtccgattgagagataaggactctgggaccctctgaacatgctgtcaagcaacatgtactactagctgtgtgaacgggtggtgtgaacactcttttcttatcagattataaaaaagaaggtgtgaacagatctgtcctccgggcgcgctggtgtgtttgtataccggccggcggatagtggctggcctagtatttagcgataggatatttcaatgtacattatcataaaataagataaattcataattc

SEQ ID NO: 15338 - DNA, 3177 bp, Zea mays
ctctatgcaaaagaggggctaaggatgacgagctataccagaaaaatggtgtgccatgttccaacacaaatgcaaagaaggttctcactgaaacaggacgcctcacaccaggcggagctggctctttggtacatattaagcagacgaggtatataaaagacaagctgaagttgttacattttctaactgataagcatcttaatgtctacatactgtttgactttcttttttaccgattctgctacaaggtcttccagttataatttgaaggagaaccttgtaccaaatatgaaattatttgaactagagaagagcacacaagatgccaggcaacctcttgctaccatttcttcgaacaaccaagataacgtgaatacagttaaatctcaaaatcttgtcccaaccacaaaacaattgttaggtccagaacaacattgtgagtctattatccttgattctgaacatctgattttacctgtatgtcttgtgtcagtgattgaatcccttctgtgccgataatttcaggtgtgaagcgggagggtatttttctgaacaaggatgacccaaaagttgctactttattacagcaatctgactttctttgctcccttgcaacaaaaatcaaaagtgacaatacaagtaaaagcatggatgaagcatggcaggtatgtatggctacaccaactttatgttacaaacttctcagcttaaaactcttggcgctttattgataggtaactgtttttatcccggacattttcagcaactgcaagatcatttagtgaaaaaagagcacaacaaagtgccagaaaacagtgggtctgaaatagcttcacttttagaggagcttgatgatttaattgtagacccctatgagaggaaagatgaagatgaacagaagctaaggttatttgtgaataaacactcaatttttttgtcaaatatgtcgcttcagttgttgacccatcattatttccaatgcaaagcgagcacaatggacggaccgatgtggacaatgatcactgtaacggttcttcacaaactagcatagtagtaacgtcaaatatggtcccagaggaaatgatgggagattgtccagtcgataactgcaatgaggatagtagtctttgtagaaaagtgctttctggaagtacggaaccttgcccaggtaacctttgctatcaattgcaacttagtagattcttatctacatcaaagaaaggctatctgaaattttttatgataaaacaggtgcaaaaatgacaggatgtgggaatttgagcgaagaccaggttgctgaaggtagtgtgcttcaacgtgtagaatctatatctcctgttataacagatattgatgatttactcgtagacccgtatgagagtgaagcggaagatgaagaaaagtcagggtaaatgatggataattttcatcttttcattcgtatatattgcttcagatgttgatgcgtcatcattctaattaacagggagcagaatggacagattgatgtgcatgctgagcagtgttttggttcttctcaaactatcatagaagtgatatcagacatggcccctgatgaagtcatggaaacttgttcagcagataaccgcgaagaacatagtagcatttgccgaaatgtgctttctggaagtatggcaccttgcccaggtaacgtacactatctaacatcacctttctatattctatttcatccacgtcacagaaaatttattgaaatccttgaggctcaaacaggtgcagaaataccaacatctgaaaaaatgagtgaacttgctgaagatagcagacttcaatgtatggagtttgcatctcccgttctggcaaattttgcgagcaaggaatgtggagaaacaccagaaccacaagttcttaatgagattgttgaagatagcaggcttcaatgtattgaattcggctccccggctcacacaattctcccagataaaacaggcgccgaaaactttgcatccccaagttttgatgtggttgcaaaagatagtaagcctccgtctttggaattcacatcccctgctcatacagttgcaacattccaaccgtatgcagacggcatccctaccccaaaattcactgctagtgtaagctttcaatttttttcatgacctgtgcctgaaatttgtatttcgaaatattgttgtacctgaagtaaataataactatgttgtgaaagctgctcacatttgtacttttcattcttttcaggagaggagttttctgctgtcagttttagagctgacctcaccagggtcaaggcctgaaacttctcagcagccatcttgcaaaagggctcttcttaatagcctttgaaatgggtttgcataaaatcccaacaccaagcctgctatgcccctcagcataatttggctactcctatatgcatgaagtgtgcctaccctcaaagggtttcatagtatgttttgtttgttgtatagaatgatgcattggtgtagttgtattagcatacaggaacgaaagggtgatggtgtaagtgtttacagcttgtgttcaaaatatagaaaaagtaatattctttgtgtaattaactcttgtaattcttcccatgggtgcgagttattagattgttgcgtagtgtgatgtaatggctttcctttgttgagcttttggtatggaagaaccgactgcaggctatggctgtatgctttattgatttgtatggttggaacttggaaacatgatattcggttgatagactgcgttctctgcagctgatccggcactaagtttggtgtccattttcagaataaaaaagaaatatttcccaggcctccagaagccggcgcggcccctgttgtgatgtgccttatcaacaaagactgcagtagtctcatcggacaaactgtccttatcatactgacattgatgatcataattagggtgtgttgtatttgaaaactatagttttagaatactacggttttaagatgtcattatataatcgtagtattttttatattacttctggcaatacatgtttgaagacaaaatatcttaaactataatatttagggcttgtttgttacatgagactaaattttaattcctcttttttttttgtttggcaacctcttttggaagtggctttaatatgtagtaaactagaacattgcggcgccctta

SEQ ID NO: 15339 - DNA, 1388 bp, Zea mays
atgaagatgaacccaggcaaagcgagcacaatggacggaccgatgtggacaatgatcactgtaacggttcttcacaaactagcatagtagtaacatcaaatatggtcccagaggaaatgatgggagattgtccagtcgataactgcaatgaggatagtagtctttgtagaaaagtgctttctggaagtacagaaccttgcccaggtgcaaaaatgacaggatgtgggaatttgagtgaagaccaggttgctgaaggtagcgtgcttcaacgtgtagaatctatatctcctgttataacagatattgatgatttactcgtagacccgtatgagagtgaagaggaagatgaagaaaagtcaggcgagcagaatggacagattgatgtgaatgctgagcagtgttttggttcttctcaaactatcatagaagtgatatcagacatggcccctgatgaagtcatggaaacttgttcagcagataactgcgaagaacataatagcatttgccgaaatgtgctttctggaagtatggcaccttgcccaggtgcagaaataccaacatctgaaaaaatgagtgaacttgctgaagatagcagatttcaatgtatggagtttgcgtctcccgttctggcaaattttgcgagtaaagaatgtggagaaacaccagaaccacaagttcttaatgagattgttgaagatagcaggcttcaatgtattgaattcacctctccggctcacacaattctcccagataaaacaggcgccgaaaactttgcatccccaagttttgatgtggttgcaaaagatagtaagcctccgtctttggaattcacatcccctgctcatacagttgcaacattccaaccgtatgcagacggcatccctaccccaaaattcactgctagtgagaggagttttctgctgtcagttttagagctgacctcaccagggtcaaggcctgaaacttctcagcagccatcttgcaaaagggctcttcttaatagcctttgaaatgggtttgcataaaatcccaacaccaagcctgctatgcccctcagcataatttggctactcctatatgcatgaagtgtgcctaccctcaaaagggtttcatagtatgttttgtttgttgtatagaatgatgcattggtgtagttgtattagcatacaggaacgaaaaggtgatggtgtaagtgtttacagcttgtgttcaaaatatagaaaaagtaatattctttgtgtaattaactcttgtaattctccccatgggtgcgagttattagattgttgcgtagtgtgatgtaatggctttcctttgttgagcttttggtatggaagaaccgactgcaggctatggctgtatgctttatcaaaaaaaaaaaaaaaaaa

SEQ ID NO: 15340 - DNA, 1348 bp, Zea mays
cccatgcccactgtgcttaaaccttccaaagatcagctcataccagcaatcagcccatgcccaatgcaataaggaatgcctagagctgtcagatgcatgttaagtctaacttgtaggtttacaaatcaaccaacaccaagggattgattcggacctcagaactacatttccaaataaatcctgaatataatcctgctcgcactaacatcatgttgaatacaactacctgtacaactttataataacatatgttccttgtcagagaatcactcagggcttgtgttgttgcatgcggattggaatggattgagggggcataaaatcccttgctaccaaacaagccctcaaaataacatcttgatacacatattctccctgatactaccaagcaagttacaaaccaatgaaccatagacaacagccaagctataatttcagaagaaaagcttgctgtaaaagaaaaacactgacaaattataggagcacacggcatgatatagaattatggcggttgaaggctagtagcagctaagtgtgataggtgaagcgagatctccgtggcctaattaggagtacaggcagacaaacaatcgaactcccagttaggtaacaataccaagcaagtgcagaaagtaattaatggagcacatctaagttaggaagatgcacgtgtcccccctcctctctttttttcttttacaagaaaaaactagacataattattccttgcatcaagcagtaataattcttagggtaagggaagagaagaaaataacagaaagggcccccattaagatgacatgtacggtttccatctgcagatctagctgagatctaagttgagaaagtaaggatcaagcaaaagctaggcaacacaacaagctgggcttctccccatacataattcatcacccaaaaaaaagtcaccgtctgatctggtagtctgatccgttgtgtggatccacaagagcggtgggaccggacgggatcggatcacgcggaggccgcggccttgcgggagcggtagagcttgccgaagatgtggagggcggtgacgaagccgatgaagcagagcgacatgacgagcaccatggtgggcgagaggcggaggcccggcgcctcgtcggtgtagaagcggagcatgttgctcccgccggccccggagaagccgcctcccccggcgctagaggtggcgcggccgccgccgccaccgacggaggactgcgactgcgaggaggagcgggccatggctgactgcgaggaggacggaagaactcactcggaggcttcaggatcgggatctgtggcgctcgctgctcaagtcccccagctgcttcgtcgttgtcgg

SEQ ID NO: 15341 - DNA, 1238 bp, Zea mays
taaaagttcggggaatcaagtgacattagggacccacccaagtgacccttaacctgacgaccaaacattagtggaggtccatacccttgacccgacacgcttaaaactttgataaaaaaactcatagcagcatccagttcaagcctaatgcaataaggagctgtcatatgctttgcccattctaacttccaggtatataaatcaaccagcatcatattgttataacctcgcgatgaacataataacatcatgtcgagcatagctacttgtacaaacttcgaatgctatagtttcagaacaagagcttgctggaggggcgaaacaaacactgacaaattataggagcacacaacataatgcagaattttatggctagcaggtaaggtgcgaagcaataatcaaactccccagttcggtaaaagtacccagaatacctagcaagtgcagaaagtagttaatggagcgacaacaatggagcacatctaaacctggtgggctgctcttattttttttttttttttttagaagaaactagtcatagttattccagtaataattctcaaagcaagggaagaaaataacagaaagggcgcattaagttgaccagtactagggtttccatctgcagatcgaaagtaaggaccaaccaaaagctaggcaacacaacaagctgcgcgtctcgccatacacaaattcatcacccaaaaaccaaaaccttcaccgtctgatctgtctgtctgatccgatgtgtgggagcaagagcggtcggatcggatcggatcacgcggaggccgcggccgtccgggagcggtagagcttgccgaagatgtggagggcggtgacgaagccgatgaagcagagcgacatgacgagcaccatggtaggcgagagccggagccccggcgcctcgtcggtgtagaagcggagcatgttgctcccgccgccccccgagaatccgccacccccgccggacgcggtggcgcggcggcggcgcatcccggcggccgccgcggccgtgccgcgcggcccgacggtggccgggcgcgcgccggcgccggcgccggcgccaacggaggactgcgactgcgaggaggagcgggccatggctggcgggcggagtacgtagggatctgcggcacgaggcggaggatgaggggagaacacgctcggaggctcgggatcggcggcgcttatgctcctcccgctgcttcgtcgtcgtcgtcgcctagacgggagga

SEQ ID NO: 15342 - DNA, 760 bp, Zea mays
  misc_feature (52)..(52): n is a, c, g, or t
cggcccctagggccctttttttttttttttttggaggaagatgcacgtgtanctggtgatctcacaagcagaatcacaagaaaaaactagacataattattccttgcatcaagcagtaataattcttagggtaagggaagggaagaaaataacagaaagggcccccattaagatgacatgtacggtttccatctgcagatctagctgagatctaagttgagaaagtaaggatcaagcaaaagctaggcaacacaacaagctgggcttctccccatacataattcatcacccaaaaaaaagtcaccgtctgatctggtagtctgatccgttgtgtggatccacaagagcggtgggaccggaccggatcggatcacgcggaggccgcggccgtgcgggagcggtagagcttgccgaagatgtggagggcggtgacgaagccgatgaagcagagcgacatgacgagcaccatggtgggcgagaggcggaggcccggcgcctcgtcggtgtagaagcggagcatgttgctcccgccggccccggagaagccgcctcccccggcgctagaggtggcgcggcggcggcgcatcccggccgctgcagccgcccaaccccgcggaggactgcgactgcgaggaggagcgggccatggctgactgcgaggaggacggaagaactcactcggaggcttcaggatcgggatctgtggcgctcgctgctcaagtcccccagctgcttcgtcgttgtccccgacccggccggc

SEQ ID NO: 15343 - DNA, 2507 bp, Zea mays
cccctcgggtcgacccagcggcgtacctcgaggccggccgggaaccctggttctagagcaactctcatcctcactccccccactcgcccgcatcttccggtcttcctcatggcgtcgagcgacctcgccgagagcctcctccccggcggcgggggcggagcctccgcctcacatgacgaatacgaggagcgcgcgtacgactccgaggacaagatctccatcgccgtctcggattccgacggcgaagacgacggcacgccggcgtcgcgcccgcccttctcgtggcggaagctctggcgcttcacgggcccgggttttctcatgtgcatcgcgttcctggacccgggcaatctggagggggacctacaggcgggcgccgcggcggggtaccagctgctgtggctgctcttgtgggcgacgatcatgggcgcgctgatgcagctgctctccgcccggctcggcgtggccacggggaagcacctcgccgagctctgccgccaggagtaccctccctgggccactcgcgcgctctgggccatgacggagctcgcgctcgtcggcgcagacatacaggaggtgattggcagcgcgattgccatcaagatcctctcggggggtgccgtaccgctctggggtggcgtcgtcatcaccgcgctcgattgcttcatctttctcttcctggagaattatggcgtgaggaaactcgaggcatttttcgctgtactgattgcaactatggctgtttcatttgcggttatgtttggtgaaacaaagcctagtggcaaggaacttctgatcggtttggtggttccaaaattgagttcaaagacaattaagcaagcggttggaattgtgggctgcatcatcatgcctcacaatgttttcttgcattcagcactagtgcagtccaggaagattgacacaaacaagaaatctcgtgttctagaagcagtttactactataacatcgagtcaattcttgcactcatcgtgtccttcttcattaacatctgtgtcacaactgtttttgccaaaggattttatgggtctaaacaggctgacagtataggtcttgagaatgctgggcagtacttacaagaaaaatatggaactgcattctttcccatcctctatatctgggctgttggtttgttagcatctgggcagagtagcacaattactggcacatatgcaggacagtttgttatgggaggtttccttaatcttcgattgaagaagtggctacgggcaatgattactcgaagttttgccattattccaactatgattgtggctttatttttcgatactgaagatcctactatggacattctgaatgaagcactcaatgttcttcagtccatacagattccgtttgctctaattcctctcatcaccctcgtttcaaaggagcaaatcatggggtcgttcgtaattggtcccatcaccaaagtgattagctggattgttacggtatttctgatgcttatcaacgggtatcttatactatctttctacattactgatgtccggggtgcattgcttcgctcaagcttgtgtgttgtgttggttgtttaccttgcattcatcgtctatcttattgtgcgaaatacttcgctgtattctcgcctttgctcatcaacgtcaaagagctcgtgagcatttcaatgtcgtcatctgctgctttgatgggttggaacagtgctgtagatccatgcaaagcttgtgctgctgcttatttattggcttcagagaagactatgtatgctgtatgcatatcccgtgtatgcttgcatttatgggatatttggtagtagggctccttcccttttaggatgctatattttcacctccagtcacacgttgcagatagatttcttatttctgaggtttatggtgatgtgaaaagactactggcaaaaaaactggcattgctgttcctcctgaaactgagcagatgaaatttactgaatgatctgtaaagctcgatgttgcagttctgaattccaggagctcaatgcatattctgctgaagcttgaatggaatgtcgtgtaagatatgaatgagttgtactttgtgatcgcccccaccgcggtggtggtgacaaggagatcacgagaagattggagagatttctcctcaatcctctccaattctctctagagatgatttggtgataatgagatcacccctcaatcccctccaactctctggtgaccgtgatttctggtcaccaaatcagcccttagagctagtttgggaacacctttttccaagagattctaattttctcaaggaaaaatgaactaattttccttagaaaaatagaaatctcttagaaaaacaggtttcccaaactagcaacacagacactagggattgatgtgatcgtgtgagaggcgtctcatactctcatctttgtgtcggcgtgcgcacgcagaagcgtctgtgtcagtgtgtcacacagctctgttccaacttacttgaagatataatactcgggagc

SEQ ID NO: 15344 - DNA, 2062 bp, Zea mays
cgccgcgccacacgcgcgcgccctcacccagtcctcgactagccgacgccgagaagcccctcgatggcgaggcgaaggcgcgcagcaatcctgcctcgcttccctccaaattcccaaagctctcgcgcgcggtgccatggcggagcgcctcgccgcctccctcctccctgccgcctcgccgtccccgtccgcccgccgcgcaacggtcgcagccgcagccgccgcctctttcccctccccatgctccgcccgcgcggggctgcgcctacgctcccgcccgcccctcttctcgcagaaggcggccgggcgcgggtgtggcctgcgggtggtgcggtgcatggcagcgtcggacgcggcgcagctcaaggccgcgcgggaggacatcaaggaactccttaagagcacatactgccaccccatcatggtccgtctggggtggcatgattctggtacctatgacaaggatattaaggactggccacagcgaggtggagctaatggaagtttaaggttcgatgctgagctgagtcatggagccaatgccggcctgattaatgcattgaagcttatccagcctatcaaggacaaatacccaggtatcacttatgcagatttgttccagttagcaagtgctacggcgattgaggaagctggtggtccaaaacttccaatgaaatatggacgtgttgatgtcacagcagctgaacagtgtccgcccgaggggaggcttcctgatgctggcccacgtgatcctgctgaacaccttagggaggtattttatagaatgggccttgatgacaaggaaattgttgcactatctggagcacacacacttggaagagcaaggcctgaccggagtggctggggaaagctagaaacaaaatatactaaggatgggcctggtgagcctggagggcaatcatggacagttgagtggttgaagtttgataatagttacttcaaggagatgaagttattttttttgaacgaaattcaggacatgaagtttttgagccagcttccctggaaagagcagaaggaacaggatcttctagttttgcctacagatgctgcattatttgaggacccatcgttcaaggtatacgcagaaaagtatgcagatgaccaggaagcgttctttaaagactatggtgaagctcatgctaagctgagcgatcttggtgcaaagtttgatcctcctgagggattctcactcgacgatgacacaagctcttcaccttccgacgagaagacggaagaacctacactggtagcggtaggagcggcagtagcaacagcgacagcggacgacaacaacggcgcagctccgcagccggagcccttcgtcgctgccaaatactcgtatggaaagagggagttgtcggatgcgatgaagcaaaagatcagggcggagtacgaggggtttggaggcagcccggacaagcccatgcagtccaactacttcctcaacatcatgatcctgattgcggggttggcgttcttgacatctctgcttgggaactgagtgttatatcatcatatgattatgatccgatttctgaagtctacgagtgtccactattgcaaactctgtaaacgtatgaaacatatctacgactagcattagagctacgtacactgtgcaaacagtttttttttttcgcgaattttggagagagacgagcaaaagaaatgtataacgagtgttcgagaaaaaaaaaaaaaactatcaacacactgttgctgccaaaagaaagagagggggggaagatcaaaaataaaagtgggcggggcgttctaaaggatccaatcttatataccgttacctagatacaatatacttggtctatagttacacctaaattaaatgaaataaccctggcttaacacaactcaagtctggtaaaacaaatccctttccaaactgaatggggttagaagagaagaggccctttacctaagcgcccttaccaacagaaaaggcccgtacaatggcgaatgtccaatcgcattggaaccgtaaattaaaaacggaaggtgacgtggataggcgcattaaaac

SEQ ID NO: 15345 - DNA, 2001 bp, Zea mays
aaggcgcgcagcaatcctgcctcgcttccctccaaattcccaaagctctcgcgcgcggtgccatggcggagcgcctcgccgcctccctcctccctgccgcctcgccgtccccgtccgcccgccgcgcaacggtcgcagccgcagccgccgcctctttcccctccccatgctccgcccgcgcggggctgcgcctacgctcccgcccgcccctcttctcgcagaaggcggccgggcgcgggtgtggcctgcgggtggtgcggtgcatggcagcgtcggacgcggcgcagctcaaggccgcgcgggaggacatcaaggaactccttaagagcacatactgccaccccatcatggtccgtctggggtggcatgattctggtacctatgacaaggatattaaggactggccacagcgaggtggagctaatggaagtttaaggttcgatgctgagctgagtcatggagccaatgccggcctgattaatgcattgaagcttatccagcctatcaaggacaaatacccaggtatcacttatgcagatttgttccagttagcaagtgctacggcgattgaggaagctggtggtccaaaacttccaatgaaatatggacgtgttgatgtcacagcagctgaacagtgtccgcccgaggggaggcttcctgatgctggcccacgtgatcctgctgaacaccttagggaggtattttatagaatgggccttgatgacaaggaaattgttgcactatctggagcacacacacttggaagagcaaggcctgaccggagtggctggggaaagctagaaacaaaatatactaaggatgggcctggtgagcctggagggcaatcatggacagttgagtggttgaagtttgataatagttacttcaaggacatgaagtttttgagccagcttccctggaaagagcagaaggaacaggatcttctagttttgcctacagatgctgcattatttgaggacccatcgttcaaggtatacgcagaaaagtatgcagatgaccaggaagcgttctttaaagactatggtgaagctcatgctaagctgagcgatcttggtgcaaagtttgatcctcctgagggattctcactcgacgatgacacaagctcttcaccttccgacgagaagacggaagaacctacactggtagcggtaggagcggcagtagcaacagcgacagcggacgacaacaacggcgcagctccgcagccggagcccttcgtcgctgccaaatactcgtatggaaagagggagttgtcggatgcgatgaagcaaaagatcagggcggagtacgaggggtttggaggcagcccggacaagcccatgcagtccaactacttcctcaacatcatgatcctgattgcggggttggcgttcttgacatctctgcttgggaactgagtgttatatcatcatatgattatgatccgatttctgaagtctacgagtgtccattattgcaaactctgtaaacgtatgaaacatatctacgactagcattagagctacgtacactgtgcaaacagttttttttttttcgcgaattttggagagagacgagcaaaagaaatgtataacgagtgttggagaaatagcgacctgactatcaacacactgttgctgccgatcctccggttgctaatcactatgttgaaaaccgacgacggggctatatacggaggcgcgaatgatctgcgacctggcacatgggctggtttcttgtctgatgagccggacggttcgtttctgatggccggacggtccgtgcgtgcgcaaaaacgacggagttcaccggcagcgcctagatctcgctcctgggatcccgtcggggaggagagaccctaggctttgtcttaggatcggcaggtcactcaagacgtctctagtcgacgtagagccgaagagaggtaaagatttgatggagagaaagactaaactagaactacttctaacgcataagataaaaacgaggtgtatattgagt

SEQ ID NO: 15346 - DNA, 2170 bp, Zea mays
  misc_feature (1089)..(1089): n is a, c, g, or t
gtttcatatttgtttaaacggctagcgcccaggcgttatatatagctttatttaatctagcgctgatcgagtgctatatactaatctaatattattgtttatttaatcttgattaggcgcgaagctaagcaaggatgacacgaaaccatttttctcagatggaattggtgggagtggatttaagaagctccctacaagattgccaaatgtagggaggttctatagattttaggttgtttataaatttaagatgacttttacataactgttagagaaacaattttcttaacttcttaaatcggtgtttagagagtgttttacataactactattagagttgcttaggttttttttgtcattcacccgtgcaagcaattccatgttccgtttgtagtacacgttgcactgctcctgtaccggactgatcagtgagcccgctatccaccccactgctggctgtccctgccctcgggttccacgcagaggaagtgaatcacccattgcacttttccgcgcggaggaaggtgaatcactcattccactcccaaacctcccgaaaaccctcgtcgtcttcctcccaaatcactcactcgcttgatctctcctctccgaacccggcaacccctagaactagggttccagcgacccaatgacggacggcagcgacgagtacaagcgcgacgagtcggtgatcctgctggtcatcgtctccctcgccgcgctctcgctcctatccctcatcgccgccttcgcctactactgctacattacgcgcaaggtctcccgccgccttcagtcactccatctccccaaacgttccagctctcctcctcctcctcctcctccccgggccctgccgccgccgcaacagcaggggaaggacagcccgttcagcagctccgccagcgatggggccgctgcggcggcggcggcgatgtcggttgtggttgctggggagaggggcgtgcaggtgttcagctaccgtcagctccacgcggccatgggcgggttcggccgggcgcacatggttgggcagggcagcttcgggaccgtgtaccgcggggtgctccccgaccggaggaaggtcgncggtcaagctcatggaccccccagggaagcagggcgaagaggagttcgagatggaggtaaaaacaattactgacatttgtgcatttggatccttgctactcagcggcgaatgcgggtggtttcatgtgctgggtttggggttgggacagaatacaccgcgtcctgtagcgtcttccgctagttggtaactactggatctggccattgcggcttgggcttggtgaagctctgcggtccaagccgagacattgtaggtttcgtgagtgcaaatggggtcactatgcgttgggggtttccgtggttgttcacttaaagaccatatcctctttctaaaaatggagcagtcacttgtgtgatggtaactgcgaagttctctactgtttactaactgtaaaatttggtctccataaaatttctcatgtggtggtgaggtgcatttttttaacggctggattattttagattcttggttgtgagtttgtgactatcagctctttgcggtgtttatttagttgtagtgatagtaatgattggtaagcaataaacattatgtgaagtactttaattcttattagttgttcatggataacttcgtagtattttttttctggcatgagggtaatgtgaccattttcactttagcaatatgttggtcaaattgctctgttgttggatgtaactgcacaattatttcaatatcctcatgtatgcagtatgctagacaagtagactgctacttaagtggaaataggaacgcaaacaaccactcggttccaccaacacttcacatatccccaatttagccatggggatagcaacagatcaacagctagaaaacaattaccttgctatagggatagggcacaggcttggcatctgataagtaccagatttggcaacaggtagtgtgtttgaaatgagtaaccagcaagcaagacatgccgagctgtgagatggacacgattttatgtgttaggttagcagctactcctgtgctggctataagaatggaagtatatgcagaaattgacatgaagaaaaaatttatgattgaactctgttgttttatgacataaagggc

SEQ ID NO: 15347 - DNA, 1633 bp, Zea mays
aaaagcctgtctagaaccaaacacccctctccaccgactgcaaataatccgactcccactgctgggtgccctgtcccctacctcgggttccgcgcagaggaaggtgagacaccaattccactcccaaaccccacgaaaaccctcgccgtcttcgtccaaatcactcgcttgatctctcctctccgaacccggcaaccccttgaactagggttccagcgacccaatgacggacggcgacgacgagtacaagcgcgaggagtcggtggccctgctggtcatcgtcttcctcgccgcgctctcgctcctttccgtcatcgctgccttcgcctactactgctacattactcgcaaggtctcccgtcgcctccaggcgttccatatccccaagcgttccagctcccatcatacgcttcctccccgggccctgccgccgcagcagcaggggacggacaacccgtccagtaactccaccagagatggtgtcggagcggcggcgatgtcggtggtggctgctggggagaggggcgtgcaggtgttcagctaccggcagcttcacgcggccacgggtgggtttgaccgggcgcacatggttgggcagggcagcttcgggaccgtgtaccgcggggtgctccccgacgggaggaaggtcgcggtcaagctcatggaccgcccagggaaacagggagaagatgagtttgagatggaggtggagttgctgagtaggctccgatcaccgtatttattgggcctgattggccattgttcggaaggtgaacactgtctacttgtatatgagttcatggccaatgggggtctccaggagcatctctatccaaacagaggttcatgtggtggaatctcaaaattggactgggacacaagaatgagaattgcacttgaagcagccaaaggtttggaatatcttcatgaacatgttaatccacctgttatacatagagacttcaagagtagcaatattctcctggacaaggacttccatgcaagaatttcagactttggtctagccaaacttggatctgatagagctggtggtcatgtctcaactcgagttttgggcacacaaggctatgttgcaccagagtatgcattggctgggcatttgactaccaaatcagatgtgtacagttatggtgttgtgcttttggaattgcttactggcagagtaccagttgatatgaagaggtctcctggagaaggtgttttagttaactgggcattgcctatgctcactgaccgagataaagttgtgcggatcttggatccagcatcggaaggtcaatattccttgaaagatgctgtccaagtggctgctattgctgccatgtgtgttcaaccagaggctgactataggccattaatggctgatgttgtccaatcgctggttccacttgtcaagaaccgttataatcagaaatcttgcaatcccaatgtgcaaccatcgaagccacttgactaggagaaaagctagtgtttgatctgcagtttgtgctcgtccttctggaacccttctcgagttctcgtctataacgaactactgttgagacagattcacacgcttcctaacaatgatttcgtctgctggtgccctccaaaaataaaaaaaaaaaaaaaa

SEQ ID NO: 15348 - DNA, 3371 bp, Zea mays
  misc_feature (3092)..(3092): n is a, c, g, or t
tgttttgtaggtggagttgctgagtaggctccgatcgccgtatttattgggccttattggccattgttcagaaggtgggcaccgtctactggtatacgagttcatggccaatgggggtctacatgagcatctctacccaaccagaggtataggtgtatagccattttgtatcgtctaagtctattgttgtttttgtgcatttattttatgcacttggcatttttagtgtcaacaacccatcactactttccaattgataaatgctccagactctgcctgataatgccaaaagcaccagtgtgtgctttaactgactcgtagaagatatcagcaagagaaggttatgtatttttattgcgttgatacgctgcttgttgctaatatacaaagtggaaatacttaccagtgtagatactaagcttacaggtagtttgcatagtataaaagtgatctggagaattgccacattcaattatggaagtaaataactttttttaggatgatatgtaaacgtgaagttggctgaaatgtcttcctaccacttaacacagcggataacttgggtattggcactctttttaagacattgtttttgccaactgatagatctaaaacattgttctaggttcctgtggtggaatctcaaaattggactgggacacaagaatgagaattgcacttgaggcagccaaaggtttggaatatcttcatgagcgtgttaatccacctgttatacatagagacttcaagagtagcaatattctcctggacaaggacttccatgcaagagtttcagactttggtctagccaaacttggatctgatagagctggtggccatgtttcaactcgagttttgggcacacaaggctatgttgcaccagagtaagatcaggctaatgttcatttattacttcttatagatttaactacttactaaatctgttgtacaaggtcataagtttgttattggtctgtcatttgctcaatcgcttttgtgttctaaagaattgatactgtctctaatatgatgcacatactgcaaatctgtgcagatacgcattgactgggcatttgactaccaaatcagatgtgtacagctacggtgttgtgcttttggaattacttactggcagagtaccagttgatatgaagaggcctcctggagaaggtgttttagtaaactgggtatgccaaaagttcctgattagtatagctttgcgttgagctgttttcttctgccatcatggatcataatgttttaggaagtgtttagctgttaacatgaaatcagtattgactgtacaacagtgtctccttgaactgcaaaaaaaaaaggtggttatgacgagtgaattggatatttgcatgttcttcagttcttcaatgagaacatttacttcagttccgtgctgtcatagaacttcattttcttccttgcttctatacttcgatttttcatgtacaaagtcatgacatgtattaattagaatgcacctgcttctcttgtacttggttggaaaacatcagcctgtgtggtggtaattcaacattgcttatatatctaacctgtcacttgttgaattactgcaggcattgcctatgctcactgaccgagaaaaagttgtgcggatcttggatcccgcgtgggaaggtcaatactccttgaaagatgctgtccaagtggctgctattgctgccatgtgtgttcaaccagaggctgactacaggccattaatggctgatgttgtccaatcgctggttccacttgtcaagaaccgttctaatcagaaagcttgcaaccccaacgtgcaatcgtccaagccacttgactaggaaagcgtgtgttcgatctgcagtttgtgctcgtctttctggaacccttctcgtctataactaactatggctgagacagatattcacaagctcctaaactatgattttgtctgcgggtgctcttctgattttgtaggtccgtctgagcaggtaggttgtctgaacggtcctgagagcttatttgggtttgaagggaagtttctgtcatgtacaattagctgcccgcggtgatggtgggttgttggattagtacttgtggttgtgtggagttcgtcatcagatggtaggtttggtatgagctggcagaactgtttgtagagtactgcactaatttccttttggcttatttatgttagggaagcagctttagaagatcattgtgcgcttgtacagaggtcttaactgttaagctgctaagtgttatgtatccttgccagtagtgagtgttatccttgtattgtagtattactaatgtatagcacgtttctggattggttctgacttcattgttgtttgagcaacgtaccttctttttaccatgttttgttgatttttgttaaactttcaactgattcagaaaatggagcatattgcaacaaaaaaggtgaaaaaaagtctgaaacaagaggacatcacaaattcacaatgttgttcagtttaccaggactcatgtgttcagacaccaaacgttcatgacagacatgtttggacatgattaatgtggttgatgactttgaagccaaatggttgttggttgatggtgaattaccgaaccacatttcttggtgttcccgcaagtgtcctcaggcgcttcaacaaatggttgctccgttgtaaggaccagcgagcaatggataaggaatagaacaatcgttccaacaaatggctagcaagaccagtgaagcacggtgtggcgggcttggctggcggaaggggaagcattcaaaggagagatgtcgtccgtacctacctccttttcgtattcggtgcagccacaagggctcgtgaattccatgctctattaaattggaaaaattccttttcatctaagtagaaggatcctgtattttttactagaaattctgttctcttgaagggctagtttgggaacctaatttttccaaaggatttctatttttccaagagaaattagttcattttccattagaaaaatataaatctcttgaaaaatggtattctcaaactagcccgaaaagtttttatttggggaaaaccaaaataaaaggagaacggaanaattcttcttattccataagaaaataaagattttgtcgttttagttttgttctaagtcaaactatttaaattttgatcaacaatatatatatatatatatatatatataattaaattattttaaattaaaataattatatattaaggtagctcaagtaatgatgaatctagtaactttacattttatgttgtaaaatcttatgaaacatcaggtatacttggtcaaagttaaaagtgattgatttagtaaaaacccaaaacgactaattcatgtggagg

SEQ ID NO: 15349 - DNA, 1918 bp, Zea mays
gacccaaaatcaccagagcgcctctcctctccctctccagcagccgctcccgacttttaccttcctacctggtgctgtagcatccgccgcctcccgcagaacccgaagatggcgtcgtcggcgtcgaccctcgaaatcgaggcccgcgacgtggttaagatagtgctgcagttctgcaaggagaattcgctgcagcagacgttccagacgctgcaaaacgagtgccaggtctccctcaacactgttgacagcatcgacaccttcattgccgacatcaacgccgggcgttgggatgctgtgcttccccaggtcgcacagctcaagctgccacgcaagaagctcgaggacctctatgagcagattgtgttggagatggctgagctccgtgagcttgacacggcccgtgccatcctccgccagacgcaggtcatgggtgttatgaagcaggagcagcctgagcggtacctccgccttgagcacctccttgtccgcacatactttgaccccaatgaggcctaccaagaatccaccaaggagaagcggcgagcactgattgctcaagctgttgcttcagaagtctcagtagtaccgccatctcgtcttatggcactgattggtcaggctttgaagtggcaacagcaccaaggattgttgcctcctggcacacagtttgatttatttagaggaactgctgcaatgaagcaggatgaagaagaaacataccctacttccttatctcatcaaataaagtttgggaagaaaactcatcctgaatgtgctcgattttcacctgatggtcagtaccttgtttcatgctcagttgatggaataattgaagtctgggattatcttagtggaaagcttaaaaaggatcttcaatatcaagccgatgaaagctttatgatgcacgaggaacctgtgctgtgtgttgattttagtagggattctgaaatgctggcatctggatcacaggatggaaagattaaggtttggcgtatacgaactggtcagtgcttgcgacgccttgagcgtgcacattcgaaaggtgttacaagtgttacattttcacgtgatggaacccaaatattgagtacatcctttgacactaccgcgagggtacatggcctcaagtctggaaagatgctgaaagaatttcgaggtcattcttcatatgtaaattatgccatcttcactactgacggtagccgtgtcattacagcttccagtgattgtactgttaaggtctgggatactaaaacaacagattgcttgcatactttcaagccaccacctcctttgaggggaggagatgcatctgttaattctgtccatttatttccaaaaaatactgatcacattgttgtctgcaataagacttcatcaatattcatcatgactttacaaggacaggttgtgaagagtttctcatcaggtaagcgagaagggggagattttgttgcagcttcagtttcaccaaaaggagaatggatatattgtgttggtgaagacatgaacatgtattgctttagctaccaatctggtaaactggagcatctgatgaaggtgcatgagaaggatgtcataggcattacgcaccatcctcacaggaacttagtagccaccattgctgaggattgtatgatgaagatatggaagccttgactttttttctttttaaaaaaaccttgaaccgatgattaaataggatgtattttgttttgtaatttagataactggtaggcgctacagctatggactcgttggtgcttatgttgccccatgtcttactaccattgtatcctgtactagatttagggacctttcaatggtgtaaacacagcttactacgactcctcgctacaagttcattatggtcaaaaaaaaaaaaaaaagctggatgctgattgtgtccgcagac

SEQ ID NO: 15350 - DNA, 1760 bp, Zea mays
agatggagatgttgattggttgctgaattaggatgtgtagatatgatgataataaaaaattataactttttaaaatttatataaaaaatacttataaaaaattacatttgtttgtcaaaacaaaatctcagaacagtaaaaaacgaaaggtgaaccctatcgagaagacattagtttagccaggctcagcccgaaaatgaaccaaaattaggcgggcccttagtgactgctgcatgtctgcatccgtgacctcatcagagttgtgcgaccacacgacacatggagctacaagccaccaaacgcttggcacgccagattgcctggggctgctagaggaaaggaacacgaacacgacacccgccctaaaaatagcctagatgctcccgtctcactcctatgggcgattgggtccctcgaggccggccgggatcacaacaaaaggcgcaagcaccgcacggagagcaagcaagaaagcaaccaccgcactgccactacctaacaatggcccgcgcctacgtgtttctcgtcgtgctcctcctggccgctgtcatcgtggcaccgttcgcgggagcgacgcgtgtcgacgtcgttgagggcaggtccatggcgtccgccgacgcgccggaggccgccgcaccatcacccgggcctgactccgcctcgtcaccggactcctcgtcggatgcgccctccagcagcagctcctcggactagatagctagccgctcgacgcacgatctcgctctccatctacacggcgatcgagttctagctttgtcggcatgcaatgcaaaattccgattcttcgggaataatcaagcaccaaaggaatgtgcttgcatcactcactactagtaccttgtttttatatatgtttcctctcctgacgctctccgattttaatcttcatgtatgcaacatatgtgatgaatggaaaaatcgatttgtatttgttagaaaaaaaaaaaaaataacaacgccgtcgggtttctgaaaccaagcaatgtatataaatgcaacaggaattacattctgtaattaaacaacctgttaaaagaggacttgatggctctcaaaaaaaaaaaaaaaaaaggggcggccccactttttagtctaaattttggggtaattactcttctacccaaaactaaagaggcaataaaactccaacaatataggccaatatgtctgttaaatgttagttttaaaatttttactaaagttgacaccaatagaataaataaggttgcagaaacagttgtgagaccctcacagaccaccttcatgcctggaaggaatataatggaaggagtggttatattacacaagaccattcatgaattacatacaaaaaacttaatggggtaattttcaaaattgattttgaaaaggcctatgacaaagttaagtggccataccttcaacaaaccttgagaatgaaagggttctcaccaaaatggtgcaaatgggtagagaacttcattataggaggttgtgttgcaatcgaagtcaatgatgacatcgcccattatttccagacaaagaaaaggttgcgtcaaggagaccctattgagtgcacctaaagaggggatgaataggtgatcctgtaaaaaatagctcgacaaaacaaactgggaataatattggattagtgaaagcaagagccaagttcgaatgagaattatgaagcgtagtaaacttcttcacttaattgctctttactaagtgagtattaaacttagagaaataatgtaagtgaa

SEQ ID NO: 15351 - DNA, 767 bp, Zea mays
gattccgggttcttgtttccactagtaactggtgcgcgcttcgcgcgcattgccaaaaaaatattcatataagttagcagacacggttacagtgaaatggcagaagaactgaatctaaaaaaataggcttcaacttgggttcataaatagaacaaaacttggacgatgcaatacttgtcttgtcaggaaattcaaaaggactctcagggtggtacatgtagaatgccacaagcctctgcttaatattcctttttgacgctaggtatgccgtttcaccctcttgcttgaagacattgtcagcagcaccgagtagcaggctcacctctccggcagtttgacctccgccttgtgcagttgtgcttgacggggctccgtgcagccccgacgccaatgctgagcttccgctcgacagactcgaggtcatccgctatcagcgttgtcgcctcagtctgtgccgccgcaacccaagcgcggctcgacagatgcccttaacggagaacgccatgctgcagccgcgcgctcttagcgcctccggtttctccggcgtcaagatctgctctgcggccgacgccggctccttcgcgtcttgctccggcatgcggacctcatccaccaggacggcggcctccctcggccagtggcagcacacgcgtcaggggagcagcgaccagcggcggcaagctctggacgaatgaggtggatggcgctttcagacggagcgcttggctggggaggtagaaggagaaggggacggggattggacatgt

SEQ ID NO: 15352 - DNA, 1319 bp, Zea mays
gtcatttaccatggcgtttttttctcatcaaataaccatggaaaaggggccggccgggccatggcatttttttgttttctgaaacgaaccgcggaaaggggaaaggtggggaaagaccgaaataggcgacagaaatggcgacggagaagcgcagccgccggcgctcaccgtcggccgccacgccgagcgcctcgctgacgtcctcctcaaatccagaagccgctatattgcactcaccttccccatcgctggacctcatccccgacatcacctcccgcctgatctccctcgaggacttcttcgctctgcgcgcctcctgccgcgcttaccgcgccatccttccgccgtccagcgaggccctcgcctgccagtccccgctcctcctcgtctcccttttcccctccttctccgaggcgttattccacctctcgctccgccgcctccaccgcttccgcctcccctggggccatcacctgcccccctcccgccgcaccctccactacgcgcacggctacctcgtcaccgccaccaccgcgtcctcccactaccccccgaggctcatgctcctccacctcttctccggcgagcagctccgcctccccaaggtccccgcgccgttcacccgcgtcgtcatctccgacgacctggccgccgtcctcttcctgcccggcaggtccattgtccagcactgccaccctggggacgcgctctggcgcgtggccaccgcggatgcgccccacgttgttgaagatatgctcttcgtcgatgacaccctctacgccctggtaaatggcctccgtcttgccacagtcgaactgtctgatggtttgctggaactatcgtttctaggagaggaggtggatgacggcagcaagccagcaggagggcagttcaagctcggagagtgcggcggtgacgtgttgctcatcagtgaggatcacacgggggtgatgctgtaccgtgtttatcggtgggtgtttgaggcggggaagtgggtttcaatcacgagcttgggcaggcggacactgtttcttggtttcttcggatttgcagcctgtatcggtccagattacccaggaatccgagcggattgcttatatgcagctgggccgcgcttgggtgaatggcgcgagtactccttggctgatgggacttgcgatgttcgctatgctgattatccaggtgcaccaccgctgaacaacaattcacctaccagacctccagtctgggtcttccccagcctgtgttgatactggctgtgaattcttcccatcatgtagaacatctgacgctgacttgaaataagtatggaatgctga

SEQ ID NO: 15353 - DNA, 746 bp, Zea mays
gccggccgggttggatcaacccctcaggaagctaagcattacacctagctagctgaacaccaccagatactgaattccactcagcaaaggagagccggcaaccaaccatgatcaatgccaagagacttacgcagatggcaaccaagtggcaaagaataatggccgctcttacgagctaggacgaggggtcaagcccatctcggcgacagctagaaagcgatggaccgtgcagcacttcgacgacgccggtggccggcaaaaaagggcactgcgttgtgtactcggccggccgacggggggcagcggttcgaggtcccgctggcgtacctcgatcggcacggcgcggtcttctgcgagctgctaacgctgtcgcaggaagagtttgggttcgcgagcggcgacggcagggatcatcctgccctgtgacgcggcggcggtggatggagtacgtgatgggtttgcttagaggagacgcatccgaagaagtcgtgagagcgttcttgaggtccatggtcaggccacaccatgccacactgcagtcagcgtcgtggcaccatgcagccagcggctagctgtttgtgtatgactttgatagctctggtgatgtatgtagtttttcttttgttaaggttctatactagaaaatcataaagaatggtgtgaaatgaactacatggactattcgttgctaacactatgatatacgattcttctttcaggaaaaaaaaaaaaaaaaaaggccccta

SEQ ID NO: 15354 - DNA, 812 bp, Zea mays
cattgacggccatctcgtcagccgcctgtggcacagtgcacacactcgtctcatcggagaaaagtagatccgggttagggttttagacggcgatgggtgcggcgggcgacgagaaggctgcgatggctgcgtccgctgcagccgcgggggccggtgccgccgagggcgagggcgcggtggactccaaggaccttcagcagcagagcaaggcgctcgacaagctcactgatcatgtcgaggaccggcagctcgattcatcccgtgtccaatccgccatggcggcacttgcttcatccaaggaggctgactggaacgcgatgaggctgagggagaaagaattggctgctgtcaagatcaaccctgccgatgtcgaaattatcgctagtgagcttgagctggacaagaagatcgcggagagaacgctccgtgagcacaagggtgatgccgtggctgcggttcgattcctgctgcgctagttccgagatttcgtcgccagcatcacatgttccccttcagttccacacaagaggtgatgatgtgaagcactagtacttttgtctgtgtgcctgttttggaagtttgctattagaactatgttgcagaaaattaagaatgagaataccatgcaaaaggtgtaatatgaattgtattaattatttgctattagaactaattaatcattatataaaattaaatactagatgaaaaaaaaaaaaaaaaaaaaaaaaaaaaaaaaaaaaaaaaaaaaaaaaaaaaaaaaaaaaaaaaaaaaaaaaaaaaaaaaaaaaaggtttttcaaaaccgccaacccc

SEQ ID NO: 15355 - DNA, 1878 bp, Zea mays
gggggccggtgccgccgagggcgagggcgcggtggactccaaggaccttcagcagcagagcaaggcgctcgacaagctcactgatcatgtcgaggaccggcagctcgattcatcccgtgtccaatccgaatattggagatgtgccttcaacaatctacgctcgattgtctccagatgagcaactcactgcagaaacaagatacacctcttgacatctgaaagaaacggttcgaacacatacggcaagaacaatgagtcgacgatccgcaaacagcagatgcagacgaatctgcaaatggagggtggacaaacgcacgtaccgtggaggcggacgccagcgcggttgaggtggttgacgcgatcgggacgccagcgagggggccctggccaccgtcgcggcggggggccaggagcgctcctgcaccacgagcgcgcagatctgagaagggaggactacggctggcttcgtccgcgaaccgagtcgtcgtcctggtctaggcgttcccaggaagtcagcggcgagctccgccatgagcacgcgcacctcggtgcggctctggttcgtcgtgcccaccggccccgactcctggaacatgtacccagggcagcgccacggcaccacttcgaagatcctgctgctttgctgctagtagtggtagcgacggtggtgctagcggtggctgtggtttgagcggaggatttcttgagccacttgaggcgacgaggtagggaagcaacgggggacgcgggctgggcgagcacctagcgggatctaatttgcggggaggatccgagggggagggggttcggtggatctgcgcgacgaccgggaggtgggcgatccctcgacactcgatagtcgacaccaaatacccggaccgcgaacggccgcccgcttcgcggtcgcgcaaaatgccgccgaaacccgcgccccagctcttccagtacatctccaacaagtcgcggaaaccaccgccgccaccagtcgcgcgggatctccggatctggtggttgtgttagggttgggcgcgagaggcacgagcacgagcgttgccgcgatttgctcggggtaaaactcgcgctccaggcaagtgggctgctgctgctgctgagagggggaggcgggggcacccggacggtctacactaatgccttaatagttagtagagatttacagagtatgatgtacttgagggaaagcattggatcagcattaaatggccctcgattgtatttgcttggataacctttctattcacatctgattcttatctgctcattgcaacggtcttggactcttggggattattttatagttttatgaatattaaagtcatagataaaagtagcgtcaaatgtagagttacggagaaatgttgtgtttgtgattcagctatgtttttaaatactaaacatgtttttacatgctttgtttatggtgcagaggccatggcggcacttgcttcatccaaggaggctgactggaacgcgatgaggctgagggagaaagaattggctgctgtgaagatcaaccctgcggatgtcgaaattatcgctagtgagcttgagctggacaagaagatcgcggagagaacgctccgtgagcacaagggtgatgccgtggctgcggttcgattcctgctgcgctagttccgagatttcgtcgccagcatcatatgttccccttcagttccacacaagaggtgatgatgtgaagtgaagcactagtacttttgtgtgcctgttttggaagtttgctattagaactatgttgcagaaaatttaagaatgagaataccatgcaaaaggtgtaatatgatttgtattagttatttgctattagaactaattaatcattatataaaaaaaaatcttaaa

SEQ ID NO: 15356 - DNA, 918 bp, Zea mays
gccggccgtattcgaaaccaccagttcgccccccgcgtcggccggcgggttagacacctgtaggctagcgcattgttctcaaggtcagagcttcgccgaggaggcgaggacgatggcaatcgccgggcagtgctcctcctgctattatacgtcacccaccctgcagctccagctccaccgacggcacagccacctgccgcggcagccccaagccgcacgaagagcgcggcggccgaggttgcaggtggccgcagctgccggcagcgggcccatcagggcggccacggacgccgagttcttccagccttccgacaccaggccaatcatgctcttcgacggcgtctgcaacctctgcaacggcggcgtccgcttcgtgcgggagcacgaccccaacaggagcatcaggtacgtgccgctgcagagcgagtccgggaggaagctcctgcagaggtcagggaggtcccctgacgacatctccagcgttgttctcgtcgagaaagacaggtctttcatcaagtctgaagcggtgctgaggataatggagtacctcaacctgcccttcccgcagctcgccgtcttcctcaagttcgtccctctgttcctgagggacttcgcgtacgacaacgttgcgaacaacaggtacgccatgtttggccgcgccgaagcagaagcatgcgagatactgtaacaactggtgcccctgagatctcgatacttagtctatacgattcgatgtcaacagtcgcatacatgatgtaccacgaacatctatgtgtgcgtagttttagccatctaaacaaagctcaaacaaaaaaaccttgctctatctctatgctccttgcagtgcagtgagcgataggcactgaagggcgtatactagctacaaaggctgtaaaaactgtatctttgccgcacgac

SEQ ID NO: 15357 - DNA, 1954 bp, Zea mays
cctcgaggccggccgggcccccagccgtcccgccacttcgtcaaaatcggcgcggtgcgacgagagcgaccgccctttccctcttccctcccgtcgtcttcactccgacgcctcccctgccgccaccgctattgcctattgggagggcggtccctgtcgcgcgcgacgccgaggcttcgtgacggggacacgctgctaatttgtagcgcaccacacgccggctcggcctcggttgcgcctcgcctcgcctcgccaggggattactggtgggcagcgctcgtgcttgttgtgcagccggtgtgcgtctgctcgcggcctgcggcgatggggcaggacctcgtcgagatccacccgcgcgagctccagttcacatttgaggtgaagaaacaaagttcatgtgttgtctgcctaaccaacaagtccaacgaatatgttgcttttaaggttaaaacgacatcccctaaaagatactgtgttcgaccaaataccggggttatccttccgaggaaaacatgtgaattcacagttaccatgcaagcgctccggactgctccaccagacatgcaattaaaggacaagtttttagtacagaccacagttgttccttatggcacatctgatgaagaactcgttcctgccgttttctccaaagaaactggcagatacatcgaggaaagcaaattgagagttgttcttgttagttcataccaatccctcgaagagcaacccactaatggaattcatgacactgagccagctgttgaagttcctttactgaaagagatgccaaatttagggagcgaagtaccagatgttgcaaaagaaattcctgcccctctggtacaaggtccagcaattgtgaccggaataccttcacctgtcaaagaggttccaggcctgagagaaattcctgtgccactgaacgaagcaccaactttattggcagaatttccttcccctcaaaaagatccctctgctattacagttgaacatgcctctaatgttacaattgagcatgcccctgctatttccattgaatccccacctttgaaacaaagtgttccagtttttaaggaatctcctctgaaacaaagcgttgcagtttttaaggaatctcctcctttgaaacaaagcatttcagtttttaaggaatctcctccactggaggaaactactcctaaagaagctgttatgctaagtgaccgagggcttttcaatgtgcagaatcatcaattatcccatgtaacagaagatgttcagaatatgaaatcaaagctcaacaatcttgaatcaaaattggaagaggctgaaaagatgataataaggctaagagaagagagcagaaataccacccaggagcgggatgagctacagcaagaaatggtattcctaagaaagaagggaaccgcaaggagtcaaatgggtttccccctgctctttgtggtgtacgtggcgcttcttggtacctgtatcggttacctgctccgcatatgagttccaaacttcaaaaaagttcagcagatgggatatgcttcgtatgtgggcaagacaattgaacggcagttgcactccaaaatgttgaggggtgaatttattagcattattagttcggaacttcatatggttttgcacataacagcagtgccaaactaccatctgcctgtatgtatagaacagttactttttttcgcgttttatagaacccacccaaaagatgtctgctgcctcgtagactaacctgggattcttcttccatctacctaagatttttttttacactttaaagaaaaaaaaagccctgaatcaaaaaaaaaaaaaaaaaaaaaaaaattttaaaaaaaaaaaaaaaaaaaggggaaaaaaaaaaaaaaaaaaaaaaaaaggcccctccaaaatttggaccctggaccctattggggcttgaaaaaaatggtggagggaggatttgtccttt

SEQ ID NO: 15358 - DNA, 1812 bp, Zea mays
ttgggtacccccgggctcgcccccgcggattcactccgacgcctcccctgccgctgccgcaactgggaggcggtccctgtcgcgcgcgacgacgagccttcatgacggggacacgctgctgattcatagcgcaccacccgccggttcgccctcgggctctctcgcgcccctccaacggattactggtgcccaacgcttgtgcttgctgtgtagcctggcgcgtctgctcgcggccgatacctccgcggccggcggcgatgggccaggacctcgtcgagatccatccgagcgagctccagttcacctttgaggtgaagaaacaaagttcatgtgtcgtccacctaatcaacaagtccaacgactatgttgctttcaaggttaaaacaacatctcctaaaagatactgtgttcgaccaaatactggggttatccttccaaggaaaacatgtgaattcacagttaccatgcaagcgctccgaactgctccgccagacatgcaactaaaggacaagtttttggtacagaccacaattgttccttatggtacatctgacgaggaactcgttcctgcctttttctccaaagaaactggcagatacattgaggaaagcaaattgagagttgttcttgttagtgcataccaatcccttgaagagcaaccgactaataaaattcatgacactgagccagttgttggaggtcctgtactgaaagaggtgccaaatatagaggacgaagtgccagatgctgcaaaagaagttcctgcccctctggtacaagctccagcgattgtgactggaataccttcacctgtcgaagagactcctggcctgagagaattccgtgtgccgccgaatgaagcaccagctgtattggcagaatctccttccgctcaaaaagacccttctgctattacagttgaacatgcctctactgttacaattgaacattcccctgctatttccattgaatcctcccctcctttgaaacaaagtgtcacagtttttaaggaatctcctccttcgaaacaaagcattgcagctttcaaggaatatcctcctccttcgaaacaaagcattgcagtttttaaggaatctcctccactggaggaaactagtcctaaagaagctgttgtgctaagtgaccgaggactcttcagtgtgcagaaccatcaattatctcatgtaacagaagatgttcagaatctgaaatcaaagctcaacaatctcgaatcaaaattggaagaggctggaaagatgataataaggctaaaagaagagagcagaagtaccacccaggagcgggataagctacagcaagaaatggtattcctaagaaagaagggaaccccaaggagccaagtgggtttccccttgctgtttgttgtctacgtcgcgcttcttggtaccttactcggttacctgctccgtctatgaattcagaactctaagaaaacaaaaaagttcagcagctgggatgcctcatatgcggcaagagaactgaattgaacggcagttgcactctaaaatgttggagaggtgaatttatttgcattattagttcaggacttcgtatggttttttgcacataacagcagtaccaaactaccagcagttgcgtgcatatatagaacagttttttttttttttggcgttgtatagaacccgacccaaaagatgcctgctgtcttgtagactaattatggggattcttcctatgcctaagctttctcttttcttctgtctcttttacagtttgctggattcgcttgtcctgaatcggtattgaactgtcgtgtgactatttacacct

SEQ ID NO: 15359 - DNA, 1625 bp, Zea mays
ggtacctctcgcaggccttccgggccaaccgacgcctccagtcctactcctccacccagctcgccgcttcaggaatccggagagctcgcgtcgcgcgtgcgtgggcgtgggtgcgtgcggcggcgaagcaccagcaccaccctctcgcgtcgcgcgcgcgcgcgcgtctcgatggccgacggcgagccttccctcacgcgctggaccttcgaggatttcgtggtccactacgaggcgcgcttcggcctccggcgcgaggccgacggcgacgacgcacccccgccgcgcggatccgatcatggggccagccgccccgccactgcccgcgccaacggcggcgcggacctcgccgtcttcgagcagttcgagcggatggagaggaaggtggagataagcaatggagcaatagaggatggtccactgcagaaatctctacttccttcatttgaatctgcagaaatgcgcaacttagctgagacattgttaagggatataattcgtggaagtccagatgttaaatgggaaagcataaaaggtctggagaatgcaaagcgtcttctcaaagaagcagttgtaatgccaattaaatatcccaaatacttcacaggtctattatcaccttggaaaggcatattactgtttggtccacctggaacaggaaagacaatgctagctaaagctgtggctactgagtgcaaaacaacttttttcaatatttctgcctcgtcgattgtaagcaagtggcgcggtgactcggagaaactagtgaaagtgttattcgaacttgcaaggcatcatgcaccatctactattttccttgatgagattgatgctatcattagtcaacgtggtgaagctcgtagtgaacatgaagctagccggcgattgaaaactgagctattaatacagatggatgggttgactaagacagatgagcttgtttttgttctagcagcaacaaatttaccatgggaattggatgcagcaatgctgcgtcggctggagaagcgtattcttgttccattgccagagccggatgctagacatgctatgtttgaagagctcctgccatatacacctggcacaatggagattccctatgatgttcttgtggagaaaactgaagggtattctggctctgatattcgcctggtatgcaaggaagcagcaatgcagcccctaagacgggtaatggcagttcttgaaggcaggaaagaagaggtccctgagggtgagttgcctgaagttggcccagtaactacagaagatattgaacttgctttgaggaatacaagaccgtctgcacatcttcatgcacatagatacgaaaagttcaaccaagattatggcagtcatgtacatggctaaaggggagaagcttgttgtagggtttaatttgtatgctcatgcgtgggccaataggtgactactgaattcatcgacatgctgaggtatccttgtaaacactatgcttatccttgtatgctgtacactatcattcatttgatgagcaataagctgtttggtaactcagtctcacctggataaggagaaactacgattttccctgcatttggctcgatttatctaaaaaaaaaaaaaaaaaattcctctggtgtcactct

SEQ ID NO: 15360 - DNA, 1175 bp, Zea mays
agtgacagtactagtgacaatgtgacatgtcaaaatggcgccttgtactactaccggtcgtggagggcaacctggcagctgtcctctcccctccaccgacagctcgtcgctgacggcgacggcccgcaagccaccgccatcatcgccactcgcccactccaccgctcgctcccacacctgtgccagtgccatccctttttgactcctcggcccccccctcggcggccggcactacctcactgtccggcgctgtccctgtccctgcgcaacaatcaatcccacgggcttcctgccgcttcctcggctgcccccatcctccgaatcctgcctcgcctcgatctccccgttcctcgtgtgccgacagagggtggcgggcgagtgggcgactaatggggacgggggcggggagcgcgcgggctctggccgtggcgttcgccgtctcgcttctcgcctgctctggcgccgtcgctgtcgccagggcgcaggacaccgagcggatcgaaggaagtgctggtgatgtgctcgaagacgatcccgttgggaggctcaaggtgtatgtctacgagttgccgaccaagtacaacaagaagatggtggctaaagactctaggtgtctcagccacatgtttgccgcggagatcttcatgcaccgcttcctactgtctagcgcgatccggactttaaatccagaagaggccgattggttctatactccggtatacaccacgtgtgatctcacaccatggggtcatcccttgcccttcaagtcaccacggataatgcggagcgcgattcagttcatttcgaaccggtggccatactggaacaggacagagggagcagaccacttctttgtcgtgccacatgacttcggcgcatgcttccactaccaggaagagaaggccatcgaacgaggcgtcctcccgttgcttcgccgtgctacactggtccagacttttgggcagaaggatcatgtctgcctgaaggaaggctccataaccatcccgccatatgctcctcctcagaagatgaaaacccacctcgttcccccagggacccctaggtcgatctttgggtatttccgcggtttattctacgacactgccaatgatcccgagggtggttactatgcaaggggcacccccacgccactttgggagaactttaagaacaac

SEQ ID NO: 15361 - DNA, 1856 bp, Zea mays
cctcgaggccggccggcgattgggtccctcgaggccggccgggctcggcctccctcaaatcagtcgtcaccacctcactgtccggctgtccctgtccctgtccctgcgcatcaatcaatcccacggtcttcctgccgcttcctcggctgcccccatcctccgaatcctgcctcgcctcgatctccccgttcctcgtgttccgacggagggtggcgggcgactaatggggacgggggcggggagcgcgcgggctctggccgtggcgttcgccgtctcgcttctcgcctgctctggcgccgtcgctgtcgccagggcgcaggacaccgagcggatcgaaggaagtgctggtgatgtgctcgaagacgatcccgttgggaggctcaaggtgtatgtctacgagttgccgaccaagtacaacaagaagatggtggctaaagactctaggtgtctcagccacatgtttgccgcggagatcttcatgcaccgcttcctactgtctagcgcgatccggactttaaatccagaagaagccgattggttctatactccggtatacaccacgtgtgatctcacaccgtggggtcatcccttgcccttcaagtcaccacggataatgcggagcgcgattcagttcatttccaaccggtggccatactggaacaggacagagggagcagaccacttctttgtcgtgccacatgactttggcgcatgcttccactaccaggaagagaaggccatcgagcggggcgtccttccgttgcttcgccgtgctacactggtccagacttttgggcagaaggatcatgtctgcctgaaggaaggctccatcaccatcccgccatatgctcctcctcagaagatgaaaacccacctcgttcccccagggacccctaggtcgatcttcgtgtatttccgcggtttattctatgacactgcaaatgatcctgagggtggttactatgcaaggggcgcccgtgcatcagtctgggagaacttcaagaacaacccgctcttcgacatctcaacggaccacccacccacgtactacgaggacatgcagcgtgccgtcttctgcctgtgcccgctgggctgggccccgtggagcccccgtctggtggaggcggtggtgttcggctgcatcccggtgatcatcgccgacgacatcgtccttcccttcgcggacgcgatcccgtgggaggagatcggtgtcttcgtggccgaggacgacgtcccgaggctggacaccatcctgacgtccataccgatggaggtgatcctccggaagcagaggctgctcgcgaatccgtccatgaagcaggccatgctgttcccgcagcccgcccaggctggggacgccttccaccagatcctgaacgggctggcgcggaagctgccgcacggtgaggacgtgttcctcaagcccgggcagaaggtgctcaactggaccgagggcccccgcggcgacctgaagccatggtaggtgtactggaaaaaaatgccatggcaccgtcagcgtgtccgctgttcttgtgtacgctacacagcacaaccagatgggaagctgatcgacgacgaggacgatgagtactcccatgtcactgatgtaaatgtaaagcgtcttccagcccaccaggcactgtgcttcttcaggcgacgtgtctggtttgcttgtgttgtgtctgttctgaactttactttagcgttaacctattaacgatcggagatcatgtaatttatggctgttgtattctccctatagtatcaaggacatgtttgattagtttagtctagggactaaaatttagttaggagactgtggtttactccctactctatttagttgtagggactac

SEQ ID NO: 15362 - DNA, 1651 bp, Zea mays
cattgggtacctcgaggccggcctcattagaccagaccagacagggagacagggagagggttggggagggaggagaggagagacacaatcaacgggtggtcgctgggaagaggaagaagaggcccgcgccgcggcccggccggccagacacacatgaggccgtgggtcctggccgtcgccattctcgccgctgcttcggcggcggcgctcctcctcggggccgaggcccagcagcagggccaccagacagagaggatctcaggaagcgccggcgacgtgctggaagacaaccccgtcgggaggctgaaggtgtacgtgtacgacctccccagcaagtacaacaagaagctgctgaagaaggaccccaggtgcctgagccacatgttcgccgcggagatcttcatgcaccggttcctgctgtcgagcgccgtccggaccttcaaccccgaggaggcggactggttctacacgcccgtgtacaccacctgcgacctgaccccgtccggcctcccgctccccttcaagtccccccggatgatgcgcagcgccatcgagctcgtcgccaccaactggccgtactggaacaggtcggagggcgccgaccacttcttcgtcacgccacatgactttggcgcttgcttccattatcaggaagagaaagcgatcggacgcgggatccttcccttgctccagcgtgccacgctggtccagaccttcggacagaagaaccatgtctgcctcaaggacgggtccatcacaatcccgccgttcgcgcctccccagaagatgcaggctcaccttatccctgcggacaccccgcgctccatcttcgtctacttccgcggtctgttctacgacaccagcaacgatcccgagggcggttactacgcgaggggcgcacgcgcgtcggtctgggagaacttcaagaacaacccgctcttcgacatctcgacggaccacccggcgacgtactacgaggacatgcagcgctcggtgttctgcctgtgcccgctgggctgggcgccgtggagcccgaggctggtggaggcggtggtgttcggctgcatccccgtgatcgtcgccgacgacatcgtgctgcccttcgcggacgccatcccgtgggaggacatcggcgtgttcgtcgcggaggaggacgtccccaggctcgacaccatcctcacgtccatccccaccgacgtcgtcctgcggaagcagcgcctcctcgccaacccgtccatgaagcaggccatgctgttcccgcagcccgcccaggcgggagacgcgttccaccagatcctcaacggcctcgcgcgcaagctcccgcacggggacggcgtcttcctcaagcccggggacgagagggtcctcaactggaccgcaggaccgcctggcgacctcaagccttggtagcatcgtacgttcgtgcgccctataagttaccatggctgcatgcatatacactgctgacaacaagccaattaagtgtacatttttttggtatcttctttcttccttccttccttatatatagctgcaataccgtatacgttcatctctctctctatctccttatatatagatgatgagaaccatgtggataccgtagtcgaaatctacaacagtttacttactcgatcgctttgaatgtctg

SEQ ID NO: 15363 - DNA, 1535 bp, Zea mays
gcacgagaccattacctagaacatcctaatcaaaaaggccgctctctctgccacactcgggtgcctccaccaccaccagtagcagcagcagcaggatcaaaaggccaatgggggcgcacgccaccgcggccgcggccgccgtcctgctcgtcgccacctgcgttgcggcggtggcggcggcggcggcggcggcgctgctgcagcacgagcccggcaggatctcaggggacgcggtgggcgtgctggacgacgaccccgtggggaagctgaaggtgttcgtgtacgagatgccgcgcaagtacaacaggatgctgctggacaaggacagccggtgcctgcaccacatgttcgcggcggagatcttcatgcaccagttcctgctgtcgagcgcggtgcggacgctggacccggaggaggccgactggttctacacgcccgcgtacaccacctgcgacctcacgccgcagggcttcccgctgccgttccgggcgccgcggatcatgcgcagcgccatccgctacgtggccaccacgtggcccttctggaaccgcaccgacggcgccgaccacttcttcctcacgccgcacgacttcggcgcctgcttccactaccaggaggagcgcgccatggagcggggcatcctgccgctgctccgccgcgccacgctggtgcagacgttcggccagcgcaaccacgtgtgcctgcaggacggctccatcaccgtcccgccctacgccgacccgcgcaagatgcaggcgcacctcatcagccccggcacgccgcgctccatcttcgtctacttcaggggcctcttctacgacatgggcaacgaccccgagggcggctactacgccaggggcgctcgcgcgtcggtgtgggagaacttcaaggacaacccgctgttcgacatctcgacggagcacccgtcgacgtactacgaggacatgcagcgcgccatcttctgcctgtgcccgctggggtgggcgccctggagcccccggctggtggaggcggtggtgttcgggtgcatccccgtcatcatcgccgacgacatcgtgctgccgttcgcggacgccatcccctgggaggacatcagcgtgttcgtggcggagcgggacgtgccgcgcctcgactccatcctcacctccatcccgctgcccgacatcctgcggaggcagcgcctgctggcgcgggactccgtcaagcaggcgctgctgttccaccagcccgccaggcccggggacgccttccaccaggtgctcaacgggctggcgcggaagctgccgcacggcgagggcgtgttcctgcagcccggggagaaggcgctcgactgggacgccggactccagagcgacctcaagccctggtagtggactggactcgttgtacatctcttcgtgttcctttgtactctttcatttgacatgacatggatggatcacgcattagtttttgtaccacggcccgtttacatgcagcagcaatatactaatatatagtgtatttccaaaaaaaaaaaaaaaaaacggcacgag

SEQ ID NO: 15364 - DNA, 1396 bp, Zea mays
gcattacgcaggcatggctgccctaggctgcaactaccataagaaaaaaaaaaagaacccctcatgagtcatgctgagccatgacagtgtgctccgtcgtattcatgcacgcatgaccccccatgtgcgagggaacaatctcagtcaccatgcttcacatttctttcgaggcaaaagatggtgataataacaacaacaataaaagaagcattgcttgcaagctggaacagcgggggggtgaaaaggacctgaaaatgaccggagaagccgaattttaaggatccgattagaatcaagttctatttatatatatttttgaataaaaattaatttaggactatatctaacaaatggtcaagaaacatttggatcgatcgttaccacccctagtactggcacactggcatacagcacaattttatttttcaaaactcatttgaatgcgtcccgtggagagcatcagctagcatttggccccacgtcagcacgattagttacgctaacgccttattaacagcgtggtttggccaatgctgcaagcaaatccccccccccccccgaagaattcaaggtctggctggcgttttgttagggcagaagacaagtgagaggtccagtccaagtttggtgaaaccaaaccaggatggagggacgaaaaggaaaaggaaagaaacctgacatccgctgcggaggcaaacccctcaccaaacctccgttcacggagcacaacaatataataacacatctacagccgcccggcaatggtgtgcgggaaaagattagatgaaggcaggaggaagaggggagatgcatccatcatgcgtgcgtactcctatttagcaaacactaccatacagcaaaaaaagaagcatcagccgcggggactgcctccctagtcccctaccctcgctttctttctcgctcacccctttcttcccgtcccgaagctgtctgtcctgctcctgcgcgcgttggaaagccaccgctcaccttctcgctcgctcccccaccgaacgcctcttggtgggagaagaattggccgaaaagcttcgcgttggctggccgggatctcctccgtctttaattaccggacccctggggggattccctgcggcctcattagaccagaccagacagggagacagggagagggttggggagggaggagaggagagacacaaacaacggggggtcgctgggaagaggaagaagaggcccgcggggaagcggagggatccagaagaagatgaggcagtgggtcctggccgtcgccattctcgccgctgcttcggcggcggcgctcctcctcggggccgaggcccagcagcagggccaccagacagagaggatctcaggtgagagatggcggacctcttcttctccgatcatccctgcg

SEQ ID NO: 15365 - DNA, 1125 bp, Zea mays
  misc_feature (1033)..(1033): n is a, c, g, or t
  misc_feature (1105)..(1105): n is a, c, g, or t
ggacccgtacacaccgcacccggactcggtcggtccgtcggccgctcccgcttgcctgtctgcgtcacgccatccgccgcgtgcaggccatgccgggtacgacacagagccacacggaaccccttccgcccgctccttttccctttcttgctccctccgccgccctgctggctgccgtcagtgctgcgtctgcgtgcgagcggagcgcatcagcagcagctcccgaattctccgccattggctcgccaccgccgcgcccttgactagctcgcctcgtctcgtctcgtctcgtccctaatctctctctctcccgaggatcaggaccgtgcgtgccatcgggtcctgagtcctgacggcgacagcctaccgcacacgcagcgcagcggcagccgagaaacaaacaggggaggggaggaggagagcagaggacgggcgctcaagcaagcaaagcgagcgagtaaccagcagctcctcagtcagcggcaagagggatcagggcgcttcccctgccagctttggtcagctctcgggcgcctgcggcagcagcccaatgaggccgctcgtcgccgctgtcctgctcgtcaccatctgcgtcgtggcggcggcgccgctacagcggcatcacaagcccggcaggacctcagggaacgcggtgggcgtgctggacgacgaccccgtggggaagctgaaggtgttcgtgtacgagatgccgcgcaagtacaacaagatgctggtggacaaggacagccggtgcctgcagcacatgttcgcggcggagatcttcatgcaccagttcctgctgtcgagcgcggtgcggacgctggacccggaggcggccgactggttctacacgcccgtgtacacgacgtgcgacctgacgccgcaggggttcccgctgccgttccgggcgccgcggatgatgcggagcgccatccggtacgtggcggcgacgtggccgttctggaaccggacggacggtgccgaccacttcttcccggccccgcacgacttcggcgcgtgcttcctaccaacngaagagacgcgcccccgggaaagcgggggcatcctggccgctgctccggcgcgcgacgcttggtgcagacgnttcgggcagcggaaaccacg

SEQ ID NO: 15366 - DNA, 1811 bp, Zea mays
tccctcaaatcagtcgtcaccacctcactgtcgggctgtccctgtccctgcgcatcaatcaatcccacgggcttcctgccgcttcctcggctgcccccatcctccgaatcctgcctcggctgcatctccccgttcctcgtgtgccgacggggggtggcgggcgactaatggggacgggggcggggagcgcgcgggctctggccgtggcgttcgccgtctcgcttctcgcctgctctggcgccgtcgctgtcgccagggcgcaggataccgagcggatcgaaggtattggacctcgcctggcctggaagtgctggtgatgtgctcgaagacgatcccgttgggaggctcaaggtgtatgtctacgagttgccaaccaagtacaacaagaagatggtggctaaagactctaggtgtctcagccacatgtttgccgcggagatcttcatgcaccgcttcctactgtctagcgcgatccggactttaaatccagaagaagccgattggttctatactccggtatacaccacgtgtgatctcacaccatggggtcatcccttgcccttcaagtcaccacggataatgcggagcgcgattcagttcatttccaaccggtggccatactggaacaggacagagggagcagaccacttctttgtcgtgccacatgactttggcgcatgcttccactaccaggaagagaaggccatcgaacgaggcgtccttccgttgcttcgccgtgctacactggtccagacttttgggcagaaggatcatgtctgcctgaaggaaggctccatcaccatcccgccatatgctcctcctcagaagatgaaaactcaccttgttcccccagggacccctaggtcgatctttgtgtatttccgcggtttattctacgacactgcaaatgatcccgagggtggttactatgcaaggggcgcccgtgcatcagtctgggagaacttcaagaacaacccgctcttcgacatctcaacggaccacccacccacgtactacgaggacatgcagcgtgccgtcttctgcctgtgcccgctgggctgggccccgtggagcccccgtctggtggaggcggtggtgttcggctgcatcccggtgattatcgccgacgacatcgtccttcccttcgcggacgcgatcccgtgggaggagatcggtgtcttcgtggccgaggacgacgtcccgaggctggacaccatcctgacgtctataccgatggaggtgatcctccggaagcagaggctgctcgcgaatccgtccatgaagcaggccatgctgttcccgcagcccgcccaggctggggacgccttccaccagatcctgaacgggctggcgcggaagctgccgcacggcgaggacgtgttcctcaagcccgggcagaaggtgctcaactggaccgagggcccccgtggtgacctgaagccatggtaggtgcactggaaaaaaaaatgccatggcaccgtcagcgtgtccgctgttcttgtgtacgctgcacagcacaaccagatggtaggctgatcgacgaggaggacgatgagtactcccatgccaatgaatgatgtaaatgtaaagcgtcttccagcccaccagtcactgtgcttctggcgacgtgtctggtttgcttgtgtgacagtgtctgttctgaactttactttagcgttagcctattaacgatcggagatcatgtaatgtaatgtatggctgttgtatcatagtattaatagggtgtttggttcgagtaatgagctagtgtatcatctttttactcctcatttttttgattatttttttaa

SEQ ID NO: 15367 - DNA, 6278 bp, Zea mays
  misc_feature (5752)..(5752): n is a, c, g, or t
ggccttctcattcgatggcaatgaactaggtgacacaggggtattttcaaacataatgttgaccatagcagtctgtgagagtttgtcatgttctgatttacatccatgaggcataccaacattggcccgggcccctgaattgctatttgtacaattccttgtatctggatcaactaccacatgtctcgagggcaatttaggaagtgttgcaccttcatctgcaaagaatgatgtttcaagagaaaggtgataagcagcaaagactgcaagttgtacagcacgcttaatcctcttgagctcctcccgacatgaccctctcagtagaacctacataaattggtgcagttataatagagttagaaaagtaaaactgtaaattgaatatcaactaaaaaatacacttttagtgctaatactcttcataacagattgagcatctacagtatttgatgttattccaatcaggtgctcataataaagcagagttattattaccgtgcaacccaaacgccaagggcagccttcaaagaacatcagtgtcttgcttgatctcctatttgtctgtttagctgatgggaattctgtaactttttgcaccttgaacgcttcacattgacctagccgtactgaagcaatactgtcagctgatgaagcaatttgtgcccctgtgcaccttgataccctgtccaaaagtgtcctcttaacattcagaactaacgaaatgtctttggagaagagctcctgagcagaagatgagacagttttctcaactagcacaacattaggtcgccgggactcaatctttccaacaatcattttcatgtgctccttctcctgtatcaagagcatttcttcaattatagcatgaattggacaaacaaatatccagcaagagtatgctaggcacagacctgttcaagtatcctgccaatagatgccaatttattaggaaccctgtggttctcttgtgcgccccctaaaatgagcaattttgcattcctatgctcagagaccatgcgcttgtgttttacattcttggagcaaacaactcctcgaacaaaattactgtacaaaagaaattactagtcagttttacatggtagtgacaacagccatgtaaattttagtctgaaaaacacaaacctatctcttggatcccctgatgctatacatttgaccttcacataatcagtaggatccatgctgcctcctttcttggtatctggcctcacatagcttgcagcttgccaagttaaggatgacacaatatcaagccaacctttggacccatcatcctttcccatatcaatgccttctgccttcagtaattgagccacaagagctcggaaatggccgagcaccgcagtcttcagacactcttcctgagcagtgtttgtgacctcgtcaatagcagctattttgttagcactaaagctaccagaaacaagaagcccgcttgagtccccagcctcatcatcctcgtcctggaatccaaataacctcgattcgatatcatcgccctcatcttctggtggtggtgggcaccatatattggcaccaaattcaacaggatactgagttttgcttccgtcaccactgtcagtgacgctaccatttatctgttgcggcgaaccatcagatcctaaacttgcctttgtaccatatccaggagaatccgggctgaaacggccattcttcctggatattggtgagctgtcgttctgcttcaccatccaagtcgggctctccaaggggcttggggtcagggagcggttgatatcattaggggtactaacactaacagattctgtatctgagaagtcatgtaagaagtcattcccatgggtgaaaaactgaaccccgggctcatcatcatcctcatcatctgctcgcctgcatttgtacaaaccaaatcaataaaaactcagctcaatagttaattaaatgtaaaaataaaatgaaaagcccaaacttccattagaattacttgctcccgcaaccacttaattgccagtcacaagttttcattctgtcttcttcaagaccaagttctacctcaaattttaaaaaaggcagagacttttagcgaacttattattaattgctagatcgtagcaggtggcaccacgcaagcataatcaatccgttcacttcagatcgaaaaaaaacagcacctttcccttttcctccacagcaagtcaaaatggaaacttgaaacgtaagtactgtatgtacaacttttccaaagccacggaaacggagtagcacacagtacctgacagcgcggcagcggagcagctccggcgaggatatctgccggcgcagggcgatggcgcgcctgcctccggatctcgtcgccgcgggcgggggcgagttctctggggagggccccccgctgcgcgacctcggcgtggcgggcagccggccgtctgcggcttcagccggcgtggcgccggcgacgaaggatctgaccttctgcagagcgcccagcaccgagaagtccacaactcccatctctccggcgcgatcgcgagaacacggtccaaaaatcacgaaagaaaaaagctagaaaataacaaggcaaaaaatcacgcctttgaggctaaaactcctctccggcgacgagacagcggcggcgaagcgtcgggatcgattctccgcttcaacctccggtacggtgtgtatgtctgtctgtctgtgtatgtacaggctgcggctagttagcggcgggaggcatttgggggttagccaatgccggactggccgaggggcataggtcggcggctcctcgccggtgggccgtcgccgcgcagtacggcggcactacacgtcggatcgcgggttcacagagttgaaggaggtgagcatgggcgacggagacgaaatggcccgtggaaggaagcggcggtgagcgagcgaagagcggcgtctgcgaaagtaatggcgggcggattagaggggaggaggggtggggcggaggttttaattgtcgagaatgcgggatgccggtgatggaggagcagtatctttcggacaaaaacaatgggcacgcaatgggaatgggctatattagtaatttaatttatttaataaatactgtatggatatgaggctgtatgcctagtagtagtatacaaatttatacggggtgagtaaatgcctaaagattttgttttgctgctaattgatgaattataaagttagaagatatatatgcattaatgagtaaaaaggaacccaatgatatgaatgtatccttctttttttattttacgtacttgctagggatgttcgcatccaaaaaccaagactttagttctatatcacatcgaatgtttaaatgctagttagaagtattaaatagttttattataaaactaattacagatgaaagatgaaaactaaacgacgagacaaacatatgaaagtttattagtccatggtttacacatataatgctacaataaacatttagtaatcatagattgattaggcttaataaattgtactaaagtttagcctttatctatataattaattttataattatactatatttaatattaaaatttggtatttaaatatatccaatgtgatatagactaaactttagtcagggaaaccaaacacctttagtctctttgtccacaataggtagatcatcttagcatttatacaaataataaactattgtgtatgacacaggtctctttagagtaaagtcatgcttggatcacaattgaattattattataatctatattttactctcttggtcttgtaatataatgcattctaaaattttagagataacttaagaaaatatccaaatactttatgtacccatgtattaaacccaagtaaaatgtttctccttaaatcatggttttctttttaaaacatatctaaaattaagtatgtgcaacataatggatacctttttcagtaagttttcagaaatcatagtgcactttacattttagaatggagtgaatgcatataaaattattatgatatagattacgaactataatattatattcatgtattgttatggcggattatccttaaccaactatatatagtaataatcacaaagacagatccaaaggtggattctggaattattataaatgatgttttgattataataatccacctggtaatctagtctatttaggtcataattagatattataaatgatgttataatcctaggggatcaaaaagaccataaattacttagatatttctgcagaagaattgtgccaagattttctcgcgagcatggcagtactacatggttgctaaccaaaatctgtggtgtaccatacaagaccaataaatcaaaaagggcagaaggttattattcgtctttttgaaacaaaagcttattattcgtgatcactctagtcaccaatggttgttttgcccaaacaattcgctaaacatttacacatggctgtttcctaaaggcgttggtgtcaagccctcaaaagttggggcggctccgtctagagtaacctcttggatgagagtgatagacacatcttaaaaaggcggtttacactatacgtggtaggagcaaattcaaccaccaattaaatttgcaacaccacagccccccttctctctctccggtagggatctctgatatctgtgagtctgtgacccatttgtccccacaggtcggtgtcagacaaaaaaaaaaaacgagccatcttgagctgtggaagggaatttaggatccactagaatattcagaaaaccgaaagtggatgcactgtgtcatggtcggatagatggacaaccatatcgatctcgcaggcggctgtgcatatcaaattataaagtatggtcgtatgcagttgttaaataaaactggggatattttaacatcatgtatactgcttcttttccttctttttcctgaatgaaactttttgccgaacaaaaatttactcacttcattttaaaatatagttttttctagcccacaacttttctgtccacgtttattcaaatggcaatgaatatagacatacatgtaaactgcattcatatgttacttaatttatgtataattagtctaaacgaattatattttaggatggaaggagtactttttattagtaccttccagaaattaggggaatactgcctctcatggatgcccaaaatagttgcacaaaaatgcacgacctcccgtggtgtcacatatttccacgtggttctccatatcgcatcctcatgttcatccaccgttggcttcctctttccattcgtcatgtattgctcctccctctacttctacactaggttgtcgccgccattcgatctggcaggcgtggcctctccaccatcaaagtggcggcgtaggtccccaagcaataaggcggcgtctccgcctccatagaggagccgtcctcgagcgcggttcggccgccgctaccatcgatgacccgaccagcatggagtttcaatctccgagtgtcgaaggtaagcactcgtacacaagggtattgttagggaataagagtagatcaggatcgatttgaccgtttatagggtttacatgatgtccagtaaactactcctacttactccatcatgaatgaatctctctatgtttattctataggggtttagggttctagcaatttgtagattgtttaagtaaccactccaggtagttatgctttacgcaatcatgttttcgaactacatatatatcagtagctaaaaataaatnatttcacacaatgttcatagtaataactaatactatatgaattatttaatgattcatagaattcacgctaattcatagagtatgaaggaggtgaaaggaacagcttaccataactatgtgcatgtgtcaaccgaagtacatttccagtttgttggatcgtgatggataagatgaattgatgggaacattttgggtgttgtactttcccctattgtcttgagttgtagcatttattctagttcttcatggctattgttaaaaaaattgtcagtactggcaaattgttaaggttgcttccaaactaatgcctgcttctacagaagaaatccgcatagatattttgataccatccattactaaagtctttgttgtcttccttgtttaactactcaaatctaaaattttgtccaagcttgtattgggctaccagtcctgcataaatctatatggttttttcttaaactaggtagtggccttagtttgaatcattttagttgataagaacctaaattattagtgaatgaaa

SEQ ID NO: 15368 - DNA, 1814 bp, Zea mays
gctccacccacccgacccattgctatcctacctgccagcgaacctgtctcgtctccttgttgcccacgtggcctcgccgtcgccgcgagctccaccttcctcagctctgccccgagcgcgatgtggcgagcgacgaggcggtctccgccgttcctgcgatggctatcgtcggacgcagcctcctctaaggcgccgcggcagcgcgtagcggcgctgtgggggaacggtgactacgggcggctggggctgggctcgctggagtcgcggtggagccccacggtttgccccttcttcctcgcccgcgccgccgacccgcccgcctccctcgcctgcggcggcgcacataccctctttctcacccagaatgggcgagtgttcgctacagggctgaacgactttgggcagctggggataggaacctctgttacacatatgctggagcctgttgaaatttctggatttcacgaaagagttgtagaagtttcagctggcaaccatcattcttgtgcagtcaccgcggatggtaagctctttgtttggggcagaaactcaggtggccagcttggccttggtaaaggggcaggtaaagtagtttctaccccaacaaaggttgattgtttgactgacctcagagtaaaaacggttgctctgggatcagagcattcaattgctgttacagaggaaggtgaagtcttgagttggggagctgctggttctggtaggctcggacatggccgtcaatctagcatcctgggattttctctgacctcaactgaatatactccaagattgatcaaaaactttgatggtatcaagattaaaaagatagctgcaggaatgttgcactcagcttgcattgatgaaaaagggatttggaagaccgaacgaagaattcagaccaaatattgttgaagagataccattttcagaagaagttgcttgtggaggttaccatacttgtgttgtaacagatagcggtgatctgtattcttggggttcaaatgaaaatggctgccttggtctgggaggtacggatatggtccgctctccggaaattttgaaaagttctctatttaaacttcctgtatctaaggtatcttgtggttggaagcacacagctgtagtttcaggtgatgacatctacacatggggttggggaggcgccaatgggacttttttcgaagagggccattcttccggtggacagctgggacatggaaacgacgtagactattttgagcctatgatggttccctttggcacgaatgcaagagccgtccatgtatcgtgtggcttcaatcatactggtgcaatttacgagtgctccgaggactttgactgacgtgccacctgcagacagcagatccgcatgtcttggagacttaggttagttatcaaattatactcgctagaagtgcatataaacagcataaataagctctgatgttggacctgcatttatgtgaagagaaatatagaacaagtgataacgcccctgagagggggatgtaaattaaacagaataagggatgaactggatgcattttgtgatgcatcagagttacttgccagtgtatagcatttcttcatttattggctggttctgtattattttgccaggtactaagaaatccattgcctgatgtctcagcaggctgtttgtgtacattatgattgcttgactgcttggtgtcgatgcttgctgtgttttttgtgtgtaaataatacatgaatcagttaatcgtgcttgtacaattaaatatgtacatatatcagtgcatcacttattatatgtaagaaatttaaaaaaaaaa

SEQ ID NO: 15369 - DNA, 5086 bp, Zea mays
caaggtttagaggagtggagaggtttgaataggataatacctaaaatttctttcaattttctaagcatcagattaggaaattagggtttgtttgaaagcatagtatttttagagttttaggtaaaactatgatattggacaatatcatagtattttctggaaagaggtgtttggctatattgtaaaaaaaattgttttgaataccattgtttttatagatacatggtatttttggagtatttaaaagttcaatccaacaccaagtttttggccatgactaggcttgcacatgtgtaagagtacacagttgtgtgatgacaacttaaaatcgtagtatttaaagattgaaatactttgcatccaaacaaaccaaaggacacgaagatttgtcttgaactagagttatttggaactttcgaaaaatttctagcaattgttttaaaaaaacagaccgatgatttattgaattacagcacttccttcgggggagccttctaacctcaggaaactgtataatatatttaatacgattaactgctatagttgttggtgtaaatattaacatctaaaattctaagtcatggttcgacaatatcaaattttacttttcctctgttctaaattatttttttttctagatatatagtttttattacgtagttaaatatacaatatgtatattatatataatatattaaaataaaatatattgtaatttgagtggaagaagtatttatcagttatcggaacacatgtttgctactgccttaattttaaattgtatgctattctaacttttgcggataataaaaatatattaaatttaattaattttataaagataattataaaaatatatgacatcaaatatatagtataaacatataattaatgaaaaatctaatatgtgctacaaaaatataattaatgaaaagtataatatgtcaaaaatataattaatggaaatattaattcttatttatatcataaaatgattattttattatataaatctgttcaaatttaaaacaaaatgttttgactctaaaagttaaaatgaactatactttagattggagggagtaaaagaaggtttgttaaaaaaattccacaggaagggtggtggcctgatgggtgggtgaagaaatgagggagcattctataggagttgaggacatgaaattgaggaagcctttcaggttggcaggacgccaggacccacacattaagctccagggcagcgtgcagcgtgcccagctgctgccaagtgtacgtcttccccgggcagctggataccccgctccgcctctccttgtctcaactctcaagtctcaattccgtcgtcgccactcggcccctacacgaaggcacgcagcacatatcagacacctccgaccgtcgcattcttcacgagtcctccggcccagcgcgcgccttctcaaaccttctagaacgcccaccttccttctttcgtccactcctccaccgctccattccgaacctttttaagctctcccatggagtctgacctcatagcttatatagcaaaacaatagaagtagaacaagcacagaactgttaagctccgcaggctgcagctcgtccccaatgtcgtctgcttctcttgcatcttctctcttgtgcagcagcagtgcttctactagtagaagcgcaaccgtgccaagagtaaccaggacccctcttttttccaagaaccagtacaaaccgcctcttcggcctcttaggagtagttcagtagtaaggcgatcgttgcagcaggagcaagaggagagggtgggcccggcgtcctctgtctctgtggcctccggcgagcgacaggaggaggcgacggcgtcgcatcatgttggaggggtggatgaggccaaggcgtcgggccatgttggagaggcagataaaggaggccaaggagaaggcgacggcgaggagaagaggagcacagacgagcagcaggaggtggactggaagtcagacgaggagttcaagaagttcatgggcaatccctccatcgaggccgccatcaagttggagaagaagcgcgccgacaggaagctccgcgagctggaccgcgagcccgacgccaaccccgtcgccggcctgttccggggcttggtgaaggaccagctggcccgcgagaagcagaggctggagctggcggagcagaccttcaaggcactcgacctcaacaaggtaacttccttcctcaattcgctctgcttggtgctgattatcagaacttgggcgattgatgccgtgctgcgtctgcgtgcagctgaagagctgtttcgggtacgacacgttcttcgccgtggacgtccggaggttcggcgacggcgggatcttcatcgggaacctgcgtaagcccatcgaggaggtgcggcctaagctggagaagaagatctccgaggcggctggaacagaggtcaccctctggttcatggaggagaagaacgacgacatcacaaagcaggtctgcatggttcagcccaaggcagagatcgacgtccagctcgagatcaccaagctgagcacgccgtggggctacctcagcgccgtggcgttggcggtcacgaccttcgggacgatcgcgctcatgagcggattcttcctcaagcccggcgccacgttcgacgactacgtctctgacgtgcttcctctgttcggcggcttcctcacgatactcggcgtctctgaggtacgagcggcggcacagcaatgtccgcacacgcacagctgcacttggatgttttcgcggcattcgacgtgctgcagctgatgatcatgcggtggcagattgcgactaggctgacggcggcgaagtacggtgtgaagctgagcccgtcattcctcgtgccgtccaactggacggggtgcctcggcgtgataaacaactacgagtcgttgctgcccaacaagaaggccctgttcgacataccagtcgcgcgcacggccagcgcgtacgtcacgtcggtggtgcttgccgtctcggcgttcatcgtcgacggcagcttcaacggcggcgagaacgccctgtgagtcctgcatgcaaccatcatcgttcgcttcttctgttcgttcgtggcatcagttttggtcgaggcagagagatctgactgacactggcactgcttgcttgcaaaggttcgtgcggccggagttcttctacaacaacccgctgctgtcgttcgtgcagctggtgatcgggccctacgcagacgagctcgggaacgtgctcccgaacgcggtggagggcgtgggcgtgcccgtggacccgctggcgttcgcggggctgctgggcatcgtggtgacgtcgctgaacctgctcccgatcgggcggctggagggcgggcgcatcgcgcaggcgctgttcgggcgcggcacggcggcgctgctgtcgttcggcacgtccgtcctgctgggcgcgggcgccatcagcggcagcgtgctgtgcctggcgtggggcctcttcgccaccttcatccgcggcggggaggagatcccggcgcaggacgagatcacgccgctcggcaacgagcgcctcgcgtgggggttcgtgctcgccttggtctgcctcctcacgctcttccccaacggcggcgggacctactctgcctccttcctcggcgacccgttctttagaggcggcatctagacggaatcatctccttccgtgcagtgtgcgtgtgtttataaagtttttagtaggctaataaccacactactaaccacttgagacgccacggcactcgacctgcagtccgccgatcccgaaacagatcgttgatgtcgccagaactgcatatcgatcgccctctgcagggcctacaccccctgtacaatcggacaacaataggtcgacgatcctcgccgccccgcctgtccaggttttccctccctcgcccctgttcatgcctgctattcatgatctggcacgcgcgggggagtgcggccaccagcacgcgtgatggcccgtggaagagttatttgctactatgatactcagtttggaatggctaggcattcagtctttttaaaactttggtttggtttatcggttttaaaaaaaactttggttacgataggaaccaatcggttttctagaaaatgaagaactgagaagttcggttccggttttttactttggtttttgtgtaaaaaccgaacaccaaacttatactcaggacaacacatacaataaatttacattatagattacacaatttttaaaagtaaaaattatataggtacaaagattcagagatacatcaatcatcacatacaaataagtgaataacaatttaattgtatgacacatttagttcatataatcaaaccgtcaaatttcagaattgataaagtttcatattcagtttttttatatttcagttcggtatatggtgaaaaccaattacgatagcgaacaccgaacttcttagataaaaaaaaccaaaaccgaaccgaactaccgaaaaaccaaaatttctattcggtacggttttcggtttacggtaaaaagtgcctagtattacgagtgatcaacttctctaaaacaatatttcaccattattttagtcatttccttttattttcttaccttctaccatttaaaataatattttatccttacggctcatactgattctaaccttttaacctaaatctctcggtaccttctacttcattcagcttaaataagataaatattaaaaacgtgtatgttaggtttgttttacaaattacaattaaaaacacgaaatcattttttatcaaaatctaagttgttatgcacgtcgatccaaagagactattaccaagttcatattcttccgtagctaaattttataaaatgaattgttatcaagctcaccacaattgcgtgtgaaaaaatgcagagacaaaattgtaagtgttgcaagggaatatttctcgacgttcatttctaaggcacctgcatagtgcgctagtttaagcactcagggtaaaaatattattttaagcggtagaaaataagaaaagagaatagaaatcggtgaaataagagtgaaatactattctaaagttgcccact

SEQ ID NO: 15370 - DNA, 2854 bp, Zea mays
gcacgagaccattacctagaacatcctaatccaaaaacagccagccggccgctgctgtgcctcgctgctgtgcctgcctgccggctgccgccatccatcctttttcccttcctcccctcaccccctcgtcggaatcggaacggctgtcgtctgccccttcgcccccctcttcgatccctcaccccacccagtgctagctagctagctagcttctagtggctagtagctcccctcccctgtgggctgcaacctggtttgggttcgcgaatcgatcgcgagatcaatcaatccatggcgcggaccaactgggaggccgataagatgctcgacgtctacatctatgactacctggtgaagcgcaacctgcaggccaccgccaaggccttcatcgccgagggcaaggtcgccaccgaccccgtcgccatcgacgcccccggcggcttcctcttcgagtggtggtccatcttctgggacatcttccattcgtccaccgccaaagcctcatccacatccactgccgccgccttcatcgaccacaccgccaagcaacagcagccaatcggcgccgggaccggggcgcctcctcctcatccccttcacgattccagagagcaccagatgaggctccagcagctgctgcaccaacacaacccccacctccacactacaagagatgcttctcctcccgcctctatcaatgccctcaactccgatgtctccgctgtcctcgcgtccaaaatgatgcaagaccgagtcaggaaccccaaccctattgactccgacgcctcacagcatctcctagacgcaaacaggatcgcgcttctaaagtcaccaccacctagccacactgggcctatgcctatgcagcagcagcttcatccaaggaaccagcaacttgacatcaagcccaatgttggtatgccacagagaacgatgcctgcagacccttcttccatgtatgcatcagggatgatgcacccaaaacctgcattacttgccactggactaaatcaaggtggtgttgggagtgtgccacttaaaggttggcctttaacggtcccaggtattgaccaactccggtccaatttaggtgtgcagaagcaattggtgccatcttcaaaccagttccaacttttatcgccacaacaacagttgcttgctcaggcacaaacacagaatgaccttaccagaatgggttctccagcaccatctgcttcgccgaatgttcgaccagatgacccggattatttgatgaagttgaagatggcccagatgcagcagtcctcaggccacaggcctatggaattgcaacagccgcatcagcagaacactagaaagcggaagccaacttcttccggagcagctaatagttctggcacaggaaatactgtcgggccttctcctccgtcaactccatccactcatacccctggtggtggagtaccagtggctagcaatgttaatattttacagaagagttcaatgatttgtggtgtggatgcaactggtggacttgcctcatcctcaaaccagatggatgctttggatagttttgttgattttgatgaaaacgtcgactcttttttgtcgaatgatgatgtagacggaagaggcatgtttgcagcacttgaaaaagggtcttcagagcacaatacagagtccttaaagggtctctctttgagtgaagttggtaacaaccgtacaagtaacaacaaagttgtttgctgtcacttctcttcagatgggaagttactcgctagtgccggccatgagaagaaggtcttcctctggaatatggacaattttaagatggataccaaaatagaagaccatacaaactttatcacagacataagattcagaactaattcaactcagttggctacatcatcttctgacggaactgttcgactttggaatgctgctgatgaaagtggcgctttacaaacttttcatgggcataggtctcatgtaacatcagtagattttcacccaagattgacagaggttctttgctcttgcgacgacaatggagaaattctcttctggacagttggtcagactacatctactcatgttttgcgggtgaagcagggtggaactggaagagtcaggtttgaacctcgaagtgggcagctcctcgctgtggcagctggaagcatggtgaacatttttgatgttgaaaagcaatccagcttaccctgccctccaaagggtcacaatagtgaggtaaactttgtgtcctgggatgaaaatggtgaatatctggcatctgtaagtcaggacactgtgaaagtgtggtcggtatcgtctggtgtgtgcattcatgagttacgatccaatggaaaccaatatcagtcatgcacattccatcctagatacccgaaagtgttgattgttggtggttatcagactctggagctgtggagcttatcagataaccagagaatcccaatccaggcgcacgaagggttgatagctgcactggcgcactccccgttcactggaatgattgcctctgccagtcatgacagatgtgtaaagctctggaagtagctatatatagaggtgatggaatagtcctaatcctaattatatatgccattattaacttatatgtagcgtttgtttcattccttggttaataacttatataatataatatatacataggcggagacgtgagatggatatacttttcaagggtgattggaccctgtgaggtggatggatgtagggtcggttgtacatgatatattgttgagctgatgattgggctgtatctgcgcctatccccttatataaactactagtttaaaaaaaaaaaaaaaaaaaaaaaaaaaaaaaactcgag

SEQ ID NO: 15371 - DNA, 877 bp, Zea mays
  misc_feature (543)..(543): n is a, c, g, or t
  misc_feature (631)..(631): n is a, c, g, or t
  misc_feature (639)..(640): n is a, c, g, or t
  misc_feature (668)..(668): n is a, c, g, or t
cctgaccaacctgagccatcacagagaagcgtccgctgcgcacacccaggtccttttcatctatctgtgagccgtcacaactcgtagtctcgtacagtatacttgcgcgccagccatgtcgtccatggtgtcccgagccgcggccgcggccgcgctgcggtgccacgtccgccgccccggtcccaccttctcccgccccgcctccacgtcggcggccaccgccgagcaccacgcgggccacagtagggccggcggcaggctcccccgcggcgactacgtgccggtgtacgtggcgctgggcctgatcgcgctgtcggtgacgctgggcctgcacacggcgcggcagcagcttgcgtacgcgcccaacgtctgggtggacaagaagaagcgggagacggtgccggaggtggcggcgccggagctggcgctggacgaggccgagcagttcgtggacaggtcgctcttccgcaaggtcgccaacgtgcaggacgaccgcagcctcgccgccggcgtcgcttgaccccgtcgccgagtacccgacgnaagaaggcggtgacgctcaagggacgtggggcgtggagacgccgggcatcgagcagggggcagggaagggcttctccacaagatcttncagaaaanncacgcttagtttagtgcagcggatgcanggtgtggattgatatataacctttaggtcttgtttggaaggcatctataggtctcggatgaaaaatggtttcaggttcagatgctccaataaaagggaaggtttaacgtttgtataattaaaaaaaaaggtcactttctggacaaaaaaaaaaaaaaagctatgtaccctcccccccctcgcgggggggggcccggaccaatcttcccc

SEQ ID NO: 15372 - DNA, 953 bp, Zea mays
tttgccccagtctcccagcgggcaatacccccctaaagggacaaagcggaagtcccccgcggggggggcgcttagaattatggtcccccggggttccaggttcccccgagccattccttagaacatctaattgaaaacctgaccaacctgagccatcacagagaagcgtccgctgcgcacacccaggtccttttcatctatctgtgagccgtcacaactcgtagtctcgtacagtatacttgcgcgccagccatgtcgtccatggtgtcccgagccgcggccgcggccgcgctgcggtgccacgtccgccgccccggtcccaccttctcccgccccgcctccacgtcggcggccaccgccgagcaccacgcgggccacagtagggccggcggcaggctcccccgcggcgactacgtgccggtgtacgtggcgctgggcctgatcgcgctgtcggtgacgctgggcctgcacacggcgcggcagcagcttgcgtacgcgcccaacgtctgggtggacaagaagaagcgggagacggtgccggaggtggcggcgccggagctggcgctggacgaggccgagcagttcgtggacaggtcgctcttccgcaaggtcgccaacgtgcaggacgaccgcagcctcgccgccggcgtcgctgaccccgtcgccgagtacccgacgaagaaggcggtgacgctcaaggacgtgggcgtggagacgccgggcatcgagcagggcagggagggccttctccacaagatcttcaagaagaaccacgcttagtttaagtgcagcggatgcatgtgtggattgtatatatacttagggtctgtttgggaggcatctatatgttctcggatgaaatgtttcaggttcagatgctcccaataaaaggaaacgttaacgtttgtagtatcagaaataaggtcacttctgagacaaaaaaaaaaaaaaaa

SEQ ID NO: 15373 - DNA, 6747 bp, Zea mays
  misc_feature (1639)..(1639): n is a, c, g, or t
  misc_feature (2332)..(2332): n is a, c, g, or t
  misc_feature (3515)..(3515): n is a, c, g, or t
  misc_feature (3572)..(3572): n is a, c, g, or t
tggggacatactaggagtgaccgtcggcgggtctcctgaggcggcggtggacgatgaacagctagacgaggagcagcaggccaaaggcgacaataagagagagcagtgggtggggtagacacaccaggacggagtatggcattcctccaggcttgatggaagatgggaagaggaggtcattttcaatgccatcggattaattatgatttttaattatgaaacgtgtgttgcttccgatttagggccaaacactagaggtgaacctctctctgcttgatcgcggacagctcagagccagatggtctatgaccttgctgcagtagtggctcctttctgcggggcacaagacgttttgcgcacaaggccggacggtccacggtggtgcaaagagtcttcttcgctcgccacaccccaagagtgactccatcagggaggagagttctagggagtgttctagagtcgataaaccatccgagtcatccctagacgacatcgagccgcctagagatgaaggaataggtcaaggaaactaatactagggctaaattacggctactcctagggcaataaagtaaaggaaatgatatgtatattgattggatcgattgtaggcgcgtgcaatcggtcataccccttcatatatgtaggggggaggtctagacccattcctaggcgttatccaacataatccacgtgattagttagataagcacgcatggaaaagggttttctcgcccgagttaatcctatcgtggaccatccgaacttcccagtggactgttcggggcgtggaccgtccgggccacatggacggaccgtccgaccgtctgaggtgctacaaatgttgttcaacatatgtccccttgccttttggagaaactaagagaaccaaaagcacctggtacggactcgatgtgaaagcatcggttttcaaagcattttgtcatacactaggatgatatttcttcaggaaacaactattcaatgccttaggtaactcatcttcttgcaaagtttgtagcatgtatatattaccaaatattgtcatacctagttgccatccctagttgcatgacctgttgccatccctaattgcatgactcttccaatttgacgtatgctcaggggcataaggctggtcacaacacttgtttgatgtatgctcaggggcataagactggttacgacgatcagggtcaccgaccactgccattggtggcccgcgtcgactctaacatcaataacttcagtcggtcatacaataggcatatcgatcaatcggttcgattgacaccgatcgtgtttgagccatcgtcgctcgataccaaccaacgttattgactaatccattggacgctcagattggtaccaactgttcgatacacatgacgactctaattgatcgactgaatcaataccgactcgaactggtcggtatcagtcgcctttagtaacatgacatgttctgattggtccatgtatgcaccgtaccacgtcaactaatcgcttttaaacccattgaagaaaaaaatctaaaatatggcctataaatagaggagtgttggtgttctagaccaccggctagtaatttacgtgctttacatgtccagtgcgaaactgtggatagtatgcaaggaanacacaaggattttatactagttcaaaccgaaaatctccacatccagttgagtaacttgtgataccctacactatgtatgtaacatggatggattacaaactcagtcgagggagagctcgatgcccaagcctctagggtggagtgcgagtgaaatggagtgctaagtgttgttacaagtattgactacttgtgcttgcttcttgcctaatgccttcatttgtggtcctccccttccttttgagaagggaggccctattacacaaatctaggggtcagacaagacagaggggtgtcctgccttgtcgtgttatttgttgtccttgctgaccaaaggacctccctggctaacattgtctcctatcacggcattgtagccacgcatgccatgcatatgtgccttgtcttgtcttgtagcatgcccttgtttatccttcggaccgtggagtggttgagccatggtcatctttcgtacagacgccaattcataccttacctggaatgatcatttagaatttccccatgttagaacctcacttgtcgtcattggtatgatctcatgaattctggtcccgaggggtcaggtgcaaccctaacccctggatcgagcgaggcaaactttatcgagcgtggttttgtacccaaacccctcgaccaaccagaggttgggtgagacagagacctagggtcgacctntcaagcccatggtccttaggggtcaagggtcgatcgaggcagaaacacaatgtggggctattcgcgggggtcgaaaggtagataagtcatgttattcagggtccacgttatatccggattatccaccctcaataaagagtgtttggcgtcattcacaccccctcactctttagttctctcccaccactttctatttcactaatgtcatttcgctataccaaactgtttgcgctatcaatcgtcgtcaatccttatctaccacagatcttcaatgcatagcctttatcgccatcctcacaaccactctaccaccacattatcttttcttttatagactttggtttaaaatgaaatacgacgttttgcttggaaaaaactcatcgagcgcataattaaggaaaaatcataattcaaataaagtaaataaaattcaaaaataaaaacaaaattatagttcctaaaaaataaaactactcattatcatcctctgccacctatgcattatctttcccttctagttttaattgtttgatcatttttatggtcggtctatgggccctttttatatcatcatccatgttagtggtggagtgatacaataatttaataatgtgctcatataattttgattgatttatcttctcgctagccttgtagagcctattcaccatgttcatattcttgacagtggacttgctactactcgttgatggccccttatctttgtgttgtgctcactgctcttgccctatcacgaccaatggggcatgtcaattcgacactatccgatgatgtggggctataatcgccctccatgttgatatgagatcgtttgctcatatcgttggagtcgttgttaccttgacgtgtgcaccacttgggctgatgacgaagagcacgcccaaatgctctagcttgaagtctttcgtcgagcgtattgtgaaagcccgcctttgtcgctccgagtagcatagcatcatcttattcgctcggtcaggccacagacaatcagttggatgtcattgaagaggatgacatttcagttgcttgtgaaccatcgattcttggcctgcttagtagtacgggggcgatgaggttcgatggtagagttgtatgtagctactatttggccccaaaaggatggttcacgtgtgcacctataaatttatgaactcaaaaggtntttttgacttaaaaagtgtggaacttataacagtatatgtgtacttataagtctttngtcatcttagtccagtcctatcgtcgttggaactacgatccatcggagtacaaggactgattggagtctgcattagtgtggatgcttaggggcactaccatgcttggggaagaatgaaaaggagcatgagcaccatatgtgggaggaccaccatacaaggcagataacgtaggaggataaccataagaagttgcatatagaggaggagcattatacgaaccataaggaggaggaccatatggatatctgtatggataaggaggaggatacatataagtaaaaggttgcaaaggagaagcatcgatggaaggggcttcaatggtaggagtgtcaatcattggaggtgaagtatcggtactttgtcgatatggatatgtaggaggatacaaataaagaaagagaggttatggagtactagaatatataggtacgagcaagaacgtcctcacaccaatgatagacatgagaaagaccatcaaataagatttgccccgcacagatatgtctgagaccttgcaaagattgctcattgagcaagtccatgaatgtattaaagttgagactccaccttagatccatattaaaaacagagagtaaaaggctaataaacatagagtaaacagagagtaaggtgtgtaaatgaactcatgcacccctctatttatagggtggattttttttttgagttctttaaaattcaaacgtttaaaattgtaccgacagtgtaaatgaactcaagcacgccctctatttatagggtagatttaattttttttagttctttaaaattcaaacgtttaaaatggtaccagtcaagcaccgatgatcagtaccgaccgtgcctagtcggtaacggtgttggagcattggtaccgaccgtgcctagttggtaaccagcgccacgatggtaccgactgatcgatatacccgtccggcccccctgcagtcgataccgaccgtgctaaccagtcagtaccccaccgactggccaaccgagttgcccactgttgtgcttcatgatcaactttaaattcgtgttaggcccaggtatatcgccacaaggacggaagcaaatcagaccccctcaaggcctagtttggatactcttggattgaagtggtttggagggattagagggtatttaaatcctcaataggtcaaaaactctcacgatacatctcaatccactccattctctcttattcctagagtacccaaacaaagcccaaagagtatcatgaacaacagtaaggacttataacagctggttggctaaaggaaacagcggaggtaaaaaatcaccaaagtgattaagaaaaaataggggcaaacaaggttaaactcaccaagagcatcactacaagaaagcatgtccttaggttgctaacattaggcaaaagaacataccttgatttgcagcagggtacaatcatgtataaactaagaaaaaaaaagcatctagcaaatgaaacaaccctgccacaaaattctgaagaatatatatttttttgtatccactgacaattctgaatcactagtcaccaaacaagtcgtcactgtcatcggctgaattcatgtttaaattcatgccacgcgtcttctcctcaacaggttgatcatctgatttgtatgcccaagatgagcccacttttgctggaacagaatccccataaaggtcatcgtagattccaggtcttgttgcgctctttacttttttaagcacctcttgtagcttatctgttaccccactcggtgaggtagaggtacattcttttcgtgatgcttgctcctttcccttcggtatgacagtaacctgtacaagagattcatacttcccaacaagactgccttcctttacacctatggggcccggttcagtttcaacatctgcaccatctgaaatcccaaccacttggataagttctccaccaacctgatctctaaatgacactctgcgctttttacctctctttaagagcctttcaactgcatgtttaccatcatttgcactagaggcgcctcctgaagaatctttggaactggataatatgtcagatttacttataccatagcggttaagtactgtattgtatgccacaacagcatcttcatcattggggtccggaggagatggcaaactaacatccgatggaaggctaggagttgggaatagagcagctgcgttctttcgcaggatataggttctggttgatgcagcaaagcgaagtgactgaccaacttcaagttcaactgggttgtcttttgttaatctctcattcgcaacaaaggtgccatgaaccgatcctaagtcgataacatagatgcttccattcctgtgtggaataacagcagcatgctgacgcgacacagactgatggtccaacacgaagtcacaagcaggaacctgcctcccgaatagatgcctcctgttgtccaaattgatcctgtcaatgacctccccatctttcactacatcaagatagtagacccctgggcgcggctcaaacgcccagtctggaggttgccacgtcgactgccctccaccgacctgtgtcccaacatgccctggagcatcaccaccttgcccagccacccttgagatggttccttggggactttggtggttctgacctggcacaaaattagaattcagtggcagtgtcaacggagccagtgctttagctgttcctgcagctgcaggtgccttcttggtgcctgactcagacttcactgagaagggctccaaggtctgtgccttcttgaagcggtcaaggcccccacggtacatctccccacacctctgatccaccagctcttcggttcccgtctttaccactccaaatccagctgcatatgcacttgtgtacttcaatactctatcccgtcgggaggggtgggtcgtgctgagataagagctccgcacgcggaagcagatagccctcctgcgcgctcgacctccggtggcctcagcccagagacgcgctcgccttgcacaccgcgccgccggagccgccaacacctcccccgcgcgccgtccgcgccgggccgcgccggggccgcgccgcgctcctcgcacggtgccgcacgagctaggaggattctgatctgtcgcctcctactcagggaagaaggggcatgaccgggaagaagaagactcacgggtgaagtcggaggg

SEQ ID NO: 15374 - DNA, 1249 bp, Zea mays
acccacccgttttatccacgcacggcgtcgaacaccccgcggtcgctcacgtgaggcgccaccccgcgcacccagtcagcgcccgcctccaccacccacccacacgacaaaaatccgccatggccttcgcgctcaaggccgccgccgcggggtcggcgtcgttctccgccgcggggccgaggcggcgcgccgcggcgactggtagggtctcgttccggagcgccgcgcccgtggtcgccgtcagggccgcggcggcggcggccgccgctgtggcggaggacaagcgcagcatctccggcaccttcgccgagctcaggcagcaggggaagactgccttgattcccttcatcactgctggagaccctgacttggccaccacagcaaaagcactcaggatccttgatgcgtgtggttcagacgtgatcgaactgggtgtgccttactccgatccattggctgacggccctgttattcaggcctccgcgacgcgcgctctggcaaagggcaccacatttgaggatgtcatctccatggtaaagggggtgatacctgatctgtcctgccctgtagcgcttttcacatattacaacccgatcctgaagcgtggtgtccccaacttcatgagtattgttaaagaagctggggtacacggtcttgtggtaccagatgttcctttggaagagacagatgtcttgaggagtgaggctgccaaaaacaacctagagctggtgctattgacaacaccgactacaccaaatgaaagaatggagaaaattgcacaggcttcagaaggatttatttatcttgtaagcactgttggagttactggtacacgtgcaaatgtaagcggcaaggtgcaatctcttcttcaggatatcaagaaggtgacagaaaaacccgtggctgttggctttggtgtgtcgactccagagcatgtccggcagattgcaggatggggcgcagatggtgtgattatcggtagcgcagtgatgaagacgttggaggaagctgcttctccagaagaaggattgaagaagctagaagagttcgccaagaacctgaaggccgcattgccgtgaaccaaccattttcgttagcaaagaaattaagatttttttttcctttcaatcttggctttcagggttgttggttgttgtgtagtgaaaataattgtgtccctatgttgaatgctcaaatgaataaatcaagatcccacatattaaaaaagaagagcagaagacagtgttct

SEQ ID NO: 15375 - DNA, 2883 bp, Zea mays
tgtctgcattgtacgtgtcctacagtttcacacgtggagcgcagtgcgacgcgggcgggcggccggcacctgccaccgcgataccgtaccctttctggagatttctcgccgccctttttatcacccacctcgcgccgcactgtgttcatccactgagcactcgcacaagcagggacaaggaagtgcaccggcggcgtcgccatcgatcgagtagatactagatagtgtgtcaggttgctgtcagctagagccatggcgtccatgcagaagagccgcgagcagcgcgcccaggccgcggcgcagaaggcggccgacgagctccacgcgtcgaggcaggacagagtccccgaggaggcgcccgtcagcccccgcggcggcggcggcatcctgggcagcctgcaggaggggaaggcgaacgccaggggcgtggcggacgccgccatgggcaaggccagcgagacgaaggacgcggcggcggacaaggcgggtggcgtcagggacgcggcggcggacaggacgggaaataataaggcgggggccgccgagtcggaggaggacgtgatgctaagggtgaaggcggcggaccagatgacggggcaggcgttcaacgacgtcggtacgatgggggaggagggcaccggcgttccgcggagacgacgttctggctgatggccgctggatcggaactggcctggctggcgctgtgcttctcatgtaaaattagcatgcaacgacaaatgaatgttacataagaaactacaataaataaaagggtgtttggtttgagaattcgggttgatcggatccagatacagggaacgcctagggggtgggggtaatggatgcggtgatatggataggatgataatgaatcgtgatgtaaatatttctccataatttcttaagaccttaagataattttagtttaaaaataagtataagtaattttttaaaattttaattcgaaattctatttctttatattttctattttttcataatttatacttttagtttaaaaatatatataaaaaagttctgatcctattccagtttgatccttaaattctatactctaaaatttagagtcatagtcatccaaaatttagagtcatagtcatccttaaaaacgcaacgaatcttcaaccattcttcatatttctctctctatcgatattttctattatattttactgccacttaaactatcagtattttttattatattttactgtcacttaaaagatacttttctccccatatagtacgtttttaaccggtcattctattgcactttctctttaatatttttattagtttttaaaatttagaaatcatgtgtgttatttatactacaataatacatattgttattaggttacaataattaaaaaaagttaatgtcaaaagaaatgaagtaactaaaaaaattaaaaaatagataagattataacctaccctatatataggggaagttttttctcccctatataaggtgaaccgtggtagggctattaaagcaactgctctcctataatacacgctacgtaggatgggggcgttgtgggggtgcggttggagttgaccttagttaaatcctctcgttcataggttaacctagtactgagccaccaaggtacttacctggcacgaattcaacggtgtggtggataaggctctaacccccacctctctcaagtctatggagttctattaaagcccctctcaaatctcattatgaattttatggttttaatcatctattcgatgttacactattttaaactattatatatgtctattttgagtaatttcttaagcttatattgatatagcggtttaattcgattttttttaaaaaaattctcgctttgtccatttttaaatttcctcgctctgtccctgctcctgcgtatctcgaaccacgaaccagaaaaacatgtacaaatttggccggatcatccaaaacaaaacagaatttggccggaccatccaaaaccggttcagtccatccaaataccaccgaaactggatactcaaactcggttttaaatggaccgcttggcatgatttgttactcgaaccccgacctctcaaaaccgggtacttggctgactcattcaaaagcgacgtggatgctcaaaccagacgttcaaactcgcttttgtggtttggtccatccaaatacgaccgaggtggatgttcaaactcagttttaaatggacccattaagttttagtatccgtttttctagttttaagagttctaagagctaaataacctaccatgtcaaattcaagcaccgcggatacattttagagtagcttgtaagagcatctacaaaagactcattaattttgactctctatttaactctttatttatctttccataaatattaaactctatatatataacatctcatcccaatatataatatctcgttccaacagactctataatatgcaagttagcttggctagcaagacttgctagctaaatttagctagtgagggaattaatttagagagtataatagtctagcaagttaaatggctagtctattgaagagctattatgctattaaataactaaaatttaacttgacaaattatttaggcagtctcttgaagatgctttaaggtagtccgtgcaaagggacttatactatcaactatcattacaaagctcagagcacaaagacgtgagggcaaaaggccaataaaaacgtactctcctcccaaaatattagactttttagctcttgatttttatgtttatattaaaataaatgatgataaatttagacatatatatagaacaaatatattaatcaattaaaaatgtaaaacatattttattttggaatggatggagtattaa

SEQ ID NO: 15376 - DNA, 1370 bp, Zea mays
ctgatgtcacctgctgcctctctccaattctttcttcttctctccatgtaaaattatgtccaaacccaccctactcccgcgagcgcatttataaaataaagggcactgatgcctgctgtcttgttctgcccccctgttttccttttattctgctccgctctgttctcctgcgggcctggctgcgccggggaggcaaatgcttagcacaggacttggccttctggaatcccccgctaaaccataggcgtgttctattggaagttggaacaaaaccatggagagtgaaatcatggcctcctatgaaacaaagcagaattgcgaaattagggtatttgagagttcagacgagatggcaacagatctggcagagtttatttcacaagcttcagaaatttcagttaaggaaagaggatgctttgctattgccctttctggaggtcctcttgttagacatatgcggaagctctgtgaagcaccatacaacaagacccttgattggtctaaatggtacatcttctgggctgaagaacgtgcagttgcaaagaaccatgcagagagtaactacagattaacaaaggaagaatttctctccaaggtgcctatccttaacggccacgtctactccatcaacgacaacgcgacggtggaagaggcagcgagcgactacgagttcgtgatgcggcagctggtgaaggtccggacggtgggagtctcggagagcaacgactgccccagattcgacctggtccttctgaacatcgggcccgacgggcacgtagcctcgctgttccccaaccacccagcgctggagctgaaaggcgactgggtgacctacatcaccgactccccggagcctccgcccgagaggatcaccttcacccttcccgtcataaactcggcgtccagcgtcgccattgttgccaccggagaggacagggcgagagccgtgtccttctccgtctctgcctgccaggaccaggaggaggaaggcccagcagacgacgacgctggaacgacgatgataccgccggctagcatggttcagccaaccgatgggaagttggtatggttcctggacgaggcggctgcttcgtctcttgaggcttcgaatggcgcttgcgagcatcaagaagggtactgagaacagactggatgctacctctgcgaacgccgcctacagtactctctggtttcttcagagtcgaaagtttgcatgcagttggatgtgggcaattaagagtgaagcggtttgtgtgtttttatgtcaagacctcacgcatatcgcgcggagtagctaagctcgaccgtatattggttgcgacgtatgatccttgttttatttaagtgtgttggcggttttatcctgcccg

SEQ ID NO: 15377 - DNA, 717 bp, Zea mays
ggattaaaaataaggttcgtcctcttgcactccctgatgtcacctgctgcctctctccaattctttcttcttctctccatgtaaaattatgtccaaacccaccctactcccgcgagcgcatttataaaataaagggcactgatgcctgctgtcttgttctgcccccctgttttccttttattctgctccgctctgttctcctgcgggcctggctgcgccggggaggcaaatgcttagcacagattcttcattttaagatatttgaaaattgaaatgtcggtaggacttggccttctggaatcccccgctaaaccataggcgtgttctattggaagttggaacaaaaccatggagagtgaaatcatggcctcctatgaaacaaagcagaattgcgaaattagggtatttgagagttcagacgagatggcaacagatctggcagagtttatttcacaagcttcagaaatttcagttaaggaaagaggatgctttgctattgccctttctggaggtcctcttgttagacatatgcggaagctctgtgaagcaccatacaacaagacccttgattggtctaaatggtacatcttctgggctgaagaacgtgcagttgcaaagaaccatgcagagagtaactacaaattaacaaaggaagaatttctctccaaggtgcctatccttaacggccacgtctactccatcaacgacaacgcgacg

SEQ ID NO: 15378 - DNA, 1339 bp, Zea mays
aggtaggacccccagcctagagttccttctttactcccactccccagggtcaggcaggcagggagcagccacagcctgctagggagagacgcagacggcacatgaaaactacaagaaatccgctgcgaaactccggattaaaaataaggacttggccttctggaatcccccgctaaaccataggcgtgttctattggaagttggaacaaaaccatggagagtgaaatcatggcctcctatgaaacaaagcagaattgcgaaattagggtatttgagagttcagacgagatggcaacagatctggcagagtttatttcacaagcttcagaaatttcagttaaggaaagaggatgctttgctattgccctttctggaggtcctcttgttagacatatgcggaagctctgtgaagcaccatacaacaagacccttgattggtctaaatggtacatcttctgggctgaagaacgtgcagttgcaaagaaccatgcagagagtaactacaaattaacaaaggaagaatttctctccaaggtgcctatccttaacggccacgtctactccatcaacgacaacgcgacggtggaagaggcagcgagcgactacgagttcgtgatgcggcagctggtgaaggtccggacggtgggagtctcggagagcaacgactgccccagattcgacctggtccttctgaacatcgggcctgacgggcacgtagcctcgctgttccccaaccacccagcgctggagctgaaaggcgactgggtgacctacatcaccgactccccggagcctccgcccgagaggatcaccttcacccttcccgtcataaactcggcgtccagcgtcgccattgttgccaccggagaggacagggcgagagccgtgtccttctccgtctctgcctgccaggaccaggaggaggaaggcccagcagacgacgacgctggaacgacgatgataccgccggctagcatggttcagccaaccgatgggaagttggtatggttcctggacgaggcggctgcttcgtctcttgaggcttcgaatggcgcttgcgagcatcaagaagggtactgagaacagactggatgctacctctgcgaacgccgcctacagtactctctggtttcttcagagtcgaaagtttgcatgcagttggatgtgggcaattaagagtgaagcggtttgtgtgtttttatgtcaagacctcacgcatatcgcgcggagtagctaagctcgaccgtatattggttgcgacgtatgatccttgttttatttaagtgtgttggcggttttatcctgcaaaaaaaaaaaaaaaactagattccttcttgtg

SEQ ID NO: 15379 - DNA, 1861 bp, Zea mays
ccgtcgcggccagccctcccacggaggaggccgtgcagatgacggagccgctcaccaaggaggacctcgtcgcctacctcgtctccgggtgcaagcccaaggagaattggagaattgggacggagcacgaaaagttcggtttcgaagtcgacactttacgccctttaaaatatgatcagattcgtgacatactgaacggtcttgctgagagatttgattgggacaagataatggaaaaaaacaatgttatcggtctcaagcagggaaagcaaagcatctcactagaacctggaggccaatttgaacttagtggcgctcctctcgaaacattacatcaaacttgtgccgaggtcaattcgcatctttatcaggtcaaggcagtcggagaggaaatgggaataggatttcttgggcttggctttcagccaaaatgggcactgagtgacataccaataatgccaaagggaagatacgaaataatgaggaattacatgcctaaagttggtactcttggccttgatatgatgttccggacatgtactgtgcaggttaatcttgacttcagttcagaacaggatatgataaggaaatttcgcgctggcctcgctttgcagcctattgcaactgcaatatttgccaattctccgttcaaagaaggaaaaccaaatggatttctcagcttaaggagccatatctggacagatactgataataatcgtgcagggatgctcccttttgtctttgacgactcatttgggtttgagcaatatgtggactatgcattagaagtccccatgtattttgtgtaccgaaataaaaagtatattgactgcaccggaatgtcgtttcgggattttatgcaaggaaagcttccacaggctcctggggagttgcccactcttaacgattgggagaaccatctaacaacaatttttcctgaggttaggctaaagaggtaccttgagatgagaggtgctgatggtggcccatggaggagattgtgtgcgttgcctgcattttgggttgggctgctgtacgacgaggaatcgttacaaagcattttagacatgacttttgattggacaaaggaggaaagagagatgctaagacggaaggtaccatcgactggtttgaagacgccgtttcgtgatggatatgtaagagatttagctgaggaagttctaaaactggccaagaatggactggaaagaagagggtacaaggaggttggtttccttagagaggtcgacgaagtagtgagaacaggagtgacgcctgcggagaggctgctgaacctgtacgagaccaagtggcaacgcaacgtcgaccatgttttcgagcatttgttatactgattactgaggatgacgccgccgaacgacgttggactgagcttgtagatgtaccccgtaccctaatacagagtctcgtcttgattcattcaatgcctgagccggaagggctcagtttcaggcacacaggagcagagctttcggttggttgttgacggggggcaaccgctgcacagcccggtgctgtgcctacaaataacttcgcctggaactggaacggatcactcatcactgtgctttgctttgacttgatctgcctgtctctccagggagatggaacaaactactgtttgtaccggcccgttttgttttgcagctatgaaaatcgccgtattgaaaataagtccgtcttctgcacgatggaactgtttgtttttcctttttttttggattgttgggacttgggatgtttgttcggggttaacatggcaaaagtgatctcatcgacgataaataaatgaactgatggtttgatccggaaaaaaaaaaaccaaaaaaaaaaaaaaaaa

SEQ ID NO: 15380 - DNA, 1385 bp, Zea mays
ggtttgcctgtatactggcatgctgcagcacctgcagccctgaccggcgacgatttggcggccgtcgctgcctccttactccaggtgtccagctcttcttcgtgccatttgccggccgtgagcaccaccagacgggatgagcaacccgggggcaccggacaccgtcactgagtcggcggagctggtcctgccgttgttgccgccgcaggacctcgcggccgcggcatcggcctgccgcgccctccgcgcggctgtgactgctgtcaccgcgcgccgcgccggcgacgccgcacgtggtctagagccgctccccatcccgttccgcaactacgtcgattccaagccctatgcctacttcctgtatacccccttctccctcacccggctggctcccggcgcctccgcccccagcgcccagccgtggggtgccgcctggacccggccgccccgccccacctggccccgccccaacctcgacggcttaccatcagccgtgtacgggtgcgcgtgcgcggcggcggaatgcggtggtacccagtgcgcgtgcgccgatgtggaggccgatgcagcgggctcgggcttggaggccgggatggggagcctcacggagtgcggtgatgtctgcgcgtgtgcgccgtcatgtgggaaccggcgaactcagcgcggcgttgctgtgcggctgtgcgtcgtgcgccacctgcacaaggggtgggggctgcacgctgcggaggccctcagctgcgggcagtttgtgtgcgagtacgccggggagtttttgacaactgaagaagcgcggagacgacacaaggtgtatgatgaacttgcctctggtggcaagctctgtcccgcgctgattgtcataagagagcacctcccttctggtaaagcatgcttaagagtcaacattgatgcaactagagtgggaaatgtggctcgctttatcaaccattcatgtgatggaggcaacctgcacccagtgctggtgaggagctctggtttgttgctcccaaggctttgcttctttgctgccagggatatcgtggagggagaagagctcaccttcagttacggtgatgctagggttaggcccaagggtttgccatgcttttgtggaagttcgggttgttctggtgtgcttccttcagaagaaacttaagaagtgatgccatcacctgggatgtcttacaaatgagtttgattatatttctgacttcgcaataacattggcttcataaggaattgcctggcccattcttttagccatactgtaatgtgtgcaacaaacaaaaaaacaagctgtcagtttttggtgaagaactggtcatgtttgtaatgtgatctgttttggctggacatgtgtttcctgcttaaaaaaaaaaaaaaaa

SEQ ID NO: 15381 - DNA, 853 bp, Zea mays
ggggtataatccgctacacggtacctggtttgcctatatactggcatgctgcagcacctgcagccctgaccggcgacgattgggcggccgtcgctgcctccttactccaggtgtccagctcttcttcgtgccatttgccggccgtgagcaccaccaggggagtttttgacaactgaagaagcgcggagacgacacaaggtgtatgatgaacttgtctctggtggcaagctctgtcccgcgctgattgtcataagagagcacctcccttctggtaaagcatgcttaagagtcaacattgatgcaaccagagtgggaaatgtggctcgctttatcaaccattcatgtgatggaggcaacctgcacccaatgctggtgaggagctctggtttgttgctcccaaggctctgcttctttgctgccagggatatcgtggagggagaagagctcaccttcagttacggtgatgctagggttaggcccaagggtttgccatgcttttgtggaagcttgggttgttctggtgtgcttccttcagaagaaacttaagaactgatgccatcacctgggatgtcttacaaatgagtttgattctatttctgacttcgcaataacattggcttcatgaggaattgcctggcccattcttttagccatactgtaatgtgtgcaacaaacaaaaaaacaagctgtcagtttttggtgaagaactggtcatgtttgtaatgtgatttgttttggctggacatgtgtttcctgcttacagttgattggcagattctttgactgtcaatttctagcatatgaggctcaacacgacagccaacctggcatggaaacaaaaaaaaaaaaaaaa

SEQ ID NO: 15382 - DNA, 2910 bp, Zea mays
  misc_feature (125)..(125): n is a, c, g, or t
gtccactgatgtcatcctctgcgggcaaggttagggcaagtacgtacttgtgcatttcaaatctgagagcagctgcattggcaggagccacatgcatggaaatggaacctgtcctccatgttatnttgagttgatcacacgactcacaattagcctgtataggtggctgtgtagatgagtgtcttgttagctcgagttggcaatccactaccagtatcttgagctcttcataacgccgcacaatgcagtcatgtcgtctttttcaccaggaagcttgatcttcaaattttcagcaacgtcactcacatggatagaaaaaaaaaacatcattctcacacttggcctccctaccataccacggccagagttgttttttaattgatggaatgttttcccttgtcgcggttccatgatctacctggtgaagcccaagcagcgcaaataggcccctaaaagcccaagcatcgcaaataggcccgtaaaagcccaagtagtgcaaacaggcccataaaaatctaggttttcttatgttcttagagctctgaggctataaataacctcgtgaccctccatctcctcgttcagggttccgatttccgccccaccatccgccgccgccgacgatgcttcgtcgttgcatccttcgcagcccttgcactacgtactatcgtagccctcttttctttatagcttgtgttgtctattttgatttggtaattcaggccccgtagaatgttttcttttgttttatgcatgcaaaggtcgatttggtgataggagcggtgatgattttgtggactagagtttccgatactaccacggtagtatttgacgaccaaacccttggctgtctgagctcctaaatcacagtcttcgaccacttcgctgtttatatatatacatgcgagatctgcggtctttattttcttctgcaatgcaatggtatgatgagattacgggtaatgaagaacaagtgagttttcgactagagtctctgatgctgctactttgttggcggtagttgaagaccaaacccttggctgtctgaactcaatctgagcatactacttgctggtttcatagtagttataaaaaatatcttttgctgcatgcgtccattaccaattccggaggattatttcgttcctcacggtataatggctcggacgcaacaagctattctcttgatgtgtggttatatcctgattggtggcgttcttatgccaatccgatcttggaaaggccacatatattttttcatttgcaaaaatctgtaaacgtttttttttcttagttacgtgatctaaatgatgtgaaactttgaaagggaaagcacccaatctgatcggttgtggtgtaccatgacacttctttcatattgaataggaagatctgatagatccatgaaacttttttttgttgctgtgctctgtttagagatgttgatgatgataacacaagtaaaatacagttatccctgtctgattccttcaaaagggtgctgattacgttattctgacacatctgtatttattaaaaaaattgtcgtgttccatgcgcattttagtttcgttaattggagtaaaagatgactgctttaaagtttctctgaccttggcctatgatgacatgattgtttcagaagaagcaaattttttgtctaatcttgttgatatttatcatgaactaggacggtctgaggcaaatttctgtctaatttgttttttgtttgtctttcccacgaactctttgattgattggatcttgagagctatgacttataaagcagtgttctttccccatcttttgattctgatttgaccattgttggctgtgttggaggatgatgatatggttttgtcgccccagtcttagatccggacttccggacctttgctgattgacatgttaattgaatctgactccattgtcttaactatgtttttttatctgttagattctttaggtgacaatttacaattgatgcatttgactgttccagatatttgttggtgcattgcagatgatgataaatctgaggcttgtttctctacattcgcagttgccgcctaagagctttcgccttgccaggcttgagagctagtgctgctaaatccttccttggatgtctgatgcgattcaaatccaattcttttgtgctttggttgtagagggttccgtaggtttcggtctaaaatcgtgtgctttgcaagatcagcttcttgtttggacttcgaaactgaaacctggtccaggcaatcggcaaatcatcctgccatcttgcgatactgtatccaagccagcttaaactcacctggatctgacgtcctgattttctgggccctttcggctggcacatgccttctgcttcagccatttatgcttctcttttctgctgttgcttgaactgtgtacctgaatgttttactgcttaccctagctaaaattttcttgaatggctatttgctatggcacacagcaaaagcttatgttgcaaggtcatgttttgaattgtaggcataactcttatttgagaattctgtattttcttggccccacaaatcaagctcctgtattagctttatcagtaagcgattgtttctagatatggatgtaatggagcttctcccaaatagcaaacaagtttcggctgcataactcttatttgagaaggatgatttgtttggcgtgagatactgaagtcgtggctccctacctttatcagtaatcaaaggatgcgccaaatgcttgcagactccagtgagcaggactgcagtatacacgtacattgaggcagtaatattaatgttgatagagagaattaaatacatctctttgtttttgaactagaggtttatgccttgtatactgggagtaagtattctgtcgctgcgaatagtacgtcccaaa

SEQ ID NO: 15383 - DNA, 3907 bp, Zea mays
cgtagagagcgccgtcacacaattttgtttcgagtgtttggcttccagaccgggcgccaacaaaatgtgaaaacgggtggagtattaaattctagagcctagggtttaaaatgaatggagtggtgtatctatccatcaatgtcatatggacacaccagaaacccaatctactatgatggaaatgaacattacccctttgcgtgcgtgacagcgcgtgaaagatattagtgtacattaatttcatcgagcatcatcatccaattgtcaaccacccgcttaggctttggttcggttacaagggatgaaatcccacccatggatttaattcggatctggattgggtgaattcatacctcacaccccaatccatggtggtattaaatccatcatttaattcatgtatctctcaaagctagttattcttttgatccatagattctaatataaacttgtgcaaaattttatggatttgttttatacgtaatgagctatggatagaatccatgcactccgtggttttaaaaaatcccaaacccttgggttataatccataatgagtttaatcgaataaatttttttaagtgagtttagattatttggaggcatggatagtggccaatttgattctaatccatgctaatccaggacctcagcagcgttctcccgtgcccgtttttcttcatcgttaatcatcgtcgttcatcattaatcatcgtcggcccggctttcggctaggcgggctaaacagtgaaaaagaaccggtggcccaggcttattttagagtccatggctcgcttacttgctttgacatgtaccggcccaattcagctcagcccaactcaatccgacaccctcgtctttataactcggccgtggccgcgccgcattctcagcgctcccctggctcgctactcgctagggttcaatccttgcgccgccgccacctactcgagccctcgcgctagccccctacgccacctagccgttcgccgtgcgtcgagtcctcccagccgcctcccgctcgtcgcgacctgcaggcctcggtcatccggcggtgttcttccggcctttcgtactgtcgctcatgaatcccgttctgtcgtgaatttgcatgcagtagcttgaactagaatgcctgcgaattagtctgccttctgtttttattcatcggagccaggttacgatatggtggtagtagctgtgatgagcactgctttcttctgacacctcttgtatgagcagggactttgttccctccgttgagcagattcagcaactctctgagctcctccctcgcattttttctgagctaacctggccatttgctccgtcatttagcattttattacgagtttgtgagatcgtaggtctttactttttctcagatgacgccgactgtgctgtgacgagctactccttatttctgacaccttgtgagccttgagcagattagcaactctctggatcgtcaatttcgtttgctattcttgatatgccctttgttcaattagtgaatttgcattcgtcaatctgactagtgacttacatgaatccttttcgtttggcatcagaggatgaaagcttgaaacaatcttaggacaccttctgacacagcgcgttacatcacgttgtgaatgagaaggcaattcttttctgatgatgctgtgcttcaatatgttacaaatcacatgtttttggattatttgttgtctacttttgtttgtgggttgggagcatgtgcgctatttctttcacccatatttcattttttttatgatgatgtgttgatgtagttatccttcaatttgccgcctgttttagttgtgataacttgatagaaaattgcctagcttcctgatgattaacctgttaaccaatgaaatcagctacatttgcaatttgttttgaactagatttgtaatggcatttaatcctagaattgcattcacctagatttgctgtgtttagattcttctgtgcagttctagggaatgtttgttttagtttcctgaatctgccatgagagtagtttggctatgttgtcccagtgaagatcccaagacctaccgataggaagtgccgtttgacactgcaaacagcagctgcctctctcagctgcaggtgttccatcctttgaccataacctttgtggtttggtcaggctggagctcccatctgcagctgtttgtttcagctgtggtgtgtgattttaatcgggtctctgagggactgtactaaatctgctgttatgtatgatttcattatcttgatgtcaatgctgaagtagtttgggcctgatgccacgtctctggtagccacgagcattgaccggagatgctatgattaggccgatacaaaggtgtttcaatgtttcacatgtcgataggaacctggggacggcttctatctgtccacagagccgttttctgtgattacagtcattgctttactataattattgttagtgctttgccttcagctcattttgttccgtatatttgttatgcatatggcaatgatgttgaagttaaaggcttgtttctcaacattcgcagtagccgcctaagagctttcgccctgccaggcttgagagcttgtgctgtttaatccttccttggatgtctgagccatacctgttcttgtccagctcatgattttgtcagtacgttctgtattatcttgctgttttattagctgttgtgcattgcaagtgatgatgaagtcaaggcttgtttctctacattcgcagttgccgcctaagagctttcgccctgccaggcttgagagctagtgctgccaaatccttccttggatgtctgatgcaatgcaatacctatgtttgatacttgtatttagcttgtgctgtttaatccttccttggatgtctgagacatacctgttcttgtccagctcatgatttttttccagtacattctgtatatcctgctgttttattagctgttgtgcattgcaagtgatgacaaaatcaaggcttgtttctctacattcgcagttgccgcctaagagctttcgccctgccaggcttgagagctagtgctgccccatatccttccttggatgtctgacacaatgcaatacctatgtttgatacttgttatttctgataatgggtgccctatgatgacaaaatcaaggcttgtttctctacattcgcagttgccgcctaagagctttcgccctgccaggcttgagagctaatgctgcagaatccttccttggatgtctgagggccgccgcaaaaagtactgaactgctgtcttttgctatgcttgtaagatcatcatccagaatttcccaactgtttctagcgcacctccagtttattgcctgtgtgaagcaaaaggagcatccaattcgtcttggtcatgggtctgtagtttatagttacggctggttgattgcaatgttgtgcgagcgctaatgtatttttgaacagagattgatttgttttttaatgatcaatgaatcaagtctcgagaatccatcctgatttgtataagtttcatcagtttgaagaaatgtgatgacctgactcaaattctgatttgtaagtttcatagatctgaagatgctaagcatgagcgcggtacaactaaagttgcaaaggctggctgcatatttttttcttggtagaatatccttcgatctgattatgtaaagaaactggaacttttctgtattgatgatcagtccatgtttgggcaaagaagcattgtccctttgtatgtgatggaagtagagacctcaaagtttcatgtacttttttaaaaaaaggtacaggcaacagaacttcggttcatgtactatgctccatgtgactgaaccgctatgttttgcaccccaaccggagtgcctactgctgtatcttcttgtttattctgttgcg

SEQ ID NO: 15384 - DNA, 1891 bp, Zea mays
  misc_feature (130)..(144): n is a, c, g, or t
cgggaaggaaaactagtaagttccgtttcctacttccgtcgcggcggagatcgaatcgagcgcccgccacggcgatggcgactagagtcctgccaccggctctgctctctttatactcctgctgctgctnnnnnnnnnnnnnnnaaccttctctgggtaccccgacgcagggcgactcaagttccgtttccatacttccggcgcggcggagatcgaatcgagcgcccgccacggcgatggcgactagagtcctgccgccggctctgctctctttcatactcctcctgctgctctcgctctcagcccgcgacaccgtcgccgcgggcgaggatttcccacgcgacgggcgggtgatcgacctcgacgacagcaatttcgaggcggcgctgggcgccatcgactttctcttcgtcgacttctacgccccttggtgcggccactgcaagagacttgcgcccgagttagatgaagctgcaccggtgttgtcagggttgagtgagcctattgttgttgccaaagtcaacgctgataaatacagaaaactcggatcaaaatatggagtggatgggttccctaccctcatgctttttatccatggtgttccaattgaatacactggttcgaggaaagctgaccagcttgtccgcaatctgaagaagttcgtttcgccagatgtttctatccttgagtcagattctgcgataaagaactttgttgagaatgctgggataagctttccgatattccttggttttggggtgaatgactcattgattgctgagtatggaaggaaatacaagaaaagagcctggtttgctgttgctaaagatttctctgaggacatcatggtagcctatgaatttgataaggttccagcactagttgctatccatccaaagtataaggaacagagtttgttctatggcccatttgaagaaaatttcttagaagattttgtacggcaatcccttctccctttggttgtcccaatcaatacagagacactaaaaatgctgaatgatgatcagaggaaagttgttctcacaattttggaggatgattcagatgaaaactctacgcaactggtaaagattttgcgatctgctgctaatgcaaaccgtgatttggtgtttggatatgttggaatcaagcaatgggatgggtttgtggagacttttgatgtttccaagagctcacagctgccaaagctacttgtgtgggatagagatgaggagtatgagctagtggatggttcagagagattagaagaaggtgaccaagcatctcaaataagccaattccttgagggatacagagcaggaagaacaacaaagaagaaaatcaccggcccttctttcatgggtttcctgaactctctggtcagcctgaactcgctgtacatccttatatttgtcatcgcccttctgtttgtcatggtgtactttgctgggcaagatgatactcctcagccaagacgaattcacgaagagtgatgaaagcttgttgggcttcttgcacctaaagatggctaatctaccgggagattagcttttgtattaattgtacaaaagcttcaactgacgcaagtcgtgaagagtggttttggcaatttggccattcatgctgagtttcttcaatctctattggcgacatcaatttctgcatcctgcctatttgtgtttctgctttgtgcccttcaatttgttctttaatttagagcttagaaattagcctctgcctgtgtattctggaacctgccattccagagtccatttctgtgaaaatatatttattattatcatactctgctaccgagcttttgtacaattaatacaggatatatagactgttctggtgcaaaaaaaaaaaaaaaaaaaaaaaaaggccccta

SEQ ID NO: 15385 - DNA, 1747 bp, Zea mays
ggaccccccccgccggccggggcccgtgcacactagtcaagttcagtgcccccatacttccgtcgcggcggagatcgagtcgagcgcccgccacggcgatggcggctagagtcctgccgccgccgccgctccctctcgtactcctcttgctgctgctcccgctctcagcccgggacaccgtcgccgcgggcgaggatttcccacgcgacgggcgggtgatcgacctcgacgagagcaacttcgaggcggcgctgggcgtcatcgacttcctcttcgtcgatttctacgcgccatggtgcggccactgcaagcgccttgcgcccgagttagatgaagctgcaccaatgttggcagggttgagtgagcccattgttgttgccaaagttaatgctgataaatacaggaaacttggatcaaaatatggagttgatgggttccctaccctcatgctttttatccacggtgttccaattgaatacactggttcgaggaaggctgatcagcttgtccgcaatctgaagaagtttgttgcgccagatgtttctatccttgagtcagactctgcgataaagaactttgttgagaatgctggtacaagctttcctatgttccttggttttggggtgaatgactcattgattgctgaatatggaaggaaatacaagaaaagagcatggtttgctgttgctaaagatttctctgaggacgtcatggtagcctatgaatttgacaaggttccggcgctagttgcaatccatccaaagtataaggaacaaagcttgttctatggcccatttgaagaaaatttcttggaagattttgtacgacaatcccttctccctttggttgtcccaatcaatacagagacgataaaaatgttgaatgatgatcagaggaaagttgttctcacaattttggaggatgattcagatgaaaattctacacagctggtaaagattttgagatctgctgctagcgcaaaccgtgatttggtgtttggatatgttggaatcaagcaatgggatgagtttgtggagacttttgatgtttccaaaagctcacagctgccaaagctacttgtgtgggatagaaatgaggagtatgagctcgtggatggttcagagagattagaagaaggtactgaccaagcatctcaaataagccaatttcttgagggatacagagcaggaagaacaacaaagaagaaaattagcggcccttctttcatgggtttcctgaattctctggtcagcttgacctcgctgtacatccttatattcgtcattgcccttctgtttgtcatggtgtactttgctgggcaagatgatactccacagccaagacgaattcatgaagagtgatggaagcttggggagcttcttgcacctgaagtgtaaagatggctaatgtaccaggagatgtagctcagaggttatagatttcaaactttcaacggacgcaagtcttgaagagtggatttggctattgatgctgagattcttcaatttctattggccacaccaacttctacatcctgcctatttatgtttctgttttgtgcccttcaatttgttctttaatttagagcttagaaattagcctctgcctgtgtattttagaaattgtccattccagagtccatttctgtgaaaatatatttattatcatactctgctactgaacgtttgtacaattaatacatgatgtatagactgttctggtgctaaaaaaaaaaaaaaaaaaaaaa

SEQ ID NO: 15386 - DNA, 831 bp, Zea mays
agctctgggcagtggccgctttgagtgggccgggccgcaccgcgcgaaacgatgagatgggatgagccgatgaggccgcatcggtggcgacgatccaattccaatcttagccggacccggaggcagcagcgaccagcgagcgacgccggccatgctctccgccgctgcgtccgccatacccaggctccgcttagcgtcgggcccgcggctgaggcggccgtcggctaggacgcactggccgcggccactctcgtcctccagccacgtaacgcccgtggcggctgcgggggctggggagctggagccgccggacctcacccgcttagccaacgccgcgcgcatctcgctctccccgcaggaggccgaggacttcgagcccaagattcgtcaggttgtggattggtttgggcaacttcaggcagtagaccttgagtccattgagccttcacttagagctggtacaacggctgatatttctttgagagaagataagcctgaaacattcgataacagagatgccataaaggaggccattccaagttatgatgatccatatatcaaagtgccaagagtgctgaacaaagaatgatctgtagcatgtatatcagaattgttagaatattaatactctacaatgcagcatggttaaacataatgataaaatttgcagaaagattgaacgagtcaccagcaagcttaattgattttgtgcatttcaatttgataatgctgtgattgaacagagcaatcagcaaccttgcattgggacaggataacaggaaagatttgggagatctgcttcaaaagaaaaaaaaaaaaaaaaaaaaaaaa

SEQ ID NO: 15387 - DNA, 864 bp, Zea mays
cattgggtacctcgaggccggcctgagctcggaccgcgcacgggagctggagacgcttgtgagagacaccgtcgaggaggccaccaagcccaacctctcggacctcttccccgtgctcgccaggctcgacctgcagggccgtcgccgccgcagcgctgagttcatcgggaggttctacgacttcttcgatccgatcatcgcccgccgtgtcaaagctcggggcagtggtgaacatgttggtgatgatttcttagacgtgctgcttcagcttcactcgatggatcaactcagcctgcaaactgtcaagtcttttcttttggatctcttcgccgcaggaacggacacgaacacgatcgcggtggagtggacgatggccgagctgctccggcacccggccgtgatgtccaaggtccgcgcggagctgcgggacgcgctgggctccaagccgtgcccggacgagtcggacgtcggcaggctgccctatctccgcgccgtggtgatggagagcatgcgactccacccgccgagcccgatgctggtgccgcacctggccatggccgacggcgcggaggtgggcggcttcacggtgcccgccggcaccaaggtgatcataaacctatgggcgatcatgcgcgacccggcgtcgtgggcggagcccgaggcgttcgtgcctgagcggttcgtgggcgcgagcgacgcggacttccgtgggacggaccggcttgagttcatgccgttcggggccgggcggagggcgtgccccggcgcgccatgggccacgcgggtggtgacgctgctcctgggcctcatgctgcacgcgttcgagtggaggctgccccgaggggtggagcccggcgacgtgga

SEQ ID NO: 15388 - DNA, 2212 bp, Zea mays
  misc_feature (28)..(28): n is a, c, g, or t
cccgggcctccgccatctgcccctcagnaaaatggaagctccaaccctgctatggttgctcttcgtctcactcgcctcctgcctcctctacaagctcttctcttcatccaatacgagctccgagaaggcgcggcggcgcgcacctggcccagcacctctgccgctcgtcggcaacatcctggagctccgaggtgagccgcaccacgccctcgccaggcttgcagagacgcacgggccggtcatgtccctgaggttgggcactaccgacgccatcgtggtctcctccgccgcggcggcgcgcgacgtgctgcagaggtacgacaacgtgctggcggcgcggtcggtgaccgacgccgggcgcgcgctggggaaccacgagcgctccgtcatctggctcccagccaccagccagctgtggaagcggctccgcgccgtgtgcaccaaccacctcttctcagcgcgcgggctggaagcgacgcgcgccacgcgggaggaggcggtgaggcagctggtgtcatgcctgggccgccgcaccggcgagaccctggaagtgggccgcgtcgtgttctcgtgcgtgctcaacctcgtctccggcgcgctcttctccgaggacgtggccggcctgagctcggaccgcgcacgggagctggagacgcttgtgagagacaccgtcgaggaggccaccaagcccaacctctcggacctcttccccgtgctcgccaggctcgacctgcagggccgtcgccgccgcagcgctgagttcatcgggaggttctacgacttcttcgatccgatcatcgcccgccgtgtcaaagctcggggcagtggtgaacatgttggtgatgatttcttagacgtgctgcttcagcttcactcgatggatcaactcagcctgcaaactgtcaagtcttttcttttggtacgtttctatccacctgtccattggacccagccgcgcatgccagcattgtctatttcgaaccgtccaaaatatatggtcggcaaattttggtactcacattttcgcaatctttgtggaattgtcattttttttatgtgtccgccgcccatgcaggatctcttcgccgcaggaacggacacgaacacgatcgcggtggagtggacgatggccgagctgctccggcacccggccgtgatgtccaaggtccgcgcggagctgcgggacgcgctgggctccaagccgtgcccggacgagtcggacgtcggcaggctgccctatctccgcgccgtggtgatggagagcatgcgactccacccgccgagcccaatgctggtgccgcacctggccatggccgacggcgcggaggtgggcggcttcacggtgcccgccggcaccaaggtgatcataaacctatgggcgatcatgcgcgacccggcgtcgtgggcggagcccgaggcgttcgtgcctgagcggttcgtgggcgcgagcgacgcggacttccgtgggacggaccggcttgagttcatgccgttcggggccgggcggagggcgtgccccggcgcgcccatggccacgcgggtggtgacgctgctcctggcctccatgctgcacgcgttcgagtggaggctgcccgaggggatgaagcccggcgacgtggacgtcagggactggttcggcacgtcgctcaacatggtcacgccgctcaaggccgtacccgtgccttcgtcccggtgatgcactgcggcggcttgctgtgcatgtccaggatatggttctacttagcccagtctcggcgaagacttctatagcgctgcgttataactatccgacaggtttcatcacgatgaaattgtcgctttataatttccctgttaaatcattaaatttggtaatgtatcagtgttaaatgtaaataaaactaagacaaaatttcaccgaaactggccttactatggcggcccctgtttaaatgttctaaaacttatgatataattgagaataagttcctaacatatatagattcctatacaagtatataacctaaccatatggggccataagaacctacccatcttgacacatcacactaactactattcgaagacgagcattttcaaccattttttaaaccactctctaagaccaaattagcagggcttcagctctggctgctgcggagctaaaactgttttggaaaacattgggcaaaatggctccggtggcaattttatcataatttgtggtgatttg

SEQ ID NO: 15389 - DNA, 1937 bp, Zea mays
cattgggtacctcgaggccggccgggattgcaccaacaccaggcaacggcacgccgcgttatgcgttacacgtcgcagctagcactagcactgtacactacagaaacctccattgccagccagctgcgcagtgcgcttgcctctgctgcgtataaagtttcttccttccttggccgcttctgcgctcgcctcccttctcctcccccatcctctcccttgtggttctagatccactcctccccgtgctcactgctcatccgcgaacaggttgagcggggacgccgtggaggggcgagggggagccagattgagccatggcctcctcctgggttcttgccctggttcttgcgctgtcggcaggcgcaagcctggcgcgtggctccgagccgtggtggaacgagacgcaggtgtacgccaccaccgccaactccggtggcggcaacggcgtcttcgtcggcctcacgctcatccagtcggcggcggccaagggagcggtgtgcttggatggaagcttaccaggttaccacctccacagagggtttggatcaggagcaaacagttggctcgtcaatctcgagggtggaggctggtgcaatgatcgcagcagctgtgtgttccgcaagggcagtcgtcgtggatcatcaaatcacatggagaggcaactccagtttacagggatattgagtaacaaacctgaagagaatcccgatttctacaactggaatagagtgaaggtccggtactgtgatggtggatctttcactggtgatggctctgatgcggctgcaggcctttatttccgaggtcagcgcatttggcaggccgctatggatgacctaatggcccaaggaatgcgttatgctaatcaggcccttctttctggatgctctgccggtggtgtttctaccatacttcactgtgatgaattccgtggactgttcccatcaaataccagagtcaaatgcttagctgatgctggaatgtttcttgacactgttgatgtttctggccgccgggaaatgagatcctttttcaatggtattgtgagattgcagggttctggaagaagcttgcctaggtcttgcacctcacacatggacaaaacctcgtgctttttcccccagaatgtgttgccaaccatccgaaccccaacttttgttttgaacactgcctatgacgtgtggcagcttcaacaaagtgtggcccctagaacagctgatccccaaggtctttggtcaaagtgtaggacgaaccatgccttctgtaatagcaaccagctccagtttttgcaagggttcaggaaccagatgcttgatgccgtgaggggtttctctgcatcaaggcaaaatggtctgttcatcaactcatgttttgctcattgccagagcgagagacaggatacttggtacgcgaacaactcgccacgtcttggtaacaagaaaatcgctgacgctgtcggggactggttcttcgagagggggaatgccaagtacacagactgcccatacccttgcgatggcacttgccatcaccttgtgttcaggggagaccactaagatcattcttcagcaccaacaaattcatcagatggtacaaggatcaaaccccaatgggtacagaatggaaaacaaggtatagatacagataaggtgcaagtggtcggcttgcccatgtttgttcatcagtgagtcatatgattgatagtgcgaggacctcacccgcgaacgcgcggaggaggcctctgcattagattcacataccgtcatgatatcgattattttcattggaaaagcgtccatgattacgtaccagaacaattgagttacatactcatttcgtgtactgtattaataacactagaacgttacatattcatttgtcctgaagatcgtactacttggcataaaaaaaaaaaaaaaagggggggccccggcccc

SEQ ID NO: 15390 - DNA, 1929 bp, Zea mays
tccccgtaggccgtagagcacgaatcgaaccgccggcaaagccaggacccgcagttcagctgagttgaggccactcagtcagtcagagacagctccacacgtgcgactcaccccgccacgtgggcgcggcccttctcacttcggaccgcgtctattaatcccctgctgcgcgcggcgcgcctcctccgcaaattaaggcttcagctcgcgcgagacctcagctttcactcgagtgagtgcgagtccatcgccggagagagagagcgagagagcacgcaatcgagttaaacaagctctgtctcttggttctctgtccacggcgggagagtgtgagagatgggcaggcagccgtgctgcgagaagatcggtatcaagaaggggccgtggaccgcggaggaggaccagaagctggtcaccttcctcctgtctcacggccattgctgctggcggctcgtccccaagctcgcgggtgcggtgcatatgcgtgcacaaatgcatgcagatggcggcatcccggcatggctttcctcacattagtttcttggtccccgcagggctgctgaggtgcgggaagagctgccggctgcggtggaccaactacctgaggccggacctcaagcgcggcctcctctcggaggaggaagaggcgctggtcatcgacctccacgcgcagctcggcaaccggtggtccaagatcgcggcgcggctgccggggaggacggacaacgagatcaagaaccactggaacacccacatcaagaagaagctcaagaagatgggcatcgaccccgtcacccacgggccgctcgcgccggccactcaacctctggcgctggcgctggcgcagcagcgcgatcctccgcaggtggtgcgagaagaggaacgttgcgacgacgaccccagcaagcaggcatcgtcgcaagggctggcggcgggcgccgacgaggacgacgacgtggaggagacgccggcgagcgccgcccagccgcacggcgcgacgaccacctcccctgcttccgcagcggctggatccgtctcgccgtcctgctcctcctcggcctccggcgcggacgcggacgcggccgcctggcccggccccatcgacctcttcctcgaagtggacggcatcatggacatggactgggcgggcatcctttcgggctgcggcgatgacgacgccgcggacataagcgtcgtcgatcttttcgaccattacgcgggcgatggctttgatgaacaagtctggatgtgatgcatgctcttcctgcaggtagcagcagtacactgggcggtaggatggttagaactgtgttgtgttgttactggtgatcgtatctctgctcttgcgtttgcgtgtccagttgcctctcttgttttctttggtttcttgggtcaattcaagttcgcccgcgtccatgcatgcatggttgctggtatgggggagaggcacggcctggtttgtgtggtacgttcttcgtgaagattgaggaatgaattgtgattgcgtcaagctgttgatctcagtctcgtggctagggatcgatcattctcggatcaagagcaactgtcaaatccttcaccacccgtgtactgcaggcagttcaggaatgtgaaatttctgatgtaatcgtgctaccttccacggtactgtcctcaagtacaagagtgagcccatgcgaggacaatggccaaacgcagaaattaatatcgcaaacccccaactaaatcagattccttgagatcgatgatgcctgctgcaaagactagactgtaaatctgaatgaccattggagcctcaaaataacccttacatcaaaccctttacctttttttcctgagagagataattccttattcgatattagtaaagtttctaatttatctcttgactctcaaaatataaaatatgattttacctctattaaataa

SEQ ID NO: 15391 - DNA, 1275 bp, Zea mays
ggccggccgggccgggatatcgcaagagctaacatgtattcgcaaattaaggcttcagctcgcgcgagacctcagctttcactcgagtgagtgcgagtccatcgccggagagagagagagcgagagcacgcaatcgagttaaacaagccctgtctcttggttctctgtccacggcgggagagtgggagagatgggcaggcagccgtgctgcgagaagatcggtatcaagaaggggccgtggaccgcggaggaggaccagaagctggtcaccttcctcctgtctcacggccattgctgctggcggctcgtccccaagctcgcggggctgctgaggtgcgggaagagctgccggctgcggtggaccaactacctgaggccggacctcaagcgcggcctcctctcggaggaggaagaggcgctggtcatcgacctccacgcgcagctcggcaaccggtggtccaagatcgcggcgcggctgccggggaggacggacaacgagataaagaaccactggaacacccacatcaagaagaagctcaagaagatgggcatcgaccccgtcacccacgggccgctcgcgccggccactcaacctctggcgctggcgcagcagcgcgatcctccgcaggtggtgcgagaagaggaacgttgcgacgacgaccccagcaagcaggcatcgtcgcaagggctggcggcgggcgccgacgaggacgacgacgtggaggagacgccggcgagcgccgcccagccgcacggcgcgacgaccacctcccctgcttccgcagcggctggatccgtctcgccgtcctgctcctcctcggcctccggcgcggacgcggacgcggccgcctggcccggccccatcgacctcttcctcgaagtggacggcatcatggacatggactgggcgggcatcctttcgggctgcggcgatgacgacgccgcggacataagcgtcgatcttttcgaccattacgcaggcgatggctttgatgaacaagtctggatgtgatgcttgctcttcctgcaggtagcagcagtacactgggcggtaggatggttagaactgtgttgtgttgttactggtgatcgtatctctgctcttgcgtttgcgtgtccagttgcctctcttgttttcttgggtcaattcaagttcgcccgcgtccatgcatgcatggttgctggtatgggggagaggcacggcctggtttgtgtggtacgttcttcgtgaagattgaggaaatgaattgtgattgcgaaaaaaaaaaaaaaaaa

SEQ ID NO: 15392 - DNA, 1167 bp, Zea mays
ttacctggaacagagacaggcaggcagcaggccttcatcgcagagaggacagcagcacctgagattgacggcggggcagcgcgcgggcccttcccttcggagcactcagcgtgagagatggggaggcagccgtgctgcgacaaggttggcgtgaagaagggcccgtggacggcggaggaggaccagaagctcgtcggcttcctcctcacccacggtcactgctgctggcgcgtcgtccccaagctcgcagggttgctgaggtgcgggaagagctgcaggctgcggtggaccaactacctgaggccggacctcaagaggggcctgctctccgacgacgaggagaggctcgtcatcgacctgcacgcgcagctcgggaacaggtggtccaagatcgcggcgcagctaccgggcaggacggacaacgagatcaagaaccactggaacacacacatccgcaagaagctcgtccggatggggatcgaccccgtcacccacctgccgttgcaggaaccgccggctcctgctcctgctcccgccgagcagcaggagcagagccacaggcagcaagaagaactgcaactgcaagagctgcagaacggccgcgagcttatcatgcaggagggcgcgggggaagacgatatcacgccgatgatccagccgcacgagatcatgccgacggcggcagcggcaagcaactgcggctctgtttcctctgcccacgccggctccgcgtccgtggtctcgccgtcctgctcctcctcggcggtgtccggcgtggagtggccggagcccatgtacctgctcggcatggatggcatcatggacgccgactggggcagcctcttccccgacactggcgctggcggcggcggcggcggcttcgacttgggcgtcgatccgttcgaccagtacccgggcggtggcttcgaccaagaagacgaccacagaatatgacatcggcctagcaatgcacatagattcgccgcttctccttccatctcgctcagcacatcagcgccgtagcctccatgttttcttaatagctctccagggtccagtgctgataaacaagaactgacaaattcgggtgcggaaaaaaaaaaaaaaaaaaaaaaaaaaaaaaaaaaaaaaaaaaaaaaaaaaaaaaaaaaaaaaaaaaaaaggggg

SEQ ID NO: 15393 - DNA, 1784 bp, Zea mays
ctagtttgtttagaaccaacttagtttttttaaaccagtttcttaaaaactgggtgttttcaaacaggccatacggaatataaacagggatacaaactagtatatttggaaccaccttagtagattcacctctagtttttataaaccaccttagaacttgttcgttttgctctcaatttatatagattgagtggaattgagcgggttttaatcacaaacaaatcaaaaaaatttattattttttacaatcttattcaatacacatgggcaaggtcttagtcatttagaagagaatggattctttccctagacaagtccagctaaagagcgaaatatttcaacctgcgcgagtcgtacggtcgtgcccttcccctgcacaggctgtcgtccacaatgcccgcgccgctgatactacccacagtcgcgcgcgagctggcagagctcctcgtcgccctctccgccgcccgcgcgctcccaaaaggacagcagctccacggccatctcctcaaggctggacacgtccccgccaccgcctcctcccacgcgctgctcgcgcaccacctccttacgttctacgcgcgctgcgcgctccctgacctctccctccgtgccttccttgacctccccgcgccgccccttcccgctgcatggtcttccctcatctcctccttcgctcagaacggcctcgccgccgctgccttcgacacgttccgccgcatgctcgccgcgggcgtccctgccaccgaccgctccatccctttggctgcaaaggccgttgccgctgccgagaccttgtcgcgccctccgttctcccctcacgcgctccacggccttgctgccaagactccgttcgctggcgacgtgtttgttggctcggcgattgtcgacatgtatgccaagtgcggccaccttgcagacgcccgccggctattcgatgatatgccagaacggaatgttgtttcttggtctgcactcatatgtgggtatgctgacgcggggatgcatcctgcagcgatgggaatcttccgcttggcacttgaggaggctgtgcctgtgaatgactacaccgtttcttccatcatccgtgtatgtgctgcagcgacgctctttgagcttggagcccaggtgcatgccagggctacaaagacagcgcttgacgcgtcaccttttgtgagcagctcacttgtctcggtttactcgaagtgtgggcttgtagagtgtgcttaccgtgtgttcaatgaagcacctgagaagaaccttggcatttggaatgcagtgctcattgcatctgctcagcatgggcatactgctgcagcatttgagcgatttattaaaaaaaaaaaaaaaggattccagcccaatcacataaccttcctgtgcttgctcactgcttgtagctatgctggccttgttgatgaggggaagcgatatttttctatcatgaaagattatggcattgaaccacaggctgaacattatgcttcgatggttgacctacttggtcgtgtaggacttataaaggaagcccttgatcttattgagtccatgcctatggaaccacctgagtctgtttggggtgcactgctcatgtcatgccgcatatttaaagatgctgacactgcagcaattgctgcaaagaggctgtttgagactgggtctcgcagctctggagcacatatgcttttatcaagcacatatgcagctgcaggaaagcatattgatgcagctcttgctaggaaagcaatgcgtgatgcaggtgtacggaaagaaacgggacttagctg

SEQ ID NO: 15394 - DNA, 1375 bp, Zea mays
cgaccttctgacagatacatcctatctctacatatacgggttgcaggtacatgaactggttgcaagacagctggctgttgttgctgctctacatgagtggagagatcgtatagctcgtcaggaagatgagagtactggttatatactgccaaataaggctttaattgagatagcaaagcagatgcctacagatgttggacatttgaaaagaattgtgaaatcaaaatatccatatgttgagagcaatcttgagctaattgcttacactgtctggaatgcacttgagtattcttatgccttcgaaggaatagctgagcaactaaagaaggaacggctggaacaggtggcactgaaaagtggtcagaccagtgatgaagtgactcctttggatgctgacattgataggagtaattttgattcatctgatcagtctgcaaatgtcaatgttgcttctggtagtagggctggttttatgagtgaagcagctttgatcagcagcatccacctagaggacaaaactcaaaccatgtcctcagttaagacctctcagaccttgctaggccagatcagaccagtgaataaggatgtcctgagcaataatatacatcagcaggctattcaggacctaagtctcactttaaaagctctaaaaggaaacttggcatctggaggagagtcaaatgagcaggtataggcaaactattcttgaacaatgaaaacatcgaagcagtcattctgaatacatgtgattttctatgtatcaatctgccttttttttctgttggaatgttgttgaagagtacacatttggtttgtctacagttaattttatgcaacttggtattgttctgaacgtttgtctttactacatgttttgagaggaagtctttactatagattagctgggatattctttcagcatgcgttcactagagggttttcaattttggttacccttctcgatatgtttggcttcaatctacaggacacacccaggtttgatctgcgacgcttagaagctgtagcacctgacatcttattaccccaactagacggatctcgagacatagggggggggggggggggaatggtgagaggatgacgacggtccggttctctcgtctgccttctccctcccatccgagcccactccctttcccccccggccctgctcgttccggatgtacgtgcctctgggcgtggtgtttggcctgcgttggtgccccctcctacaaagtgctgggctgcttctcagtcccatggtgcaaggggtgggtggagcctaggtgtggatgttgcccatggtcctagagatgagggtcaccactctagagattgtgccaaagctctatggtgtgtgatctgcaggcatgca

SEQ ID NO: 15395 - DNA, 1631 bp, Zea mays
cgcggcgaggccgcggggcgcccgcgcccaaacgccaaaaccctagctccccacccacccaccccaagcaccgcggggccgccgcgcgctcgcccacggtcgccacggatgcgcgcggcccgctcgcggacctcgacgacaccccgctcgcttgccgcggctgttccgccatggacgagcccgagaaagtgaggggcagggaggatgcggcgtcgggccgcgaggctggcggcgccgaggaggccggggatgggttccagctcgtgatccatggcaagaagaagaagagggcggccagcggccaggaccgcgggactgctggctctggctctggcgctggcgccgggccagtgcgggcgttgaccagggagaagggagccgcgccggcgccgggggccaaggccaaggtgcctttccacgatccaagcattccccggccgcaggacgtatacaaaatcagagtggataactacaagccattcgagcatgtctggctggagcgcagcgaagacggcacccgacgtgttcacccgctggaaaacctgcctgttgaacagttcgttgacagaaatgttcctgacagagaaccagtgaagccagctgatttagaggatacaccatttacgctggttcaagatcacaaaggcttaacagaattagctaagaagttgaagagcgtaactgaatttgctgtagatctggagcataatcaatataggtcatttcagggcttgacctgcttgatgcagatttcaacaagaacagaagactttattgtggacactcttaagctacgcatatacattggtctctatttgcaagagcctttcaaagatccaacaaagagaaaggtaatgcatggtgcggatcgtgatataatgtggctccagcgggacttccacatctatgtgtgcaatctttttgacacaggacaggcttcaagggtcttacagatggagagaaacagccttgagcacctattgcttcatttttgtggagtaacagcaaagaaggagtatcaaaatgcagactggaggtcgagaccacttcctgatgaaatgatcaagtatgctagagaagatacacactatctgttgtacatatatgatttaatgagacagagactacagagggagtcaacatttgaaaatgatcttcttctagaggtccataagcgcagtaatgaaatttgcttacagttctatgagaaggagcttctgacagatacatcctatctccacatatacgggttgcaggaacatgaactggatgcaagacagctggctgttgttgctgctctacatgagtggagagatcgtatagctcgtcaggaagatgagagtactggttatatactgccaaataaggctttaattgagatagcaaagcagatgcctacagatgttggacatttgaaaagaattgtgaaatcaaaatatccatatgttgagagcaatcttgagctaattgcttacactgtctggaatgcacttgagtattcttatgccttcgaaggaatagctgagcaactaaagaaggaacggctggaacaggtggcactgaaaagtggtcagcatattatggatattatttccgtaatgcttcctttggtcgcaaaaaaaaaaaaaaaa

SEQ ID NO: 15396 - DNA, 1661 bp, Zea mays
cttaatgttatgagagaatgcgggggcggtgtttattgtatccttgtcagacaattctaagcttatgagctttggctcaaaccaccaatatcttgaatgtataaaatctgcatatgattttgcaagtggtgaatcgttgactctgatgaaagataagtatgatctcatcgggaaactccgatccctgaagcgctatctactccttgaccaaggtgactttttggtccattttatggatattgctcgagaggagcttacaaagaaaccagaagaaatatccgctgaaaaacttcagtctctgcttgacattgctttacggagtactgcagctgcttcagatccaagccatgaggaattaatctgctgtgtggaaaggagttccctccttaagaaactggccactctgaaggacttggatcctgcagataagcttgctgcagcagatgttgatcgatcaatgcaattaagcatcacgggtttggaaacattctgccttagcaataaggtccagtggccgttatctcttgtaatttcaaggaaggctttgacaaaataccaattgatctttcgcctattgttccactgcaagcatgttagtcgccagctgtgtgcagcatggcaaatacaacaagcattccggtctgtcaagattctagggacaccaattctgcggtcatcaattctttgtcgtagcatgctcaagtttgtaaatagccttttgcattatctaacatttgaggttcttgaaccaaattggcatctgatgcatgaccgccttcaaacagcaaggagcatagatgaggttatccagatccatgatttcttcctccagaagtgtctaaaagaatgcttgctgttgtcgcctgaactccttgtgaaagtcgagaagctgaaaggtttatgccttcagtatgccacttccatccagctcttgatgccatctatcgatgtcgctaactctgagaacacatcgaagtctaggaagtcaagatcaagaatcgataaatcacaggacagagaccagcagctgaaactagcatcagagaatgttgtcatgtcagagtcgatcctgaaatttgaagcagcgttcaattcagagctgcagagtcttgctcctacgctgagtaacagttcacaagcggagccgtacgtgactcatctcgcacagtgcattcttggcgtgcgaatcggccaatgagttatttgatgggccgtacccatacctgcctgccttcatttggacttttggcacaatgccatactctatgtgcgccgctgcagtcaaggtaggtgcatatccgtttcttgtgaatgctaatgtggagctacgacgcgtttagtgaccctagggtggtgtcgggagccttgttatcttgagctcgaaccttgctgtgtgtttatcagctgcgactcagcatttcgtgctgttgatatctgacaatagcaatgtgtggttgtgttgtgttgtgttgtgagactcagatgtaagctttgtggagttcatttccacgtgtgtgggaaaagtgtttggtttgaatcgaactgggcattggtattccacgagagttggttagcggccagtaatgtaatagtaaatatcatgctattaagctaatttaagttgatgaaatccaaataaagcaagaaataaaaaaaaaaaa

SEQ ID NO: 15397 - DNA, 1043 bp, Zea mays
ggaccctcgaggccggccgggccgggatttattatattatcttcctgatctgatcatgtgcccataaatagcaagggccttggattgtttggccagggatagcacgccgaggaaggtcgacatgtcgtctccgccgccgccggtgaagctgatcggcttcttcggcagcccgtacgcgttccgcgcggaggcggcgctgtgcctgaaaggcgtgccgtacgagctgatcctggaggacctgttcggcagcaagagcgagctcctgctccaccacaaccccgtgcacaagaaggtgcccgtgctcctccacggcgacggcagggccatctccgagtccctcgtcatcgccgagtacgtcgacgaggccttcgacgggccgccgctgctccccgccgacccctacgcgcgcgccgccgcccgcttctgggccgacttcatcgagaccaggctcaccaagcccttcttcatggcgatctgggtggaggagcgcgacgcgcgcctgcggttcgaggaggaggccaaggagctcgtggcgctgctggaggcgcagctcgagggaaagaggttcttcgccggcgacaggccggggtacctcgacgtggccgcgtccgcgctcgggccctggcgcagcgtcatcgaggagctcaacggtgtggcgctgctcagcgaggacgagcaccccaacctgtgccggtggaccagggactactgcgccttcgaggctctcaagccgtgcatgccggatcgggagaagctcctcgcctacttcactaagaacttcgacaggtacaaggcggccgtcaatgcgacgctatcgcagtcgcagcagtaataactggccaactgggtacgcctctgcccggccgtatggcgggcgtttcttttttttttcttcagaataacgtagctgtgcccagtactcatggtttcaattctgcaaagtgcaaaccaacaagtcgttgtgtggtttactctttttacatatacagatatactcctacgagactaaaacttcttattaaactaaaaaaaaaaaaaaaaaa

SEQ ID NO: 15398 - DNA, 1001 bp, Zea mays
tgggaccctcgaggccggccgggataaatagcaagggccgcggggcgttcggccagggatagcataacaccgccgaggaagcagcaagcagcaaggtcgacatgtcgtctccgccgccggtgaagctgatcggcttcttcggcagcccgtacgcgttccgcgcggaggcggcgctgtgcctgaaaggcgtgccgtacgagctgatcctggaggacctgttcggcagcaagagcgagctcctgctccaccacaaccccgtgcacaagaaggtgcccgtgctcctccacggcgacggccgggccatctccgagtccctcgtcatcgccgagtacgtcgacgaggccttcgacgggccgccgctgctccccgccgacccctacgcgcgcgccgcggcccgcttctgggccgacttcatcgagaccaggctcaccaagcccttcttcatggcgatctgggtggaggagcgcgacgcgcgcctgcggttcgaggaggaggccaaggagctcgtggcgctgctggaggcgcagctcgagggaaagaggttcttcgccggcgacaggccggggtacctcgacgtggccgcgtccgcgctcgggccctggcgcagcgtcatcgaggagctcaacggtgtggcgctgctcagcgaggacgaccaccccaacctgtgccggtggaccagggactactgcgccttcgaggctctcaagccgtgcatgccggatcgggagaagctcctcgcctacttcactaagaacttcgacaggtacaaggcggccgtcaatgcgacgctatcgcagtcgcagcagtaataactggccaactgggtacgcctctgcccggccgtatggcgggcgtttctttttttctttcttcagaataacgtagctgtgcccagtactcatgttttcaattctgcaaagtgcaaaccaacaagtcgctgtgtggtttactctttttaaaaaaaaaaaaaaaaaactcctcgtgcaaaaaaaaaaaaaaaa

SEQ ID NO: 15399 - DNA, 2003 bp, Zea mays
ctgccagttccgcgcagccccctccaatccatcgataaaacacacaataaatcaataataactaatcaaaaagtttgcgtggattgccatcgccccttcctccacctctgcgctccaccacctaataattgattccactgccaatacctgcgatgagtgccgccatgccgccggcgatggaccccgcggcggcgggggagatggcgcgggaggccgccgcgtggtgctcgctgcacggcctcgtcgtcggggaccgcgccgaccagagatcagcaacggtccctggtgttggtttggtccatgctccattctccttgctcccagcacattttccagagtccttttggaggcaggcgtgcgagctcgctcccgtttttaacgagcttgtggaccgtgttagcatggacgggaatttcttgcagaatgctttgtccaaaacaaggcaggttgatgatttcacatctaggctcttggaaattcacaggaaaatgatggaaataaataaggaagagaatattcgcttggggttgcaccgatcagattatatgctggattcagaaacaagttctcttcttcaaatagagctcaacaccatttcagcatcatttcctgggcttggttccttagttagtgatcttcacaggtccttaattaaacaatatgggacttctttaagtctagaacacaagagggttcctgcaaatgcggctagcactcaattttctgaagcattggcccaagcatggtctgagtttaatattgacagtgctgtaattatgatgattgttcagccagaagagagaaatatgtatgatcaatactggctttccaaacatttgcaagactcacatggcataacaactataaggaaaaccttatcgcaggtggaagcggaaggccaggttctcccagatggaactcttcttgtaggtggccagaaagttgctgtagtgtattttagagctggctatgcaccaaatgattacccttcagaagcagaatggagtgcaagacttatgatggaacaatcatctgctgtgaagtgcccttcaatatcatatcatttagtgggaaccaaaaagatacaacaagaactagcaaagcctaatgtgcttgaaaggttccttaaaagtgaggaaattgacaaggttcgcaaatgttttgctggcttatggagtttggatgacgaatatattataaaaactgcagtggaaaaacctgagttgtttgtattgaagcctcaacgtgaaggcggagggaacaacatctacggtcttgatttgagggaaacgcttgtcagactacagaaggaaggaggggatgcgcttgcagcctacatactgatgcaaagaatcttcccaaaagcttctcctgcttatctcgttcgtggtggtgtttgccacgagggtcttgcaatttctgagcttggaatatatggagcttatctgcgtaacaaagataaagtggtgatcaatgagcaatgtggttacttgatgcgaacgaaggtttcttcatcagacgaaggtggcgtagctgcagggtttgctgttttggatagcttatacctgactggcaagtgagataacaaaaggagcggcggctacagctttcggttgggggcatacaccgtcaatggatcatcatgtcctccatttagatcgacacagaataagctgctgcaaactagagccattatgtgacaccatgtcacgttgtttgatgaattccttctatctgcccctgccaagggagagaagagaatagacatattattgtgtgtagattaaatgtgcatgaaatccatggaaatggtgaaggatgaaccacgtgcccataaccgtgatgtaggctggcggtgccgtttcttgttcttgatcaccttgacagcaacggggaattctgtgtttcttttgaggacacgtgatgtgcaccatcagtatgaatgtaaccaaagaataagggcctatttagtttatgacttactatgtcatattttgtctaaa

SEQ ID NO: 15400 - DNA, 1696 bp, Zea mays
ctggatcagaaggcaacctcagcggccgcaagcccgcaactttatccatccgtttggcccacgcgctccgcagtctcctctctcctcgggtggctagggttttgactcctagtcctaaaccagctcccacgccgccatgatgcagccgccgccgccacatcagcagcagcaatgggcaatggcgcccccgcccccgccgcagtactaccaggcggggcaccctccgccgccgcccccgcagttctaccaggcgggccctccgcctcccgctatgtggggccaaccgccaccgcaggcggcggcggcgccggcgccggccggcggcggggcgggggacgaggcgaggaccctctggatcggggacctgcagtactggatggatgagaactacctctatagctgcttctcccaggctggcgaggttatttccgtgaagataattcggaacaagcagactgggcaacctgagggttatggttttattgaattcagcaaccatgctgtagccgaacaagttctgcagaactataatggtcaaatgatgcccaatgttaatcaacctttcaaattgaattgggctaccagtggggctggtgagaaacgtggagacgatggttcagattatactatatttgttggggacttggcctcggatgttacagatttcattctacaagatacgttcaagagtcgttatccatcagttaagggtgcaaaagttgtctttgacagaactactggccgttcgaaaggctatggttttgtaaagtttgcagattcggatgaacagacacgggcaatgactgaaatgaatggacaatactgttctagcagggccatgcgccttggaccagcatccaacaagaagaatactggtggaccacaaccatcgagtgctatttaccagaacacccaaggaactgattctgatagcgatccgaacaatactactgtatttgttggtggccttgacccgagtgtgactgatgagcttctgaagcaaaccttcagtccatatggagagcttctctatgtcaaaatacctgtaggaaagcgctgcggatttgtccaatattctaacagggcatcagctgaggaggccataagggtgctaaatggaagccagctgggaggtcagagcataaggctctcatggggccgtagccctgcaaacaagcagcctcagcaagagcagagccaatggagtggtggtggctattatgggtatccccaaggatacgatccatatggctatgctcggccccctcaagatcctgccatgtacgcctacgcagcatatccagggtatggaaattaccagcaacagccaccacagcagcccccgccacaacagtaatgatgtcccgagagtgatcatttgcaagctggtcgcaaagtagctggggggttggggcgcagcaactttggtgcgttggcatgagaaattttgcggcggttgcttgtgttgtgttgtattgttccgacgcccttgtacacgtagcctgtgttgtaactgaatttttgccgaggccttatgagtgactagtgtttcaactgtaactggattgcacatttttgtcgcaaggaatgtactattattgtgtggctcgtgccgctttgaacgctgagtcccggtattaatttttcttcatgctcttacaaaaaaaaaaaaaaaactcgagagtcttctagagcg

SEQ ID NO: 15401 - DNA, 2303 bp, Zea mays
  misc_feature (64)..(65): n is a, c, g, or t
aaaaaattttttcctttgaagcacggggacgttaactttggtcctttaaaaggcgcgccccccnntttttttttttttttttttttttttttttttttttttttttttttttttttttttttttttttttttttttttttttttttttttttttctttttttttttttttttttttttttcctgaatttcactgccattataaatagatattacatttgcttttcattgtcactgacagtgacacgcgtacatatgacacagattacaagttctcaattaatcaagatacatattggctgccacctaacacagcatacactcgtttgacgatcactattgatttacgatatgaggggcctcagtctctcccatacagaactatatcaatctagcagagatcgaattatttttgtttcttggtaacacccggtcgatccatagaacaggtacaaccaaacagagtggtataaatttctttcataaagaatatgagccattaactttcgatagtaagaaggcgaagaagaagcatgtgcatgctgcaaatagactgaagaaagaaggcttcacttgcacacatacttgagaataccagggatgtggattctggtgaagtaatcgtcccagtcgatggtcttagggtcgaaattgaacatttgatcctcaggggtcttcatcgccattgccagccttagccgctccaggtttatgtcatcgaagcatcctttgaagaaggcgaatgggccgtagacgtcaaccagatgcatcacaaacttgtacttgcggttgaggtcgttgtagagccgcgagagaaggccacagagcagcagattcacaaggtgcagaatctctaatggcaccttgtagatgagagtcatgtagaggtggaacctggcgatgctggtgaagaagtacatctccctggtggggatgaccctgccgtccttgccgacgcgcgggttctcgtagaaatggcggcgtccggactggtagagcacgtcgtaggtggccgggttgcgcagcgacgaggtggcgtggtacaccaccacctgcggcagcggcggcgcgaacgcctccgagtgcgccaccacggccgccatcatggcgttgaccaccatgtccccggggatgacgtccatgacgaggcggaggtcggcgaggaagcaggacaggttctgcttggcgtagccgatgatgatgctgtcgatggtgcgggtgccctgcatccacccgggcagcgggtcgcgccggacgctggtgatgatgctgggccgcatcaccgccacggggacgtcgccgccccggagctgctggcccagcacggcctcccccatggccttggtgaacacgtacgtgttggaccacccgaagtgccgcgcccgccggaggcccagctccttcatggccttccgctccgtgctgtcgccgtcgccatcgccgttcgccgccagcgacttcttcacctccttgacgaggcgcagctccgcgtccacgtccaggtacgtgccctcccgcagcgactcgccgggcttgatgggcttctccaggatgaggccctccctgaagcccgagacgaaggcagtggagacgtgcatgagcatcctgagcctcgcgcactgcttggcgaacatgcacaggtgcttcactcccagcacgttcacgtccagcgaaacatcgtatctttcgtagaagttggtggttgctgcgatgttgacgatgacgtcgacgtccttggccagcgcgtccagcacggctgcctccagccccaggccgtcgtatacgatgtctccggccaaagcgacgaccttggcctctacgaactgctggaagcccttgccgtgtttctctctcagcaggccgaacagctccgtgtctatcacctcttgttggacgcgctgcttcgctgatggctcgtcgaccgcgcgtacaagcaggtaaatcttgcgcacgtcaggctgcacccgcagtatcttctccacaaggatctttccaagaaaccctgttgagccggtgacgaggatgcacttgcccttgaagtactctacgatcctcgccgcgtccatcatcatcgccgccgatatcgtcttggcctagctaggatcggtctcaagctatagagcgaacgaaccggccggcggggcagccgcctcgcgctcgacgatcctgcaggctagtgtgttgggcgcgcgcgtgtgagaattgtatggcgtccccccggcgcccgggggccctaccgtaaatagaagatggcgagatgcatggagggcagacaaccaccaccaaacaagataacaaataaaat

SEQ ID NO: 15402 - DNA, 4613 bp, Zea mays
  misc_feature (2795)..(2795): n is a, c, g, or t
  misc_feature (3851)..(3851): n is a, c, g, or t
tgacttaatatttactgaatgacttaatgtttattggaatgactcaacgttgtttgaatgcttgaatcactttgcttggactccaaaatgacttaatgttgtctgaacactagaatgacttaatatttcttagaatgactaaaccaataacaaggaatgtctgagatacatgaagaataacttaatgtactctgaaatgtatgaaacagaagggaaataacttaataggtgcgcgtctatggagcagacgcgtggcgcagagggagccgcgcgtgggggagtagccgacgcatggcgcagagggagccgtgtggggaatgagccgcgcttggctgggtaacgagccacgcgggggaaacgagcacgggaggttggttcgggtgatcgactgttgggtccatcaacttaggtaataaatagagtgtgtgtatatatatatacatctccatccatatcagaaaaccctactttctgattaactagttctctttcctgaatttcactgccattataaatagatattacatttgcttttcattgtcactgacagtgacacgcgtacatatgacacagattacaagttctcaattaatcaagatacatattggctgccacctaacacagcatacactcgtttgacgatcactattgatttacgatatgaggggcctcagtctctcccatacagaactatatcaatctagcagagatcgaattatttttgtttcttggtaacacccggtcgatccatagaacaggtacaaccaaacagagtggtataaatttctttcataaagaatatgagccattaactttcgatagtaagaaggcgaagaagaagcatgtgcatgctgcaaatagactgaagaaagaaggcttcacttgcacacatacttgagaataccagggatgtggattctggtgaagtaatcgtcccagtcgatggtcttagggtcgaaattgaacatttgatcctcaggggtcttcatcgccattgccagccttagccgctccaggtttatgtcatctcgagttgatcgccataacacaagcagattaaattaaagaaatgtgtcactcctaagagaatatgcacaggtcacaggactacaggaggcgagtacgtagtagtaattaatttaccatcctttgaagaaggcgaatgggccgtagacgtcaaccagatgcatcacaaacttgtacttgcggttgaggtcgttgtagagccgcgagagaaggccacagagcagcagattcacaaggtgcagaatctgcatgcattaccatcagtatcagtttgattaatactcctattagcaccaccacacgtccagaccacaagaatcatcatgcatgcatacctctaatggcaccttgtagatgagagtcatgtagaggtggaacctggcgatgctggtgaagaagtacatctccctggtggggatgaccctgccgtccttgccgacgcgcgggttctcgtagaaatggcggcgtccggactggtagagcacgtcgtaggtggccgggttgcgcagcgacgaggtggcgtggtacaccaccacctgcggcagcggcggcgcgaacgcctccgagtgcgccaccacggccgccatcatggcgttgaccaccatgtccccggggatgacgtccatgacgaggcggaggtcggcgaggaagcaggacaggttctgcttggcgtagccgatgatgatgctgtcgatggtgcgggtgccctgcatccacccgggcagcgggtcgcgccggacgctggtgatgatgctgggccgcatcaccgccacggggacgtcgccgccccggagctgctggcccagcacggcctcccccatggccttggtgaacacgtacgtgttggaccacccgaagtgccgcgcccgccggaggcccagctccttcatggccttccgctccgtgctgtcgccgtcgccatcgccgttcgccgccagcgacttcttcacctccttgacgaggcgcagctccgcgtccacgtccaggtacgtgccctcccgcagcgactcgccgggcttgatgggcttctccaggatgaggccctccctgaagcccgagacgaaggcagtggagacgtgcatgagcttcctgacccgcgcgcccggccgggcctgcaggcgcccgtgcttcactcccagcacgttcacgtccagcgaaacatcgtatctgcaagtaatagccatagccatgcatgcatcgtcgaagtcgttcaaaacatacaacattcttttcgacgtcctgcttaattaagattacctttcgtagaagttggtggttgctgcgatgttgacgatgacgtcgacgtccttggccagcgcgtccagcacggctgcctccagccccaggccgtcgtatacgatgtctccggccaaagcgacgaccttggcctctacgaactgctggaagcccttgccgtgtttctctctcagcaggccgaacagctccgtgtctatcacctgtagtgtatagatcagagtgtgtgtgatccgatccataaaatggttacgtaatttgaggcaaaaaaataaataatttctcttctagctactatacagtaattaatagtgccttttttggaatatatgtgtatgttttcttctttttttaaacatatatataccccgtattaattgaagaagaattgctggaggttgttgttgcatgatgcataacgtgggtgcagttggaccatggccattatgtttagaggcaggaaccaggaagcatgcatgcgtatagcaagtcagattttgaatgaaattatcatncaatttacacgcaccaaccaaccagctgccagctagccgcatatatatggctcattcaattaatattcttgattggtagaccacggccggcccgtttaggacttgttccgttagggtagattaaggcttgttcggtaaaggttggattgatgagaaataattcactcctaaccgaataagttctaagaggattagtgggattaagggcatatgccacagtttatctaaggttagtcgtttgaattgaagaactaacgttagacaaaaaagttagctaagcatggtaagttagacagcgaactaaacagactttaaatcccctcccatacaaatttgtatagaaaagggaattaaattctcctagatccacctaaaaccgaacaaagcctccgtcggttcgaacatatatacccctgtcccttttcagctagctagcgatcggacagccgcatatgaccccacgcggacacgcagtgagagagacgtgcagatccagccatgcatgcatgcatatattggagcagtcaaagcagtgagatgagaatgagatgagagtaggtgtggcggcgccatgaatgagatgaataaggtacggttgcaattactgccgccttgggccggtcgatcgatcgatcgatcggtctcggtcctcccccgcgcgcggcacgggccggccgatacataaaaacacacaaaagacttgaccgtgcctgtgccttcttgcctagctggctagctctatcatccatctggaccatgcatgcatatgcacgtactgtcagtgagctgatgatgacacaacgacccaactaaatagccgacttcagtagggaccctaattaactagctatatacaccttcttaattgttaccactactacgtactacgattagtattcatatgtggttgtctccggccgtacgtacgtacctcttgttggacgcgctgcttcgctgatggctcgtcgaccgcgcgtacaagcaggtaaatcttgcgcacgtcaggctgcacccgcagtatcttctccacaaggactgcatcatcatatccatatncatatatatcattccaacgacgacaaactaaatcgtcagtacttctacctagcttttctaatagtaccattcaacacaagcccaaaaaaaggctatatgagcacacacttaatttgcaaagaacgaaggtgcacacacacacacttgtattagctagctagctagctagcaggtttatatatatagaaactgcatgcatttgtacttactctttccaagaaaccctgttgagccggtgacgaggatgcacttgcccttgaagtactctacgatcctcgccgcgtccatcatcatcgccgccgatatcgtcttggcctagctaggatcggtctcaagctatagagcgaacgaaccggccggcggggcagccgcctcgcgctcgacgatcctgcaggctagtgtgttgggcgcgcgcgtgtgagaattgtatggcgtgtaacagagagaaggcggggctattataaatagaagatggcgagatgcatggagggcagacaaccaccaccaaacaagataacaaataaaatagaattggtctcgtcagcacaaatatctatacgcgtacgcggaggaggaggcagccagagcaggaagctaggaaatgtacggcacgatgcggtgttggtgtgcggtcgctgcaaactttaaaacgttccaggaccgtgtctctataaagatgtattcggatcccatacgtacgaaaacgaatttgatgtcactatttatcatattttgatttagaacatagcattttttctcgat

SEQ ID NO: 15403 - DNA, 1039 bp, Zea mays
cattgggtacctcgaggccggccgggttcccttgcaacagcagtgctgaatcctttgcagactacttaaaacgcgacggggcattgtaagtggcagagtggccttgctgccacgatccactgagatccggccccgccccgcccgggaaaccctagccattttcttttcttatccccagccgccacaaagacagccggccgcctgggaacttttttttcttttcttcttcctggccgaccgcacctcccacttctctctattttttttccttgcaccatggcttggcaaacggatctaggctggcttcctctctttctgttcttctcctgctctgttctttgcttctttcttccccaccgaacagctcaaaccggtgagctagccgctgcctgagcgcgcagccggctcacatatccgaggatgaccggattaatgttcaggggcatgcgggttttaccgccggtgtgcgcgtcccctcggtagggcgcgccgccgtcggtcaaacgccgacagctgtccctgttgacagcagagaaaaggggtcgacctcttggtcgacttctgtgactgtgcacgcccagatcttatctcccttacctctttgactcgatctcgttctctgtgatgtatgagatggatctaatgtaatattcgggatcgagttatgagttgatagaacgtagattttctgtgaggatttttttgtaccttttctaatctgctctgtcatctaggccgtggatgtaaaagatcccgagccactgtgatctctgttgacccagatttaaaactgatcagggttaggttattaaaccctaaccctaaaacatcgatctgtttttactatctcgaatcttctgggtttggccgagaccaaatctctgttagtggccaaaaccctagatttagggttaggtaaaccctaacccgagagataaaaaatattctttctattttaatctatctgttctcgggtgataaacgagaaaaatagttcaatcatgttgatccgagacttttctgtgatctcataaaactg

SEQ ID NO: 15404 - DNA, 2043 bp, Zea mays
tacgtcaatgcacacttcagttatttgccccctcccagtccctcgcatggccgttttttcagcgtcgaaggcggtctcggatgaatccgctttccgtgtggccggtagagtcttcgtcttcgtctcgtctcgtctcgtcccaaacacgcgaacgcgacacgccgacacccgtatcgtaccacctaacttttgctccgagatctcctcctcccgtctcatcagtcttttccaatcaatcaccagctcaaacttgtacccaaaaccctacaccggagggagagggatggtcaagaaagccgtctccaccgcgccagcagacgccgaggccgacgagcgccgccgcctccgctcgctcgccttctccaacggcctgctccagcgaggcgaccccgcggcgccgcgggcgccgctcgcgccggcggctgccgtcacgcgcctacagggccgcgacgtcgtccgccgtggcggccagcgaaagagccgctacctcttctccttccctggcctcctcgcgccagcagcctcgggtggccgggtcggagagctcgccgacctcgggaccaagaaccccctgctgtacctcgagttcccacagggaaggatgaagctcttcgggacgcacgtttaccccaagaacaagtacctcacgctgcagatgaccaggtcggccaagggcgtcgtctgtgaggacgtctttgagagcctgattgtgttttctgaagcctggtgggtgggaacaaaagaagataatccggaagagctcaaacttgagtttccaaaagaattccaaaatgatggcacgacagcagactgtgatttcagaggtggtgcaggtggtgccatcgatgaagcaactggaagcaaagctggaaaggaaattgcagaacctcgttccccaaagtttgcatctgatgacgatgctcctgaggattcaaatcataaggatgagaataacacacagactatgagtggaacaccagttagacagtctgctaggaatgcagggaaaaccttgaaaaggtacacagacttatcttctggaggtgaatcgtctgacaataataatgaaactgatatatctgaggacttggatgataaggaggtggagagtccagaaattaaggacgagattgaaagcgaagatgtcaaacccgcagattcttcagcaatttccctctctagcaagaaggagcctcttgttcaggctactttgtctagcatgtttataagggcagaagaaaaaaagagatctacaaggagtcctaaagggtcccctgcaaccaaaggtgctgctgctaagaagcagcgagcaagtccaatggcaaaacagccagcagggatcaagaaggttagcggaactcggggaaagaaaaaaccaaaggtgggagaagatgaaatcgaagagctctcaagttcctcccaggataacgacgcagatgatgatagtgacgaggactgggccgaataatgcgatggtacagacgacggataggttgggccgttggggaagcatatgcataattgatgtgcggctgaagagaaggatggattgggggatggcacagaaactgcctgttttcatggactggtttggctggtcatgtctgacgacggatctagaatatggaatatcctgatctgttgtcaagctgagtccatgaaacgttggttgatgaaacattagttagtcagaagcgggtttgtttgtagttaggaactaggaacacacacacccgaggttgtgatggggttgcatacttggactagccattcccattcatctgtctgtactctgttcgactgttcctttgtgtggctcacacctgttgtgtttctgatggtggtcatttctccagccaggggcaaagaacacactgcgtttcgctgatcctttaattcagacccatagtccttttttttcttcagcaaagagtacctcggccgcgaccacgctatttttttttcagcacatttgatgggtctttgtatcgcagactgtatcatggtatcagattggtttcgcacttgaccccccttctcttc

SEQ ID NO: 15405 - DNA, 1015 bp, Zea mays
acacctccaggggcttccatgtcgtcactttcaccctcccgatgtctgacattctcagttataaccttggagggaaggctgagaagaacgttgagatgctatctgaacatattgctgactgggtcagggaggagagtgggaagaagattattttccacaccttcagtaatactggttggctttgttatggcgtaattctggagaacttgcaacagcatgatccttcagcagtggacaaaattaaagcttgtgtagtagactcagcacctgttgctgcacctgatcctcaggtttgggctttgggcttctcggctgccctcatgaaaaaacgcagtgtcaccacgaagggactaggttcagatgattcaaggtctgatgtcctagttgtggagtccaacaaggagctcaagctgggggcaacagaggcggttatactgtcagcgttagagagtttctttgacgttgttttgaactatccaaagatcaataggaggttgtgtgacgtgatggagctcttgtcctggaagcaacccaagtgcccccaattgtacatatacagctccgccgacagggtgatcccagcgaaatcagtggaggcattcatcgacggccagcggaaagccgggcatgaggtgagggcctgcgacttcgtgtcatcgccccatgtggaccattaccggagcaatcctgggctgtatagctctcagctggccaacttcttggaggattgtgtgcttgccaagcgctgtgagggtgcttgcacatcatgattgtctcttttatttgttcctggtcttgaattggaatgcaccagggacactgacatacgtgggttatacatgattttgttctctccttgttttaacggtctttgtgggtgacctttttttccccctcttgtaactcttgtctttgtggttggagtctgggcgcacaattgtaaaaacgtgtgaggagaaataaccaaatgaaaggagaggaaattcttttttttttatccaaaaaaaaacacccc

SEQ ID NO: 15406 - DNA, 707 bp, Zea mays
aggccctatataacattagctagattcctcctccctccttcctcacggctgctgctgccctgccctgccctggagtaaggaagccgacaccacttggagttgctgccaactaccgggctcggctgtcaaattctctatctggcagccagcccgtgtccaattccaactccaccggtggtaaaccatcgacagcaggagcagggagggcaggctgcacaagtttcctccttggactgccacaagaaaagagcatcattcctgctgatcggctcggctccactccaccccgaataaaatggcttccttctcgggacatctccaccgccccctgtccgccatggccgtggccgccttcgccgccgtctcctcccacgagcttcccgacaagctgtcccaccacaggcatcctgatgccagcacaggcacggacgcgctcgcctcgcttccattgaccaggtcagatgttcccgcagcgccttcggcatctgccctttctggcgcgcagctattgccacgggacctccacagcttgcgtctgctgaaggcgcccttcgcgtctgtgccggtcatgcagacggtttaccagtacgccaactttgccaaaacctcgggacaggccgatgcgatgcctgcaattccttcctcgccgtccgatgtgctgtaccgctggcacctgccagaccccagggtctatgccgacttccctg

SEQ ID NO: 15407 - DNA, 824 bp, Zea mays
gtgtgccatgttctgcctccgacatccttgcccctgtcgtgcctagatctccgtcgatggaaggcgcaatttcagggatgctccgtggctgccccagccatcctcggcctcgctggcttcgcgtcaaccccgccatcctcgcctcactcttcgtcgatggaagccaacgaccgcctcctccatcctcgccctgctcaccgccatccccttccatcagcacccctccatcaccgctccacatccacaactgtcgcgtccttccatcggcgtccacaccccatgcacagctgctgtgatcgcccccgccatcctcgccccgctccccgtcatcccctccatcgccccctccagcgacccaagcgggctctttgtcatcaacatgaggtcaccaagggaggttggtgaggtcctcgatggcgaccgactccgtggtagcagtggtggcctctgatctaggcagcatcagtgcgcgtctagaaaaccactcacgctcaacggcggtgatggcatgggagcaggtgtcggacttgatggaggtaggccagtaccaattttttggtgatttccaggcatgaccagaggcgtactgggaggaggaggcaactacagccagtaccagttctatggtgacctccaggcacagtcgaaggtggacgtcgttggggtggccttttcgaatcccatgtctagcaagctctgcctgcaggatccaagtaggatttactcaaggttggatcgtcatggggctttttggggagactattcctaagacggcagggatggacgggcaggtttggggagaggacctagcagtggcaggggta

SEQ ID NO: 15408 - DNA, 1227 bp, Zea mays
cactcctatgggcgattgccctccccgccgcccgcccggccgcgtcggtttctctctcaatctctcttgtctccaagtttgtaaccctagccgccaagcttgaagctccagccgtgctcgtgtagggctgcaggccatctgggctccggcttccggcatccaccaggcgtcaatacggtgcagcgagcagcgagcagcaagtcaccgagcagccgagcgaccgccgagcacagggcaccaccgagcagccgagccaccgccgagcaccgagtcttctctgttcttctgcggcgaacaaggtcaatccagggccgtggtgcgggtgctggtttttttttccaacaagtttatgttggtcgctcgaccgctgcagcaatgaagatacagaaagcaaatgcaggtgtccttacaaacttcgaagtccttgacttcttgcggtcaagaggtgccaaaattgacccaatgggatgtttgggggctgttgctgtatcagagtgtaaggtgtatgagtatatcttaaaaacccctgcttgcaaccagacaagggaatccatttatgaatttgtgaagagaagtgagggtttcaggcttgcagaggctgataagttaaatgtcatcaactggagaccatcctcagctgccgatgcctatgcgatgatagaagaatgtgggaaacgattttccagggatgaacgaggagaagcatgtgatgaagatgaacgagtccaggagtttcttgatatggtgaaggaggttttgccagcccctccgaaagcagaggtggagacagcagaggcagaggcagaggcagaggccgaggcggtggaggcagaggccgaggtagaggcaatgcaagagtgaatgtggtgtaagttaacatatttgagggccagattgcattagacactagtgctaagtgctgcaaggaaacttagaacactcaggtcggctgttagttctggaagctttccccctaatgcttcgtttggatattatcgtattcatctcaatccatgtatattgaggtggattgaggcgtaaattaaactattttacactccaatctgcctcaatacacatggattaaggtgaatataatctcaatccacgtatattgaggtggattgaggcgtaaattaaactattttacactccaatctgcctcaatacacatggattaaggtgaatataggagtatccaaacaagccctaaagttttttactctt

SEQ ID NO: 15409 - DNA, 1764 bp, Zea mays
ctcctatgggcgcttggggcccccgcgggccggcgggcagtcggtctctctcactctctcttgtctccaagtttgtaaccctagccgccaagcttgaagctccagccgtgctcgtgtagggccgcaggccatccgggctccggcttccagcatctaccaggcgtccttagaatacggtgcagcgagcagcaagtcgccgagcagccgagccaccgccgaacacagggcgccgccgagcagccgagccgccgccgagcgccgagtcttctctgagtgacttcggtacagacgacaaactttctccacacataccgcgccactccgccactcactgtgctgacggatggggtggtgctccccgtccacttcccggcagcttctctccacgacctcactcttcaccttcggcgcgggtctccttaccttcggcatccacctctcctacgtccacatcgagccccagcgcgctcgcacgctcgctcgggaccaattcgtccgtgactacctccgcaagaagcacgacaagtagcccgccttctgcggtccccaggtgattgcttggtagtcggagacgatggccctggtcccatcgaggtccgacagcgaggccttgatcccggaggtggagatgaatgccggcgccgaccagaccgcaacaacggcgcgggtcaccgtcgttcaggcgtcgtccgtgttctacgacacccctgcgactctcgataaagcggagaaattggtagcagaagcagctgggtatggttcacagttggttttgtttccggaagtctttgttggtggctacccacatggatctacctttggactggttgtcggcaatcgcactgccaagggaaaggaagactttcagaagtatcacgcatctgccatagatgtgcctggtccagaagtgtcccgcttatctgcattagctggaaaatataaggtgtttctggtgataggggtggttgagagggcaggatatacactttacaacacggtgctctccttcgatccactgggaaaatacctagggaagcaccgcaaggtcatgcctactgcactagaacgtgtattctgggggtttggagatggatctacaatacctgtctacgatactccgattggaaaaatgggtgctctcatttgctgggaaaacagaatgccacttctcaggacggccatgtatgccaaaggtattgagatatattgtgctcccacggttgattgcatgccaacttggctgtcttctatgacacatatcgcccttgaagggggatgctttgtgctgtcagcgtgccagttctgtcgtagaaagaactaccctccccctcccgagtacacattttgtggcctagaggaagagccatccccggaatccgttgtttgttctggagggagtgtcatcatctcaccattgggaacagtgttggcgggtcccaactacgaaagtgaggcccttctcactgctgacctggaccttggagagattgttcgagccaagtttgattttgacgtggtgggccactactcgcgacctgaggtgctgagtttagtggtgaagagcgatccaaagcccgccgtctctttcatctcagccgctggtagggatgatgactatgtgcagacctaatgacaaacatatctttggtctttagcttccttatacggcaatcgcatgcatctgtataattgtgggtttccggaacgttgcacgttccgtcagaataataataaactgttatgttacaataaaatagtaacaat

SEQ ID NO: 15410 - DNA, 1516 bp, Zea mays
cgcggacactggacaccgccggcgccctccctatctagggatgcagtggtacggggataggggtaaataaccgcggttatttacccgttgggtacggatatggtggagtttcatatccgtgggtacgggtatggatactatatgatatccacgggtaataatttcgcgggtatggatatcggctatccatatccgtcacccgatggacatatgacatgtggacccaaacagtggacgcatccaaggtcccaacagccagcgtccagcctcattggggcttgtacttgttcactgaatcactacttcgcgaggtcagccgtcaacgcatcagcagcaactagcaaggccgccaagcggcccaggacccaggccagctccaagcgaacagcctacggctgcaggccatctgggctccggcttccggcatccaccaggcgtcaatacggtgcagcgagcagcgagcagcgagtcaccgagcagccgagcgaccgccgagcacagggcaccaccgagcagccgagccaccgccgagcaccgagtcttctctgttcttctgcggcgaacaaggtcaatccagggccgtggtgcgggtgctggttttttttttccaacaagtttatgttggtcgctcgaccgctgcagcaatgaagatacagaaagcaaatgcaggtgtccttacaaacttcgaagtccttgacttcttgcggtcaagaggtgccaaaattgacccaatgggatgtttgggggctgttgctgtatcagagtgtaaggtgtatgagtatatcttaaaaacccctgcttgcaaccagacaagggaatccatttatgaatttgtgaagagaagtgagggtttcaggcttgcagaggctgataagttaaatgtcatcaactggagaccatcctcagctgccgatgcctatgcgatgatagaagaatgtgggaaacgattttccagggatgaacgaggagaagcatgtgatgaagatgaacgagtccaggagtttcttgatatggtgaaggaggttttgccagcccctccgaaagcagaggtggagacagcagaggcggtggaggcagaggccgaggtagaggcaatgcaagagtgaatgtggtgtaagttaacatatttgagggccagattgcattagacactagtgctaagtgctgcaaggaaacttagaacactcaggtcggctgttagttctggaagctttccccctaatgcttcgtttgaatattatcgtattcatctcaatccatgtatattgaggtggattgaggcgtaaattaaactattttacactccaatctgcctcaatacacatggattaaggtgaatataatctcaatacacatggattaagatgaatataggagtatccaaacaagccctaaagttttttactcttaaccatattctacactcggctgtgtttattgtgatatgctgtgatctgcattctgggcagtgcttcatcatttaacagaaaaccccagcttgtgtatttgccccgcg

SEQ ID NO: 15411 - DNA, 1172 bp, Zea mays
gcacgagtctcactctctcttgtctccaagtttgtaaccctagccgccacggctctatacctctcgccctctgagtctcgcgcgggctccaggccatccgagctccggcttccggcatccaccagacgtccttagaatacggtgcagcgagcagcaagtcgccgagcagccgagccaccgccgagcagccgagccgccgccgagcgccgagtcttctatgtttgcttctccggtgaaaggtgtttgctaggggaccatggaggagcacggagcggaagacctcctgtgcgaggcgatgggatctgcggcgcaggtcgtggtggtagaggattgcgtggaagcaccgggggccttcgtcctccacctcctcctcaagcgcgcgctcgccggctgcggctccgctgccttcctcgccctcgcgcagcccttctcccattacgatcgcgtcctgcgcaagatgggctgtaacctttccctgcataggaggaatgagaggcttcatttctttgaattgctaggattcccaggtggagcaagggaaggcaccattgctgatagctttgctctattgtacaatgaaattcaaagactggtggaggcaaacagggctggagaaaatgaaggccagttcaccatcgttatagacgacgcttccctgttggaagtcgtggcccttggttctgtaagcgatgtgctggatttcttgcactattgtttcacactcacgtctgagatgaattgcaagctagtgatcctcattcacgaggatatatacgcaaatgaggagaacatgggtctccttttacatctgcgctacattgcggatcttgtgattaaagcagcacctttaagcactggtttggctgctgatgttcatggacagctggcggttgtgaacaagggtacattcagcgagcaaagggcaaaagcacagaaagtttggaacttccatttcaaagtgaaagaaaacggtgctgacttcttctatccagggagtagacattagggaatacttgtatacagtagaaacaactctggttgtgataactgataaccagtgctgctattcttcgtgtaccttgtgctaagcacagtaaagttttgtccaatccttcatttctctcgcaaaaaaaaaaaaaaaaaacagagcttacaaagtgttcgccacagcc

SEQ ID NO: 15412 - DNA, 1357 bp, Zea mays
ctgcacggtaccggtccggaattcccgggtcgacccacgcgtccgctcaatctctcttgtctccaagtttgtaaccctagccgccaagcttgaagctccagccgtgctcgtgtagggctgcaggccatctgggctccggcttccggcccccgccgcccgccgggacggtgctccgagcagcgagcagcaagtcaccgagcagccgagcgaccgccgagcacagggcaccaccgagcagccgagccaccgccgagcaccgagtcttctctgttcttctgcggcgaacaaggtcaatccagggccgtggtgcgggtgctggtttttttttccaacaagtttatgttggtcgctcgaccgctgcagcaatgaagatacagaaagcaaatgcaggtgtccttacaaacttcgaagtccttgacttcttgcggtcaagaggtgccaaaattgacccaatgggatgtttgggggctgttgctgtatcagagtgtaaggtgtatgagtatatcttaaaaacccctgcttgcaaccagacaagggaatccatttatgaatttgtgaagagaagtgagggtttcaggcttgcagaggctgataagttaaatgtcatcaactggagaccatcctcagctgccgatgcctatgcgatgatagaagaatgtgggaaacgattttccagggatgaacgaggagaagcatgtgatgaagatgaacgagtccaggagtttcttgatatggtgaaggaggttttgccagcccctccgaaagcagaggtggagacagcagaggcagaggcggtggaggcagaggccgaggtagaggcaatgcaagagtgaatgtggtgtaagttaacatatttgagggccagattgcattagacactagtgctaagtgctgcaaggaaacttagaacactcaggtcggctgttagttctggaagctttccccctaatgcttcgtttgaatattatcgtattcatctcaatccatgtatattgaggtggattgaggcgtaaattaaactattttacactccaatctgcctcaatacacatggattaaggtgaatataatctcaatccatgtatattgaggtggattgaggcgtaaattaaactattttacactccaatctgcctcaatacacatggattaaggtgaatataggagtatccaaacaagccctaaagttttttactcttaaccatattctacactcggctgtgtttattgtgatatgctgtgatctgcattctgggcagtgcttcatcatttaacagaaaccccagctgtgtattgccccgcgaaattataacttgcacagtgttacaaaaacctagtaccagttacttcaatcacc

SEQ ID NO: 15413 - DNA, 1796 bp, Zea mays
ctcggccggggcgcctctctcactctctcttgtctccaagtttgtaaccctagccgccaagcttgaagctccagccgtgctcgtgtagggccgcaggccatccgggctccggcttccagcatctaccaggcgtccttagaatacggtgcagcgagcagcaagtcgccgagcagccgagccaccgccgaacacagggcgccgccgagcagccgagccgccgccgagcgccgagtcttctctgacgacaaacaactttctccacacataccgcgccactccgccactcactgtgctgacggatggggtggtgctccccgtccacttcccggcagcttctctccacgacctcactcttcaccttcggcgcgggtctccttaccttcggcatccacctctcctacgtccacatcgagccccagcgcgctcgcacgctcgctcgggaccaattcgtccgtgactacctccgcaagaagcacgacaagtagcccgccttctgcggtccccaggtgattgcttggtagtcggagacgatggccctggtcccatcgaggtccgacagcgaggccttgatcccggaggtggagatgaatgccggcgccgaccagaccgcaacaacggcgcgggtcaccgtcgttcaggcgtcgtccgtgttctacgacacccctgcgactctcgataaagcggagaaattggtagcagaagcagctgggtatggttcacagttggttttgtttccggaagtctttgttggtggctacccacatggatctacctttggactggttgtcggcaatcgcactgccaagggaaaggaagactttcagaagtatcacgcatctgccatagatgtgcctggtccagaagtgtcccgcttatctgcattagctggaaaatataaggtgtttctggtgataggggtggttgagagggcaggatatacactttacaacacggtgctctccttcgatccactgggaaaatacctagggaagcaccgcaaggtcatgcctactgcactagaacgtgtattctgggggtttggagatggatctacaatacctgtctacgatactccgattggaaaaatgggtgctctcatttgctgggaaaacagaatgccacttctcaggacggccatgtatgccaaaggtattgagatatattgtgctcccacggttgattgcatgccaacttggctgtcttctatgacacatatcgcccttgaagggggatgctttgtgctgtcagcgtgccagttctgtcgtagaaagaactaccctccccctcccgagtacacattttgtggcctagaggaagagccatccccggaatccgttgtttgttctggagggagtgtcatcatctcaccattgggaacagtgttggcgggtcccaactacgaaagtgaggcccttctcactgctgacctggaccttggagagattgttcgagccaagtttgattttgacgtggtgggccactactcgcgacctgaggtgctgagtttagtggtgaagagcgatccaaagcccgccgtctctttcatctcagccgctggtagggatgatgactatgtgcagacctaatgacaaacatatctttggtctttagcttccttatacggcaatcgcatgcatctgtataattgtgggtttccggaacgttgcacgttccgtcagaataataataaactgttatgtacaataaaatagtaacaataaggctttgttcggttattcccattatacacggattggacgagattggaaaaaaaaaaaaaaaaaaaaaaaaaaaaa

SEQ ID NO: 15414 - DNA, 2144 bp, Zea mays
tacaacttctttgatgagaagtattgtctggatcatgagattggattaatttctttgaaagggtttaattcctggtttattacctcgagttggcatagagtagagttcagtaccatagaagtgatctggaatgaaatgattttgctgatttttattttttttctattctatttgtgttttgacgatgaccatgagcttgtgtggcttcatgtatatctctcgtaaaatattttgtatctgtatttgaagtgatctagaacagattgattttgctggattttaattttctattgtacttgtgttttgatgatgaccctgagcccgtgttgctgcctgtatatccctcataattttttttgtatttatacttgtatatataccgaagcagccagccagttgtcagttgaagcgagcaagcaggcactttgcttgcgtacatgctttctttttactatgttttgatgataattaagcttgcgcttgacggtgacccatggcacccccgtggctccaaagggcagcaggacagggcaaccccaccggtcggtgtccaccccgggaatttgcctgacaaggatttgcctcccctgtgcgggctccccagggttttcctagccgggctgccaaaggaggccttacagtgaccatcacccactaggtttgcctaccccttctcttcccttcctgttgtgcgaaactgagcacccaaaccctaacttaagctattttgctatctgtacttgcatctgatagttatcaatctatgcgtctttcttgcctactgaattaaatactgtgtctgcccctagttcttctgcggcgaacaaggtcaatccagggccgtggtgcgggtgctggttttttttttccaacaagtttatgttggtcgctcgaccgctgcagcaatgaagatgtgagtgctcgtgtctcaccgccaacctataactttttgttgttccttgttacttgtatgccgcgccaacctgtgcatcgtctactgtacatatacttttttttcctgagcaccactgtacatatttcgcaccatgcatttctttgaaaaaaaatgatccgacatgtgcttcagaagttgctgttggcctgggttcaaccaggctgccttggatgcgagtccttgattaatgatctttttcagttttgctggataattttctcgaactttaaccataaatgggtgatcaagtgtgaggccaaccatgtagattgttcaagtttatttctcaattttcataaagggttcggttaatggagcagcctgttttgagttccaaatgtgtcattcaatggtgtgaccgaacctatgtgtggaagactggagcgtgggtcttggatgtcctgcaaggtggtctcagccatcatgcggtttaaagcttggagtaaccaatgtccattgctgttatgcagacagaaagcaaatgcaggtgtccttacaaacttcgaagtccttgacttcttgcggtcaagaggtgccaaaattgacccaatgggatgtttgggggctgttgctgtatcagagtgtaaggtgatcactgatctgctgctcttttacccaatgccttatcgtctcgacttttttctagatgctgttttgagcctaaaatgacctaatagatgccattgtttcacttaggtgtatgagtatatcttaaaaacccctgcttgcaaccagacaagggaatcgatttatgaatttgtgaagagaagtgagggtttcaggcttgcagaggctgataagttaaatgtcatcaactggagaccatcctcagctgccgatgcctatgcggtactgtaatgtttatcttttccaataatgatcattttaccagttttaatatatttcttgtttaatgcaaactaaactattttagttaattttgctccgccatgaaagtgccttctattctagttatggtgttagtatttgtctattaaaaaaaactcggccggggagggaaagacagccctcccggtaatccggtattatattaaggagagaccgaaacaatggttctagccgagaaaatccccgaatcctggcctcccatcactaacgggccgatgtcaaccgtccactctacacggcccaaccggaaggtggcacacagaacatcgtaacccggacg

SEQ ID NO: 15415 - DNA, 1209 bp, Zea mays
gagtctcgcgcgatcagtcggtttctctctcaatctctcttgtctccaagtttgtaaccctagccgccaagcttgaagctccagccgtgctcgtgtagggctgcaggccatctgggctccggcttccggcatccaccaggcgtcaatacggtgcagcgagcagcgagcagcgagtcaccgagcagccgagcgaccgccgagcacagggcaccaccgagcagccgagccaccgccgagcaccgagtcttctctgttcttctgcggcgaacaaggtcaatccagggccgtggtgcgggtgctggtttttttttccaacaagtttatgttggtcgctcgaccgctgcagcaatgaagatacagaaagcaaatgcaggtgtccttacaaacttcgaagtccttgacttcttgcggtcaagaggtgccaaaattgacccaatgggatgtttgggggctgttgctgtatcagagtgtaaggtgtatgagtatatcttaaaaacccctgcttgcaaccagacaagggaatccatttatgaatttgtgaagagaagtgagggtttcaggcttgcagaggctgataagttaaatgtcatcaactggagaccatcctcagccgccgatgcctatgcgatgatagaagaatgtgggaaacgattttccagggatgaacgaggagaagcatgtgatgaagatgaacgagtccaggagtttcttgatatggtgaaggaggttttgccagcccctccgaaagcagaggtggagacagcagaggcagaggcagaggcagaggcagaggccgaggcggtggaggcagaggccgaggtagaggcaatgcaagagtgaatgtggtgtaagttaacatatttgagggccagattgcattagacactagtgctaagtgctgcaaggaaacttagaacactcaggtcggctgttagttctggaagctttccccctaatgcttcgtttgaatattatcgtattcatctcaatccatgtatattgaggtggattgaggcgtaaattaaactattttacactccaatctgcctcaatacacatggattaaggtgaatataggagtatccaaacaagccctaaagttttttactcttaaccatattctacaaaaaaaaaaaaaaaatgtgatatgctgtgatctgcattctgggcagtgcttcatcatttaacagaaaaaaaaaaaaaaaaaaa

SEQ ID NO: 15416 - DNA, 1004 bp, Zea mays
catatagatatatgtcagctacctgtgtaccctgcacgaatattcctataaatccaggttgaatattttgtgcatgtaacgtaaaagttctacgctatggtctttcacttacaggttgtcaaagaagagcagatgtgctattttggttggcctaaaattatatagaaaagagtgttgctttggtctacgagtctaaaactatattactgctatatggatgagcttcttactgctaattaaattacagtaacatgtggcggtgacatggcacaacaagaacttgaagaagtagacatgttgctgctgcctgcagggtgacgtctatggtggtgtgctgcgggcaacgcccacacaatgtgatcgggctgcacgccaatgttcaacatgtgccccaaccagaatgtgtatgctactactaatataacattcgtcattggttggttcaccccaagaggtttgctgcatgttcatggagctggtggataataaattttagttgttctttttgtggtttattagatgacatcaattagtgttcaattgagccttagagtaggatgaatacaactgtcttaagtttctttgttccagcagattgtttgggggcaaggttacctatgaacttcaagaattggtcttatgatattgttagtttgtacaacttagtgttaggttgctcgacttcttcatgaatgaggtgttagacattggtcgatcatgcagggttgaaggtgcttcatataactaaatctaccatgactttctaggaaaagatggaatggaactcaatttttggtggccgcacaagtgtggaaacttgaattcatatatacttacaatcaacattagcgcaaacagttgaccaagtttttcaattagtattttagtttgaatttagtgtgcaataatgtatgagttatttaacaatgcttattcatgacatattgaatgatacttatatttattatatcaattatgatgttattaaaaaaaaaaaaaaaaaa

SEQ ID NO: 15417 - DNA, 1381 bp, Zea mays
gtgggacaggcatcatttggcgtcgggccggtacggtattggcggcgggccagctgacgagaaggaacggccgcagcccatcctgattcctgtcctcccagcaccggtgtctcatcaggaacaggaagcgaacaccggcggttgtcccgttccaattccaaccaacctacctaggctccgcgcgcacctaccccgtctctgctccggggagcgtcaccagtcagtcacggcggctctaaaatctcagataccaccagaccaggccagacccgtcccgcgaatctaaggtcaaaccaaccgcgatccgcgaatccgcgggagaggaggggaggggcgcgggggcatggagttcctgcagggccagaggctggagaccacgctggccgtcgcgggcgccgtcgttgccgtcgcagccggctccgcctacctcttcctccgcagtaggaagcccaggggatgcctagaccccgagaacttcaaggagtttaaacttgttgagaagaggcagctgagtcataatgttgccaagttcaagtttgcgctcccaacacctacttctgtattgggtcttccaatcggacagcatataagctgcagaggacaggatgcttctggcgaggaagtgatcaagccttatactccaactactctggactctgatgttggatcttttgagcttgttataaagatgtatccccaaggaagaatgtcgcatcatttccgtgagatgaaagttggtgattatatgtctgtgaagggacctaagggccgtttcaagtacctacctggacaagtgagagcatttggaatggtagctggaggatcaggcattactccaatgttccaagtcacaagggcaattcttgagaacccaaaggacaacacgaaagtacacttaatctatgcaaatgtcacgtatgaggatattcttctgaaggaagaacttgacggcatggccaaaaactatcccgatcgtttcaagatctactatgtcttgaatcagcctcctgaagtctgggacggtggcgtcgggttcgtgtcgaaggaaacgatccagactcattgcccagcgcctgccgccgacattcaggtattgcgatgtggacctcctcccatgaacaaagccatggccgcgcacctggacggccttggctacacgaaggagatgcagtttcagttctaagcgttgcattctctctaccagtaccagaataaacggcggtggaacaaagttctaagctccaaacagacgctcttttgtacccaccaaatttgtatcggtgtcgggacattgtaccatgccgttattttgtatcggtttgtcactcacaaaaaaaaaaaaaaaaaaaaaaaaaaaacaatccacgttgttaccactgct

SEQ ID NO: 15418 - DNA, 998 bp, Zea mays
cttcaagcagtttaaacttgttgagaagagaccgcccggccataatgttgccaagttcaagtttgcgctcccaacacctacttctgtattgggtcttccaatcggacagcatataagctgcagaggacaggatgcttctggcgaggaagtgatcaagccttatactccaactactctggactctgatgttggatcttttgagcttgttataaagatgtatccccaaggaagaatgtctcatcatttccgtgagatgaaagttggtgattatatgtctgtgaagggacctaagggccgtttcaagtacctacctggacaagtgagagcatttggaatggtagctggaggatcaggcattactccaatgttccaagtcacaagggcaattcttgagaacccaaaggacaacacgaaagtacacttaatctatgcaaatgtcacgtatgaggatattcttctgaaggaagaacttgacggcatggccaaaaactatcccgatcgtttcaagatctactatgtcttgaatcagcctcctgaagtctgggacggtggcgtcgggttcgtgtcgaaggaaatgatccagactcattgcccagcgcctgccgccgacattcaggtattgcgatgtgggcctcctcccatgaacaaagccatggccgcgcacctggacgaccttggctacacgaaggagatgcagttccagttctaagcgttacattctctctaccagtaccagaataaacggcggtggaacaaagtcacagtcacagagcgtcgtacttactctacctggatgaaagcagcagtacagtacccacctaatttgtatcggtgtcgggacattgtaccgtgccgttcttttgtatcggtttgtcactcactcactcactccgcgagccagcagcccagcacacgatccatcgtgtcgttttggcaacgtcatacaaatacaaaaaaaactgcacgtgaaaaaaaaaaaaaaaaaactcgaggggggg

SEQ ID NO: 15419 - DNA, 1530 bp, Zea mays
ccggccggggtcccgttccaattccaaccaacctacctaggctccgcgcgcacctaccccgtctctgctccggggagcgtcaccagtcagtcacggcggctctaaaatctcagataccaccagaccagaccagatccgtcccgcgaatctaaggtcaaaccaaccgcgatccgcgaatccgcggagaggaggggaggggaggggaagggcgcgggggcatggagttcctgcagggccagaggctggagaccacgctggccgtcgcggccgccgtcgttgccgtcgcagccggctccgcctacctcttcctccgcagtaggaagcccaggggatgcctagaccccgagaacttcaaggagttcaaacttgttgagaagaggcagctgagtcataatgttgccaagttcaagtttgcgctcccaacacctacttctgtattgggtcttccaatcggacagcatataagctgcagaggacaggatgcttctggcgaggaagtgatcaagccttatactccaactactctggactctgatgttggatcttttgagcttgttataaagatgtatccccaaggaagaatgtctcatcatttccgtgagatgaaagttggtgattatatgtctgtgaagggacctaagggccgtttcaagtacctacctggacaagtgagagcattaggaatggtagctggaggatcaggcattactccaatgttccaagtcacaagggcaattcttgagaacccaaaggacaacacgaaagtacacttaatctatgcaaatgtcacgtatgaggatattcttctgaaggaagaacttgacggcatggccaaaaactatcctgatcgtttcaagatctactatgtcttgaatcagcctcctgaagtctgggacggtggcgtcgggttcgtgtcgaaggaaatgatccagactcattgcccagcgcctgccgccgacattcaggtattgcgatgtggacctcctcccatgaacaaagccatggccgcgcacctggacgaccttggctacacgaaggagatgcagttccagttctaagcgttacattctctctaccagtaccagaataaacgggggtggaacaagtttcgtcgcctctttgagcagacgaagcctgaccatatcgccatatagctccaaacagacgcggtttgccactgacagtcacagagcgtcgtacttaaggggtgtttggtttatagggactaaactttagtctctccactttattccattttagttcataaattattaaatagggaaacttaaatagagttttagtttctatatttagtaatttagggactaaaatggaataaaatagaggactaaaaattagtccctagaaaccaaacacccctttactctacctggatgaaagcagcagtacagtacccacctaatttgtatcggtgtcgggacattgtaccatgccgttcttttgtatcggtttgtcactcactcactccgcgagccagcagcccagcacacgatccatcgtgtcattttg

SEQ ID NO: 15420 - DNA, 1655 bp, Zea mays
  misc_feature (1652)..(1653): n is a, c, g, or t
gagccgaccgcgcctccggatgctttaattcgaacgcggttgcctcctccctcgagcccttctccttccttctttccttgcttcctccccccacagccacagtggcatatcgcatcacgccaaagcccatccgccggccgtagatcggctccggcaaccggcttcgaccgcggcctcccctctgaggattttcggcctagaggttccccatggcatcagttacttatattgatgatagccatgctgaggttattgatcctccaaagaatgaggaaatgctggatgccactgaacttgttggtgatcatattcagaattcaccaaaaccaaatgtggcaagctatggcaacgtgcgtgagctactggaatgccctgtgtgtttgagtgccatgtatcctccaattcatcagtgctccaacggacatactctgtgttctggatgcaagccaagggttcataatcgctgtccaacatgcaggcatgaactgggtaacataagatgccttgctctggaaaaggtggctgcatcactagagcttccatgcaagtaccagaactttgggtgcttgggcatatatccttactattgcaagctgaaacacgaatcgcaatgccaatacagaccatatacttgtccatatgctggatctgaatgcacggttgctggtgatattccgtatctagtaaatcacttgaaagatgaccataaggtcgacatgcacaatggaagcaccttcaatcatcgttatgtcaagtcaaatcctcatgaagtcgagaatgctacctggatgctcacggttttcagctgcttcggccagtacttctgcctgcacttcgaggctttccagctgggcatggcgcccgtgtacatcgccttcctccggttcatgggggacgacgctgaggccaagaactacagctacagcctggaggtcgggggcagcgggcgcaagatgacatggcagggcgtgcctcggagcatcagagacagccaccggaaggtccgggacagctacgacgggctcatcatccagcgcaacatggcgctcttcttctcgggtggcgacaggaaggagctcaagctgcgggtcaccgggaggatctggaaggagcagtgagtcgcgtgcatgcagtgcaggtgcaggcagcagctcgacgcatgcggcgttgcgtgtgttccttctccggtgttaccatgacctgaagcatggaatccaggaaccttgtagggtggtgtaggtggtagttggaatctttgagtcgtgggtggttcttgtgtcgttgtgtggtagtggtaccgactgatttagagaactggaggcaattctctcctttgctttgaacctgtcgagagctggtcatgatgggcacggctgtggactccatgaaatgtaaatgatgtatcccggctcactctgtctgtggatcagactcgctctctatcggcggaccacaattgttcctgagtttggccaatgagttaggtcccaaccattctctgctccagctggtacacgtagttttagggtccgtttggtaaagctacagctcttacttctttagctctagatcctgatcctcctgattctcctagaaaatcagaatcatttttaaaaccgtttggcaagtaaacagattcttgtcttcaaaanngg

SEQ ID NO: 15421 - DNA, 1078 bp, Zea mays
ctggaactctcgaccggccgccattggcaagggtttagggcgcagcagagtctggtgtctcttgctccgaccccgttggcgactgagacgcgatccccttctcctgcactgccgtcctccgtcgctgcgatgcctcggtattactgtgactactgcgacacctacctgacccatgactcgccatctgtccggaaacaacataatgctggatacaaacacaaggcgaatgttcgaacctactatcagcaatttgaggagcagcaaactcaaagtttaattgatcaaagaatcaaggagcatcttggacaagctgcagctttccaagcaggtgcccctttcaaccaacatctgcttgcattcccaggagctatggcccgccctcgtcttccaattctgccaacccctggcatgcctcatgggtttcctcaagcacctggcgcaccattgatgccaggaattaggcccccgattttaccagctccaggttatcctggtcctccaccaaccatgcagcaaccaggcgccccacctgggtccatgccacaaccgggcgctccacctggttccatgccacaaccaggcgctccacctggttccatgccaatgcagatggccccactcccaaggcctccaacgctaccgcctccaacatctggagtcccaggtgctcccattcctaacagtggagcacctccagccatttaccaagcaaatccacaagcatctgcaggtccaacttctggtgctcctccagctccaccgactgctccacagcctgcgttctcctatgctcccccatcagaggggaaccactgattctgttccttaggcatgacttgggaggccatatgaagtatgtgcagaaaggctgttcctttggaggttgatgttgtcatcttttaactaaggccatttctatcatcctgaattcaagagattattgagaaaatcttccaatttgtgtggctgggtctctgttgttcgatgcatgttaactatgttagtttttatataaatttcaataaaaaggacgcttgaaaaatcaaaaaaaaattctctaggaaaaaaaaaaaaaaaa

SEQ ID NO: 15422 - DNA, 5689 bp, Zea mays
  misc_feature (420)..(420): n is a, c, g, or t
  misc_feature (759)..(759): n is a, c, g, or t
gatactgtcagtcgacttgatgatagttttagcattctctcctggtggcaagaccataagctaacttagcttgttctgtctatccttaataaagatgtgatgactgtacctacatctaccatgtccttagaatctgcttttagtttggctggcagggtgatcgaggagcgtcatcaacggcttacaagtgacatggtggaggtcttatcctgcatcaaagattgtgagttagcggactcccacttgcagcataatctggagagggacaccacatatattgaatctgtccttgagagcataagcataagcctagagtgattgagtgactatcttcatactctgagtgattgagtaatgtgccttgttgagttgttgtaatggactaatgaacttatgaacattaggatttaggagatgacngcactctttttttttcttcctagggttttctcacaaggtgtgagtttttacctaggaatgtttttaatgaggcaacactacacacaacagctctaatataatctttatattcttcaacttggtaatggtctgtctactgtatgtgtgctctgtgaattgactgaatctaaactctcaagtgtgtactcttaagttggacaccgtatgaatccgaaccctgtgaactgtgatatgtatttgatttgataaagattatttgtactctgaatctatgtatttgtgcctattggttgaactgtctgtgtatttgtaatacacaacaagttctgtattagggcntaatacactatcgtgccgtacttggactgcgaccaagtacttggactgcgcccaaggtggtcgtgctggcccgacacgagatggccagcgtgttgtgccgggtcgtgcccaaatcgtgtcgggcgatatatttggatatgtatgtcctcgagtcagccactatcaacacagaaacgctaaaatagcacggttccttttggaacaaaggaattttttataaatcttacgtttcttatgtgtttttgaacgaatttccctaaaatttatatacaaatcctataaaatttatagtgttccgaaggagccctacacaggggtggtgagcctcctgacgttggaagtgtcggtacccgggactccgcttatgggccgtcacagagcctgactcgtatgggcctacttgccattgatcggcccagccatttaatggtcctggaactctcgaagggcttccattggcaagggtttagggcgcagcagagtctggtgtctcttgctccgaccccgttggcgactgagacgcgatccccttctcctgcactgccgtcctccgtcgctgcgatgcctcggtgagtgcttctttgtcttggctactcaacttgtgcccatatgtccaccagcgggggtgcggttgcagaatgggggtgggggggtggggataggcgttgtatttgaaaccctagcactggtgtcccatgattcgcgccaagatctcgctggtcgattccaccatgcggtagtattggggtctgggtttgctcaccggagccgattagatgataccacctgcctctgtctgtgctgcactgttgtatatgttcctttcgatttatgtcttagctcgtgttctgagttctgactttctcttgttcttaccgtgcaggtattactgtgactactgcgacacctacctgacccatgactcggttagtgtcttgttctgcttcaatcttctaagactagagacaggtagcaggctcatcatctttgtaggtttcccgaggattgcatgcagtaatctaatgcaggcataggtggtggcgcttctgctgccaagtataagctttaatgaacataagcgaaataaaagttatttatgtgacttgctcatgattttttttcttttcattagctcaattcaattttatttctaactccctaggaatattttgtgacattttattgatgctccatatagattgcagtgctcatcatttatatagctgtgtactaggtaaccacttattcaggctctcataatatacgagatattcacaaactacagttctcttggcttcctgaattgaaatagttgttctcccttttagacttccatatattgcatacataagtgatttcaacatagttgcttctgcaaactgtattgtcaagggcgttcgtgcccaaggatgccggacctcgactacggagttcgtagtcgtgatccgtggtagacggcagggttatacccccacgccgccgctcttcgtcaaccgggttatgcccccaggttgccggcttaggagaatagagagaggagattagatagttgatattcttcccttctcatagtctgattacaaaatatatatagggcctatggcccaaccgacttggagtaacaatctccactaattaaggaactaagatagatatggcctatggcccaaccgacttggagtaaccacctccactaattaaggaactaaaatcgacacatatctatcccttgccgctggtggagccggcgcccagcatgccctcctgcgtggcctttgcatgctgctcggcgcgctcctgggcacggcaaacgtcctgggctcggcgacgcctagtatacgtgcgcccgaacatgacatgtatagatccaagaatgctgtctgctctttgctaccatgtacactattttttatttctcatcttatttttgaaacgtgtgctgactactttgtaaaaaatgttgcagccatctgtccggaaacaacataatgctggatacaaacacaaggtatttattttatctttgtataatcttcacagttccaatttgtttttggtgcctattcatctataagatgttgctcaaccttatttgaaatatggtaggcgaatgttcgaacctactatcagcaatttgaggagcagcaaactcaaagtttaattgatcaaagaatcaaggagcatcttggacaagctgcagctttccaagcaggtgcccctttcaaccaacatctgcttgcattcccaggagctatggcccgccctcgtcttccagttctgccaacccctggcatgcctcatgggtttcctcaagcacctggcgcaccattgatgccaggaattaggcccccgattttaccagctccaggtaaacagggctgctatttgtatcattcattatgattgctagccccattaattctaatattgttttcttcatcaaagacgaaataactacatttacccctgcctctaaccttagcagaacaaatatcaaaagttgaatgttccacaaagagtgctacttgtttgctatgacccgattcaggttcttctgcatgtatctgcacagtacattctattttcatgttgcttattagggcattggtacactcgttacctaccatagttggttaattaggtttggtttatttcgtattcgtaccatgaaatttcatggatttcattatttcgggtacaacctgatactaatgactttaaccgatctataaaccctttgcacagttctaatccagaagaaactggtcttcattttctgcaaatgtgcaaactgttctgtactgatattttttctggggaatgaaacaaaacttttagaacaagctgtaaatgttctcaaaacctcccccagttttttacctttgccaaagtaattaatcacttggtttgtgatgagtggagaattggagatctaaaatgcttaaattagagtattctgatatattttctgttttcacgtttatctcaaaccacggtactatgtttctatcagttgataaatagattgtgtgtctataattatgcagataaatgtgtaagtattataagcatccttaatcaaccctccctctcccccatccttatttactactactagcattcaaatttgtctacagatgtaagaattttctgtgtaatgaaccctatctctccctcataactaaaaaaaatacttgtttgtaccaatgtaatgttggtgttcaaaattttagctggagccttctgtttctggcatctctgtaaagacactgcacctcagtaatcttagcgattgatgaaaggttaccagtcattttgcttcctctttaatcttctaaaattcctagaaatgcttatggatggaggtagttgcttaatgttgtgctgactttgcacagctgataagttagcctttggaagaatgccatttacatttttcataaagaccatcgatatcctgatacatttcacttattcaaaccaaccaatgactactttgtgttcctgttttttcaaatatttcaggttatcctggtcctccaccaaccatgcagcaaccaggcgccccacctgggtccatgccacaaccgggcgctccacctggttccatgccacaaccaggcgctccacctggttccatgccaatgcagatggccccactcccaaggcctccaacgctaccgcctccaacatctggagtcccaggtgctcccattcctaacagtggagcacctccagccatttaccaagcaaatccacaagcatctgcaggtccaacttctggtgctcctccagctccaccgactgctccacagcctgcgttctcctatgctcccccatcagaggggaaccactgattctgttccttaggcatgacttgggaggccatatgaagtatgtgcagaaaggctgttcctttggaggttgatgttgtcatcttttaactaaggtcatttctatcatcctgaattcaagatattattgagaaaatcttccaatttgtgtggctgggtctctgttgttcgatgcatgttaactatgttagtttttatataaatttcaataaaaaggacgcttgaaaaatcaaaacaaaattctctgagaattgtttgtggcatgggatgcttgaactcggtgttgtgattcgccagtattcatgttttagatgttcttatgtccacttttaccatcaaatgtgctatttctggcaaaagttaggttccaatgtccaaagaaattgaagcggtatcaagcatgtttcaatgtctcgacttttttctgacgaggagctttgggctgtacaatctgagtgttgtggaaattacgctcgaaggaagataaatgagtgtatagggtttaggatggaaagtgacagattctcgttagagtaccagttagggcttgttcggttaggagtagactaaagggatgtttgttcgaaattataatctattcagattatataatacaatattttttgaactaagtgttagtttaaaagttgttggattatataatttggatagattataatcccaaacaaacacgaatcggaggaattcaaacctttctattcaaaattgtataggaagggatttaatctctttaatcacctccaatccaaatgcaacagaaaaagccttagggttttggggttagtcttttgtaattacagttatacccttgtgtaatgggttaggtccattaacctgagtctattaatacatctcccaaacctgagttagggttttcattattcaatttggtaccagagccagtttctctgccccctccctcccccacagtcgccgccaccctgggcccctgccgagccggtcgcctccctgatgaaggacctagggtcccttcaccacttcctcgacatcactgtcgagcatcggcctcaaagtctctcctccaccaacgcaaa

SEQ ID NO: 15423 - DNA, 1144 bp, Zea mays
ccggaatgatagtataccaaaaagcttctcaaggaatctgacgattacaaaggatatgaaggattctatatttgtgtggtatcagctggatgacttttaccagaaccataggaggtatgtcaagagccgtaatgatgcacagctaggagataaaagtaaggcgactgactttaccaattgtgatcctgaggccaaaacggtagacggaaaaccaattgtgccttgtggtcttattgcatggagcctgttcaatgatacatataaactcattcacaacaatgtaaccttgagagtggagaagaaggacatctcttggaagagtgacagagaccacaaatttgggagtgatgtcttcccaacgaactttcagaaaggacctcttaaaggtggaaaaacacttgatccaagtatcccgttgagtaagcaagaggacctcattgtttggatgcggactgcagcacttccgacattcagaaagctgtatggaaggatatatgttgatctcaaggaaaacgatacaatcacagtccagttggacaacaactacaacacctatagctttggtggcaagaagaagctggtgctttctaccgcaacctggctcgggggaaagaacgattttctgggccttgcgtacctcaccgtcggcggactctgcttcttcctggcattcgcgttcaccttgctatacttgataaagccaaggaaaatgggagataacagctacctgtcatggaacagacccccttcaggtcgctgatgatgtgctttggaagttaaatgcgatacacaggcagcaccaaacagattcagattatggtcggaatgtatcttgtaccacagagaaattttatccgtgctcgtcggtgtagaatatatacggcacccttgcacatattgtacattacatcgaaacacatagctttgttttctacaaaattgtatactcaaaagtttcagaagtggatgccagtagttccatgctttgtttttttgttccccttaataaaacagctaaacctaacctgcatgactgagctatgagatgaacatgagctcttcgtaagtgaccagttctcgaaggctaggcatttgcagaaatttggacttttggattccaaaaaaaaaaaaaaaaaaaaaaaaa

SEQ ID NO: 15424 - DNA, 738 bp, Zea mays
actttgaccatgggaaagcagtctctttttctagtctggttataagagcatctctattatatagttctctaaagcaacccatggaaggtccgtctctggcctacggatggaacagggtgtggggcagacgagatctcggtttaaatccgagtcagcactgcgatcggattggacccagcgaagcgaagcaacgctctcccaactgatacacccgccccgcccaccttctggcttctgctcgtctcgtgagccttagcgcttaagcttgccggctgtcgccccttataagaagctagctagccgcccgcccgccgccgtcaaactcggcctcggcagcaaactaacaaggcaacatcgtacgatcgaggagaggagctgcgttcgtggtgtgcatggcggaatcggcgatctacccggctgccggaggagtgcgtggcatacgccatctcgctgacgacgcccggcgacgcgtgccactcgtccgcggtgtcaccgtccttcagggccgccgcggactccgacgccgtctgggcgcggttcctgccaccggaccactccgacatcctggcgcgcgccgacgacccgggcgccgtcaccgccggctgcgcgtccaagaaggagctcttctcgcgcctctgcgacagccccgtcctcctcgacggcgccaccatgagctttgggctggagaggcggagcggcgccaagtgcttcatgttgtcggcgagggcgctcagcagg

SEQ ID NO: 15425 - DNA, 1117 bp, Zea mays
  misc_feature (1084)..(1111): n is a, c, g, or t
  misc_feature (1114)..(1117): n is a, c, g, or t
gggtacctcgaggccggccgggccgggacagtaggttcattcccccctaccacatcgaactgtgcgcgcgctgcgcggtcggtcgctcccctcctctgtccgcgatctcggctggccgcctgggcttggccctcgccaccgctcccgtctccggttccggcggccgagccaggtttgctcgggtcttcgtgccagcgacgatgaaggacaagcgtgggctcgaggacgccggcgacgggcgccctgatgccaagaggccgcggcctccggctctggccagtgttattgttgaagcgttaaaggtggatagtctgcagaggctctgctcatcattggaaccaattcttcgtagagtagtcagtgaagaagtggagcgcgcactgggcaaacttggccctgcaacaatcggtggaaggccttccccaaagcgaattgaaggtccaaatggaagaactctgcaactcgaattccgaacaaggctgtcacttcccctttttactggaggaaaagttgaaggggagcagggagctgcaattcatgttgttttgtttgatgctggcactggctgtgttgtatcctctggaccagagtcgtctgccaaacttgacatcgttgttctagaaggtgatttcaacaatgaagatgaggagggctggaccggagaagagtttgacagtcacgttgtgaaggagcgtgagggaaagcggcctattttaactggtgatctacaagtcacactaaaagaaggtgtggggacaattggggagcttacattcacagataactctagctggataaggagtaggaaattcagacttggcttgaagattgcctcaggattttgtgagggtgttcgcattcgtgaggcaaaaacagaagcctttatggttaaggaccatagaggagaattgtacaagaagcactatccacctacactgaaagatgaggtctggaggttggaaaaaatagggaaggacgggtcattccataagaggctgaacaaatctggaatatctacagttgaggatttccttaggcttgtggttcgggatccacagaaattacgcagtatacttggaagtgnnnnnnnnnnnnnnnnnnnnnnnnnnnnttnnnn

SEQ ID NO: 15426 - DNA, 1915 bp, Zea mays
ggcctcccccccggccggggatatgcgcctcggcccgttgctccgttctgagttgcccccgatccggcccacctacatctcccagctcacctcccgagtcccgacgaccgcttcgtgccttcgtttcgtccgtcccctagtccctacgaccctactccctaccgcacgccaccgcccaccagcgccgccgaggggcaaggccgaaccctcctccgttcgccgaggcggagcacgcccttccaggccagcttccaccggagcaagagctaagtcgcctcgaattcttcccagctagtagcgtgtgccgtaccccgtcgctcaaccgggatggcgtcgagtggggatccgcccggatctgctgatgagaagaaaactccaatatccgaagggtcttccgacgaacgtcaagggcttcctccagcaggcttttcaaatccttttgattttggttctatgcaaagtttgctcaatgatccatctattaaggagatggcagatcaaattgcaagggatcctgcattcaaccggatggctgagcagctacagaaaagtgctcaaagcacaggagaacagggcacacctccattaaatcctcaacaatacatggaaacaatgcaaaaggtcatggaaaacccccagtttatgaccatggcagagcgtctggggaatgctcttatgcaggatcctgctatgtccagtatgctggaaacctttagtagtccatcacataaggagcagctggaagagcgtatgtctcgcattaaggaagatccagctatgaagtcaattcttgatgagttagagaatgggggcccttctgcaatgatgaagtactggaacgaccctgatactcttcaaaagattggtgaggcaatgggagctagcttcccatttggtgcaggttcttctgctgaaccttctggtactgaagaaactgaggaagaaggtggggatgatgatgaatccatcgttcatcacactgccagtgttggtgatgaagagggtctcaagaaagcactagatggtggagccgacaaggatgaagaagactctgagggaagaagggccttacattttgcatgtgggtacggtgagttgaagtgtgcccagatccttcttgaagctggtgctgcagtggacgctcttgacaagaacaagaacaccccgttgcattacgctgctggctacggccgcaaggagtgtgtggatcttcttttgaagcacggtgctgctgtaactctccaaaacctggacgggaagacacctatcgatgtcgccaagctgaataaccaggacgaggttctgaagttgctcgagaaggacgccttcctttgaataccatgcctttcgtatacacttggactcttggtgtcatgtttttttttcataccggttgtttttgtctggatagccacatgtcatggtccttaaatctgttatgcctaaatgctattagcatgtgggtgttcgaactggcctgtaatggtctaccgttcgtgacttgtgttttcccactccatttctgatacttaagcacatatgaaaaagttgtttccggatcaaattcaatggtggtgtatcatggttatctgtcttatgcttaagagacttgaggcgacgtgacgccgtcatatttcaaaactcgagcagtagatgtatagatgatgagcaaacagagaaggggaaaaggaaaatggagtaagaagtgggctggcctaccccaccatgcagctcatgtgcccctcctctcttcatctagagttatatgtatggatgtcttgccatctcttgtccataatccttttagagtgcgtttgggtagagaatcaactagaatggtggagttttggttagagaattaactagaatggagttttggttagagaattaactagaatgaagtggctctattcta

SEQ ID NO: 15427 - DNA, 4159 bp, Zea mays
gctacccccgatgtagttagtgggagaaaaactaaaaaaatacttgagcagaacagtcctaaccaccccattactactgatagtctacatatacgacatcgacacatttgtttttgcaaacttttagacgatataattattgaaatataaatacatctaattacataattaagcaacaaaataacataatttatagaaaaattaaaaattacataactcaaacacaaaaataaaaaaacactaccttagtcccaatttacaatttctttggttttttatcctaagtttgactagctcgtcttatttatttttttttggaaaaaatgaagaattcaaagtcgtatataaagtactttataaactaaaagatatcctagaaaattaataataactataatttttaaaaaattacgacaagtcgttcaaacttggtataaaagagtcaaataaattataaattagaatgagagagtatataatttgtaaataaacttgcataccttaaacataaaaataaaaataaataattctaaataaaacctaatttatagataatattctatgatatttttagtttttagattttcctaatttttcgaatcacaaatagttaaaacggaactagttgacgtgaagtacgtgtagaccaataaaaaaaaattatgtaactaaagtcagacggtatggaccggttcatccaatatcatggtcgatatcggtagaatcgactccaatatagctgacatgatttttttaccaagtttaaatggctagtcttattcaagattttcgcgaaaaacttaaatttaaagcgggagtgtcgagttgtatttagttgtatatgttcaagaattcagagtcgatgattggttactgttgtttttttagagaatggagtagaagactttctagcctgagtcgttacaatgtgccgatgtcgactcggtcccttgctaaccccaaaaacacacacacacacacactggcctgtttattttgtggacctatagcatattcccgtggtctccccccttttgctttgcttgccgagacggcgaccatggcgaagcagcagaatcctatccccatcccgatgccgctgtcgctgtcgctgcccctcgtcctcgtcgcgctgctcctgccggccgcccgcggcgccgcggagacgccgcagtacacgacggtgcacgcggagtcggacttcgaggtgcggctgtacggcgacaccgtctggatgtccgcccccaccccggacatcccttccttccacgtcgccaccaagctcggcttccacaggtccgtacgtcgatcgccctcgaggaccaggaaggatcttgttccggtcgtctaacggtattgttgttgctggctggcagattgttccagtacctgatgggcgcaaacctcaactcttcgaggatcaggatgaccacccctgtgctcacgagtgtggttccaggtgcagggcctctgcgctcctcggcctactccgtccggctgtacctgccggcgaagttccaggcttcccctccggttcctctcccagagctgaacctgcatccagatcggtggccaggccactgcgtcgcagcgaggagcttctcgggtcgtgcacgggacaagaacgtggtcgaggaagccgagaagctcgccatgagcctgagccggtcaccatgggctaactccacagactactccagcaagagcgcttactcggttgcacagtacagcagtccattccgcatcattggccgtgtcaatgaggtgtggttcgacgtcaactgcagatctacatctactgctgctggtgttgagtcctactgaaaaaaaaacctgccagatgtgatggataataataatttgcatgtaaaacacaagctgtcctgctttattccatctcttactcctagcctacaaattgcctcagcaatcgttaaccgccgtcgtcatcatcagattggcacgtaatagctggaacacgacggcggcagccagcaaggccaggactgccgcggaaatgtacttccagtttaccatcgtcatcgtcgtcggctcgatagatcgcactgtgcattcgtctggaatcaccacctcatcggcttcaacctcctcttttacttgaacgggcctaagtacaccttcgcctgtggtaacattcttgcacagcaatgtgcgctcgctaacattttctttgcacttttgagccaacgccccgttctttttcgccagcgtaacaacctgtacagcaaggagtggttcagaaactgcccccaaggaaagtacgcattaaactgtatataaaacatttaatatcattaaagcaaccattcaacttctaggctttctatcattatgctttattagagtatatttgctttctataacatccaaatcacatacatacaccgatatacagcagaaaaaaaaagggtgataccataacctatcctaaataagaacatccgtacctgaacatgaaggcgttctctttccaaggaaagttttgcaaccaagtccatgatagtcttagttttactagcaatgtcttttgcactggacacctttagttggttagcttcatgcagtgagttttctagcctttctactcggcctctcagaaatgacagctcttcactgagttctaaattggtatctgtcaacaatgcacattttgattcagcactctcggccctggtttcagctttcaagtacttttccttcagatcttcaatcaccagttccatatcagacatggaggatcttaacataccctgttgttcaacaatagcatcaaccgatgctcttgcatgctctaactgagtgtctgattccttaagtttcgtctccaataagccagccctatctgatccctgacttttaagagtgttcaactccccattaagctgaacattcgttcgagtgagctgtgtacaccttgtctcagcattttgtgctctactttctgcattggaaatggcaagcttgaaatcagcgataacattcccaaacgcgcttatcccagattgcgctgtatcctgctcttcttcatctgcccctcttgaaagagatgattgctgcagttgagagccagagtccctcaacaattcctccagctgctgaaccttattccataaattctggaactcaggacgtgatagcacccgcatctgcacaggctcctggttagcattgttgtcactgtctccaagcactgtctccctggtgctcttgttgccacttagcttcatcaagttttcgtctaactttgatttaagatcatcttccctgcgaattgaagcacttaaataggactgggtggtattaaatttggcaacgagttcctttgaagttccaagaagcaattgggaagcattttctgccgacaacgttctttcataaagctctttgatggattcctccaagaaacatgattcttgttctgcgtgatgcagcttcattttgaggtcttccacaacagactgcgaatcacgtagcttattttcaagatctagcttgcttgctatcgactgttgtaacatctgcagtacatttctctggtcctcagcctgcatagcagtgtgacctgatatatgaccattttcatatcccataccctcactatttcctgtaaaatttgtttttttgcagtagttaggaaatgtgtttgatcaacacttgatattagattagcagtagtacgtagagtgaatgttttgagcataccttgtttgccatgtgaaggttgtatggcattctcaaaggttgcaagctgtgttctaatatcagaaattacatcttgcatctgcttcaaggactccttccgcgcgcacagctcatcggtcactctgctcccggtttctccccccaatgccttggtttcagcattgccaatatctgtctgaatagaggcagctagcttctccaactcgctgacttccgaatctacaataccgtgcaggacatcgaattcgaaagccttgccaactgacttggaagaaatggaacaagggtcccacatgagaggctcgatatcagaggctcggcgagcgatctccatgaccagcatgtctagattgagcagcttctcagatccaaacgcggtgtcacggtacaccctttccagaattgcctcggcgctagcctctgcaggcatgcaagc

SEQ ID NO: 15428 - DNA, 907 bp, Zea mays
gcacgaggctaaccccaaaaacactcgctccctcccggccccggcggattttgtggacctatagcatattcccgtggtctccccccttttgctttgcttgccgagacggcgaccatggcgaagcagcagaatcctatccccatcccgatgccgctgtcgctgtcgctgcccctcgtcctcgtcgcgctgctcctgccggccgcccgcggcgccgcggagacgccgcagtacacgacggtgcacgcggagtcggacttcgaggtgcggctgtacggcgacaccgtctggatgtccgcccccaccccggacatcccttccttccacgtcgccaccaagctcggcttccacagattgttccagtacctgatgggcgcaaacctcaactcttcgaggatcaggatgaccacccctgtgctcacgagtgtggttccaggtgcagggcctctgcgctcctcggcctactccgtccggctgtacctgccggcgaagttccaggcttcccctccggttcctctcccagagctgaacctgcatccagatcggtggccaggccactgcgtcgcagcgaggagcttctcgggtcgtgcacgggacaagaacgtggtcgaggaagccgagaagctcgccatgagcctgagccggtcaccatgggctaactccacagactactccagcaagagcgcttactcggttgcacagtacagcagtccattccgcatcattggccgtgtcaatgaggtgtggttcgacgtcaactgcagatctacatctactgctgctggtgttgagtcctactgaaaaaaaaacctgccagatgtgatggataataataatttgcatgtaaaacacaagctgtcctgctttattccatctcttactcctagccaaaaaaaaaaaaaaaaaaaaa

SEQ ID NO: 15429 - DNA, 1321 bp, Zea mays
cattgggtacctcgaggccggccgggatcgtggggacctatagcatattcccgtggtctccccccttttgctttgcttgccggtgcgcccaaggcggaaagaagacggcgaccatggcgaagcagcagaatcctatccccatcccgatgccgctgtcgctgtcgctgcccctcgtcctcgtcgcgctgctcctgccggccgcccgcggcgccgcggagacgccgcagtacacgacggtgcacgcggagtcggacttcgaggtgcggctgtacggcgacaccgtctggatgtccgcccccaccccggacatcccttccttccacgtcgccaccaagctcggcttccacagattgttccagtacctgatgggcgcaaacctcaactcttcgaggatcaggatgaccacccctgtgctcacgagtgtggttccaggagcagggcctctgcgctcctcggcctactccgtccggctgtacctgccggcgaagttccaggcttcccctccggttcctctcccagagctgaacctgcatccagatcggtggccaggccactgcgtcgcagcgaggagcttctcgggtcgtgcacgggacaagaacgtggtcgaggaagccgagaagctcgccatgagcctgagccggtcaccatgggctaactccacagactactccagcaagagcgcttactcggttgcacagtacagcagtccattccgcatcattggccgtgtcaatgaggtgtggttcgacgtcaactgcagatctacatctactgctgctggtgttgagtcctactgaaaaaaaacctgccagatgtgatggataataatatttggatgtaaaacacaagctgtcctgctttattccatctcctactcctagcctacaaattgcctcagcgatcgttgaccgccgtcgtcatcagattggcacgtaatagctggaacaccacggcggcagccagcaaggccaggactgccgcggaaatgtacttccagtttaccatcgtcatggtcgtcggctcaatagatcgcactgtgcattcgtctggaatcaccacctcatcggcttcaacctcctcttttacttgaacgggcctaagtacaccttcgcctgtggtaacattcttgcacagcaatgtgcgctcgctaacattttctttgcacttttgagccaacgccccgttctttttcgccagcgtaacaacctgaacatgaaggcggtctctttccaaggaaagttttgcaaccaagtccatgatagtcttagttttactagcaatgtcttttgcactggacacctttagttggttagcttcatgc

SEQ ID NO: 15430 - DNA, 1037 bp, Zea mays
  misc_feature (1007)..(1007): n is a, c, g, or t
aggcaagtttgtcaggcaaccgagcaagtcgggagggactccatttttcttctgacgttcaccccgagtgggcgaccgccgccgccgccgccgccccacgccaggtgcacagatcttcgtcgggcccttggccggcgacgaacgcccagcagattatcgggtatacatgcgcacaaccatgtcctttaccgggtccgcccctgccaatgatccctgcctcgccaagatcctgtccaagcaaggggacaacaaagttctctttgcggacaaggtattaaagttcacccaatctggaaagatgaaaagacgcatcctagtgatcacagactttgctctataccttgttgaccccgaggccaacatattgaagaggaggatagcacttgcagctgtggataagctatgcattagcaacctcagtgataacttctttgcgatcattgtgccgactgagtacgattgtttaatggccagcactagaaagaaggaaattgttgatgtcattgttaaggctatcaagagcacatctgagtatgaacctgaggtggcttcgtctaacaggtttgagtatcatgcagctgctgaagttattaaggtggttgaatttgaggaagtcgatggaggcacgaaaaccaggatcacgaacagggagaaatcatgattcagatctcatggatgggtggtttcctgtaaactgtatagccttcgtttttcatggatgggtggttttttatcttcacatgtcacgtgtagtgtgtaccgcaacctcaatgtcagttctttttgttttgctctgtattattttactagaaaactgcatggcgctggcgtcccccattcgcatcgagcccatgactttgtcgatgccctgtaactggacaggatcaggcaactgtttgccctgctgaacccctggaacattgttaagcttgacattcgagatagttccaacaaaaaaaaaaaaaaaagtgaaaaaaaaaaaaaaaaaaaaaactggagactagttncctcgtgccgaattcggcacgagctcgtgc

SEQ ID NO: 15431 - DNA, 1016 bp, Zea mays
  misc_feature (788)..(788): n is a, c, g, or t
tcggccgggttgtcagggccagaagaccagaaccaagcaaccgagcaagtttggagggactccatttttcttcttacgttcaccccgagtgggcgaccgccgccgccgccccacgcaaggtgcacagatcttcgtcgggcccctggccggcgacgaacgcccagcagattatcgggtatacatgcgcacaaccatgtcctttaccgggtccgcccctgccaatgatccctgcctcgccaagatcctgtccaagcaaggggacaacaaagttctctttgcggacaaggtattaaagttcacccaatctggaaagatgaaaagacgcatcctagtgatcacagactttgctctataccttgttgaccccgaggccaacatattgaagaggaggatagcacttgcagctgtggataagctatgcattagcaacctcagtgataactactttgcgatcattgtgccgactgagtacgattgtttaatggccagcactagaaagaaggaaattgttgatgtcattgttaaggctatcaagagcacatctgagtatgaacctgaggtggcttcctctaacaggtttgagtatcatgcagctgctgaagttattaaggtggttgaatttgaggaagtcgatggaggcacgaaaaccaggatcacgaacagggagaaatcatgattcagatctcatggatgggtggtttcctgtaaactgtatagctctttcgtttttcatggatgggtggttttttatcttcacatgtcacgtgtagtgtgtaccgcaacctcanatgtcagttcctttttgttttgctctgtattattttactagaaaactgcatggcgctggcgtcccccattcgcatcgagcccatgaatttgtcgatgccctgtaactggacaggatcaggcaactgtttgccctgctgaacccctggaacattgttaagcttgacattcgagatagttccaacaaggctagtctgtttggtgatgaaaaaaaaaagtcgacgcggccg

SEQ ID NO: 15432 - DNA, 2380 bp, Zea mays
ccgggacacgtgactggtggactagacaggaaaatcccaagttacgacgacttccccgagacgacggcgtaacaaggggggaaaaaaggaaaggggatcgccatggcagcgtcgccgcagcagcaaggccagggcggccctggcagcggcgggtggactcccgagcagttctggtcgctgctggacaaggcggaccgccggttcgcccgggtgcgagacctgccctccttcggccgccaggagcccgacgagttcgccaaggccttccgcgcctacacccagctctggcggatgcagcaggagcaccgtcaccgtcttctcgacgcgggcctccgccgctggcaggtcggcgagatcgccgcccgcatcgcccacctctactacgcccagtaccagcgcaccgccgacaccgcgcttctctccgaggcgttcgtcttctaccacgccgtcctcgaccgcgcctacttccaggacgccgaccaccacctcgcccccgccaaacacctccgcttcctcgccaggttcctcctcgtcgcactcctgctcggcaggcgttcgcacaccgtcccgcgtctcgcctcggacatacgcacgctcttagatgactccaaaaagtccttccaggatgccgaatacaaggagtggaagcatgtcgtgcaagagatcgcgaggttcctgcgagctgactcaccatttatgaacatgaggccgctcaggtacagctatgcattcgatccgcccccggacacgcttcgtactgtgccaactactgtcaagaagcgaggtctcgtcttaagtgacaccatactttgcagctactatcctaacgaggtcaaatttacagacctctccatagatgtattcagaatggttcagtgcctcgaatgggaaccatgtggttcatttgcgctaaacgatggttacagcgcccatgatgaaagtggacaaaatcaacccaatctattgaaagatttaagagatgctgcactgcccccgaatccacttaagacaattctctatcgcccttcggtaacacatttcctaacggtcctttccacaaaatgcgaggagcttccttcaaatggtatcatgttaatatatctttcagctacaggggagatgggaacttctggattttgtcctgatactggtgaaaatgttttgagcaactttaataagtttgacatatccagtcttagtcatactagttcaaaggaaaacaaagaaccttgtctatggttaggctgccgtgaaactgaaggttcaaattgcatataccctggtgatctaatcccatttacaagaagacctctatttttggtgattgacagtagcaccagctatgcattcaagtctattcatggtactgaaaggggggagacttctgccatgctactttcaccaagttcccgatcttccgctgcgggattcagtggcgattctactcggcacagtggtagccaatttactatgttcctcacatctccattgcaagctttctgccttctgcttggcaacaatgggacagatattgacagggatgcatataacaaagctgaggagttattattattgtccctaaatgaatgggctgcgactttagttgcatcatcttcacttcattctatttgggttgaagttttaggcgacccgctcctaagaaggttacttctcaggttcatcttctgccgagcaactcattccctgttcaaaccaacaaaccataagacagagttccttccgacctgcatgcctcctttgcctgagtctgttgatgcagagagcatgctctcccaaagctgtgtgctgcgagtcgcatcattctttggcgctgccagtcagttctcatttgctgaggttaccacatggcctgatgttgactctgaggaggctgttgtcaccagttcatctggcagtgccaacaaaggtgtgcctgagacagccagagattcagacatttcaaactcatcatcatctttttgatgcgaccatggcgctaccttcgtccgcttgtgttatttacttatctgcatatgcggatccatttgtaattactggtgctcctttatgcttgatttacacatcatgcagaactgccttgcctttttgtttcctggttacttactgaattaatagtcactagaacatttttttatcccttagtttggaggtgtggaggagctgtgtgagaaagtgtggttgaagagtgttgtttcgttactgtccatggctcggtagaatgtattccctcggtcatttcggtttttctatgtatgttttctataaaaaaaaaaaaaaaatagattagatacataataaaagttatatatgtaaaacagacaaaatggcatctaatttagaacggaaggaatattatgca

SEQ ID NO: 15433 - DNA, 6893 bp, Zea mays
  misc_feature (571)..(571): n is a, c, g, or t
  misc_feature (1499)..(1499): n is a, c, g, or t
  misc_feature (3776)..(3776): n is a, c, g, or t
  misc_feature (4215)..(4215): n is a, c, g, or t
agagaggagatattttcgaccagcgcgacatgcatggcatggcaaactatatatcgtcatcatcattattatcatctgaccctctttttttttcactctcactcccatgtttttattcccgggcggggccgtgtgggtgtgggttgggatggccggattggggtcccggggtggagaaatgacaaatccaggcccgcaggcggccacccaccaaatcggacgacgcagggtgcccaaatcaggaaggattttaaggttaaccggccaccggcggtgaccgacgccccaccccactctccttctcctattctatctatatatcacccgcctcttttttctccctcactccgccacaccttccctcttcttcctcagctccgtcgcccaccgccggagctccgaaaggccccgcgcccgccgcctttcctgtaaaaaacccaacctttagctagctaaccgctcctcttctccccctactccccttgcccaaatcagagaagatatttaacggaggaggggaaggagaggatatttagctgattgttgattggtggtccggggtacggtgttnttgagtcgtgaagcgaccgtacagtggctagggccgtctccgggttgcgtgcaggatggtcgtcagagatcgggagtgaggaggcagctcgtggtcgtggaggctaaatgtaccgcaagaacgactcggcactctcctgtttctacctcttcctcctctggttcttcttcttgaaatagaccagcgccagccaccaggtagctacctactagctagcagcccagttgcgactggggacgggctgctgcttgcaagttggaatcttggagcaggagcagaggagcgggagatggagctggatctgaacgtggccgaggtggcgccggagaagccatcggcggcgctggaggcgagcgactcggggtcctcgggctcgtcggtgctgaacgcggaggcggcatcggcgggcggcggggggcccgcgccgggggaggaggggtcaagctcgacgccggccgtgctcgagttcagcatcctcaggagcgacagcgacgcggccggcgcggacgccgacgacggcgacgccacgccgtcgccacctcgccaccaccagcagcagctcgtcacccgggagctcttcccggcgccgcagcattgggccgagctcggcttcttccgcgccggcccgcagcagcagccggacatcagggtcctgccgcacccgcacccgtacccgcccccgccgccgcccgcgcagccgcagcaggccaagaagagccgccgcggcccgcgctcccgcagctcgcagtaccgcggcgtcaccttctaccgccgcaccggccgctgggagtcccacatctggtcagtagcactgcaagctcaccatgcgccctttcacctaccgaccaataatcgcttgtgattctgacacccaaatgtttcgtcttcctgtgctgtcctgttcctcggaaatggcagggattgcggnaagcaggtgtacttaggtgagcagcaataagcagatcgatctgcagcataaatttcccgttattaactagttcgtgatctcgatcgaatggcctaattaaccgattcggtgatctggccgatggccaatctacgcaggtggattcgacactgctcatgccgctgcaaggtaacgatcaatccatccatccacccttgtctagctaccccaccgaccggccggattaatggaccgctagctctcgggacgggcttgctgcagggcgtacgaccgagcggcgatcaagttccgcggcgtcgacgccgacataaacttcaacctcagcgactacgacgacgatatgaagcaggtacatacacgagtgttcttgcagctagcaccgactgaaacatctgctgaacgtacacgcatggccctgtgcaccagatgaagagcctgtccaaggaggagttcgttcacgccctgcggcggcagagcaccggcttctcccgcggcagctccaagtacaggggcgtcaccctgcacaagtgcggccgctgggaggcgcgcatggggcagttcctcggcaagaagtaagaaacaacacttcgtttgcaggcgctgtactttgctgcagattatttcatttcatccttgcatgtgcctttcctttccatccactcacttgatggctgtagtctcgatagagttcgttcgttcgtacttcgcaccagatgaactcccacgcacatgatttagtactagttttaccatgcattgttcagtaaaagtatatgcttgcttgatcagtggttgtttcaatcagaagattaaaaaaacggaatattaatataaaaaaaaggggaagtggctagggaattcctcagtcctagctagctagctcaccggtgggaacgccatgcttggcttgggtgcaggtacatatatcttgggctattcgacagcgaagtagaggctgcaaggttgttcacctcggacgattctgccatttgttcatatacaccatgccttttgatttctctcttgcaatttctcttcttttatcatggcttttgattcccaaagggttgagtaccgactcgatattcgattctccctgccgtttcgtgaccccagggcgtacgacaaggccgcgatcaaatgcaacggtagagaggccgtgacgaacttcgagcccagcacgtacgacggggagctgctgctgactgctgaagctagcgcagaaggtaattaagtagctgctcgctgccatgtaatcttcagatgacgccgctgttaattattagctcatcagctttcggacgatgcccttgtttttcggttgaaccggggtgaactttctgaatttgagatttgattttttttgtttctgcttctgcagttgctgacgacgttgatctgaacttgagcatctcgcaaccggcctcgtcccagagccccaaaagagacaagaactgccttggtccgcagctccaccaccaccatgggcggccgtttgacggctccgccgttctgaagaaaaccaaggcaagcgctaagtaataacgctacgtaccttgacaagtatcaaaatcagtaaaactttcctcttcgtcaaaccctatctctaccgacggctgttagttgcccggttttgatcatttgacaattaaacacataccctctcgcaagtcgggatcatttttagctaggcggactagtttatcgccaagcagcgagtttctctttcggggtgggtgatcgcgacagctgagcagaatacttcttcttcgtctactttttctccttcctcctaccaaaattgaattgtttaaggaaaatttatacagagagcggcgtggacagctttggatggagctgccgataattcaactgaaaatctctcgcttcttcttcttctcatgcagatcgatgctccgtctgagctgtcgtcggcgggccgccctcaccggtcgttcctccctcatctcgtggctgccgagcatctaccgcctcggtctcaccccttcttcatcacacaccatgaggttagacgacactatacagtactgaatcatttgcaaaggtctgtcaagctagctagattggcatcataatacacggatcaggtgtcagattgttcatgcagtgcagtatgcagcctgaaggtgtatgcagtttcagatagcagatttttagcagctggttaatttctctcttgcgtgcggctgtcagtcagtgtagctctcgtcgtcgcccgctttatttccttggattctagctagagtccgcctgtcncccgtcgatttcagtgaagttaatgggatgcgcgaattttttttctcccccgtataggccggctgttgaatatatgtgtctatcttgaattggcctaatatgggaataatagtactagcagctttatggctagatcagaatatgtacatgtgtttgattttttttctctctctcccttagcttccttgaaaaggaaaggtcctagacctagctaccggccagcagcgacacttcaactctaagggcatgtacagtggagagacgccaaaacggttctccaagcataggagacaactaagagactctattgtacaatggagtgtctctaaacgtagtctattaataaatacagaattaaatgtatttgtatagcatcagatcgatagaacagacgacaaattcgtacagtgggaagtgaggcgtctgttgttacttggtntacgagccagaggcgtctcttcacggagagacggctctaagatttttttgcaaataaccccctaaaacaccttaagagcccccacattaaacaccactgtacatgccctaagccctgcctggcctgcctaatcaaaccctctcggtcaactatgctatgcctgcctgcctgctttcaacacgtactgttcctttttcaaaccttccctggaaacgaaaacagaagatgcatggtatttatgcttggggatttgccttcttttcagtgtactaataagcttggggtttgtttagtcgttcagcaatcaacttggacgagtgttgataaataaaactcgatctccaacctttcgttcataaatgggtcagctaactttgaggtcggtctcactctcacaccagtgtcgctttctgattgtattgtattggacgggaagagctgaggtcgacgcttttctgcccccagctgaactgatgggaaacgctaagctaattatattggtggaacgagtctcctgccgtttgctctcttttttgttttgtttctcttaaaaaaaacatgcttccatgcatcagaaagcgttattacttaggatgattaatttgaactgttcatcagttcgttgaattggtcctagggtgaatgaactttcagtttatttgttgaccatgcatgcagagtgatgcatcaagaagagatcccagctgggcagcagcagcagcatggaaggtgaccgcagctgcacctcctcctcctaccaccaccctgttgccgttgccgctgccgtcgacgtcgtccgctgcagcatcatcaggattctccaataccgccacgacagctgccgccgccccatcggccgcctcctcccgccggttcgacccgccgccaccgtcgtcgtcctcctcctcgagccatcaccaccaccaccaccgccgctgagaatcgaagaagccacactgtaaatctgccgggaagcggctggtggcatccggcccgctcctccctccgggcgccgcaacttttttcgatcggttttgcgccgcccgggacgggttgtagttgatcgattggattcttcataactgtatttgcgtactgcttacactacccaagtgaaatcgaaaatggcgccttctctcgttgaataaattgcacgtacgctactcgatccgctgcggctcttgctggagtggccgccgccgctatagatagaaggatcaagccaaggaatctgtcatgcatgggcatgtgaaggaggagcctcctgcaatgtttagtcttttttggtcgacgcccaccagagatatacgcactagatttcatatagctgagctagatcgattccgttgcatgcatgctccatggcgtcgagattcgagctagcaccgcctgttcatcatcgaccgatccattctgatcgattcccctctcgagctttcacgaactgaacctacctagtgagggtgacgcctaacgcctagtgcgcgcgcgtgggtctccgatgtcagtggccgcacgcgcgcgcgcgttctcgagatcgcatgtggtcatagcgcagcaggtttgccctcagaacctacagcaactcgaccaccggtttggatttcttcttttttcaaggatatgatcggagagagagagctacctaggcgtcgtccttgttttcttgtatcgcatgtggtgtgggtctctctcctcctttcgtacgcacgcatgattccattcttaccccccctcgagatcgagaggaaatatattgctattttatacacacacggcgcccccagctatacgtcactgcttacgttaattcccccaccggatagtagttgtttaatggcccaaacaaaccttgttgttgcatgcatcatggaccaaacaaaatacatagttagttaaatattactgttatatatacaactaataataattatattattagttaaaacaaagcaaggcatatgcagcagctgctggtactacccagtacatggcacatgcgtttgtttaatcccctgttgctgtgtgtgtgattgattccttgtattagctaataattagttaggtcggtcgtcgtctcccctctaatccctcttcgatttagaattagtagtcttgtacgttgtttaatatgcttggacgacgacgctctttgttgggtgtgcacttcatctttccatctacactagctagctagacacacatgtactatagctagctacttgttttagtatgctgctcttctaattaactaaccaacatgattgcactgctaagcaaggctacctttggtacggtcttaaactttgtgtggcccatatgctgctatactatatcatgcatgtagattcttcctgccaaggtgcatggtttttttatgttaataggtacggttagttgtcgtagtacatactaaggcatcgatcgtccacttatatatatcaaaccctgcagctcaaacaagctgcaaataaaaaaaaaactgaagctggtatatgagtgtatattgtatatgaaataataatgcatatgcggctgcatgcatcagggagctgagtcagatgacaggtgtaggtttgaagcagcttgctgtacgtgtgcaatttttttctctccataatgatgtctcagattggtgatctgatgacgctgtgattattctattctattcatctttg

SEQ ID NO: 15434 - DNA, 2313 bp, Zea mays
aattcggcacgaggtccttctcctattctatctatatatcacccgcctcttttcccgactgcgccgggacgcgccttccctcttcttcctcagctccgtcgcccaccgccggagctccgaaaggccccgcgctcgccgcctttcctgtaaaaaacccaacctttagctagctaaccgctcctcttctccccctacgtactccccttgcccaaatcagagaagatatttaacggaggaggggaaggagaggatatttagctgattgttgattggtggtccggggtacggtgttcttgagtcgtgaagcgaccgtacggtggctagggccgtctccgggttgcgtgcaggatggtcgtcagagatcgggagtgaggaggcagctcgtggtcgtggaggctaaatgtaccgcaagaacgactcggcactctcctgtttctacctcttcctcctctggttcttcttcttgaaatagaccagcgccagccaccaggtagctacctactagctagcagcccagttgcgactggggacgggctgctgcttgcaagttggaatcttggagcaggagcagaggagcgggagatggagctggatctgaacgtggccgaggtggcgccggagaagccagcggcggcgctggaggcgagcgactcggggtcctcgggctcgtcggtgctgaacgcggaggcggcgtcggcgggcggcggggggcccgcgccgggggaggaggggtccagctcgacgccggccgtgctcgagttcagcatcctcaggagcgacagcgacgcggccggcgcggacgccgacgacggcgacgccacgccgtcgcctcctcgccaccaccaccagcagctcgtcacccgggagctcttcccggcgccgcagcattgggccgagctcggcttcttccgcgccggcccgcagcagcagccggacatcagggtcctgccgcacccgcacccgcacccgcccccgccgccgcccgcgcagccgcagccggccaagaagagccgccgcggcccgcgctcccgcagctcgcagtaccgcggcgtcaccttctaccgccgcaccggccgctgggagtcccacatctgggattgcgggaagcaggtgtacttaggtggattcgacactgctcatgccgctgcaagggcgtacgaccgagcggcgatcaagttccgcggcgtcgacgccgacataaacttcaacctcagcgactacgacgacgatatgaagcagatgaagagcctgtccaaggaggagttcgttcacgccctgcggcggcagagcaccggcttctcccgcggcagctccaagtacaggggcgtcaccctgcacaagtgcggccgctgggaggcgcgcatggggcagttcctcggcaagaagtacatatatcttgggctattcgacagcgaagtagaggctgcaagggcgtacgacaaggccgcgatcaaatgcaacggtagagaggccgtgacgaacttcgagcccagcacgtacgacggggagctgctgctgactgctgaagctagcgcagaagttgctgacgacgttgatctgaacttgagcatctcgcaaccggcatcgtcccagagccccaaaagagacaagaactgccttggtccgcagctccaccaccaccatgggcggccgtttgacggctccgccgttctgaagaaaaccaagatcgatgctccgtctgagctgtcgtcggcgggccgccctcaccggtcgttcctccctcatctcgtggctgccgagcatctaccgcctcggtctcaccccttcttcatcacacaccatgagagtgatgcatcaagaagagatcccagctgggcagcagcagcagcatggaaggtgaccgcagctgcacctcctcctcctaccaccaccctgttgccgttgccgctgccgtcgacgtcgtccgctgcagcatcatcaggattctccaataccgccacgacagctgccgccgccccatcggccgcctcctcccgccggttcgacccgccgccaccgtcgtcgtcctcctcctcgagccatcaccaccaccaccaccgccgctgagaatcgaagaagccacactgtaaatctgccgggaagcggctggtggcatccggcccgctcctccctccggggcgccgcaacttttttcgatcggttttgcgccgcccgggacgggttgtagttgatcgattggattcttcataactgtatttgcgtactgcttacactacacccaagtgaaatcgaaaatggcgccttctctcgttgaataaaaaaaaaaaaaaagcgcccccaaaaaactcgagg

SEQ ID NO: 15435 - DNA, 1301 bp, Zea mays
cctcggtgacccgcccgtgcaccgcgtatccgctttcccccccgcccaaataaaacccgaccgcagccgccggtcgtccaggaacgccgccgccgccatggccactgccggagccttccacgccggcggcttcctcctcctcccggtccgacgaagtctccgcgggcccagcccctcaccatggtcccacttccgcacccacttcatctcctccaagccgccgccctccacccctctcccgccgcccgtgccgccagctcgcctgtcccccgtgggttctgccttcgggcctcctagcagaaagaccggcgcggttggagccggggctggcgcgggtgtcgtcgggtggtaccttggcctcttggacgcgcggcccgtgctgaccaagagcgtcaccgccgctgtcatcttcaccgccgcggacgtctcctcccagatgctcacacttggtcctgaggattcacttgattttcttaggaccatgcgtatggctagttatgggtttctgatctcaggacctagcctccatctttggttcaattttatctcaaaattgttccccaaaaaagatgtagtgaacacattgaagaagatgtttatagggcaagcagtctatggaccaattattaactcagttttcttctcatacaatgcaggattacaaggcgagactgttgctgagattattgcaagattgaagagggatctagttcccaccatcaaaagcgggcttttatactggccaacttgtgatttcattactttcaagtttgttccagttcatttacagccgctagtgagcaattcattctcatttctgtggaccatctacataacatatatggccagcttaaagaaagcagatgtggaggtggccccgagtacctaggtgttgtcgagtgactcaacatggctgttatctgtcgattcttcgtacaaggcagacttcatgtatgcctcctggatcgcggatgttatcgaccggcgattttaggctttagagagatggattgcttacgatgcatccttcacttttggttagggcatagtgtccacagggattctacttgcttatgtttttggctgaagaccattttgtttggatgatcgaattatactaggttcattgggtgggtcttctacgacgtctttcttacggtcttttgatcctatggctaagaagtacatttacttcaactaaattttctgtatctagttatggagatgcaagtgaacctgttctttgccacaaacaaaaaaaaaacacaatctatcctaaaaaaaaaaaaaaaaaagcggcc

SEQ ID NO: 15436 - DNA, 917 bp, Zea mays
atcttatcatcttcccccggggaacgtgtggcgcccgtgccccacttcatccgcgcgcgcgtcagagactcagagcccaagcatagacgtgcgccttcagcagcgcgcagcgacgtcacccgagcgcgcgacacgccccagcgtccacagttcactgcgcgcgcgtcgtgcaggacaccacaccatggcacctgccgcccctgctgccacgggcgcggcgagccccgccgtcaccaagggcggcggcaaggttgcagcacgctccgtcaggctggggctgcccgcgctgccgccgctgcccggcctcagcctcgccgcgcagggccagacccgggccgcgtcgtccttgtacaagcggctggcgagggacgtggtggccatggccgcgggggagccggcggcgcctcaggctgccaacgaggagctgaccgagttcgtcgacgcgttgaaaaaggagtgggacaggatcgaggacaagtacgcggtgaccacgctcgccgtcgccgccacgcttggcatgtggagcgccggtggagtagtgtcggcaatcgataggctccccgtggttcctggtctgatgcaggccgttggaattggatacagcgggtggttcgcgtaccgaaacctgctattcaagcctgacagggatgctttctttgcgaaggtcagggagatctacgaggatattatcagcgcttaacagatgggagcaccaatgcaaagctcatccaaattaatgaagttcactttaagacatccttctagtttgctgctgttcagttgtttttgctgtgatgtatttcagtgtagcttctaatttggtccttactcagtgcacgtatggataagtaatttggacgttaaatttagttttctggcccaaaaaaaaaaaaaaaaccgccaaaaaaaaaaaaaaa

SEQ ID NO: 15437 - DNA, 1980 bp, Zea mays
agggcgatgataaggagtcactcagctgaattacttcgggatggcgtatcactggagcaaataggtcttgatttttctccagaactcactgaaacaactgctccagattccatccggatgcttgttcaaacagttctctcagataagaaaccagaagaaattcaatcagttgtagaatcactcttgagcaaagtaattaatgaacttgagcaccgtattgcaagccagagtgaattggtgaaagaaactatggataccaacggctgtaactcagttttgagaatggagtctccctgtaacaccaatgacagtaaatcattatccagagtggaccctccacaagtggagttgacttcctgcagtgatctggagaaggtgaaagaaactatggataccaatggctgtaactcagttttgagaatggagtctccctgtaacaccaatgacagtaaatcattatccagagtggaccctccacaagtggagttgacttcctgcagtgatctggagaaggccactgaaaatattaagatggacgaagttgatgagaatgcgttgagtctgacagaagatgtaagcacattagtacatgcaccactaagcaatgataatgtaaataaaaatatgccaaagccagtgagaaattttgatcgagaggagaaacagatccaggatttgaaaagtaacatgtccacagttaagtgttgcatggagcagttaaaactgctgtactctgaagaccttaaaaagcttggtaatcagttgcgtattgtttctcatgcggcttctggatatcgtaagtttgttcaggaaaaccgcaagctttacaaccaaatacaagaccttacagccaagtcaaacgaggaaggaggtgaaggaggagaagaagttagagagctcaaagaacagattgcttgcctcagggcagcattagctaggaaagatggaggtcaagagagcattcgaagcactcaatcaagcccagacatatatagaatgagaacgggcaatggattacctgcgttgaggcacccaatagtagatggaagtatagagaacgactcggcattgggagatttcgctgagcactcgccattcgggagcagcaattcgctgccagagttgggaccagatggcacacaagatctagccttctaccaaagaagcagccctgaacagcaatggagctggtccgggtctgttgcaacagaggattccgatgacttcgaggttgcaacgaattgctcgtcagatctggattgcgtgagaccatctagtgccccaaaagcttctggtttaacaaacggagggggctcagctgcaagaaagtcccaactgaagggtgcaaaaagttcagacatcagaggagggaatcctgcaaaaaagtcatcgccgttacagaaaaagctgagtgctccctcacctacggtaactaagaagagcggaactgaaggaaagaaaactccaaatggaaaaacaggagccaagaagtaagcaactcagttgaaacttcgttttgttgggaccaacttcaccatggccggggacagataaacatgttgatcctatctactgggtgatacattggtgttttgacacacggatatgtcagtcctattggttgagagagcatgctggatcttcggccatatgctgtaaatcgcttgttaatttttgttctactagtacacgaagaaatcaaggaaaaaaaaccttgactacgggaagaaaatcacggccacaggggtattttaacctccttcctaatgcgcatatatctatcgaagttgagtaaactttgatataatgtattcatgggtcacgtccaaccaaccctgtgattggttgcttgtaaatttttgtggccttaatcatggcttcaatgatgtccttcgttaaatgtgcacctggaagaagttttctaaactcgtgcaaaaaaaaaaaaaaaaaaaaaaaaaaaaaaaaaaaaaaaaaaaaaaa

SEQ ID NO: 15438 - DNA, 3187 bp, Zea mays
  misc_feature (3107)..(3108): n is a, c, g, or t
actgagaagttaatattccatccaagagagaagatgttaaaagtatgcttgtttatcactttggcttgtacatctaaaaataactgccatattcaaacccaaaccatagtgattgacattcaaatactaagagtataccatgcgaacctacacaaatttaaggcaatctcaaaatctacagcttgtaagcatttattattgaagcatcacatactttcatttttggatgggcatcagcaagacagcaactttgtcagagaacaggatttgttaattgttaaatacgtctgagactgggttattatgtgattgacattttctataattactagtcaatatggtgagaatacaacatggtttttgtgcctgtaggataattttctatctgaaatcaatttctgtgcatgtaaaattttgcttgctttttattcttgtcttcaggtgatgtcaacagcattcatattggatctggtactaatatacaagacaattcccttgtacatgtttcaaaagctaacattagcgggaaggtcctcccaaccataattggaagcaacgtgacagtgggtcagtaaataaccttttagtatattcctgctaaatgtggagcttcatttagcctggatgatcgaccaaatttatacaactgatcgaactgtatttcttacaggtcacagtgctgtattacatgcatgtaccattgaggatgaagcttttgttggtatgggtgccactctgcttgatggagtggtggttgaaaagcacagcatggttggtgcaggatctcttgttaagcagaatacaaggattccttctggagaggttatttacttaattatgttctcatcagactgttttctactaaatgtaaaaattgcaaaatttcattatttggcagtagttttagctaatgttctttatactactaagatggaactcaaagcataatatttgtaagattagttatgtgcatgttccttctacaaaaagaacactgcaacccatttttgtgagctagaaccttagagtacatctttttttttcagcaaggaacaattgcagttacaaacaaagagtgtctggcactatgctctactgttgtctgttggtgccctactgaaagatgcttagactgatctgcctttttaggttctatgccagtattcgtgtgtgcttttttgaccagttattgccgtgttacctgcatagaactttcaaacaaacctatttggaagattctagttatctgtgtgctcaacagcccatgttgctgtgttaagtggcttagtaacttgggggcacatgtattctgcagagaacattagcatgcttattctgcaagtgccatgttatgatcagaacgtggcagtgggtcacagtgctgtattacatgcatgtaccattgaggatgaagcttttgttggtatgggtgccactctgcttgatggagtggtggttgaaaagcacagcatggttggtgcaggatctcttgttaagcagaatacaaggattccttctggagaggtctgggtcggtaatcctgccaagttcctaaggaagcttacagaagaggagattgcgttcatcgctcaatcagcaaccaactatatcaacctagcccaggtccatgcagccgagaacgccaagagcttcgacgagattgagctcgagaagatgctgaggaagaagtacgcgcacaaagacgaggagtacgactcgatgcttggggtggtccgcgagatcccgccccagctcatccttcccgacaacatcctcccacacaatgctcagaaggcggttgcccgctgaaccttttctcaacccatgcttggcgttgttgcctgttgtcttggagcattttgacacgcgttcgttctctgtttttttatgaagcccaataagattgggtcgagcactgttttaggatcgaccgcacacaacaccacctctattttaaactgcaatggacaagaagctcagggtctcatttactcatctttgacttctctctgtggagcacttgtaatcgaagatcgtgccctgttttctgtactatttcaaactgcatgcagactcctgggttccgttgcttttgctttgcttcatagatattcctttggtccttcatacaatgctcgttttatgttcaaggcactattataatttaaggactagttttggaaccttatttttttaagggatttctatctcatttttccaagggatttgtatcttcccaagaaaaattagtttatttttccttagcaaaatagaaatcccttggaaaaatagtgttctcaagcaccattttcttagaggatttctagggctaaaatagtgtttgggaacactattttttcaagagatttctattttactaagaaaaactaatttactttgaaaaagtaatgttctcaaactagctataaagttcgaattaaaataaataacacccgtcttctgcaggctttcattacaccttccttcgtttatatcgtggttagggtttgttagataggttttgaatggtgggtttaaaaatcgttagggttttgaaactatacgtaccatgttatttataagtttaaatcttatattgtatttctatagtggtattaatatacaatcgtatcgtagatgaaaaattccaatgcatctagtaaggatgctcatgttcctcttgatcttcatagtatttcaatcgagacatctagacacagttgctcgttgcttttacacatgcaatagttttaatgtatgttgtttaaacttctatttctattagattttttggtaatgtttcgtttcattcttgaaggattatgagaagtgctatattttttctagtggatcgacagtcctaataagtttgaccctcatactcctttttgataattggttgagagggatacacatgagcgttttaagcggtgggttccttctccttcgaccccgcgccaatgacggaggacctagacacaaatagacgactggaatctttgcccttgtgcaattgcagaggttgtatcgtgatatatctggagactcaacatcactttgtatgtctcaataataattatgcgtgtttataacatatgtccgcaatnntaccagtttggccataaatttattaatgtatctccatgcagccatatggtgggcgtaagtgctttttcaagagtagttg

SEQ ID NO: 15439 - DNA, 1439 bp, Zea mays
ttgggtacccccgggcccggccggccatcgaccgcctggcctcctctccctacccctacgggtccagtggccactgcctcttgccgcaggcagccctcttctctctcttccgccgtctcgcctcctcacgccattaaaccccacccgcgcgcgcggcggccggcggcgagccctcacccatccgagcaagccgaggaggaagcgagcgcgcgaaagtatcaggaggaggcatgggtaccctggggcgcgcgatcttcacggtgggcaagtggatccggggcacggggcaggccatggaccgcctcggatccaccatccagggcggcctccgcgtcgaggaacaggtttcaaggcatcgtacaatcatgaatatttttgagaaagagccaaggatccatagagatgtgtttgttgctcccagtgcagcagtcattggggatgttgagattggtcatggatcgtcaatctggtacggatccatattgagaggtgatgtcaacagcattcatattggatctggtactaatatacaagacaattcccttgtacatgtttcaaaagctaacattagcgggaaggtcctcccaaccataattggaagcaacgtgacagtgggtcacagtgctgtattacatgcatgtaccattgaggatgaagcttttgttggtatgggtgccactctgcttgatggagtggtggttgaaaagcacagcatggttggtgcaggatctcttgttaagcagaatacaaggattccttctggagaggtctgggtcggtaatcctgccaagttcctaaggaagcttacagaagaggagattgcgttcatcgctcaatcagcaaccaactatatcaacctagcccaggtccatgcagccgagaacgccaagagcttcgacgagattgagctcgagaagatgctgaggaagaagtacgcgcacaaagacgaggagtacgactcgatgcttggggtggtccgcgagatcccgccccagctcatccttcccgacaacatcctcccacacaatgctcagaaggcggttgcccgctgaaccttttctcaacccatgcttggcgttgttgcctgttgtcttggagcattttgacacgcgttcgttctctgtttttttatgaagcccaataagattgggtcgagcactgttttaggatcgaccgcacacaacaccacctctattttaaactgcaatggacaagaagctcagggtctcatttactcatctttgacttctctctgtggagcacttgtaatcgaagatcgtgccctgttttctgtactatttcaaactgcatgcagactcctgggttccgttgcttttgctttgcttcatagatattcctttggtccttcatacaatgctcgttttatgttcaaggcactattataatttaaggatagttttggaaccttaaaaaaaaaa

SEQ ID NO: 15440 - DNA, 1107 bp, Zea mays
acatatacaaatattttaattcaattagtttgggtctaaattatgatcattagaatggaattcaattccaacgaaacaaacgaagccttagtaaaatagaaatctattagaaaaatagggttacaaaatttgccctaagaatttgatttagatcaagatctaaggcctatttggttcatttttttctgaccagcttttttgagaatctggctgcagaaagaatctggttgtgaagagaatctaagtatcgtagagatcacgtatggaagaaaatgaagtggtccaaagagttcataatctagaaagtgacatattcctactattgtgacgacttaatcggttatgtgtttatgttaattttagatggtttttactgaaacgattctcataaaaggtgattgaaaagccaaggcgattgacggtccgcatcagcttttagtggtcagaagctagaaaaagaccaaaggccctaagcatctagttgcgagatggaaagctgcttccgttaagctgcttgataatttcccctgcggatggcctttctcttggtttttcgctcacacaatttaacccagcatcaatgcatcttttaacttgttggaggttgcttgcttccaacgtcgggtacttagaagctatctgtggcatttttgtccaaatcctttgtacattgtcgataaggttcttagacgataagtctacagtgttagaatcgacttttaaccctgttactatctcgattataaggatgcccagactgtatatatctgatttggttgagacttcacctctgtagtaatattctggagccatgtaccctcttgatcccacatcatttgttgtgggtgcacgtgtttgctcttcgccaaagagccttgataaaccaaaatcggcaattttgggcattaagttatcatccaacaatatattgccaggtttgagatccatgtgaattatgggtctttgcgattcatgtaagaactgtaaaccatgacaaattccttgtattattttgaagctgatattccagttaagctcatgagatgcacctctaagaaatcttaagatgaaatgggtaaggcgatgtgccctcgtgccgaattcctg

SEQ ID NO: 15441 - DNA, 1455 bp, Zea mays
gcacgagaccattacctagaacatcctaatcgaaaactcggacccaaaccccaacatccatctcttcgatctccttatcccttcccgtcgcataaacccccgccgccgtgacctcgcagcgaccctgccctcgttctaggctttcattgcaggcctcgcgtctccagtggcagggcaagagaaaggagaggatggcgtcgccgataccgcgcgagtgggtcgggctgcagcagtttccggcggctacacagaccaagctgcacgaactcctcggcaaactcaaggaggaggatgtgagcacattaacaattctggtgatggggaaaggtggagtgggaaagtcatccactgttaactccatcgttggggagagggttgcctctgtcagcgctttccagtctgagggtctgagaccaatgatgtgctcgcgcacaagggcagggttcactttgaacattatcgacactcctgggcttattgaaggtggatacattaatgagcaggccgttgacatcattaagagatttcttctaggcaagactatcgatgttctcctgtacgtggatcgtttggatgcgtatagaatggatacactggatgaacaggttataagagccatcaccaattcatttggaaaagatatttggcgaagatcattggttgtgttgacccatgcccaactctcaccacctgatggaatcgactataatgatttctttacaagaagatcagaggcacttttgcgatacatccactcaggagcaggaatcaacaaacgagaatatggggatttccccttgccaatagcattggtggagaacagtggaaggtgcaagactaatgagcatggggagaagatacttccggacggaactctgtgggttccaaacctgatgaaagaaattactgttgtcatctcaaacgggagcagtcccactcatgttgatcagaagttaattgatggtccaaaccctaacaatcgccgaaagttgttcataccacttatccttgctgtggagtacttcttggtggtaaaaggaatccggagggcgatccatgcagatatcgcaaacgggaaggtagatgactgggagcagcgttaccgggacctggtgggaagcagggacctcgtagagcagaaaggttctacctcccggaaccgcaaagcctaagttggtgtaccagaaaggattctattcgtgttgagacccacccactcgatctgctgctccttttcctaaatctgtgctgggggctttatagagttcgctggtactacttgaaaaaaaaatgctcctgttgtagttgataagattatgtttcccattttatgacgattggccgtcttcgcaattttgaagatgttatcgaatacgtgttattttattgttttaaattatatatggcatggaaacagcaaaaaaaaaaaaaaaaaaaaaaaaaaaccaaaaaaaa

SEQ ID NO: 15442 - DNA, 1469 bp, Zea mays
gaaaagcggggaaaagaaaaaaagaaaaagttcccgtcttcggtcttcccaaacccccaacatccatgatccatctcatcgacaccccctccgctctccttatcccttccattcgcccaaacccccgccgccgtgacccctgccagcccgcggccttcccctcgttctaggcttcaactgccggcctcgtgtcttctgggcaagtgaagagagagatggcgtcgccaataccgcgcgagtgggtcgggctgcagcagtttcctccggccacccagaccgagctgcacgagctcctcggcaagctcaaggaggaggatgtgagcacattgacaattctggtgatggggaaaggcggagtggggaagtcatctactgttaactccatcgtcggggagaggatcgccactgtcagcgctttccagtctgagggtctgagaccgatgatgtggtcgcgcacaagggcagggttcaccttgaacattatcgacactcctgggcttattgaaggtggatacattaatgagcaggctgttgacatcattaagagatttcttctgggcaagactattgatgttctcctgtatgtggatcgtttggatgcgtacagaatggatacacttgatggacaggttataagagccatcaccaattcatttggaaaagatatttggcgaagatcattggttgtgttgacccatgctcaactctcaccacctgatggaatcgagtataatgatttctttacaagaaggtcagaggcacttttgcgatacatccactcgggagcaggaatcaagaaacgagaatatggggatttccctttgccaatagcattggtagagaacagtggaaggtgcaagactaacgagcatggggagaagatacttccggatggaactccgtgggttccaaaactgatgaaagaaattactgttgttatctcaaacgggagcaagcccattcatgttgatcagaagttaattgatggtccaaaccctaacaatcgctggaagatgttcataccaattatacttgctgtggagtacttcttggtagtaaaaggaatccggagggcgatccatgcagatatcgcaaatgggaaggtggatgactgggagcagcgttaccgggacttggttggaagcagggaccctgtggagcagaaaggttctaccacccggaaccgcaaagcctaagttggtgtagcagaaatgattttattcgtgttgtgacccactcgatctgcttgctgttccttttcctaattatgtgttgagggctttatagagttcgctggttctacttgaaaaataattgctcgtgttgtagttgataagaatatcttttccattttatgatgcttggccctcttcgcaattttgaatattgttatcaaacccctgctattatgtttagcaagttgttaaatagctattggagtaaaaaaaaacaaaaaaaaaaaaaaaaaa

SEQ ID NO: 15443 - DNA, 2894 bp, Zea mays
  misc_feature (180)..(180): n is a, c, g, or t
  misc_feature (186)..(186): n is a, c, g, or t
tctcctcctggacccgcctcattgattgttcctccccacggagccgtttttcaaacgacgattatggaggaatttggcgggtgtcacaggactggacagaactcagattgtctctgtattgttcattcagatcgggcctctgtgccaaacatgcaagacccgagggtcccaatcaccaangctgcncaggtcagggacccctgggaaattatcaagcatagtctgcaagtaaagccaccttgtttgaaggtgtactctagaaggaaagatgccacaccggttcactcccaggcagtgtcctcggcagcctcgacccccttgcaagaatttagtcaacacatctccaaggccattaatggtctgttgagcccgccaccggtccctaaacgcagaaagaggacccttccaagaaatttcaagcctaggaggtccagaagggtggccaagttcccgcctgagttaggctccgatgctgcagtctctgtttgcaagaagttgggattctgtgatgggcatggcaatatctctctggaagacgctagcagatatgctgctctatataattcacccctgtccagagagcacatcgctgcattggcagctctgtttggttgggatgcatctgagctcgcgtaagcttggatcgtttggtctggtcgtgtttcctttttctcaatggaccagtgcagctttctaatttggaatgtgagaggattgaatagtagggctaggaaagataatgtcaagaccttagtcctggacttcaagccttcacttatctgtttgcaggaaaccaaaatgagcaacatttcggactttgatatcctttccatccttggtgctggttacagtaattttgttttcagtccagcacaggggacaagaggaggcattttagtggcttggagagatggaattttcacccacagcagtcatgtgatcagggagttctcggtctctattcaactgcaggaggcttcaggcccactatggtggttcacaggggtttacgggccacatcaagataatcttaaacaggcttttctacaagagttaagtgaagtcagggcaggctgtgatgggccttggatcttggcaggtgattttaatcagatttccaggtctgaggacaagaacaactcctgtatcaacagggccctgttgagaagattcagaagatggatagatgaaaaggagctgaaagaaattcctttgattggaagaagatacacctggtctaaccagagacaggcccccactcttgttaaattagatcatgtcttctgcacttcgagctgggaagggttgttcccagcggctactttattcagcaaggcctcagaagattctgatcattgccctttgattttaaagctgcgtgaagaagaaggtacggggaaaaggagatttcatttcgagagtttctggaccaaaatgccaggctttcgtgagttggtggcagattcctggagccagccacttccaatttgtggtcatctggagaggatctctctgaagctcaagaggctaaccagagccctgcagtcttgggggcacaaaacagtgggcaacattaaaattcaactgggtttagcaagagagattttacacaggctagaaatggctcaagacagcagggtgttatccccagatgagttatggctgttaagaaaactcaagcaacaatgcctggtccttgcttcactggagagaactgttgcaagactcagatctcgagttcagtatctgaaagatggagatgccaacacttccttcttccatatgcaggcctgctgtcgcaggaaaagaaatcatatatatagcttactggatggtgagagggtggtcacatctcatgatcaaaaacaggaggtgctgcatgatttttactctaatctgttggggtgtgccccccagagaaggctaactctgaagcttgaagaatgtcacagagatcctatagatttgtctgctcttgagctgccttttacagaggaggaagtgtgggaggctattgccagtcttccttcagataaagcgcctgggccagatggctacacagggagattctacaaaacttgctggtctataattaaggcagatttgatggctgcccttgctgcccttcaccttggtaattcacaaaagtttgggcctctgaacacagcatatattactttgatccccaagaaggcagaccccatatctgctggtgattacaggcccatcagcctcattcacagctttgctaagctgtccacaaaggtccttgccaataggcttgctcctctcctcaacaagttggttgaggctaatcagagtgcttttattaggggcagatctattcatgacaattatatgttggtccagcactcaattaagtccttgcacaggagaaaagtggccagcctttttctgaaactggacttaacaaaggcatttgattctgtttcctgggcattccttcttgaggttttatcctaccttggttttggtaataggtggaggaatcttatttccaatttgctggctacttcctcgactcaaatattattaaatggatttcctggggagctgattagacatcgcagaggtttgaggcaaggggaccccctctccccaatgctctttgtcctggtgatagatgtgctcagtagccttttcagagtggcagaagaaaaacaattgttgtctagtctggaaggtgccattgtgaagtccagattatctctatatgcagatgatgtagtcttgtttgtcaagcccagggaggaagagctaaactgtgtcaaactcattcttgactgttttggagaagcttctggcctagtaactaatttacacaagagttgtgccatcccaataagatgtgaggatgatttgctgcagggagg

SEQ ID NO: 15444 - DNA, 1758 bp, Zea mays
gcacgcgttgggtacctcgaggccgggccgggacttctcttcccaattcccatagatcgatcgccgacccctcgagcaacgcgatcgcccgccgacccgacggcggcatggacaccgagtccttgcagcaggggagctcctcgtcgtggcacacgacgggcgccgtgtcgtgtggagccgcgcagcagcagaagcgccagcggtgccagggttcttccagcgatcaagctggttccagctcaagtagttctctgcaaatatcagaaccagaaccccaacaaatccaagaagaagaggattactatatggaggatgattgtgatgatgattttgatggctacgacgaagatgattatgacttcgatgaagctgactttaaccagcaccttgctgataaatttgatgatttggatcttcctccaggcgtggaggccaccgtaccttggttgcagaaaactacacccaaggaagatgtcaaagagccacctaaatcaaatactgcagatgagaatgcaaataaatatacgcagttcaagcagtttgatactgttcagaatttctctgaccattactacgctaagaattctcatggagagccaaacagagcctggtcaaagagagttcaacatgactggaaacttctggagaaggatctaccagcgtatatttttgtccgggttgctgaagatagaatggaccttcttagggctgcgattattgggcccaagggaacaccttaccatgatgggcttttcttctttgatattcacattccctctgcttatccttgtgctcccccgctggtatattaccactctggaggacttcggattaatccaaacttgtataacaatgggaaagtgtgtcttagcctgttgggtacctgggatggtagaggttgtgagaagtggaatccagctcaatcgacaatgctgcaagttcttgtctccattcaagctctgattttgaatgacaagccatattacaacgagccaggatatgagtcctatgccaacactccgaatggagagcggttggctttggactataatgacaacacctttctgcactcatgcaagactatgttatactcacttcggaggcctccagagcactttgcagatcttgtcgctggccactttcgggtgcatgggcacacgattctcgcggcatgcaagcactacatggcgggtaatgatattgggtcagtggtgccagaggaggaggaggaggaggaggaggaagagtcatcagaacacaagagcggtgatgctggagcatcgggtagtgcaccagagctaggagtgatcaaggcaatccctacgaagagacgcagctcattcaatccaagcttgaaggtgctgtacgaagatctgctgatggaattcaatgtgaagggtgccgacacaaggaaattcatcgatgagaagttgaagaagaacaaacctgcagccgcctgaggaacatgcttgcaggcaaagcttttgtaggtataactggtcttggtggtgatatctaggacctggaacttgcttgctcacatgtagtagagagtatggtttaggggtggagtgctgagagagttctctctcggcactatttatcgccaatctaaatctaatgataggtttaccgcatcataaatatatatgtaacggctatatcgtctttcgctgattgttctggcatatcatgataggtttaccctaagaagaaaacaaaaagccgaaagctaagtaccaattggtttggaactgt

SEQ ID NO: 15445 - DNA, 713 bp, Zea mays
atcacaaacacctccgatccgtccccgatcatcgcaccacctgtagcccaggtcgggctcggcgccgacctggtccgcatcgacgcccactccatgtgctccccgggcttctcgtgcgactcggcgtaccaggtcacgtacatcgtgcgcggaagcggccgggtgcaggtggtggggcccgacgggaggcgcgtgctggagacccgcatcgagggcgggtccctcttcatcgtgccccgcttccacgtcgtgtccaagatcgccgacgcgtccgggatggagtggttctccatcatcaccaccccgaaccctgtgttcagccacctggcggggaagacgtcggtgtggaaggccatctcgccggaggtgctgcaggcgtccttcaacaccactccggagatggagaagctcttccgctccaagaggctcgactcggagatcttcttcgcgcctcccagctccaactgaagcaccagctctccaagacgggggagaggatcgttctcgatcgtcgtcaaggtcatggttattaataagggtctattaataattaagttagcgtcgtcgtcttaagttagcgtcgtcgtcttaagttagcgtcgtcgtcttttagcgtcgtcgaagtcagggtagagcgagatgtagagaggtcgtctgtcatccgccattgaactggaactgctttttcaagatgaatactacccctctttcct

SEQ ID NO: 15446 - DNA, 1489 bp, Zea mays
tggcttcgcgagccctccgccgcatcacaaacacctccgatccgtccccgatcatcgcaccacctgtagcccacctcgctctcgagtctcgacccagcgacgagatggccgcggtggatctgaccccaaggacgcccaagaaggcctacggcggcgacggcggcgcctactacgagtggagccccgccgacctgcccatgctctccgtcgcctccatcggcgccgccaagctctcgctcgccgccggcggcctctccctccccagctactccgactccgccaaggtcgcctacgtcctacaaggcgtcggtacctgcggcctcgtcctgcccgaggcgacgaaggagaaggtggtggcggtgaaggagggcgacgcgctggcgctgcccttcggcgcggtgacgtggtggcacaacggccccgccgcgcaggccgacctcacggtgctcttcctcggcgacacctccaagggccacaagcgggggcagttcaccaacttccagctcacggggtccgcgggcatcttcacgggcctgtccaccgagttcgtgtcgcgcgcgtgggatctgccggagcccgacgccgcgaggctggtgtcgagccagccggcctcgggcatcgtcaagctgcccgcctccgccgccgcgctcccggcgccctcgccgcaggaccgcgccggggtggcgctcaactgcctggaggcgccgctggacgtggacatccccggcgggggccgcgtcgtggtgctcaacacggccaacctgccgctggtgcgcgaggtcgggctcggcgccgacctggtccgcatcgacgcccactccatgtgctccccgggcttctcgtgcgactcggcgtaccaggtcacgtacatcgtgcgcggcagcggccgggtgcaggtggtcgggcccgacgggaggcgcgtgctggagacccgcatcgagggcgggtccctcttcatcgtgccccgcttccatgtcgtgtccaagatcgccgacgcgtccgggatggagtggttctccatcatcaccaccccgaacccggtgttcagccacctggcggggaagacgtcggtgtggaaggccatctcgccggaggtgctgcaggcgtccttcaacaccactccggagatggagaagctgttccgctccaagaggctcgactcggagatctttttcgcgcctcccagctccaactgaagcaccagctctccaagacgggggagaggagatcgttctcgattgtcgtcaaggtcatggttattaataattaagttagtgtcgtcgtcttaagttagcgtcgcgtcgtcgtcttaagttagcgtcgtcgaagtcagggtagagcgagaggtagaggtcgtctgtcatccgccattgaactggaactgctttttcaagatgaatactacccctctttcttaatcaaaaaaaaaaaaaaaaagaagttgtgtctgggatgttcgattgtttggccctttaggcgcatgatgatt

SEQ ID NO: 15447 - DNA, 1446 bp, Zea mays
cctgtgtggacccccccggcccggaaaacacccacttcacctccgaccacttcacctccgatcccgccaccactacccaccctttcctttgacgtcccgatggcacctgtagatctaacccccaagcagcccaggaaggcctacggcggcgacggcggcgcctactacgagtggagccccgccgacctgcccatgctcggcgtcgcctccatcggcgcagccaagctctcgctcgccgccggcgggctcgcgctccccagctactccgactcagccaaggtcgcctacgtcctccaaggcacgggcacctgcggcatcgtcctcccagaggcgacgaaggagaaggtggtggccgtgaaggagggcgacgcgctggcgctgcccttcggcgtggtgacgtggtggcacaacggccccgccgcgccgaccccgctcacggtgctcttcctcggcgacacctccaagggccacaggccggggcagttcaccaacttccagctgacgggcgcgaccggcatcttcacgggcttctccaccgagttcgtgtcgcgcgcgtgggacctgccggaggcggacgcggcggcgctggtgtcgagccagccggccgtcgggcatcgtccgggcgtcctcgtccccgctgccggcgccgtcgccgcgggaccgcgagggggtggcgctcaactgcctggaggcgccgctggacgtggacatcccgggcgggggccgcgtcgtggtgctcaacacggccaacctgccgctggtcaaggaggtcgggctgggcgccgacctggtccgcatcgacgcccactccatgtgctccccgggcttctcgtgcgactcggcgtaccaggtcacctacatcgtccgcggcagcggccgcgtccaggtggtcgggcccgacggggtgcgcgtcctggagacgcgcgtcgagggcggcttcctcttcatcgtgccccgcttccacgtcgtctccaagatcgccgacgcgtccggcatggagtggttctccatcatcaccacccccaacccgatcttcagccacctggccgggaagacgtcggtgtggaaggccatctcggcggaggtgctgcaggcgtcgttcaacaccacgccggagatggagaagctgttccggtccaagaggctcgactcggagatcttcttcgctcccccatccaactgagaaaataggccggaagccccacggtggagtcctctcgttaggtcgtcgtgcttagattaggttagctagcttgcctttaataaaaagagagtggtggtcgtcggcgtcggcttcggcggtctgcttcttcttcattcagtgcgtcggtcggtttagagtctgtcacgtgtcccgtcattgaactgcagtttttgttaataaagtattgttattattaggtattaaaaaaaaaaaaaaagggcggcccgctcgcgatctagaac

SEQ ID NO: 15448 - DNA, 1529 bp, Zea mays
ccggccggaatcacgaatcaccaacaccctctcctccaccttccatcccgatcaccgccgccaccgctttcgttccacgtcccgatggcaccggtagatctaacccccaggcagccccggaaggcgtatggcggcgacgccggcgcctactacgagtggagcccagccgacctgcccatgctcggcgtcgcctccatcggcgcagccaagctctccctcgccgccggtgggctctcgctccccagctactccgactcttccaaggtcgcgtacgttcttgaaggcactggcacctgcggcatcgtcctgccggaggcgaccaaggagaaggtgctggccgtgaaggagggcgacgccctcgcgctccccttcggcgtggtcacgtggtggcacaacggccccgccgcgccgacccagctcacggtcctcttcctcggcgacacctccaagggccacaggccggggcagttcaccaacttccagctgacgggcgcgagcggcatcttcacgggcttctccaccgagttcgtgtcgcgcgcgtgggacctgccggaggcgaacgccgcggcgctggtgtcgagccagccggcgtcgggcatcgtcagggcctcgtccccgctgccggcgccctcggcgcaggaccgcgagggggtggcgctcaactgcctggaggcgccgctggacgtggacatcccgggcgggggccgcgtggtggtgctcaacacggcgaacctgcccctggtcagggaggtcgggctgggcgccgacctggtccgcatcgacgcgcactccatgtgctccccgggcttctcgtgcgactcggcgtaccaggtcacctacatcgtgcgcggcagcgggcgcgtgcaggtggtcgggcccgacggggtgcgcgtcctggagacgcgcgtcgagggcggcttcctcttcatcgtgccccgcttccacgtggtgtccaagatcgcggacgcgtcgggcatggaatggttctccatcatcaccacccccaacccgatcttcagccatctggccggaaagacgtcggtgtggaaagccatctcggcggaggtgctgcaggcgtcgttcaacaccacgccggagatggagaagctgttccggtccaagaggcttgactcggagatcttcttcgcgcccccgtccaactgagcaaataggcggaagcccacggtggagtgctctcgtgaagtcgtcgtggttagattagcattagcttagctcgccttaataaagagagaatggtggtggtcctcggctcactgcttcttcagtagcttcagtcgttcagtggttcagtcgttgcgtcggtcggttgtcgtgtccgttcgtcgaactgccaagttttgttaattattattattgtcaccctctgttttgtctaggtctagggctggaaaaaaactttaagccgcggcttgttcaggctcgcgagctatattgttttaattaatctataaaataataataaatattataattctatagataaaaaaaaaaaaaaaaaacggcacgag

SEQ ID NO: 15449 - DNA, 478 bp, Zea mays
ggatttaaaaactggaacggtgaaggtgacagcagtcggttggagcgagcatcccccaaagttcacaatgtggccgaggactttgattgcacattgttgtttttttaatagtcattccaaatatgagatgcattgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttacaaaaagagtaaatgaacaa

SEQ ID NO: 15450 - DNA, 334 bp, Zea mays
gccgaagtatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaagtgtctgacggcatcca

SEQ ID NO: 15451 - DNA, 379 bp, Zea mays
gattagcgtagtcactctgaattcggctggaacatgaatccactcctgatccttacctttgtggcagctgctcttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcac

SEQ ID NO: 15452 - DNA, 2321 bp, Zea mays
ccggccggggaactgcgggttgataattcggctgcaaacaattttttccccagaacctcagccttccgacatcaccgccgacgccatggccggctctccccgccacctctccctctttcccctgcgcctcctgttacttcttccgctgctcgctgcgggtaaacccgtcctcgaggacggttacacggtcaccaccttcgccgacctcaacccgctcccggcctccgggccacacccctacgcagtcctcccgcggtcccgcgccggcgacctcctcctcctcgactccgccggctccgcgctctacactatctccctctcctcctcccccggcgagccgcgcaggctggcagggggcaaacgaggctccgggttcaacgacggcgggcccggcgacgccgcctttgaccgcccgcgcagcgtcgccgtcgatgccgccgacaacgtatacgtcgccgaccgcctccatggtgccgtccgcaaggtcgcgccctccggttacactactacaattgctggagggttctcatcagggcctggtcacagggatggaccagcacagaatgctactttctcgccagattttgcacttgtttatgtcccgaagatttgtgccttgttagtagctgacagaggaaatcgaatggttagacaaattaatctaaagccagaagattgtgcacatgaaaaacaatcaggcttgggaaatacattggtgtcgttcattgcagtattgtgtacattgctcggttcattgatcggattcttagctcgtcatttttaccctgtcaatgcaggaagtctccgtcaaccactttttcagcaggatacggaagcaattcctgaggacacagaggaaggcaactccgatcagcttctgcgacataaaaagcgcagttgctagcttcgtgccctacaccctcctgctgaaactagtaagacttggttccggttatctacacgtgatgttatctagtgttaggttacagcaagaagttcaccgaaagccttctcgtcgacctgagttacacaagaccatcaatgctcctaacattggtcttaacaacaaagctcccgttcctcctactgagcaactgggtgatctgataagctttgccggagatgctggtgttaaggaggatagtggtaatgccgatagtcaggagggtaaggtgtcatcctatcatggtgacttgatggggcttccctacaccccaccgtgcagcgttaagaaaattgatcacatgatagaggccaacctatcgagcttttcaagtcacgagaaacgttgtagattaactgttagtggttgtagtgtaagcaggagggtgcatggagacaaataagagggtgtttggtttgatcatgacatgtaatgttaccctgggcattgtgggttcgtgtgatgatgcctaagaattctgttctggcataacagctttgtagcaaacccaattactccataatgttctcttattgcctggatgatggagaaaatatggacgattgatcctgtctaaagcttatattgcttaagggattgagtttttgttggcagagctcctctggtctgctccagtcggctctggtggccctagtacctttgtgtactgtaggcagaagttatttttatatcgtctattgaaatagacagactaaacatgtctgcttgttgcaactgatccatccaatacatcgttgataatcgctagatgcgagttaggacctgtttgatttcattagttttaagactaaagttcctatcctgtttggtttagaactaaagtttagtctagtccctaccctgttatcctatttggttatttggttgtaaagactaaatatattctaaatacattaaattcaacatataaagacctaaatacctcttttcttgtttcctatgtatgacttcagttttctaagcaagtgtaattagagtaaatattgtcctttaatcccttttagcacctatgtgagggactacagactaacgttaattagtccctaatttagtcttgttgggcaaaataggaattaaatgagactaaacaccatggactaaagattagttttggtagttatgagactaaagtttaatccctgctttgtttggttttaaagactaaagtaaacattaagggactaattgtttatctttgaatgactaaagtaaattttaaattattgaatgttttttcttgaaattttttaaaccttaaatgaataaatatttgttcctgctatacataaaagtaaaccttgaatgaccgaataaatcgtgaatggctgaaaaattgttggtgtgtgctacggggtgg

SEQ ID NO: 15453 - DNA, 300 bp, Zea mays
ccatgaatcacactgtccaaaccttcttctctcctgtcaacagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggctaatg

SEQ ID NO: 15454 - DNA, 1460 bp, Zea mays
cagttctcttccctctctgcgcaccaagaagaggtgtcttgccagaagggagccgcctcgccgcagccgaaggccacccatgcagccgagcggccgcgaaatgcagggcggcggcggggcccaggacgacttcttcgaccagatgctgtccacgctgccggccgcgtggtccgaccttggctccggcaagtcgccctgggagctccccgcggcggcgggggccgtgaccgaggacgccgccgcgctcgacgagcctgcgctcctcgcgtcgcgcctccgccaccaccagatcggcggcggggagaagcccctcatgctccacctcagcgacctgcacggcctcggcgccggcgccggcgccggcgacgacgcggggttcatgccgctaccgctgttcacccagcacctcgccagggacgacgtggacgccgccttcaagtcccccaatgccgccggaggcgaccgggagctgtacaacgggttcggagccgctgggaatatgcacaccgccgccgtgcatcagccgccgccgttcgggcagggcgggtcaatgccggcggcgcagagcttcgggggtggcgggccggcgccggccgccggagcggcgtcgggcggaggtgcgccgccgcggcagcagcggcagcgagccaagagggggcaagccactgaccctcacagcatcgccgaacgtctacggagggagaggatagcggagaggatgaaggcgttgcaggagctggtccctaacgccaacaagaccgacaaggcatcgatgcttgacgagatcattgactacgtgaagttcctccagctccaagtcaaggttctcagcatgagccggctaggcggagcgacagccgtcggcactctagttgccggcatcgcatcagagggcaacgggagtggagatggcacgagcgacagcggaaaagggaacgccgccaacggcgagaacggcggtggtggcagcctgcaggtgacggagcagcaggtggccaggttgatggaggaggacatgggcaccgccatgcagtacctgcagggcaaggggctctgcctgatgcccatctctctcgcctccgccatctcctccgccacgtggccgtccctcctatcccgcccctccatgggcgcaatgggagacgctagaggtcccctgcacgacggcggcagccctgcgtcgccgccactggtgaattgtggtgatgattccagcaccgtcaaggatgccggtgccggcggtaagcggtgaaggcaatgatcttgtcttgagaggttgcgtgtgaaagatcaacatgtccaagtgaaaaatgaaatgaattgggctaaaagttctggcaacaattaaatcttatcaaattgtctatttcactctttattattgaataggctacttcacttcttatgtctaataatattttccatcttatgtacaaaaaaaaaaaaaaaaaaaaaaaaaa

SEQ ID NO: 15455 - DNA, 3718 bp, Zea mays
  misc_feature (1933)..(1933): n is a, c, g, or t
  misc_feature (2438)..(2438): n is a, c, g, or t
  misc_feature (2444)..(2445): n is a, c, g, or t
cgcccctgtgcagagggcaccgccacggttcttgttgagtgtttggctctccgaaaaggcgtcaacagttagtttaagacttcttttggagttattcttaaccaagtaccgcagactggttggaccagtctctgtgtctcacccataaggtccgtatcggcggcggcacctcggctgtactccgcctccacgacgagctagctgcctggtagtgacagagatagaccttccgtgtcaaatggttcggaaaatacctcgccgttaggtttgggccgcgtctctgatccatcggaaaacccaaatcacgcccacgcccacgcccacgcccaccggtccatgtgccgtgccgtgccgacgccgctcgctgcctcgctcctccgtgcattcaatcagactcggtgatcttccagccgcccgcaagaacaaaccgacgcggcgtggctgacactcgtcgacccatcccaatagaaaaatcggaaccgtccaagcccgcctcctataaactaaccaacgaccaaccttcctcagcccggcccgggtggcagaggcagtccccagattcattctcttctcgctgcacgccgcactgcgccagcgtcagcatgggcggctgcggcctcggacgcggccgccgcaccgcctgcctgctgctgctcctcccgccgcttctcctgttcgccgtggccgatgccgccgcctcggggaaggagaagcagggggtgtccggtaagctgcggttccggcgggagagcgggacgttcaaggtggtgcaggtggcggacatgcactacgcggacggccggagcacggcctgcgaggacgtgctcccttcccaggtggccggctgcaccgacctcaacaccaccgccttcctctaccgcgtcttccgcgccgaggaccccgacctcgtcgtcttcacaggtcggtcgcacttatccgacccggcccgtccacaacttatttgtcgattttcatccgaacccgtaccggtagtgatggactgctggtagataggttgccgttgtcgttcagttcggtagaataagtggaaatattaatcagtcagattgtgccgtgtgcgcgatggtgatgagagagatctttgatgcactgaagttgttaaggatcgtggttgacatcccgttctggaaaaagaatctctgtagagaagtgtagcttcagccgctttgatgactagttcaagaaggatgtcacgggtttcacaatgcaagcggcagccgcaagtggcctactggagcttgtgtgcttcggactggcttgaggaattccgaatcaaaggggccccggcgacggctagcgtgctgcgtgccatgacgagtcgatgaggtcccagttgttgattggccttggatgacgacgttgggcaactggcacggtgatggatgcgtccatgactgcaatgagcactgaatggaggtgatgcatcagagggcagtacagatgtagctgcttttgcgattatatgtctaggtcactgtcatgtttcgtcgttttgtttcacgggcaattatggctgatctttccaaagccccagcttttgcaagcctgggtgttgggagaacatactctaaatttagcgaagcggttgcttttgtattgtagcaaagttattcttcctaaaccacgcacaacagtgacggtcataatatataggccatgtttagggtattaaattatgacagttttattgtgcaggtgataacatctatggtgctgattcaactgatgcagccaagtctatggatgcagcaattgctccagccattgacatgaaactgccttgggctgctgtgatcgggaaccatgaccaagagggtacgctatcgcgtgagggtgtgatgcgtcaccttgtgggcatgaaaaacacccttgcaagcttcaatccggaaggaattgaaattgatggttacgngaaattacaatttggaagtttccggggttgaagggacatccatggatgaaaaatcagtgctcaacctgtatttcctggacagcggtgactattccactgtgccgtcaatcaatggttatggttggatcaaggcttcacagcaagtctggttccaacaaacatcttcaagtctacaggttaacaagttactgacattcttttgggaaacgtgttcatcttagcccattgcactatgcttttcctttttgcctgatacaacaagctcaaacaaatcaggattattgtttggagattatttttcttcacttgtgagccatctactaccattatagaaacaatatcatagtgctaaattaaatggtgcattggtttcaacgagcatacttagaaggttcctaaaaccatgggttgatgggattagcaattgtacactaagttatcagctgtaccaagcttaactctgcaaaatgctatatttgacccttctggagtcttaagtcagggnacatgnngcttgctgaaacaaatgtatctattgttggtaatgctatagttcacaaaagtgatcataccaaaaatgccggattaaactaccaagaatgcattgacactcatttgtgtacagaagagcgtcattgttctatgttatcgaccacttttttttttttttttgcaggcaaagtatatgaataagaacccgaaacagaaggaaccagcacctggccttgtatttttccacattccactaccagagttcagcagttttacggcatccaatttcacaggagtaaagcaggagggtatcagctcagcatcaattaactctgggttctttgcctccatggtggaggctggagatgtgagagctgcctttgtgggacatgatcacattaatgacttctgtgggaagctcagtggtattcagctctgctatgctggtggatttggttaccatgcctatgggaaagctgggtggtcaagaagagcgagggtactgtctgtgcaacttgagaaaacagacagcggtgaatggcgaggtgtcaagtccatcaagacatggaagaggcttgatgataaacatctgagcacaattgactctgaggttctctggaacagaggctctaatgggaggcgcaggaaaaatcctgatggtagttaacttttgatgcagacaggaatggtgctccataagggatctctacatcggtgtgtattgttggatggccagtttactatagaatcagaaatgcagaagtgtgtacatgggggagaaggtctatacagacacatacacgcaggtttctgctgttgcatttttccatgttattagaaaataagtaatcaaaattcagtgccgttgtcaattattgcaggtggtctcatagactagtatatagtgtggtcaaaggaaaacgagaatgcaatgtcattgtagtccatctctcgtgtattgttaaactcggtcggaaagggaaaaactgttctcccggtattatattaaaaaaagacagaaacatggtttctgccgagaaaatccttgaaccctagtgcccattactagcaggctgtccccatgtaacccaggagcaggcaaagcccaacaagtggatttttttaaccatgttagaaattcgtcctcgagggaatcgaatcgaagacctagaggggttactcggaagttttaaccattaccctagaggccctttcacttatctcatgtattgttactagccccgtctagctgcaactgaaacctcagagctgccccaatatcatttttcatat

SEQ ID NO: 15456 - DNA, 1631 bp, Zea mays
ttattcggcaccaggggcagaggcgaggccccagattcattctcttctcgctgcacgccgcactgcgccagcgtcagcatgggcggctgcggcctcggacgcggccgccgcaccgcctgcctgctgctgctcctcccgccgcttctcctgttcgccgtggccgatgccgccgcctcggggaaggagaagcagggggtgtccggtaagctgcggttccggcgggagagcgggacgttcaaggtggtgcaggtggcggacatgcactacgcggacggccggagcacggcctgcgaggacgtgctcccttcccaggtggccggctgcaccgacctcaacaccaccgccttcctctaccgcgtcttccgcgccgaggaccccgacctcgtcgtcttcacaggtgataacatctatggtgctgattcaactgatgcagccaagtctatggatgcagcaattgctccagccattgacatgaaactgccttgggctgctgtgatcgggaaccatgaccaagagggtacgctatcgcgtgagggtgtgatgcgtcaccttgtgggcatgaaaaacacccttgcaagcttcaatccggaaggaattgaaattgatggttacggaaattacaatttggaagtttccggggttgaagggacatccatggatgaaaaatcagtgctcaacctgtatttcctggacagcggtgactattccactgtgccgtcaatcaatggttatggttggatcaaggcttcacagcaagtctggttccaacaaacatcttcaagtctacaggcaaagtatatgaataagaacccgaaacagaaggaaccagcacctggccttgtgttcttccacattccactaccagagttcagcagttttacggcatccaatttcacaggagtaaagcaggagggtatcagctcagcatcaattaactctgggttctttgcctccatggtggaggctggagatgtgagagctgcctttgtgggacatgatcacattaatgacttctgtgggaagctcagtggtattcagctctgctatgctggtggatttggttaccatgcctatgggaaagctgggtggtcaagaagagcgagggtactgtctgtgcaacttgagaaaacagacagcggtgaatggcgaggtgtcaagtccatcaagacatggaagaggcttgatgataaacatctgagcacaattgactctgaggttctctggaacagaggctctaatgacaggaatggtgctccataagggatctctacatcggtgtgtattgttggatggccagtttactatagaatcagaaatgcagaagtgtgtacatgggggagaaggtctatacagacacatacacgcaggtttctgctgttgcatttttccatgttattagaaaataagtaatcaaaattcagtgccgttgtcaattattgcaggtggtctcatagactagtatatagtgtggtcaaaggaaaacgagaatgcaatgtcattgtagtccatctctcgtgtattgttaaactcggtcggaaagggaaaaactgttctcccggtattatattaaaaaaagactgaaacatggtttctgccgagaaaaaaaaaaaaaaaaagagcgcgtaatttat

SEQ ID NO: 15457 - DNA, 1693 bp, Zea mays
gttggctgcccacaccgtctggttcccgttcccatgtcggagggccacgtttcccatgctcctcggtttgtgcctgcaatcgcttgctgcttagcctccgtgctgctgctttgatccagaggctgggaactccaaagaggaacagcgtccatggaggctggaggcgcaggaagtggtttgaatggggcggtgcaggcaaaggggactggggctgatggtggctctgcaaaccgctgccgccttgctgcgtcaaggccagagccgccgcgccggagtccgaggccaggtgccacgccaccgtcgtttcaggatggttcactgaaccgcgatcgcgctgtggcaaagcagcaaagttcagtattacaataacccgatgtggccaggagaggccaattctttgaaagtggagaagatcttgtaccaggggaaatcgccataccaagaagtcttagtcttcgagtcgtcgacctatggtaaagtccttgtgcttgatggtattgttcagttgactgacaaggatgaatgtgcataccaggaaatgattactcacctgccactttgctcaattccatcccctaaaaaagttttggttattggtggtggtgatggaggtgtacttcgagaggtatccaggcatagttcagtggagtccattgacatatgtgagattgatcagctggttattgatgtgtgcaaagatttcttcccacacttgtctgttggatttcaagatcctcgtgttcaacttcatgtcggcgatggtatgtagataattccatgaggctatgatgactacattattttctgatatatgctgtagcttcttgtttcttttagatattggcaaataaatactcagttcttgaactggaatttcacaagaattggtttttatctactttcagctgtggagttcttgagaaatgctcctgaagggacatatgatgctatcattggtgattcatctgacccaataggtgagcttatgctgcaacacatagtatttcttgggaacattgccatggaaatttttagctattcttgggaacattgccatgcaaattttagctatgtcttggtgttgtacatctgttctgtgcctttttctttgcttcccattgtattgttcctgaactccatgctttatttctactaggttactgcagcatagctgttctgggtttatgatgaaaaatttgcagatttttcttgcagaaaggacttcgactcatcaaaatttcaatcaaatcttactattcttatgttgcatttggcatttgcagggcctgctcaggaacttgtggagaagcctttttttgagaccatcgctagagctttgaggcctggtggtgttctttgtaatcaagctgagagtatgtggttgcatacacatttgattcaggacatgctttcaatttgccgtgagactttcaagggttctgtccgctatgcatgggctagtgtcccaacatacccgaggttcttcatattctttattgtctggtctccttacctctagtactttccctccgttttaactgtatatttgctgcactaaatctggtatattacaagttaattacctggtgcaatccactcttttggggctgtcattggcctaaagatttttttattattgatggaatggtgcatacttaaaatacaattatactttcactctgtagttttgcag

SEQ ID NO: 15458 - DNA, 1850 bp, Zea mays
cgccggccgccccgcctaggctactcgcgattttcatctcgtttcgccgccttttacttatcccatcttccctcgactgcgctctctctcccccttctctcgcgcggcaactgggccatcgccgccacccctacccaggtcttcgtcggtcgcttcgccagccgccaggtcttcgtcggcccatcccccggtcttcgtccttcaatcctccggcgacgagcacccaccagaggctgggaactccaaagaggaacagggtccatggctggaggcgcaggaaatggttcgaacgaggcggtgcaggcaaaggggagtgggggtgatagctccgccgccaagccgctgcccccttgctgcgtcaaggcgagagcggcggcgcccgagtctgaggccaagtgccatgccaccgtggtttcgggatggttcaccgagccacgatcacactgcggtaaagccagcaaggttcagtattacaataacccaatgtggccaggagaggcccattccttgaaagtggagaacatattgtaccaagggaaatcaccataccaggaagtcctggtctttgagtcgtcaacctatgggaaagtccttgtgcttgatggtattgttcaattgactgataaggatgaatgtgcgtaccaggaaatgattactcacctcccactctgttcaattccatcccctaaaaaggttttggttattggtggtggtgatggaggtgtacttcgagagatttccagacacagttcagtggagtctattgacatatgtgaaattgatcagctggttattgatatctgcaaggaattcttcccacatttgtctgttggatttgaagatcctcgtgttcaacttcatgttggtgacgctgtggagttcttgagaaatgctcctgaagggacatatgatgctatcattgttgattcatctgacccaatagggcctgctcaggaacttgtggagaagcctttttttgagaccatcgctagagctttgaggcctggtggtgttctttgtaatcaagctgagagtatgtggttgcatacacatttgattcaggacatgctttcaatttgccgtgagactttcaagggttctgtccgctatgcatgggctagtgtcccaacatacccgagtggggtgattgggtttctgttatgcgccaaggatggcccaccggtcaactttctgactcctgtaaatccaattgaagaagtggaaggagctactaaagcgggaagggagatcaggttttataattcagagatgcatatggcagcgtttgttcttccgacatttgccaagagggagctagaagcatactgtgcttccacggaaacggagcaggcggaggaagtagcggccacggcaccacaaaagctaactgcggcgcccaagcgtggaattaccaccgcatcctagctgttggatacacacatagccatgtactattattatcacgcacgtaatctaagcatcgaagtcgagtgcgtgcgtgttgggtgggggtacgcgcatcgcggtttgacgcgcgatgtatttgataataattcgtgctccgaggtaccaacaagcaacgatgagagaagcattccacctttacactccccttttaggtctggatactcattattgatctcaatccacatgagttgaggtggattgggggtgtttaacagggctttttgttttgaaagagattagagaggattaaatttctttctatacaaatttgtatatgagatttaatttttctcaatacacccttaatcgaacaaacccttagtagatcagccagatgatctatgctatgatatatatataacatgctcaagtgttttgtgata

SEQ ID NO: 15459 - DNA, 1805 bp, Zea mays
cctcgcggggccggcccggggagaactaccacggatggttcccaggctcccagcacagaatccacctccgccgtcaccaccgagcaacgcgcgccggcgcccttctatttcttccagcccctgctccgccgccgccgctctcctccccgcacccccgccctgtttcgccatcggcccatcgcgcacctgcccgtgccacctgaggctgggaactccaaagaggaacagcgtccatggaggctggaggcgcaggaagtggtttgaatggggcggtgcaggcaaaggggactggggctgatggtggctctgccaaaccgctgccgccttgctgcgtcaaggccagagccgccgcgccggagtccgaggccaggtgccacgccaccgtcgtttcaggatggttcactgaaccgcgatcgcgctgtggcaaagccagcaaagttcagtattacaataacccgatgtggccaggagaggccaattctttgaaagtggagaagatcttgtaccaggggaaatcgccataccaagaagtcttagtcttcgagtcgtcgacctatggtaaagtccttgtgcttgatggtattgttcagttgactgacaaggatgaatgtgcataccaggaaatgattactcacctgccactttgctcaattccatcccctaaaaaagttttggttattggtggtggtgatggaggtgtacttcgagaggtatccaggcatagttcagtggagtccattgacatatgtgagattgatcagctggttattgatgtgtgcaaagatttcttcccacacttgtctgttggatttcaagatcctcgtgttcaacttcatgtcggcgatgctgtggagttcttgagaaatgctcctgaggggacatatgatgctatcattgttgattcgtcagatccaatagggcctgctcaggaacttgtagagaagcctttttttgatacgattgctagagctttgaggcctggaggcgttctttgtaatcaagctgagagtatgtggttacatacacatttggttcaggatatgctttcaatttgccgtgaaactttcaagggttctgtacgctatgcatggacaagtgtcccaacatacccgagtggggtgattggatttttactatgtgccaaagaaggtccattggtgaactttctgactcctataaatccaattgaaaagctggaaggagctacaaaagctggaagggagatcagattttataactcagagatgcatagggcagcatttgttctcccgacctttgcaaggagagagctagaagcatattgcgtttccactgaaacagagcaagcggaggaaacaccggcggcaccactgaagttgactcttgcatccaggagtgaaattttcgctacatcctagctagaccaggactcgcgatgtaccacaagatatcaagaaaccattccttccttcctggtgccgtacctccagtatcgccattggttcatagtcttactatcacatgctatgagacgcataatgaggcatcatgtcagtaattcagtatccaaacaatgagatgagattggcatgctaagaaaggacgagctgatattacaatgtactcccttcaccatgtcagtaatttattgtccaaacaattagatacattgcgttatatgaaggagtttcttaggtgtatctagtgctcggagaaccgaaacgtagtatctaggttgtacatgttcacccttgtacttctacttattaagtgatgtaataaatgcagagatagtcttgctcaatacaaaaaaaaaaaaagcggcc

SEQ ID NO: 15460 - DNA, 826 bp, Zea mays
  misc_feature (45)..(45): n is a, c, g, or t
  misc_feature (52)..(52): n is a, c, g, or t
  misc_feature (63)..(63): n is a, c, g, or t
  misc_feature (66)..(66): n is a, c, g, or t
  misc_feature (80)..(80): n is a, c, g, or t
  misc_feature (82)..(82): n is a, c, g, or t
  misc_feature (88)..(88): n is a, c, g, or t
  misc_feature (95)..(95): n is a, c, g, or t
ctaattggaagcaccaccctagcaatatcaaccattaaccttccntctacantttatcatgcngcncgattctaattctncngactantcctagnaatcgctgtcgccttaatccaagcctacgttttcacacttctagtaagcctctacctgcacgacaacacataatgacccaccaatcacatgcctatcatatagtaaaacccagcccatgacccctaacaggggccctctcagccctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgatacgggataatcctatttattacctcagaagtttttttcttcgcaggatttttctgagccttttaccactccagcctagcccctaccccccaattaggagggcactggcccccaacaggcatcaccccgctaaatcccctagaagtcccactcctaaacacatccgtattactcgcatcaggagtatcaatcacctgagctcaccatagtctaatagaaaacaaccgaaaccaaataattcaagcactgcttattacaattttactgggtctctattttaccctcctacaagcctcagagtacttcgagtctcccttcaccatttccgacggcatctacggctccaacattttttgtagccacaggcttccacggacttcacgtcattattggctcaactttcctcactatctgcttca

SEQ ID NO: 15461 - DNA, 1093 bp, Zea mays
cactcctttgggcgattgggttcctcgaggccgcccggcgacagagcgaaacaatccgcagagactcggaagtcggaaagaatccctcctgttcttcgtcaaccctccagaacctgctctctcttcctctacgagactacgaccgtgtaaggacatggccgtcgagcgcttgaagaccgggttcgagcagttcaaggccgacgtctacgacaagaagccggagctgttcgagccactcaaggcgcaccagtcgcccaagtacatggtgttcgcctgctccgactcccgcgtgtgcccgtcggtgaccctgggcctgcaccccggcgaggcctttgccgtccgcaacatcgccagcatggtgccgccctacgacaagaccaagtacgccggcgtcggctccgccatcgagtacgccgtctgcgccctcaaggtggaggtcatcgtggtcataggccacagccgctgcggcgggatcaaggcgctcctctccctcgaggacggcgcgcccgacaagttccacttcgtggaggaatgggtcagggtcggcgccccggcgaagtccaaggtgctggccgaccacgcctcggcgcctttcgaagaccaatgctccatcctggagaaggaggccgtcaacgtgtcccttgagaacctcaagtcctacccgttcgtcaaggaagggctggagaaagggaccctcaagctggtcggcggccattacgacttcgtcaatggaaagttcgagacatgggaaccctaagtggccatacgtacaaatacgccccaccggacttatttgccgcgtggagtgcttaattatttgccgatatatatacacacatatacaggaaatgaccggtgagaactatactgttgtaataataatagcgaggaaaaaaatatttgcatccgggatataaaaaacacttctttacaaatagaagaaaaataaattactaagagattaatttataaatttgatatgtttttgtgggcctgcctctaggtagtagatgtgaggggctttaaaagagtgtttgtatcccgaatgcaaagaattttttccagaaaggaatacatgtgttctttgacttcg

SEQ ID NO: 15462 - DNA, 1683 bp, Zea mays
ttacctgatggatctccatctggatcagcatttgaatctcacactgccactgatgaagtatcaatgaggccacagcagatgagtggctcttcatcaagagagaatatcaagaatacctctcttagtgattcttccaacataatggtacaaagtcctctgaaagctatagggaacatgggttctatgggtgcattttggtcaactcaacatgctcaggagctatcttttgctgatgacaaggagccagcttttgataaagagcccattgatcaagtcagatcaaagcaatcacaggctaagaaccagaacacagcagctcgcaattcatctcggaagtctctgtctgcatcagttgatagttcccctggggatttcgaaattaggttttctgcaaatggctcggagtctaggttggaggaaaccaaaacggtaataacagagaataaaacaaagatacaaactactgccttcaactcctgtgcgtcagactttgataatatcaaaatgaactcacgaaacactactgacagtataaacataactagcaaattgaaagagcttcaattggaagcagaagtaactttactcaaggaacaattaaagatagcaaacctggagaaggaagaaatttcgttgaagtttgataagttgtctgccatttgctcctctcagaggcgagagatacaagagcttaagcaagctttggctgcagcttatgttacgccaccagctaaacagttcagagaaaattcaagtgttgaagtcaccccacccagcaaaagcctcgacactccgccgagggagaagattgaaggaacccctccagagctccggcaaggcctgtttacttcaagcccaggaacaccaagccctgacctgaaaacatggtcagctttccttgaagagccaaaatctcaagcagctgtgaagagtgtccaccccaggtcagtccgaactctgcgtgcatcaaacagcaacaaagccagctcgttgggacagtcaaatataagttctagcaccgatccatttgcgtttggtcaagatagttttaaggctgctccttctggaactgtacttcccctgttatcaaacatggggaatacttctcagctcagtaatctgaatatagaagaaaagaaagacggatcctaccaaccagatggatggactgggttttgattgtgctatagtaatttatgtgccaaaagagtcaagagtccatatggtcttggtggtgtggtatactgaagatgcagagaggaatgcctgaactggtgtaggtatgtgtgacaatgctttttgtacaattgttctggtcctgagctagcatcgtgatgcgttcagttgtaactgtagtgcaaatgtaagttgcaacttgcaattaattgctagatattagatataggaaggtgcttttttttccccttatgtagacaagcttgtggtgtcatgaattttggaggcatgctatatagatatagccatctattataccatatcacgaataaagggttatcatttaacaaaaaaaaaaaaaaaaactcactttaatactattcatgttgagtcacacgatcacatctttgtgactcattggggctgattggttgctggtccgtcgcgcctgtctcgtgcgagcctggtcccccagaccagcgaaggtaatttctggaggtttctctc

SEQ ID NO: 15463 - DNA, 2043 bp, Zea mays
cgctcaactcagtggatcccccgggctgcaggccccccccccccccacttatactggtttctactaaggcgaccccggcttctagattttctccacatcctggaccaagacgaagacattcttttggggaagaggagctggcataccttccgtatagaagacgagatataatgatagacaatgaaagcaatgaattacttcttcctgtcgaagggtttggtgtatcacttgaagattcttcaaaggaagaaaaaaagaataggaagggacttcttaactggttcaaactccggaaacgtgatggagcttctattctgacaagttcagaaggtgataagtccagtttgactaaatcaaccgctccttcaacacctattggggaaagcgtcaactttcctgctgaaccaagaatatcaaattcattagctggtgagaatgtatcatctgatctgtttagcattggtcatggggaatttccttctggaagcattcacggcgaagaaactctttcggccagtggaaaaacgatggaccatgttgatttgttgagagaacagttgaaaattttgtcaggggaggttgcgtttaatacaagtgctcttaagcgcctcacagaggaagctggaagaagcccaaagaacgagaagattcagatggaaatgaagaagaagaccgatgaaattaaggggaagcatcaacagatagcatctttggagagagagatagctcatgcaacattaggaactcaaggaaaggtcgatacgttagagcattcaccgtcttatcatgaactacttgagcagctcaatgagaaatctttagaacttgaggtgaaggctgcagataatagagtgatacaagatcagctgaatgagaagataactgaatgcatggaattgcatgctgaagttactcatctcaaagaacagctgtcccaagctcttgaagctaaggatttggtgtcaaatagcatgatacagaataatagagttaaccgtgaagttgaacaccttgttgatcaagatgttccaagagagatctcttctgaaccacagcaaaaacagcagcactatggtcttcagtccgttgaaatcaatgagctgaagcaaaaggtgtctgaactcatggaaatcaaagctcaacttgaggatcgcaatcaaaaccgcccgggggaaagtacatatgcaaaaggattggcttcagctgctggtgtcgaattgaaggcattgtcagaagaagtgaccaaactgatgaaccaaaatgagaagcttgcgaccgagttgtcatcgctgagaagtccaactccagctccacgcagattcaacaatggaccaagaggtactaggagggaaagcatgagtaggcgagaaccagctagcagacgagacacgaatgcaagccatgaaagggaaaaggctctagaggcattgcttatggagaaggagcaaaaggaagcagagctccaaaggaaagtcgaggagtcaaagcagaaggaagccttcctggaaagtgagcttgccaacatgtgggttctagtagcaaaactgaagaagtcccagggttatgaccatgaggatctggaggccaaacatgatggctcgtgacctcttcagtttagatatctatcggcttggcttgcgtgtgggttttctgtatgtaaggttttggtattcgttttttctcttagcatgaattagtgtctcattctgtatattctccgcgtgttaaatatgccagtagtgccttgcctgactgtgcctagagctttcgatggatgctagagcggcattttgggttcttcaggcacataatctggatttgaagaaacagtgagcaagtgtttggaaatctgacgggtttctgatgcccactcaaatatctaacatgtattagcctgcccatcctgctcaggataacaaatgtgaatatgccctgaagtgtgagctacattgtattagaacactttcgttttcaacatcttcaatactgcttattgtaaaaaaaaaaaaaaaaaaactcgagggggggcccggtacccaattg

SEQ ID NO: 15464 - DNA, 508 bp, Zea mays
ctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggtgttggtcgcaaaggtcatgctgttggtgatattcctggagtccgctttaaggttgtcaaagtagccaatgtttctcttttggccctatacaaaggcaagaaggtaagtccaagatcataaatattaatggtgaaaacactgtagtaataaattttcttatgcc

SEQ ID NO: 15465 - DNA, 1040 bp, Zea mays
gtgggtttgggcggcaacactcacggtcacgggcatcttggtaactgtataagtgccctcggtgcctgcccccttaacgtcggaatcggtaagggtcacaaatttccaggttttacggatgccaaggctctccttctcaaccacaacaatttgtccggtccacttccgtcaaacctcggtttctcaaaactgagctaccttgccctcgccaacaacaaactcaccgggccaatcccaccgtcaatcagtaatctggaagactctctcttcgaggtactccttctcaacaaccagctctccggctgcctcccccacgagctcggcatgctcaccaaggcggccgtgattgacgccggcatgaaccagctcaccggcccaatcccgtcatctttctcgtgcctaatcagcgtcgagcagctcaacctggccggaaaccgcctctacggtcaggtacccgacgcgctctgcaagcttgctgggcccgctggccgcctcgccaacctcacgctgtccggcaactacttcacatccgccgggccggcatgcgcggcgctgatcaaagacggagtgctggacgtgaagaacaactgcattccggggctcaccaaccagaggcgcccggccgagtgcgcggcgttccagagccaaccaaagacttgcccggcagcgagcactcaggtgacatgccccgccgccgcagcttccaggaacgcggcggcgccaggggagaggaaggtcaaggattactccagctacgtgacgtacgctactctgcatgactgagccacactggcatgcagtaggagacagagtgccttgctggctatgtgtctcttgtattcagcatgagtgtaccctagcgtgtgttgttgtgattgtgattgctgtctatttgcattattgtacgtgtgttgctgtcacatctagatcatcccattatttgtacgtccaaatccattttatggaaagtattgttggtgttttattgaaaaaaaaaaaaaaaaaaaaaaaagcccgcgaccagctcgtgcaaagcggcc

SEQ ID NO: 15466 - DNA, 435 bp, Zea mays
  misc_feature (216)..(216): n is a, c, g, or t
  misc_feature (363)..(363): n is a, c, g, or t
  misc_feature (393)..(393): n is a, c, g, or t
  misc_feature (397)..(397): n is a, c, g, or t
  misc_feature (409)..(409): n is a, c, g, or t
  misc_feature (424)..(424): n is a, c, g, or t
  misc_feature (426)..(427): n is a, c, g, or t
gtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgntctggcattgttcaatccagatgtttgttgggacagaaataacccagagccctggaacaaactgggtcccaatgatcaatacaagttctactcagtgaatgtggattacagcaagctgaagaaggaacgtccagatttctaaatganattttcactataacgctgctttagaatganggtnttccagaaggcnacatccgcacaattntnncacttaac

SEQ ID NO: 15467 - DNA, 818 bp, Zea mays
  misc_feature (26)..(26): n is a, c, g, or t
gggtacccctcggggcccggccgggnaaaaaaaaaaaaaaaaaaaaaaaaaaaaaaaacaaccccacccattcactcgccttgcgcttcctcgccgccccagttccccaccccctgctcacccacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacaggctgagcagctcaaagccaagggtgtagacgagatcctgcttatcagcgttaacgaccccttcgtcatgaaggcgtgggcgaagacctaccccgagaacaagcacgtgaagttcctcgccgacggatctggagcgtacaccaaggcgctcgacctcgagctcgatctcacggacaaaggtctgggcgtgcgctcgaagaggttcgctctcctggccgacgacctcacggtcaccgtcgcaaacatcgaggaaggcgggcagttcacgatctctggcgctgaggagatcctgaaggcgctttagaagccgcagcaacgatcggtctagtttgaactcgcctttgaataacttgtcgttggacaaggtctagttcggtgttgtgtatggaacggtcgtcactgagtcatgcacgatttggtatcccgggtgtttatgttcgccggtttgaggaaactctctgatccgtcgtgacacaaagttgatgccg

SEQ ID NO: 15468 - DNA, 2507 bp, Zea mays
aagccgttttgggttttctaggtgcatagcaaaggcgcatagatatacattattgtctatacacgcagtaaaaagtaaaaagtatatgtatataaaaaggtcagaacggcataccaattttggaatgaaaagggagtactaacctaaaattgcttagctgctttagttcgagaagctcaatggaaaattgcaaactacttaaaatctaaaaggattagatttgaaggtaaattccactaaccgaagccagtagttttgttgcttcctatatctctgaaatctttctactgttctgtgaaaagctgaagcactcatgctgtctctattccgtgcgtgtcttctatgttcatagcaaccagcatgtgccaggcttcatcacacaggctgagcagctcaaagccaagggtgtagacgagatcctgcttatcagcggtacgtttccagcatatgtttgcctgtctgtcttttttttttttgcttatttcttcatcgtctcctgtttacagcgctcgccgccggcaagaaggtcatcctcttcggcgtccccggcgccttcaccccgacctgcagcaaccagcatgtgccaggcttcatcacacaggctgagcagctcaaagccaagggtgtagacgagatcctgcttatcagcgttaacgaccccttcgtcatgaaggcgtgggcgaagacctaccccgagaacaagcacgtgaagttcctcgccgacggatctggagcgtacaccaaggcgctcgacctcgagctcgatctcacggacaaagggctgggcgtgcgctcgaagaggttcgctctcctggccgacgacctcacggtcaccgtcgcaaacatcgaggaaggcgggcagttcacgatctccggcgctgaggagatcctgaaggcgctttagaagctccgtctcctctagaagccgcagcaacgatcggtctatagtttgaactcgcctttgaataacttgtcgttgggcaaggtctagttcggtgttgtgtatggaacggtcgtcactgagtcatgcacgatttggtatccgtgttgtttatgttcaccggtttgaggaactctctgatccgccgtgacacaaagttgatcctgagagaacgaccgagtatttttttttcctgcaatttgctgccgtcgtgcagagtgcagctttgcgcgctcctttagatgctaaaacatgagcggccatggtgggatgcgtggcaacgacgggttatgtgctcgccggccgtgcagcggtttctggtagcagccgtgctcagatgcatgcgatcagtaataaatttggacagcaacgcgtgttagcttccctcggccaaggccaacatcccgtggtcctattttttgtgtgcaagcataaactatttactgggcccgtttcagaaatgcagcgtgcatgtcaaaactgcagtggcatggtgaaatcgaccggaaatattagtgacgtgacgtcggggtatttcattgctgaccttgatgtttacaatggtcggcgagacaaacatcaaggtcatgacatgccagaaacgaccaagtatttggacattgattaattcgacgatgtggtcgtcgagacggcgacctagaggagccagtcgatctccttgctccatggcgctctcagacacgtgtggtaaacttgaccaaagcaaccagcacaaataaagaaaaaccttcctctacgctcttgtttctgtcggtgttttgactcgagcgtcttaaccaactagtaaatttgtgttgcgtatccttgtcctgtatgattgatacaagaagacacacaggatttattctagttcgagcaagagaagaacctacatccagcgaggatggagacttatattatcttgtacctaagtgctcatagtggggatacaagcaagtcgagagagggggtgagttacaagtctctgagtatgattgtagcgagtgccaatatcaggagtgaggtgagtcgtgagccgtgaagtcttcccatgaaggctccgggctcctccttttatagtcgtaagggggactaggaatacaagggttgttatgttattgttgtggttagagaagatgtgttcgagccctgtagcggcatggccggtaggatggccctcgtccttgtgttgtcttttggtcaggagaaggacgtctgatccctatagcatgttcctttgattgggtagacagctgaggctgggttcaggagcatggacagacgtctgagccctagccggtacagggtgtggatgagatgttttccaagtttctcgagtcggagtggttgaaatagtgcttggcatggtcttctgcgaggttcgcgagagagtaggtggcatttaatgtgcgtgctcccttactggggcagttagccgaggccgggctcgggcgaggcaaagatttctcccgaagccaaggtcgggattagacattacatgtagccacgctctgggtggttgaaacagtgatcggagtggttggccgaggtgggcatgctccggggc

SEQ ID NO: 15469 - DNA, 990 bp, Zea mays
ccggccggggcccggccggggaccattgccccccccggggccggccgggaccccacccattcactcgcctgcgctccctcgccgccccagttccccaccccctgctcacccacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacaggctgagcagctcaaagccaagggtgtagacgagatcctgcttatcagcgttaacgaccccttcgtcatgaaggcgtgggcgaagacctaccccgagaacaagcacgtgaagttcctcgccgacggatctggagcgtacaccaaggcgctcgacctcgagctcgatctcacggacaaagggctgggcgtgcgctcgaagaggttcgctctcctggccgacgacctcacggtcaccgtcgcaaacatcgaggaaggcgggcagttcacgatctccggcgctgaggagatcctgaaggcgctttagaagctccgtctcctctagaagccgcagcaacgatcggtctatagtttgaactcgcctttgaataacttgtcgttgggcaaggtctagttcggtgttgtgtatggaacggtcgtcactgagtcatgcacgatttggtatccgtgttgtttatgttcaccggtttgaggaactctctgatccgccgtgacacaaagttgatcctgagagaacgaccgagtatttttttttcctgcaaaaaaaaaaaaaaaagcagcgtacggcgctgcgcgctcctttagatgctaaaacatgagcggccatggtgggatgcgtggcaacgacgggttatgtgctcgccggccgtgcagcggtttctggtagcagccgtg

SEQ ID NO: 15470 - DNA, 850 bp, Zea mays
cttttaacctagcccggccctgcgagcgagaccaccccacccattcactcttggggccctcgcggccggccgggaccccacccattcactcgcctgctcacccacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacaggctgagcagctcaaagccaagggtgtagacgagatcctgcttatcagcgttaacgaccccttcgtcatgaaggcgtgggcgaagacctaccccgagaacaagcacgtgaagttcctcgccgacggatctggagcgtacaccaaggcgctcgacctcgagctcgatctcacggacaaaggtctgggcgtgcgctcgaagaggttcgctctcctggccgacgacctcacggtcaccgtcgcaaacatcgaggaaggcgggcagttcacgatctctggcgctgaggagatcctgaaggcgctttagaagccgcagcaacgatcggtctagtttgaactcgcctttgaataacttgtcgttggacaaggtctagttcggtgttgtgtatggaacggtcgtcactgagtcatgcacgatttggtatccgtgtgtttatgttcgccggtttgaggaactctctgatccgtcgtgacacaaagttgatgctgagagaacgaccgagtattttttttttcctccccaaatgctaaaaaaaagcggcc

SEQ ID NO: 15471 - DNA, 1362 bp, Zea mays
gagaacatttgtatccgaagccatccgtattcaaattcgaatctgaataaaaatataagacaaatatggtttcagtgatattcgtccgtattcgatccaattacctctctacacctaattccgtattcgatacatagatatctgtatttgtatctgagaacatttgtatccgaagctatccgtattcaaattcgaatccgaaaaaatataagacaaataaggtttcagtgatatccgtccgtattcgatctaattacctctctacacctaattacctgctctagcaaatttatgcctaagtctaaaagacgttaaaaaatggtaagaaagttgtgtgcgttgtgcagccgtggtgatatcctctataagcagaggtctactctttgcccacaatccaaagcaaaaaatgcagtgaactccaagaatcgtacacagtatgcaccacctttggatgcactcctttcccatctctttatttctccccggcgctcctcgcggccgcccgggtcaaaaattccaagagatgaacatcttgttgagtcacttgtgttgctgcattcttattctaggcatctacgctccgacatccgccacatcagacaatcctcctctgcaggatgtatgccccatggctccccagggcgagcggcgagagttgtccatgaacgggttcctctgcaagcatccgagcaccatcctggcgtccgacttcaagactctgatgctaaaccacgccggagacctggacagcatagctcggtcgtcggtgagcatggtgaccgctgccgagttcccaggcctgaacaccctgggcctgtcgatggcgcgcaccgacatcgccccctacggggtggtgctcccgcactcccacccgcgggcgtcggagatgatgttcgtacacggtggcagcgtggtggccggcttcctggacaccgagggcaggctgttccagaagcgtctcggtgagggagaggtgttcgtcttcccccgcggcttgcttcactacgtcatgaactacggtttcggcctcgcgacggcgttctccgtgctgaacagccagaaccccggcgtggtcggtgtcgcccacgccatgttttttgcgagtgagtcggacgtagtcgaaggtctaatggccaggatgctcaagtttggagagatggaggtgactagtgacaacaacatcactgctggtttcccatgggcattctgatctgagtaggtgcaattcaagatcgttggtggtttaagttcccaaaaaaaaaaaaaaagtacactgtgatgtatctgattgaccgaagctaagtttgtagtctgaactacttgcaggacgaatcacaatcaccccttgggatcattacgctg

SEQ ID NO: 15472 - DNA, 4011 bp, Zea mays
ggctacataatactccatcctgattcctaattcatacttgagttatagtaggcattgtgaggagtaattagttaattttttattctaatattggtgaacctatatgaattaaggtggctggtttcactttcatgtaagtattttttctatcaacatttgcaaaaagtttcgggtccaactgaacgtgttgtcggtgcatctagaaaagagcacaagaattcatggggctaagaagaccgtaggataaaattaagcaagaccggaaaaaagtagtgttgaatataatttaagttttacatcaatatatgatcagattcaaaaagaaaacaatataaacaaaagaaataaatatatcgctaaatttttgctgacttaattgaagtcagatctatcttgttgaatacggatctcctctaagcgtgagggcactggtaaaggggcagggccaagtgacatcttcggttgagagatatgactcgtgggtttaccaagctcgtcattcgccggagacagtcaaattgtcatgacaagcgagatcagacctgttgggtggaccgacgtcgtgatgatgagcaagatgggggcactgagagtggagtgtggtcgggcggcatcgattgtcggacgacgtcgagaatgagacatcagggcatattggtttgagctgcgtcagaatgaatgtgatcaaatagatagatgtgaaaactaggctgaggagaaggatgacatactggttcgagctgcttcagaatgaatgggatcgaatagatagatgtgaaaactaggctgagaaagatgaaagtcggaacgatgaggacttgaccgatccgacgaggaagcctagaacatgactattttagcccactcaaaatttcatttttccctatacttaacagtaaatgaaccttaggcttcctttgaaatgcaggattggtgaaacataggaacaaaaaaaatgtgggaataaagttgtttgatacctgtaaccctagaaattaaaaacacagaaaatttttaatagagcacttagatgcaatatagaaagaacacaataattagaggagagttagacacaaaagaatttttttaagagattgtgcctcaggttagaagtcctttaaaatcacactacaataagtcattctatagtaattttatatgatttgcaaaaacttaatcctttattccaaaaccacatataaaatttttctatagaattttaatcatccaaaatttctctaaattttcttttttaaaaggggtataaaaggttataaatatttgaggggccctttccgtccgtccccggaaaagggatcgtaagtctaaaataaatcgaattaagtataggttagaatctaatggtctctaaagctatttttcaaaatctatttataattctatctaaatgtttactgccattttatgaagtgattctatatttaccgtgaaagaattagtttagtaagttaaccaggaaagatagacacacaacctaaaaatgatcaagcgtagaagcgtaaaagatgtagataattaattaccgtcaataatcaatttgtatcatgatatgaagctcatgtttctttaattcatgtgagaacccttgaagggttaagctcctcatggattaattttatggagcccacaagtctttctcccctataagtatgtctccctgacctttcgacggttttttgtcttcactattagcatcttcaagggaggtcttaaacaaagttgtattttaaaatatagggatcgctggatcggaaccataaaacatcctccaacaatgccctattgaagctattggatcaggtggccgccccatcctcttcctagttcctcccttacgaacagtagaccaagcgcctcatcccttgaaaaaccctatctacgccacgactttgtcaagtaggttgagaatggagcctgcaagattgtgggaaagtatgttgtggtcaagatgacgagaatccatgatatttggaaaggtaaccgggtgttcaaattgtagattgagtacggctcctaccctgtccttgcggggaaagagagggaggatacccccttggagggcagggagaagggtggcttttgcaaggcaaaaaggaatgcctcgtccatggtgacaaagttcaagaaggcctcggtccaatttcttgtcccgtcgaagccttctagcgccaagacctacaatgtgaccgttgtgtctgaggacttcgtcgaggacctggcggtgacctgcacttcggagggcacgaccgtgatggtgacattctcttcggaagcggagatgtgagtggtggtgaccgtttaccgggggtaagtttcagagtctcttggaaggttagctctataggagaaaagagggatgtagttaggtccattccttgggcctccggcgacgacgtctcaacctctaggttggcgatatcttttaatgttggagaaaagagggatgtagttaggtacatgaacctccttctcctcaactaacaacagtgtatcgagccgcgtccatcactggatgatcacttccgatccactcagggctttgaccaaccttgatctattacacagcccgagtcgtgtcttttttttttttttttaaactgtaaaaatgttctcctcaatttgaccagattccttaagattattacaattaccagtttcaatttacgtgacagtattacaattactaccttcatttgcgcgacagcaaatacgagtagaagccattaagtacaaacctagcacaaggagctggcatttgttgtatttagctggcaacctcaactggttcagatcccttgtcaatagaagctttcacggcatccagtaccacctgcgtcttccgggtgatagccggccacttaccctcaggcctgccaccggcgcggacgttctgcacaagccttgtgaattcctggatcatgagtgcctcctgtggcagatcagtagtaacaacatgcttctctggcaatggatcccatccgatggtgggtttgacgaagcttgacttcgaggccacactgaactccgcagagctctcttcgtacggaatgaccaggtcagtgacatggagagtgccgtttgtgccatagacggtcacgtcaaaggcgaggttagcaagaaacgagcagttgaagtttgcagtcttgccatctgcccagtacaaggtcgcaccgcaagcaaggagcacgccagcctggttcttgacaggatggcggtgagcgatcacggtctcaggcagctcatagtcaacagcccacaggattgagcggatgcagtaccatccaacatcaccgaggacacccaaggcgtcaaggtctggctttaccctgatgtcattcttgaggaattcctcggatgcccgaaagctgcacatactgtttatcactctgacgtcgccaaaggcgtccttgtcgctgacgatctcccgcatcttggcggtgcgcgggttgtggatccacatggtggtgtccatgaactggaccccggaggcgtcgcaggcgccgaggatggcgtcgagttcggcagtgcagagcgcggtgggcttctcgaggagcaggtgcttgccacgcgcagcgacggctgtggcccagggcacgtggagactggtggggagcgggaggtacacggcctccacgtccgggtcctctaggagagactcgtaggacccgtggacgcgcgccgcggggaagccgatttcggagatgaagcggcgggccttgtcatcggagcgactgcctacggcggcgatggtggcggcgcccggagggagcatcagcattgcgcgcgagatcttacgcgcaatgtcagcgcatcccaggacgccgaagcgcaccgcgcgcggcggcggcggctgcaccggcgctgcaggggacgacattggcggcggcgtcgttggttggcctcggttccgaccggtgtgtggagtgatggatcgcctgcgtcagttatttgttgtgtgtggtagttcagctttcgggttcaggattatca

SEQ ID NO: 15473 - DNA, 1346 bp, Zea mays
ttttttttttttttttttttttttttttaattaaattttagattaattaattcagagagaaactagaaatactcttttatgagtacatattaactcacgcaacgggatcaatacgcaccggatacacgcaagaagaaacacaagcatgactgtctgaatgcatcgtcacgcccaaaagtcagatcacattcacatctcagccttggacgccatgacctccgccacgtccacgccgcccatatcgccgccggcgatgctgatgacgcgcggctcccggccgcggtgcccggccaccttaggcacggtgacggtgagcacaccgttctccaatctggcggacacgcggtcgacgtcggcgccggcgggcatccggaaccggcgccagaaccgtccggccgcgcgctcggcgcgatgccaccgatcgccttccttctcttcgtcggcccgccgctcgcctgagacccgcaggacgcggctgttctcctccacctccaccttcacgtcctcccgccgcaccccaggcacgtccaccgagatgacgtgcgcatcgggggtctccttccagtcgcaccgtgccagcgccaccccggccgccgacgtagagtcgaggctggctctgggcaccgatgacgccgccagcggcgactgctccagcacccggaatgggtcgtcgaggagcatcaggtcccacagcccgccaccagggcgcccgtacggtaccagcgcggcgaccggagccgcaaggcacgccattgtcaccaccgctaccgcgaggacgacgacggccgctgaagccgacgccttcctgctgaacaaaactgcatctgccatttgctacgtgatgctgttttggaggaaagtattcgatgtagcacgtgttctgctgatcgttagcttatatgtcgaggtcttgctgatcgttggagttcgattgctccccgcgtcatttataggcacaaccgctcaagcacgacgtgaccttcctgagcggagttcgttcggttgggcttctaggcgcttcttcgttccgttgggcttctaggggcttccggtgacgactacaggagatgtcggtgacgaatagcgctgcatgcattcgtgtgtgtggccgtgcctcgaggagactctagaagcctcttctttgactgcgcgtggagggcagctgggctaggctttagcccaagcacaaggtcgtcttcctcaattttctgcaaaggtttgcaaaattgtatcttgattttaactttcttgttttattgataaataatcttggtttggataagtggtgctactggaatggcgaaaggatcatgcggtcaacagtgatgtataacatgtaacgggac

SEQ ID NO: 15474 - DNA, 4818 bp, Zea mays
  misc_feature (991)..(991): n is a, c, g, or t
tggtgctaattttactattactttgagtattgattttttgctatactattaaaatagtggaattgtatgcactggcaatttattttatccgatataaaaataggtgaaaataattctgttaatatggttaggttgaatggggaggatagatgacgtaatttagaggacgttgttggagatggtgaaaatatagaggacagaatcttttagagtgtactgtaaaggacagagaatattcctttagaggataaaatttagaggacgttgctggagcgtggtagccccgtgtgattcctacaaagggcctctgccctctggctcgacgcgagtgccatgggtcaacaaggttcgacttggcgggcaagatgttctttttctcttgttgagttgttgtattttttaaaatggtttgtttttttccgataaacacaatacgtaaaaaattatcataagcatgcaccgaagaaaaaataacttagcttaagaaccatggctagaaagaagtctatagcgtggctggcaagacagtcttttgagtgtcacattatgccaaccattaaaagttaaaatccagttaacaatcaacttatcactttgtcagactattacaaatctggtcgagaaaaacaaaacgatctgtatgtactacccctgtttaatgtaaccgcatccagctgggccatttttacgggctcaggctgctaaactagcagccgtgtatcgctgggccggtccagtttctttggaaactgaaaattcgatggaatcgcgaatgataggtaggcccgcccgggcaggaattatatttggaagaattcaatttggtcccatttcgcccgaagaccccacagtcacagtggaggtacagaattgcgcagaggtccattcaccggctccattttctggaacgagaccgaaccaaataaagaaagaggaaaaggaagacgaagacgaagagggagaaaaaagggaccagagggccggaagcccngaaccaaaacctagacgaaccacacaggcagtcaggcacagcgcgggccggggagatagataggcagacaggcaggcaggggggcgacggcacggggcggggctagccaaccagaccaacccaaaccctagctcaccgctcgttccattccaatccatggaggtggcgctatgagccgccgccgggacggcgggacgtggagctggtgcggccggggaagacgagtcgaggatgacggccagatcggacgatcccggcgtctcgccagggacgtcggcggcggctggcggcgagatctggggcacgtgggaggagctcctcctggcgtgtgccgtacggaagcacggtaccgccagctgggactccgtggccatggagatgctgtcccgctgccctcccgccgcggccgacagcctcacgcccgctgggtgccgcctgcggtatcgcctgctccaccgccggttcaccgccgccgccgccgtaaacggtgacgaggagcccgacgcggcctccgccgactgctgcgtggaggagctccgcaagctgcgcgtcgccgagctccgccgcgaggtcgagagatacgacctctcgatcgggtaaatggccggaaaaaaaaccagcacggagacggaccgtatagttaacgagaaaaacataaaatgcgttcgggcctggcccggcccggcttgctcagctcaaccatcctacgctgatcggtcggccgcggtttttttttttcgtgtcaggtcattgcaatctagagtggaaaggcttaaagaggagagagcgaggagcatctccggcgaggccaatccagtaccggcggtgaaggaggacggcgaggaggagccggcggaggggaggaaagaatctctggaggaggagggcgacgatgccggcggcggggaggaggatcgtgtctccggcggcgagtccgggcggtcgtgcaaggagtccaactcgtcagatctgaagcggccgcggccagcgcgagacgccggggacggcgacgcggcggcgaggagggaggacgagggggcaggagacgccgcccgcgagtcgtcggctgtgaagcgcgagcaggtctccggtgagtcggtggttgggtccaaggacacggtggcggcggctgacacggagaaggagagcagcgacgtgcagagctcggccagcccgtcccgtcgccgcgagcgggagatcggcgccggcgaggacgcggatgtggcctcagcgccgccgccgccagcgcccgcagcggcggtcctccccgctgcggaggccgaggcgttgcgcgcgttcctcgaggtggtgcgaaccagcaagccgggctccgtgttcgagcgccggctcgagagccaggtaaaaaaaaattatcctctacttgttttttctatccctaaacacatacggtaactgtaaaatgaaaatcaccattcacccctcccctaatctcctttttttccgggcattataaaaaaattaaaatatttgaaattacggaaccgtccaaacacaaagcgcccaacccggctgtcagtggagtacgctttacgagagttatctcgcgatacgtacggcgagtgctcggcagtcggcacccgcccaaatcgcgtaacgctcgcggtttcccggtggcctggacgcttgcttcgctttgcttgcacagaaaacgaccgcctcggctggtcaccgtcgccggtgagcgcaggatgtgggagtggaaccgcgccgatcgtacggatggcggtggggttgtgtacatcggccgccgtccggcccggggcgaggtcgacctcggtcgtccgatcagagggtcccgggcttcgtggagataaggctatctccggtagtccgtaaacagccgtgtaaattatttcactgtttgatggaagtttaaaatagagattgtgataaagactggaataagtaagggctgtttggttcttggttaaatgtgccacactttatctaaggaactgaagaaataagcttagacggaaaagttaggtaaaatatggcaagttacacatcaaacaaacagacctatagtctgttggcgaagtcgcgagacgcgtaggtgggtggcgccgcgagagacgcgtttcgtgtccatgcggtggtccgctgtgggaccaaccgtgcgccgccacgtgggcatagaaaacgacgtgtggggccggcttgtcggccattgctacgggttgtcgcggaggacagtgtactgaagggctaaaaatatctctactgttcttcacagaggaaaaaatcgtgctctcacgtgctgcacagcatttcagctgtttttttgtgtgtctctctcagttttatttggattatttgtatcaatttgattttttggtaggatattttttcttttccactttgtcggttctttcgctgctccactgaccgctgggcccaaaaatgccgctcgcaggacgacgcgaaatacaggtgcaccatcaggcgccacgtggacctggagacggtgaggtccaggctggacggtgggtccggcagctacgcctcggcgaccgagttctaccgcgacctgctcctgctgtgcgccaacgcgctggtcttctacccgcgcggctcgcccgagcgttccgccgcggcgcggacgcgcgcgctcgtcgccaagcacatgtccaaggaccagccggggccctcggggaaggctgtcgcggggccggcggcgtccaagaaggccaaggcggaggccgacgttgggtcgctgctggagaagacggcgcccatcatcgtgtgccggaagcggagctctatcgccaaggccgccgcggcggccaccgccaaagaggagagatcggagaaggcggagtccgacaaggagggcgagaagcagcaggaggcggtgggcaagaggaaggcggcggccgccgccaaggacagggcggcgtgggggcccgtgtaacgaacaagacccgcggcgggcctgctgtccggaaggcgtcggctcagagccacaagggggcgtcggcggcggcggacaacggctcggacagcgacgcaccgcccgaggaggccaagaagcagcctgccgctgacaagaaaggtggtggtggcggcggtgtcgccaagaagcgcaacgccgtcaacttcctcaaccggatgaagcaaggtggctcggcgccgtcgacggagcgggtgtcgctactggagacgctgaagctctcggccgcggcggagcagaagaaggccgggaaaggcgagggcaaggagcccgcgggcgggtccggttccaagaaggccacgccggggaggaggaacgttggcaggccaccgaaacgcgcggctgcccctccatccccgccaccgtccaagagggcaaagggcggcggcggcggcgggaaacgcgggggcaggaagtgaagccaagtgggatggagtgggaagcattaggaagctgtaggcccagtctcagaccgtcccagctcaaccgtgtgtaaatgacgtagggttgtaggagcgttcggtccgagcttttgtaccgtatgccagtggtgtaggggtggtactgttttttgggaggaaaacaggatgagttgacctgcgctcgcgggactgcattgatgaagagatggattgtggaagacgattcgtttagaaacctgtcgtcgaggaattacatttttttggctgaaatttgaaacctgtagccgggcgcgtggtactgtcactgaaatctcaactgtgacttttattacagctgttaagcagcaggaactgtagaaatagaaaagtacctcctccgtctatagtattcgttttagctcttaatttttatatctatatctaaggacgtg

SEQ ID NO: 15475 - DNA, 2757 bp, Zea mays
cgtttttccctttcttctactaaaatataaaataagtagctgaacgataagctacgctacctgtatggataggaaccggacacctcgtcgtcatactcacaagtcacaaactcacaacagaggacctcaaccaccaatcagacacctctagtaatttaaccgcttccttaacaaatttttttatagatagtttcattgaataaaattgtttatagatagattcattgaataaaattgttggtagtactagaagatattagcagtttgtaagcgtttctctgctggtaataacatggaaagttctgtatgcatcaaacaagataagctactggcatacataatgcaggcacagaggcactagtacagcttgttccacgtctattttaccctgatctacgaatccttcttcgcttcaccctgttgctgctgctgctgctgctgctgcttcgagtgcgcgcgtgcgccgccgtcatcctcatggtcgttgccgagatagtatctcctgagtgccctgggcaggtagaagggcagcaggaaggcgaagaggttgagcccccagaaggcgaggttggctgccgcgagcgccctgccggccaccacccgccgcggcggcacgggcgggccgcgcccgaggtcgtcccgctcctgcagctcctggcgcagccactcggacgccgcgaacatcctgcgcgcgctgtacatcacgggcacggcggccctgacggggagcgagaaggtgccgggccacgccgccgcgatgccctcggtgaacacctgcgcggagaggaggaacgcgtgcggggccgcggcggcgacgccggccgtgtccccggcccggaggccgtcgaggatgtagagcgccgggagcgcggcgccgacgacgaaccccaccgcggtgtgcaaggcgaggcggagccgcccgccgacgcccgggaagacgggcgcggccgggttgggcttccccgggcgctgcgggaaggcgagccaggcgaggacgaggaggtagggggggaggagcaccgcgaaggcgatctccgagagcgggaccgtggtggagaaggcgagcacggccgccgcgcccagcgtgttgagctgcttgatggagaagaggtagtagtggtggtgcgggcgcgtcgtgggagaggtgggcgtcgggtgcagcggcggcgggggcgcgcccatggatggcagcgtgatgccgccccccgccgtcgggccgacgccgcctgacatggcctgaggcgctcggagcgggagcgggagcaggagcggcgtgcggctcgcgggcttggctggatgctggaagcggtcggtaactggccaactgctgattgctggacgaaggaggcgttcgggttctagagagcggtgagccggtgaggtttagacggaggaggctggcgctggcgcgggaggacgtgtggcacgccgcggtggccaggcaagcggcggcgtgccgcgtgggctgggagggatttgtgtgttggattattttacccgcctcgagagaaaaaaaaactcgacaagtcgacaccgcagcagcgagaggcaagctgcaaacggcgtgacgtgggcacgtccttgaaactaggatacatatggttattatagtataaaacaaaaagaatggtacacgtacacatgttgagagttggtatgagcagcattgcatacctccacgccgtcgcaaataaaacgaaggctacggatatgtttggttgtctggcccaacgcacgaccaggaccatttgaaacaaggttcgcatgtttggtatcctcgttcaacttgggagcctggctgaggcgagccatatctcattctgtggccaggcccatttgaaacacacgttttttccttcacgggtgagcctggccgtgcttgcctagtaaaagtgctagggttcttctcactagtcgcagcctccgccgcggctctcgcctctcggagcaaaagctgtgtgtccgctcctcctggtgatcccggagccggccctcgcccctccccgctgtgtccgctcctcctggtgttcctctcctcctggtgatcccgcaccgtgctgtgtccgctccatcttcctccgccgccacgctcatcgccggtgaggactaccctcttcctctccttctccctctccctctccctgtggttcactaccgggtcgtcggcgaagggcgaacgacgccatgccggcggatccgtgcagggctggatccacaaaagctggatccgtggagggttggatctctttgtagggctggatccgtggagggagtgcacggcgctcgtcgcccagctcgaggtccacgtccaccaccgcgctcgtcggttaaggtttcgtgatctcactactgcattcactgcaggtgcgagggcatgtctacctacccgaggacctacgatctcatccatgcggactcggtgttcaccctgtacaggaacaggtaccagagccccctagttgtcaagacgtactcggcttcctgaggcccaggggcacggcgatcatcatggaagatgtggacttgctggtgaaggtcaagagcctggcggacgggatcagtagcaggactgtcaagtaaaattctcaatgttgataagcattttagtgtttggattcgtaccaccgcttctagctccttgagctagagatcttttggcggtttctgcttgctgttctttctggacagtacttgctcggataggaaatttaacatgtggcgggaaggaaagagtagtagtaatacccctggccccta

SEQ ID NO: 15476 - DNA, 2555 bp, Zea mays
  misc_feature (1923)..(1923): n is a, c, g, or t
  misc_feature (1944)..(1944): n is a, c, g, or t
aaccatctcatctcatccttaatagttagttagtttgttagtaaacactaatataagaaatgcggtcacttactaaagctgagcaatagactcatgatgcacaacatcgctgaatgtcgtcagttcaaactttacacgttcgtaacagaaatacagataagaatgcatcttatccgtttgacttcaactgcattttagactagacagcatgcacgaattgaccattccatgaggtcctttgatctgtacaatatataaatgcacctaacagaatcaaagttgcctcaacgctatgcatgtcctgttcgtggaattctattgaactcatacgtagaaaagattggcatgccggccatattttcgtgcaacgggactatttttccaagcatactggagaaaattcacatgctctccactctccatagcccccgtccgtccctccacgccgatccacaaattaaactcacgcacacacacaattaggtcacatacacacttcccggctgcctccctaggtagcagcttctacaatggaggcatccaacaagctcgcagtcttgctcctgtggctggtcatggcagctgccactgccgtgcacccttcctactctgagaattcgcctcaagactacctcactccccaaaacagcgcccgtgccgccgtcggtgttggcccggtgacctggagcacgaagctgcagcagttcgcagagaagtacgccgcacagagggccggcgactgccgtctccagcactcgggcgggccctacggggagaacatcttctgggggtccgccggcttcgattggaaggcggtggacgcagtgcgatcgtgggtagacgagaaacagtggtacaactacgccaccaacagctgcgccgccggcaaggtgtgtggccactacacgcaggtggtgtggcgcgccactacaagcatcggctgcgcgcgcgtcgtgtgccgcgacaaccgtggcgtctttatcatctgcaactacgagccccgcggcaacatcgccgggatgaagccctactgatatattgtgcctgcgatcaatggcaactgatatattatatctagacacgagcttgttgcagcgcatgactttccacgtgatatatgaataagattttataactagataaatctttgagtgtagtcataaataaatcaaagaggtttgttatttacaagttgctaggatccttctatcgtatgtgcaacttcgtcaaacttcacggctcgtgaaaacccgatggttgacatatgtgaactagtagggtgtttggtttgagaaataagttagttcattatcttctcactcctcactatttttgtttggtttgtggaatagaatgagttgattcatcaacacctcatttcttaaagttagttagtactaacatgatgaatgggaccatctcactaaatttaaggaatgaacttataattcaacacctcatctagaatagagtgattcctcaaaccaaacacctcctatttgcagagcgtcgccactgcacgggcgtgacagatgggaggtgtaagtcttttgttatatatctaagtcttaaaaactacaaacaaaacattgttgaagaataggcgatcggtatcagttgagaaacaaatataatattggatttccaaatcgtattggataatgagggcttaaccagtcaatctttagtcccgactgcatacaccaggattaaagatggcctttgatatttgttggtcatttcattttgaactctaaaagatatcaaatgacaaggcaacacaagttaaaacataaaagcttctccacctaattaactcttctacgatggttaatcagttggagaaggcaataggatatttcaacaaaggtaatcaaatcatcatgtaaataaagaggactaaaacttatctcttatatggangtgtatattcacatttatttnatttcttgataagtacttaacaattacaaatataccttgggctttacacgagatatactcctaaaggtaccttcgaaggctgagcagccagatgcttggggtttgaaaaacgtaatttatgcatggtattgttcctctatttatagtcgaaagggtacagctctggtgaatttacaatcgtgaccttaggcctatacatttactctattttacatgccaagggcgaggttttgctttttcttcttcgacttgttggctaaactttgaaggtgccttacactaccggaaacaacatctttgccgagtgtctgaagcactcgtcaaagcctggaaaacactcagcgaaggctttgccgagtgtgacactcgacaaagaaagctcggcgaactatacatcggtaagggcttcgactggtacacggcaaagaaaagtctccgtcacggcgctaagtaacggctacggagtctgtgccgacactcggcaaaggctcactctttgccaagtgtccactatactgacactcggtaaggaagccccacgtgaacctctttactagggcctttgccgagcatattagatggcactaagcaaaggctccctctttgcagag

SEQ ID NO: 15477 - DNA, 1734 bp, Zea mays
ggccggccgggaccgagcacgagggcattcgacgacgacttcctctctctcacgctagagacgcgcagtcgcgcagagtcctggctttttgcccctttccggctttgccccccttccccccaaaccacaccgatcccaatcccgccgtatccggcgaacgcgcgccgcggccatgtgcagctgctgagagaaggagcgagcgcaacgacgccactggccatggacgagggctattccaacctccccaccagccacctcctcggctccgtccccgctgtgacacaagatgacaggaaattgggtccccccgccgcccaagatgcagctgccacctctcggttgcaggagttcccacctggaggtggtaatgttggagggtatcggccaccaggtggccctgcagatggagatgttgaaaaccaagcagattggaaaggatacttcaatgttgcatcttatgctccatacttcaatgttgatactgatgttgtagttgacaggctcatcagttcagtttatccaatggatggtttttacaggaaaattgatgctaatcctgacatgtatgggcctttatggatcaccactactctgattttcatgcttgctgtgtttggtaactatgccacttatctggtgcaaactaaaaaggatatggacatatggaactttgatgttggttatttcagttgggcagcatcagtcatgtatagttatgctatcattgtgcccgtcgtgttctttttcctgtttcagtattttggatcacgcccaagtcttgttcgattttggtgtatgtggggctattctctgtttatcttcatacctgcatctgtacttttgcttattcctgtgggatttcttcgatgggtcatcatagctcttgctggtggtgcatcatcttggttcatcactttaaatttgaaggaatgcactgaaggagctgatctaatggttctgatggctagtgcatcagtgctgcaatttgctctggcactgttcatcaaagtttactttttcgcctgaggtttgcttgatgattttgcaaaggtgacctgatgcgccctttgcccacggcttgttctggaatacatcttttgaaagggcatggcagaccagttctactcgacatcgtgacatacgtactgaccctagattgttatgctttgggcgttcttcatttgaagtgtctaatctgcaagtctctatctagctagggaacagaattttacagcgtgccgtacagagtaccgagtttaggcaccaaagtctttccacgttgttcagtgaaagcccttcacttggatttgcatacaatcctttcttgggtaaagatctccaagtgtgtatttgtgtgctagtacgtctcatccggttttcgaacgtccaactgacaactgatttcgcatagctcttttttttaaaaaaaatggtttagcgaataaaattagcatgctctagccacgaattttcaacgacaaaaggtttcccgattttgtttgctatttagctcagaattgaagataagtaagagccttatggtcagacgtgtatcttggaatttttgtatggttgcagaagggaaggtcctgttcctaggatcaagagattagaactatgtatagttttttcaaagtaggttcatgtatgttattatttcaaataaacttcctttccacaaatttcattttgagttcatgagtaaaaaaaaaaaaaaaaaaaaaaaaaaaaaag

SEQ ID NO: 15478 - DNA, 2304 bp, Zea mays
attgggtacctcgaggccggccggggacttggccaggtgccccagctatggtcccgccgcttcccgactcttccagcaggaaccgagcgacctcggactcagcggctccgcctgtcggcgagcgcacgccgcgtgcctgcccgcggtctctcgtcgtctccagaagatgcgccccgatactcatctttccacccttcttctacctccttccacccccttctccccacgccccatcggatcgcacgcgccctgcaattgttgtgttgttcatcacctctccgaagaagcgtcacagagcaccgcccggaggttccccttcccgtcgccgtcgccgtcgcttggccaagatggctgaacaattctataccgtggcatcggatagtgaaaccactggggaagacaaatcacagccttcattccctgatgttgctgttggcattgacattgggacttccaaatgcagtgttgctatttggaatggccaccaagttgagctcttaaagaatacccgtaatcagaaagggatgaggtcatatgtcatgttcaaagatgatactctttcagcaggagttactggaggtgcagccaaggaaaatgcacacgaggaaagagacatcttgtcaggaagtgccatattcaacatgaaacgcctgataggaagaatggacaccgatgaagtggttcaagctagtaagaccctcccatttcttgtgcagacattgggtatcggtgtgagaccattcattgcggccctggtgaacaacatgtggcgatctacaactccggaggaggtccttgccatctttctacttgaattgaaggccttggtggagatgcaccttaagcatcccgttaggaatgctgtgcttacaataccagttgcgttcagtcggtttcaacagaccaggattgagagagcctgtgcaatggctgggctgcatgtgttgaggttgatgccggaaccaactgctgtggcgcttctgtacgctcagcagcagcagcagcttgtgcatgacaatatgggaagcggcatcgagaaaattgctctgatatttaacatgggtgctgggtactgtgatgtggccgtggctgccacagctggaggtgtttctcagataagagcattatcaggatgcacagctggtggggaggatatacttcagaacataatgcgccatgttcttcccaattttgacggtatatatgctggccagacaatggatagaatcaagtcgatgagcttactgcgaattgctactcaagatgcaattcacaggctcgttagtcaagaatccgtggagatcaatatagatttggggaatggccacatggtgtccaaagttctagaccattcagagtttgaacaagtcaaccgggcaattttcgacaagtgcgaaaagatcatcaaccagtgcttggctgatgcgaagttggtaccagaggacatcaatgatgtcatactggtcggaggttgttcgaagatccccagaatcagaagccttgtcctgggtttgtgcaagaaggaggtctcttacaagaacatagatgctctagaagctgctgtttcaggtgctgcgctggaaggagccatagcttcgggagtgaatgatccttcggggagcttggatcttctcacgatccaggcaactcccatgaacctgggaatccgtgccgacggtgatagcttcgctgcgatcatccctaggaacacgacggttccagcaaggagggacatgctgttcacaacgacacacgacaagcagaccgaagccctaattgctgtgtatgaaggagaaggggaacgtgctgaagataaccatctgttagggtacttcaagattactggaattccggcagcccctaagggagcagttgatatcagtgtatgcatggatatcgatgctgccaatgtcctcagggtgttcgcaggggtcgtcaagcctcaaggcccagccattccaccgttcatcgaggtgaggatgccaacgctggacgatggccatggttggtgtgggcaagctctagcaaagatgtatgggaggattctcgaccttgctgttcttccgaagaagctgcagccatgatatgtgccttccgtggcccgtaaagtagctggtgcgttgtgcgaatgtaggctgctcagtgttcagtattcactgtgtcactgtcccctgtggtgtggccactgtttatgtgctgttggtgttgggcagtctacagaactgaactaccagtttcatccttgtaggcgtgtacaataatgtcccgtgcatgtgaaatgaatgttgcggatgtttacttcat

SEQ ID NO: 15479 - DNA, 2869 bp, Zea mays
gatttagtacaacgtctcctgtagtcctgtgtcctctcgcgcgccgcgccgcccctcaggccccagctctcgctctccagtctccaccgccgctccggtgctcccttccgggattcccctccggcgagcttgctcagctccgctccaggtttccacgtcgtccatggcgctcgtcgtgatgtgtgggcagccgtgcagcggtaaaacatcagccgccgcttgccttgctgtggcgctgcactcctcctcgcctgaccttactgtccgaatcatcgatgagtcatccctccatctcaggcgcaacgatagctacaaagatatggttgtggagaaaaacttgagagggcttcttagatcagaagttgacaggtctgtgtcacgcgacagcataattattgtcgactcgttgaataatattaaggggtaccgctatgagttgtggtgtcttgcgcgtgcatctggtgtaagatattgtgtgcttttttgtgatacagaagtggaccattgtaaggaatggaacaacaaccgccaggagaaaggggaaccagcatatgatactaatatatttgaagatcttgtaagtagatttgagaagccagatagacgcaatcgttgggattcccctctttttgaattgttcccatctagagatgaattagtggaaacagctcctgttattgctgaagctgtgtcatatttgacaaaaaaagtggattccaaaacaagagatgtaaaagttctccagcctacaatagccactcagacggtgcgaacaacagaggctaattccctctatgagatggacaaggcaacgcaggaggtggtcaatgcaattgttgaagcacagtcatgcggtcttgggcttgctgtgaataagatctccattggacccaacttgccaactatcaagcttgagagatctgttggcctacctgagctcagaagcctgcggagaactttcatcaagctggcagggcagtacagtctgagtgggccaccaccaccgacagatgctgacagcgcaaagaggatgtttgtcgactacttaaaccgtgaacttggtgcatgataattttcattcgcctgcgttgcatgaacactatgtagcatgtggttaacttgggggaatagataattgaagacaacttgattgtacttgttccttgttttgtggaaatctttatatgactatcttaacgtccttgacgccttggcggacatgcaacaggaatattttttttctcaaacccgcatgagaggtgctcatcattatattaagaaaataaaaagggtttaaaatagaccggtacaagaaagaggagccaccttattgtggaataaccaaaatagagaaatgtgtctagtacaacactaaaaagactaccatctaggaattggggcgtttaggatagaagttcttggcctctgcgatctcccatacaacaccctctcttcctcagcccttcttatggctgtatctatagttggtatgattttgttgaagaccttatggctatatctacatttgggatgattttgttgaagacgtagctgttcctatggttctaaatggtctataaacttagaattattgatgtgctaagccctttttaggtatgccttgcaccatttgggatgattatgttgaagacgtagctgttcctatggttctaaatggtctataaacttagaattattaatgtgttaagccctttttagctatgccttgcacatgcagacatgctcgccttcccttctccaccattccatagcctttccttccaccattccatagccttccctttccctaactgaggagcagcttgaaggttgacctgcccaagcaatttgcactaaaattcccttgcaaagacacaaccaaccaataaatggtctattgatttctcatcctggtcataaaattggcatctttcaggatgttgctaccttcttttttagtcgatatgctgtctagcacctttgaagggtagctagccaaaggaagaacttgcatttcgggggagcacatgatttatatatctttccactatgttcaaactgaattgcaccaatgaagaggctctcataagcagccttgaccgagtatttgccatctagagcaaatctaaaaatgtgtttgtcctccctttttttgggtgcaactgaacaatgcttatagtatcccaaagggtgagataaccgaccgatacacgtactgtgaaggcgccgatgatgtctggctatccatctcatgtccatgagggcatcacgcacggttctactgctagctgtgcgtttaaggacaatagctagaactctgagagcaagatcctcaatacttttcccatgcaaccagggatcctgccagaatagagttgaagtgccactgccaattttagtcaacaaggttgtggagaagaaacacttaaccttttcagagaacttcatgggcaagaaggaccaatgtttcccaggatctgttttggatagcaacaaccatctccgtggactttgcaactctaaagttatggtgtttagctggttctgccatctactttttaaagttttgatttggaaccatactaaacaacttgtaaatggaaaccgtagtagcattcgagcattttgctaggagatatggaaggacaagatttgtatggatttgaaatcaaaattttcgacctttagttttggaccattcccaggcccagcctaacccaataaggcccagcttaaaaccaaccagacccagatcaaaccagcgcactgtacccaacattttggagactccacgcagggagcagttggttgagtcgatccagctaagcagccgtcgccgtctcctccttccgccgtaaaaagatcgggt

SEQ ID NO: 15480 - DNA, 1257 bp, Zea mays
  misc_feature (1253)..(1256): n is a, c, g, or t
ccggccgggaggcctggttcggcccggccttcccgttccactccgcgtctcctgtgtcctctcgcgcgccgcgccgcccctcaggccgagactcccctcaggccccagctctcgctctccggtctccaccgccgctccggtgctcccttccgggattcccctccggcgagcttgctcagctccgctccaggtttccacgtcgtccatggcgctcgtcgtgatgtgtgggcagccgtgcagcggtaaaacagcagccgccgcttgccttgctgtggcgctgcactcctcctcgcctgaccttactgtccgaatcatcgatgagtcatccctccatctcaggcgcaacgatagctacaaagatatggttgtggagaaaaacttgagagggcttcttagatcagaagttgacaggtctgtgtcacgcgacagcataattattgtcgactcgttgaataatattaaggggtaccgctatgagttgtggtgtcttgcgcgtgcatctggtgtaagatattgtgtgcttttttgtgatacagaagtggaccattgtaaggaatggaacagcaaccgccaggagaaaggagaacctgcatatgatactaatatatttgaagatcttgtaagtagatttgagaagccagatagacgcaatcgttgggattcccctctttttgaattgttcccatctagagatgaattagtggaaacagctcctgttattgctgaagctgtgtcatatttgacagaaaaagtggattccaaaacaagagatgtaaaagttctccagcctacaatagccactcagacggtgcgaacaacagaggctaattccctctatgagatggacaaggcaacacaggaggtggtcaatgcaattgttgaagcacagtcatgcggtcttgggcttgctgtgaataagatctccattggacccaacttgccaactatcaagcttgagagatctgttggcctacctgagctcagaagcctgcggagaactttcatcaagctggcagggcagtacagtctgagtgggccaccaccaccgacagatgctgacagcgcaaagaggatgtttgtcgactacttagaccgtgaacttggtgcatgataattttcattcgcctgcgttgcattaacactatgcagcatgtggttaacttgggggatagataattgaagacaacttgattgtacttgttccttgttttgtgggaatctttatatgactatcttaccgtccttgacgcctnnnna

SEQ ID NO: 15481 - DNA, 1536 bp, Zea mays
  misc_feature (4)..(4): n is a, c, g, or t
gccngcccggggcccgccggacacacgactagaaccaggcaaccagctgcggagggaggaaacctagcggaacactgtgcaggtgacggcggcgcgctaccggtgacaggggatacggcggcatcgtcccctcctccatccccggcgcggcggcgccagcagccggcctgcaggcacacaagtggccacccttccaatggcggtggagaagtccagcagcggcacatcaactccctccaccacctccaccatggaccggtttcagaagattgtcctaagctgggattacctccgtctcatcgctgaatccaagggcggcaagcaggccaaggtgctgcagcatgtgaagaacacatacgtctcggtggctgagtaccttggtgtctttgagccactgctctttgaggaggtcaaggcgcagatcatccagggacgcagtaacgacgaggaagaatctgggatggactggaggaggggagcagtggggtcgtgcacggagtctgaggggttccacaagctctctgtggcggtggaagacaattttcaggataatgtgtcagagaatgatctactgcttatctccaaggagaaatttgaggagggatcgacccctaatgcatatgcatttgcattagtggagcagcgaggtggtggcatacatatttcacttagaacttttgtggcaggtgaaattcaaaatctgaatgttgcaaagcctgtgaagtctacaaggctgcaacattttgcttccattattgcaagtcaaaacagcttgctgtggatactgaaggtctgcagcttgtctacaataatgcgggagttcacagctatgcattccgtagcttctctaccttttaaggatttgattctttcagctaccgaggcgcacaagcatggtgatgatcaaagtcgtgcgtggaatgtccctgagccacttatggattatctcaaagtgaatcttaatgattcccagctagaagctgttaatgtgagcatcctttggggttttgcattgttggtatctgtgttgtgttcctaatgtttttaaaagctatggttctgatagttactgcatttttttctctaggcaggtctttcacgcagatcctttgttcttattcaggtctgttattttttaccactattattttacattgttattgtttacctgtcttgattaattatatgaaagtattgcaaatacctgagctgtcttagctatatgcttttcttttgaatgatatgcggattgaacacatacaccatttaagactaatgtgcaatttgctgattatgttatttcttctaagttttatctgcttatttgcagggccctccaggaacaggaaagacacaaactattcttggactccttagtgccgttctccattctgctcctgcaagaatgcagatcaagtaacaaagccacttggttattctttatattttggtgtatggagtagtaattttatttttgaggatagaaaaacttcatgtttatcatatacgagagagtaattatactgcaggcatgca

SEQ ID NO: 15482 - DNA, 2316 bp, Zea mays
gtttataaatttcagatttgcctattctccccctctaggcgactttcaacaagcaagtttgttatgcatcggatagatccactactctattggatgcagaatcagacatcatgtacaagcaagtatgttacgcgtcaaacagatctcctactcgattggatgcagaatccgattctgcatggaggcgggttacaaatccgatacgacaactaactctggtcataaccaaccacccctatacaagaactccatgtcaagcacgcgacaacatggatccgactcaaattcggaaacccaagtctcgataggaaataacttagatgacaatgaagatccaacaataaatatgttgccactcaccggtctccagctatgcattgtcatcgttgtcacccaagctttgcaattagctagatggtgcagtacttcgggtccgagtgataagcctttcatgggataccacttgcagcaacattcatgatggacctttctactccaacactcatgatccatcaagggagatattcatggtgcgtatagtggagggtcatgtgggaaatggccctatcaataaggattttgcatcttttctatgtgaaactccatcaactaaagcagatcatattgctcacaacatagcaagggcagcgaagcaacaccaacgagtagcaagagcaggactccatcaacttatctcacatgacgagcaaacaagttctaacaaaaccgctcgatgcagaaaatattgtctggaccataatcatgatagtgagagaatatgttgttatgagagataaggagttactgactgcttccagccgacttgtgccaagggacgtcggacgtgtcccctgcacgatcccatgcagggagtggccaacggacgtgcaccagttatggtgtacagacgtgacccgtaggtctgcttctctagtagtcgctttacttgtatatatacatccaagcaataaagtgatgtcggttctcatttaaacagatgtcaaacccgtgcagaagacaatagatgccatagtgggccaatgaaatgaaggaaactcttattggagcttaacgacatgtaactagagaaatcgtggagctgaggttatggtgcgacagtattttaattagaagctagatcattgcatcacgtttcaccaaaacaggagttattgtctccccagttcccatcactttctcgcgtgtggtttcatctctcgcgtaccacagctccccttgaatccttgatagcaaatgcaatgctgccgcccctgcttatggtagaacatttcttatgatccacttgtactgttttaggttatcacaagagaatcaactacagacatcatatgcaaatgatggcgaacgaaatgcaccgcagtatgaggcaaaccgcaaacacataacccgagagataacagttccctgataatgaaattatacaatcatcaatcccatatacattgctgggaataaaagttccgatatgacagcctttcagaaaggaacttagcaagttttatagctttaggcccaggtctcagaacatctgggttacctgaaatgtcgcatggactatcatgcccaacacctatgcaccatcctcctgtaactagctctccaggatgacggtgcaaaatttcttcatcgatgcgatcaagcgcatgatcatctttgggaaatctagtcccaaaggctgcaccactttcggtcatattttctacatcatctatagtcagtaggcgtggctcgtttttggaacgagcatcccatgttgaatagtgtaggtcatggttaactacagtcttgttgaattcagcggagttgcaaagaactgtctgaaaatacttcctgtgtggcaagggcatgttagtgtagtacatcagcagagttcttggcagattatccataccaacaatacaatattcaataaatttccgagaaaggataacagacgaagagcctgcaaggaaataatttgtaagcatttggtatatcacgcttttggagacaatgttactatgttagacataagtaaaaacagagcaaactatcaatacaacaaacaagaaacaagtgaaatagcactaaacaatgatgtgtagcagctatatagtgttgtcagtcatctaatgcagttgaagatctcaaagaaatcagtggacaacttcaactctcatttatgttttgaaatcttttactaaaggttttgtgtctagctaaatataaagtaaaaaaaatatcgcgaaaagctaaaatgtcttataatttggaacagagggagggagtactcctgattcctgaagaattccaggg

SEQ ID NO: 15483 - DNA, 1832 bp, Zea mays
cctcgaggccggccgggacaccaagcagcccaacccatcggttcgacaacttcacagaccagtgagtgacacacacccatgccgccgccgccgccgctcgcgcgccgcctactcctccagccgctaccgagcggcgcgcgcgccctccacacgaccccgggggtgctggcctgccgcctggcgtcccgcgccgtggtccgcttcgcggggcccgaggcggcgcgcttcctccactcgctgctcaccaacgacctcctctccgccttctccgcggccggcgcgtcgtcgccgcagcggtacgcgcccacgccgaacgcgcccgcgcggggccccgcggcgcccgcctacgccgcgctgctcacgccgcagggcaggttcctctacgacctcttcctctaccggcccccgccgcggtcccagatgctcgaccgcacaggatccgcgccggagaccggtgaggcccccgaggggcacccgcacctgcaggaggtgctcgcagacgttgacgccgccgaggtggacgacctcgtcgcctgctttaagagatatcgtttgagatccaaggttgaaatagacaatgtaagtgagaattttgcatgttggcaaagatttggacatgatgtagtgcacactgaaccttctactcaagaacctgaggctcaatccattgggtggggacaaggtgttgaccatgctggcgagtcagctgcgcaagggaacggtcatggatggcaatggctcaaagatcctcggttggactaccttggttacagaggaatttttccagctgacacgataccacccctagttgagtctgacaaagaagcagatgaacgccattatcaactttggcggatagaaaatggagtcgcagaaggttcgactgagatcccaaaaggcgaagcaatcccgctggagtacaatcttgctggcttgaacgccatttcgttcgagaagggctgctacatcgggcaggagcttatcgctcggacgcaccatcgcggtgtcatccggaagcgcctaatgccaatgaagttcgtcgacgggaatgggcaagaactcgagcaggccgtcgctccaggctcggaggtcgtggacgaggcttcaggcaagaaggtcggggcagtgagcaccgctctgggctcccgcgggatgggcctgctacggctcgaagaagcactgaaaccgggctcggccctccgcgccggcggcaacagggacgtgagggtccaggcgatcaggccggactggtggccagccgagtggacgcaggtgcttcaggaacagcgcgcagccgcttgacagcagcggagctgtatgtagtactggaccccaaacacaaaccctgcctgtcgtcagttagtcgcctcttggaagaggacccaaacaaaccccatagctaaccgttttcagcttcggtttttagtcttgttgtctggtgtatcaaggcggagcctgttttttttcctcgcagaagacgaggaaggcaggagggcctgtttctcttcctctctgcctgctgctgtgttcagctgcggcatctcgttcagaacgagatgagcaaactgtgtgagtgtgtgtgtggcccaaacacgcagtgtgttcgaataagtttatctgtactacactgaataataagtttctctgtcttgatgatcttgtacaacgttttatattggacggtcatgggctctgtacgttgcgttgctctcgcatgtaaagcatttcatgctgagggttgtctcagcattatactgttttgttaggaacgcaattatgataaaaggatttgttgtgggcttatttaaatatataattttatttttttattg

SEQ ID NO: 15484 - DNA, 3034 bp, Zea mays
tcttgtttttatgtttggtacgcttctggaaaatgttcagttcccatataggatttgttcatctaatatctttacaaatcagcgtatctgtttcatcacatcaacatagccttttagtcccaagcaagttagggtaggctagagttgaaacccaacaagatgccacaaaaaaagaaagagagagaaagggtgggggaagcttttgatagcactaaaaggaaaaaggcctaaatgagtgtatctgtttgcttagccaaatttcatctaatggttttcttatctctagactttatcgtgaccttgaagctactccaaattcactttttgactgtgttcgatttatatggttctagaactgtgactgcagtaatgtctcagtaagacatagataatatgaatgagcggccacatgccacataacttttttataggaaaaaaaagcttcagattatattatagacgggaaaaggcaggtttgacataattttgccaattgtccagctattgggtgacgcctttttcagctcagatacctggtgccttagattgttctccttcccgtcctttttgacgaagttgtgttcatttgattcaggcgaagcaatcccgctggagtacaatcttgctggcttgaacgccatttcgttcgagaagggctgctacatcgggcaggagcttatcgctcggacgcaccatcgcggtgtcatccggaagcgcctaatgccaatgaagttcgtcgacgggaatgggcaaggtataatacaattctttttttcgtggtgattggtgaacagcacggtgcaccgccgttctgtctgtcgctggctatgctaattgtgcagcctctggcatcagaactcgagcaggccgtcgctccaggctcggaggtcgtggacgaggcttcaggcaagaaggtcggggcagtgagcaccgctctgggctcccgcgggatgggcctgctaagactcgaagaagcactgaaaccgggctcggccctccgcgccggcggcaacagggacgtgagggtccaggcgatcaagccggactggtggccagccgagtggacgcaggtgcttcaggaacagcgcgcagccgcttgacagtggagctgtatgtagtaatggaccccaaacccaaaccctgcctgccgtcagttagtcgcctcttggaagaggacccaaacaaactcatagctaaccgttttcagcttcggtttttagtcttgttgtctggtgtatcaaggcggagcctgtttttttttttccctcgcagaagacgaggaaggcaggagggcctgtttctcttcctctctgcctgctgctgtgttcagctgcggcatctcgttcagaacgagatgagcaaactgtgtgagtgtgtgtgtggcccaaacaggcagtgtgttcgaataagtttatctgtactacactgaataataagtttctctgtctggatgatcttgtacaacgttttatattggacggtcatgggctcccggctctgtacgttgcgttgctctcgcatgtaaagcatttcatggctggggattgtctcagcattatacttttttttaggaactaaattatgataaaagaatttgttgtgggcagaatcactgtatgcttgtaggatcatatacgactgagtttctgacattttctgtagaatgcgtcacggctaaccgattatgagctgttttgaataagctttgggttgggagaaaataccggggaaattaaaggaagtgtttggagattagttaccaacacactgtcagagttacactgtgtctggtttcatactcgagggaagaaaagctggcctttttacgatagttaagagaggcaaataaatgtttttttttttactttcagctttggtcctttgtcactgaccatggactggaccacactaggctaggcagtaggcacacagtgttccggaaatccagtgtgcctgcctccagtgcgattagagatggcaatggggacccgatccccgattccccgcggggaattcctctattaggggatggggatgggggagtttcttcccccacggggatgtaaacgggggaaaactctcccccgacgggtaaatggggatggggatgggaaagcattccccatccccgttccccgcggggacccgttaaacttacatgtgacagtgttttcatgtaatagttaatgataaaaataaagaattaccttgtcaagagatcacccgttgtacaaatacattgattttaatgcgcacataatgatttttacatctaacaatgtgtataagtgacaatgttttacattaataacaaataaagtatgatttaattataatttaaacggggatggggatacccgacggggatttatcctcgcggggaacggggatagggaagaaatgtcccccgcaagcattcgtggggatccccgcggggaaattttttcgtcgcggggacgggtttggggagctaaaacccgacggggaattccccgttgccatccctaagtgcgatggccgatgcatgggtacgtgcctgcagtatgttgaccactgacgcctgatgccttggattccctgtgaccttttggcagaggtagtaaatgaaaataaaaacaaaaatactacgggcgtggaacttagaaagaaattggtgctgcatataataataacaacaacaataatgataataataatattaatattgaatatctcaaaaaaactggccaaatggtccgtcaacctaaattgtggttattgaacagtaaaataactcttcaatagactaaccaactgactcgtcaagttatctgactctttaaattgggttccgtaatagccaaacatgactagccgctctaactagctaaactagatagatagatattctattagagtaagatattatatatagtgtaatctttatgaaatggtaaataaagagccaaaaataaaaaacctcttgaaaatactctaatactgatacacaaacatgtcgcttgtagtgaagcagggcgcggtgtgaagtgtgcag

SEQ ID NO: 15485 - DNA, 810 bp, Zea mays
ggacgctgggcggacgcgtgggcggacgcgtgggttctaagatcgcgagcggcgccctttttttttatttttttttttatttttttttttacttttttctgcttcttttttttttttttttaataaagaaaacaaaagataagcaaccattaaagggtccgagaacaaataagcaccatgttgcatgttttgataaattgattactacaaattaatgatcgcttccctcaagattgaaacaaactgccgtttcaagacaaaacttgtgtacacaggagtggaacagatgagatatgtgcaagtcattgtgggttttggaatctgcaacagtcgtcaatatcgcttttcatgcttcacgtaggtctgtcatctcaaacctgacatttgggttcatgtacacatgggagcaatgctcatagattggtgttccatctaggggctcctcatgagggtggaatccagttgcatcacaatcatggatcacgcccatgccacatggctccgcgagatgaaatatgccatgttttcttgttgtatccgtatggagccataactattgcaatcgcttccggaagcataatctgatatgcgtaatgattatgaagatcaatggaagataggaagcaggtctgtgttggatgtgtatgaatccaaccaagagataaaagggagcctttgtcctgaacttcaaatatttcttcttcattcgtagcttgacatgaatcagatgttgatttctgcttaggaattatcaatgttgtcacataaaaggttctctttttcagagtaccagcaagaattccacaggtt

SEQ ID NO: 15486 - DNA, 2026 bp, Zea mays
cccatggccgctttgttgtttttttttttcaactgcaacacacaaacatgtattatattaaagaaaacaaaagataagcaaccattaaagggtccgagaacaaataagcaccatgttgcatgttttgataaattgattactacaaattaatgatcgcttccctcaagattgaaacaaactgccgtttcaagacaaaacttgtgtacacaggagtggaacagatgagatatgtgcaagtcattgtgggttttggaatctgcaacagtcgtcaatatcgcttttcatgcttcacgtaggtctgtcatctcaaacctgacatttgggttcatgtacacatgggagcaatgctcatagattggtgttccatctaggggctcctcatgagggtggaatccagttgcatcacaatcatggatcacgcccatgccacatggctccgttagatgaaatatgccatgttttcttgttgtatccgtaggagccataactattgcaatcgcttccggaagcataatctgatatgcgtaatgattatgaagatcaatggaagataggaagcaggtctgtgttggatgtgtatgaatccaaccaagagataaaagggagcctttgtcctgaacttcaaatatttcttcttcattcgtagcttgacatgaatcagatgttgatttctgcttaggaattatcaatgttgtcacataaaaggttctctttttcagagtaccagcaagaattccacaggtttccaaattctttgcggtatttaactcagcgaccctcaggaaacactccattaatgccactggcacatgcaaattctgatagcgtccggttgcagatgtagcaagtcctggtcttggatcagcaactcttgatggaggaatttgaccatgctcagggtgcacttgagctaggacaggtgggggagaaggttgtctaatattcaggtgagagaactctgcttccaaaccaggagacactgaggctggttctaatggtaatgaccacctgccatcatcaagcgatagaacagacagcatatcgtcacttttgccctgagatgctgtactgggaccacgcaaaccatcttggttcaaggttgttggcattaaactagaaatgtcactttgggttaattcaggattatgtggatactcaatcctgataccagtaacaggtcttgcccattgacccagattcccctgaagcccattaggtcctagtatcgagtgtctcgataatgtttcctcttttggatacagcatgttggtagatggtttcatagcatgtctataaggttgaacattctgcgacatagctgcttgatgctttgaaccaggtaatggtttctgcagtagtctagtagggcttccagacaaggacttcgacacatatgggcctggggtatggtgctccaactcactacttgcagcataggttccatatacaccattaggttcatctgcacccctgctattaccggtggcaatttgttgctgcacaactggcttaagggactctagctcattgacaataccaagaattttctcagagttgtgtgggcctttcttcaggaattccttttctctagccttaaatgcattataatcgcgatgtttgggtatggtctcaagcaacaagctcgagtatctcaggaggaggatgtagaggtccagaacattcttctcttctcgatacacattagcctggcggaggaggttgtcagcgatgcggaaatagtagtggatgcttatgcggtggtccacggcgataggccgcgccatggactcgatgcatacgtctctcctagtgccgtgagatagttccgaagccatctcaggtggggtgggactgactccgcggcaggtcaggcgatggatctccgcttcaacccgctacggcagcgcaaaagtcgacgggcgatcacggacacggaagcggggtaggatggggggcgtgcttgaaggaaaacgtgggaaggagaaggggaatgtcgcgttgatgtattcagccggccggcctcgag

SEQ ID NO: 15487 - DNA, 2786 bp, Zea mays
gcacgagaccattacctagggcccccggcccgaatcaagtttagtcctcgggagccctcgcgtgcgctctcttttcctgtgtctgctgccgacgaaagggcggccgccgccagacctccatcttcgtgaccttcgtaggcggcgagcacccaccaggagaaggcatggcttcacgcatgacaccttccaagaggccttttcagagaagatcttcagactacgatggccggggcaagtggcagaagacgaagcacccttctccacataaatctcagttcaaaatcgagcctggtgttcccattttccgtattctctgcccggcttcaaaatctggtaatgtgattggcaaaggaggtgccattattgcaaagatacgtcaagaaaccaggatgagaatcagggttgatagggcagcccccggctgtgacgagagagtcatcttcataactgctgccaacaaggatgaagaagctggcagcgagcaaggcggagagaatgacggaggtgctgctgcttctactggtggtgaccatgagaaggataaagataacaacagcaaggagcaaaacgttgatccagaggagaacaactgcaacgagcagaatgatgattcagagaaaggaagtggtaaggaagaaatagatggtttcgagaaagaccatggtacggaagaaaagaatgattcagagaaagaacacaataagggagaaaaggatgatcccttggttgcgaaagttacaaagttagaaccagagagggtaataccgttggcactgaaggccgtttcacttgtattcgataggatttttgcaactgaaggtaataatgaaactgggaacgcatctgctgcaagcgctcctgtttcgttgcgaatgttggtgctatacagccaagcaggttggctcctggggaagggcggtagtgtggttaagcaaatggcagcagataacggctgtgaaatccgtgttttgaaagacaaccttccgtcatgtgctctgttgaatgacaaactttgccagatcactggagagattgactcagtaaggaaaggtctcaatgctgtatctgaagtgctcttagctcatccacccaaggaaactgatgcagttgctgatgttcattcttctggatcatcgtcacgttctttgttcagccagcctgatggtcttccctctggaatgcaatctaacttccatatacctttgcaaggcccgccatcccaagccaatggaccttttgatatagttgatcttcaacctccaatacatggtcatgcctcagtggctatagaatccctctcctttaggatgctgtgtccacaagacaaggttggcagtataataggcaagggtggaaatattgttaaaaccattcaaaatgatacaggctgtgaaattaaagttcttgacactgttccaaaaacagatgatcgcatcataagtatatctggacctgcgcatccgagtgatggaatctcccctgcacagaatgccattctgcatgtgcagcgtaaaattatgttacctagctctgataagaaggaaggtcctgcaacgtgtaggctgatcgtttctggaaaccaagttggttgtgttctcggcaagggtggtagtatcatagctgaaatgaggaagctgtcaggagcatttatagtagtgttgagcaaagacaagattccaaggggtgtcccagagcatgatgaagttatccagataaacggaagttgtgaagctattcaagaagctctaatgcaggttacagctaggcttcgtaaccatcttttccgggacagaatgcctgcagtggggcctaatatgcggccaccttttggtttgttagatccccagtttggtccattttcgggaaaccatgaatcatcatccctgtttcataaagatttcatgggacgaccattggatgggattgctgctccttggacagtgaagggcatgcgggatctcagcgatccagtgtcaatatccgatatccctggagcagggcatagagaagctggtggatttccaggtcctggtcagccatctatgatgccaaacttgactgcagaggtcttggttccaagattagttatccctgttctctgcggtgaggatggaggttgtttggacaggatccgtgagttttctgaagctaagataactgtcgctgagcctacagccgatgcgatggacactgctgttttgatatctggcacaccagagcagatgcatgcagcccgaagtctcgttgaagcattcgttatgagcgaatcttttggcccatgacatgtccagaggcagtgaagctagcgatcatatgtgggttcatgtttgtgaatatgcgtcccagtctgtctgcagagtgacatatgctccaagtggctaattaggctgaatattcgactggagtcctctttctgtctgcagagtggcaaatgctccaggttgctagttatatataatcttccaaagtcgtcactttgactctgagatacggagcacattttgagtagccgcagaactatgttgcttatgcaaggaagtattgtttggacccggaaaggctctaactttatttttgttgtactgatgttgtgagatgtaccaccattgtctgtatttcagtccggctttaaatatgtattttatggtattgctaccatagttaatatgacggtaaggcagcgaaaaggcgtaagccggggaatattaaatagtagaaatctttatctttatatatactaatataatgaagcagatgcaaattcaaccaagagaaaaaaaaaaaaa

SEQ ID NO: 15488 - DNA, 730 bp, Zea mays
  misc_feature (2)..(2): n is a, c, g, or t
  misc_feature (31)..(31): n is a, c, g, or t
  misc_feature (695)..(695): n is a, c, g, or t
  misc_feature (699)..(699): n is a, c, g, or t
  misc_feature (702)..(704): n is a, c, g, or t
  misc_feature (710)..(710): n is a, c, g, or t
  misc_feature (716)..(716): n is a, c, g, or t
  misc_feature (722)..(722): n is a, c, g, or t
gnaccatttcataactttgtcaaagttaaantataggctaaatcctatatatcttaatggcacatgcagcgcaagtaggtctacaagacgctacttcccctatcatagaagagcttatcacctttcatgatcacgccctcataatcattttccttatctgcttcctagtcctgtatgcccttttcctaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgatccctcccttaccatcaaatcaattggccaccaatggtactgaacctacgagtacaccgactacggcggactaatcttcaactcctacatacttcccccattattcctagaaccaggcgacctgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgctacacgaccgggggtatactacggtcaatgctctgaaatctgtggagcaaaccacagtttcatgcccatcgtctagaattanttcncgnnngctccnctgagntagggnccgtattt

SEQ ID NO: 15489 - DNA, 1994 bp, Zea mays
ttgggtacctcgaggccggccgggaggctccactctccagaccccggtacagccccctcgcggagccgcggacacaccttcctcctcctcccgtcgccatggacgtctgctcctccacgatctagcctgtggctattggttagcacgccggcgccggcgccggcgaccctaaagggagcgttaacgttgtatcccgagattttatgctctaagctttcgagccgcgtcatgggaaggaagcctgacgcggtagccaaatcgtatcattccggtggcggcggcgctgccgcctcctcgccgagggcagcgaggaaggcgtcgccttctccggtgttcctgggaaccgcgctgttcgttctagggtttgtgtccctctttacgggacacgtggtcaccgacgctgactgggcgcggatccgcagtcgatggcgacccaaacagcatagaaactacgaacctatcgatatttgggaatccaagtattccagcatgtactacggatgcagcgagagaagcgcgagtttcagatctgctgtgccagagaacagttccactggttacttgttgattgctactagtgggggcctgaatcagcagcgcatagggataacagatgctgttgtagttgcctggattttgaatgccacacttgttgtacctgagttagaccaccactcgttctggaaagacgacagtgacttctctgacatttttgacgtggagtggttcatttcccacctatcgaaggatgtaactattgtcaaaaggatcccttatgaagtaatgttgtcaatggataaactaccatggactatgcgcgcacctaggaaatcggtgcctgagttttatattgatgaagttctgccaatactcatgcgaaggcgagctttgcaattaacaaagtttgattataggctcactagcgatcttgatgaagatttgcaaaagttacgttgccgagtaaattttcatgctttaaaatttacgagttctattcacgccatgggtcagaaacttgttcaaaagctgagactaatgaacacacgatatgtcgccattcatttgaggtttgaacctgacatgcttgcattttctggctgttactacggtggcggtgaaaaagaaagaaaggaattgggtgaaattaggaaacgatgggatacattacctgagttgagtgctgaagatgaacgcagcagaggaaaatgtccactgactcctcatgaagtcgggttaatgctccgagctcttggttttggcaacgatacacttctgtatgttgcttctggagaaatatatggtggagatagtactctccaacctcttaggggactcttcccaaatttctatactaaggagaagcttgctggggatgatttaaatcccttccttcctttttcttcacggttggctgcaattgacttcattgtttgtgatgagagtgatgtctttgttacgaataataatgggaacatggccaaagttttagctggacggaggcgatacatgggccacaagagaactattcgcccaaatgcaaagaaactcaatgtactatttcaaacacggaatcaattgagctgggataccttttcacggaaggtacagagagttcagaggggtcttatgggggagccggacgatatcagaccaaaacaggatgacttccatgaatttccatcatcttgcatctgctcaagaaaacctgggaacatatcggccacaacatgaaaaccaaccggacagggcaaatgcagcgaggatgctgctagttgggcacttactttgacagtagggaaacatatgcttacgttgaaagaaacacggtagaattaacagggcaaggagggagtgcatatatgtcatggctcggtaagatgccacgtcaaggagagttgccaactggtgatgtcatgcctgtaaattattgttcgtacatgattaattctttaaacatgttgtccgctcgctgttcctcaaaaaaaaaaaaaaaa

SEQ ID NO: 15490 - DNA, 733 bp, Zea mays
actttcatgtatacatcagtgaaaatgctctttgtttgtgcggatccagtagtactttgttttgcctttttgcttgagcaagtgtagttcaccgccacttatttgccagtaaagatgtacgtggagcctgcatgagggcagccgtgctgaaactgccgtcgatctgggtccagactcggaggacggcagcaagaggaggtcgctggccaccgccatgttctgtgtggcgaaacagggcgcggacgcggcggcgctgcaggcagggctcaactgggcgtgcgggcagggccgagcgaactgtgcgcccatccagcccggcgggccgtgctacaagcagaacgacctggaggcgctagcgtcctacgcctacaacgactactaccagaagaactttgctaccggcggctcctgcggcttcaacggcacagctacgaccaccaccagtgatcccagctcgggggcagtgcgtcttcacaggaaggtgagcgtcttgaggtcacagaagcgccactatacatgtcactcagtcactgtcagtcagaattcagaaacgtgcaagtggtagcacgtaacgtcttctctttttggcatgcagctccatggcaggaggcggcacgccggctgcgagcgcccccagcggcctctccccgccgtcgtcgttcacgccgggcattgggagcccctccaacaccctgatccctctggacggcgccgagagcctggtgtccagcgt

SEQ ID NO: 15491 - DNA, 1194 bp, Zea mays
cctcgaggccggccgggtggtaccctcgaggccggcccggccgggattcatgcccacaaattccttccaaacagaaacagcaccagactcctttccttttcctctcgctccctcgctctttctcccgcaactcggcgtcggcgaccgctgccgctgccctactacgccaggtgcactgctgctggtctagtagcctcgtcggtcccttcgacaggttttcttcgggtcttcgccggcgacgagcacccgccaggtggccaatgataatgttggcggtcagagggctgaacagtaaaatgctggagaaaagactgcacggatgcctgctcctgctcgtcttccttctggcagacgtatcaggcagccgtgctgaaactgccgtcgatctgggtccagactcggaggacggcagcaagaggaggtcgctggccaccaccatgttctgtgtggcgaaacagggcgcggacgcgacggcgctgcaggcagggctcaactgggcgtgcgggcagggccgagcgaactgtgcgcccatccagcccggcgggccgtgctacaagcagaacgacctggaggcgctagcgtcctacgcctacaacgactactaccagaagaactttgctaccggcggctcctgcggcttcaacggcacagctacgaccaccaccagtgatcccagctcggggcagtgcgtcttcacaggaagctccatggcaggaggcggcacgccggctgcgagcgcccccagcggcctctccccgccgtcgtcgttcacgccgggcattgggagcccctccaacaccctgatccctctggacggcgcccagagcctggtgtccagcgtctggtcggcgatttgcgccccgctgctggcgttgccgctcttcttcctctgaccaccagcggccggcggcagatgagtggccggtgcttgctagtagagcgcttattatgtttttgttcttgttcctgggtagatcgctctcgtgtggcggtgttgatgtacatgtcagggtcgtgttggatgcgctgggatgggagattacataagatgctacagagatcgattcatacgtagaaagaggaccggactccgccgtgtttccgtgtgttctggtctcagatctgttcgtggcagaaactagatgtaaatgaatcatgttcactactctctgtgtacgaaaaaaaaaaaaaaaa

SEQ ID NO: 15492 - DNA, 1650 bp, Zea mays
  misc_feature (1631)..(1631): n is a, c, g, or t
atataaaaccctctgatttatatggtctctacgggtacctcactattatactatatgtataggtggagacacacccaccctttatttgcttcagactttagagacgatcgagtctttataatactattataaaggttgttttattaattaagtcagaatgggattgcagaagaagatacatagctgtctgacgtagctgtctgacgcattgctgctactcgctgattccttcccgaccaccgcttcacgcccgccgttgtttcgtacattgacagacaggctcacagccaattcagtgcgccatttcatgtagagccatctagttgataatttggtcaaaaccaattaccttctgcctacaatcggttcatattttgtaggtaactgaatccaattcccctcaggatcctttacatggcttctgttgttgagttcataaatgcagatctggtgactggttgagttcttgaggtcctcctcggtgaagttggtcgtcatcttggtgatgatgaagccggtgatggcgaactctgtgatgaagcgccagtgatgtcgatcgtcttcatcctctcttctcgaagcgcgcagcgcaagggtggtggtctggcgaggtgctggtcagctcgtccaggagacgtgggcggcggttgcggctatggcgacggcggaatcagcgggcgacggagatgtgagagcctccgtgccgttggagatggctgcggcgggggcagggaccggaagcgaggggaagtggggcgcgtcgcggagctggatcctgctcaacgcggccagggaggaccaggtgctggacgccgataagtacgccatcatgcgccgcgtcgacatcaacgcgcgcgacctccgcatcctcgacccgttgctatcctacccctcagcgaggtggcgttgttgctgctgctggtcgatcgtcatgggggtgggacgtcgcgcgctcggcggcgccatcccaagctccagctccatgccacaagtcttcttgcttgctggcaaagctgcgagctttgggactcggatgctctctgtttcttgtagaaacgcgcgcgctggctgctgcacctgcacggaggggagaaagcttgggattctgatgcaatggatggcggtcgtgggcggggataagaagatgctccgcgcagatccactccctttagcaggagtcaccgtgatgaagggccggtgattcgaggatggagcgcgggattcgtcgccatagaaggaagcctccgcgggcgggattcgcggcggatttggcagaccggcgattcgcggatccatggattcgccaatccatctcaagtcacgcaaggaaaggggcaggcgggcgctgttgggggagcggggcaaggctgccatgccgtcccgtgatttgtgggctcgatctcgcttcgcacaaggaaaggggagccgatctcgcgtcgcgcagccatggatgggagccgacgctgcggggggagcgggacgcggctgggggagcggggagcgcgatttgtgggctcaatctcgccgatctcgcttcgcgcaaggaaaggagagccgatctcgcgtcgcgcagccatggatgggagccggcgctgcgggggagcgggacgtggctgggaggcagaacgtgncacccggaacccggccggc

SEQ ID NO: 15493 - DNA, 1768 bp, Zea mays
ctgattgctcctgctcgtattcgtagatccacccacccatcgcccgcccggacagaaccctacagtacagcaagagatcgagcagccacgcccacgcttctctcctctcctctgaaactatcctactatcgtactttcctttttttgttcccttctctttctctctctcccgtcgtcgccatttatcactccttcctcgtcgaaaatcttctgtcgtaataaaggggtcatccgtccaccgtccacgtgggcggcggttgcggctacggcggcggcggcggcggcgtcagcgggcgccggagatgtgagagcctccgtgccgttggagatggctgcggcgggggcagggaccgggagcgaggggaagaagcggggcgcgtcgcggagctggatcctgctcgacgcggccggggaggagcagctgctggacgccgataagtacgccatcatgcgccgcgtcgacatcaacgcgcgcgacctccgcatcctcgacccgctgctatcctacccctccacaatcctcgggcgcgagcgtgccatcgtcctcaatctcgagcatataaaggcgatcatcacttccaacgaggttctgcttagggatccttctgatgagaatgtaatccctgtagtagaggagctccataggcggttagcaccatcgagtgctactcagcatgatggaaaagagaacttaagtggccagcatgatgtagaaggggcagaagaagatgaatctccttttgagttccgtgcattggaggttactctggaagcaatctgcagtttccttgatgcacgcactactgagcttgagaccgatgcttacccagctttggatgagttgacatccaagatcagcagccgcaacttggatagggtacgtaagttaaaaagcgggatgacaagattgaccgcaagggttcagaaggtgagagatgagcttgaacaattattggatgacgacgatgacatggctgatctttatttgtctagaaagttggctggggcatcttcccctgtcagtggttctggtggaccaaattggttccctgcctccccaactattggttcaaaaatatcaagagcaagcagagccagtgcagctactgtgcatggaaatgagaatgatgttgaagagctagagatgttgctggaggcatatttcatgcaagttgatggcacattaaacaaattgacaacgttgagagagtacatcgatgacacggaagattacatcaatatccagcttgataaccaccgtaatcagttgattcagctagagttattcttgagttctggtaccgtctgtctgtcgctgtactcattagttgctggagtctttggtatgaatattccgtatacctggaatgacggccacggatacatcttcaaatgggtggttcttgtatcagggcttttttgtgcctttatatttgtctccattgttgcttacgcacgacacaaggggctcgtcggatcctgaatagctgaaataaccgcgtacttgcttccctcaactgtaaatttgagccagtgagcatcgactttgcggggtgattcatctgttgtaccaaattcggtagtatcaaattggggatgttgaataggaactgtaataggaaaaagttaatgcaaaagaaatatgttatgattgcccccggttttataaagtttgcaccgaaagattcaaacaaatatgttattaaaaaaaaacacaaaaaagaaaaaaaaatcatagctatgcacaagtccaaaaaaaaaaaaaaaa

SEQ ID NO: 15494 - DNA, 1976 bp, Zea mays
ccgggagatgcttcttaatttaatagcagtggcggttgctctcctcccacgacggtggccatagtttagtcgcagcagtacaggctccacttgggagcgaggacgaggaggcgggtgccgctcctgtggcttcgccatgtgctctcgccccgcgtcctcggctcctccctcctcggtatctacatgccattatgccaagatctcccactctccgatctgaccagggccgggccaccgcagccatttgcgtctgctcttcccgaatccctgtctcgctttgccctccgtttctccagctataaagccggggggtcctgtggcgtgtgacctttttataccggatgtgcagcgcagggtcaacttcgtcaggtttcttggctccaacaaccttcctgggtcactctaaattgtaaagagatggggtgtggcccatcgatccccgacaagtacacgataggtgggaaggggcgcaagcgccggagcgtcatacaggaggttgccgtgttcgtgcccaccatccgcatcccagtggcctctgacatagctcatccactcaggggaatagtttccaaggatcttgtcgaccgactctccacactccgtgcccatgtcgcctcgctggctgaagaaatctatcacgcggacgtatcagctgttcaggaactgcagcatgcgttagaggagtacttgccagttgttcttggtttaacaacgaaagagagccgtcttgaatcgtcagtacagttcagatggaagaccttagacgacgaccaggagtgttgtctggcgagcgcgtggtatgaggtgctctcggtggtccacatgatggccatgcttgcgttgtttcaggctaacctattgctcatcccaaagagcagccaaggtggtggtgaaaggaaggtagcagaagacgcaaagaaggatgtcgtcgattcgttgctccgggcgtcgggatgcttagactactccgtgcatcgcatacttgttcagatacctgcgcaagtcaagaagagttttcccagttacttgcaggagggcatgcttgaggccatctcaattcaggcattggctcagtgtgtggaaatacagcttggcttggcttctgaatgtgagaaggcaacgctgtcagtaaagaggaggctagcttgtgagcaagtcagctatttttctcaggctcactattgtctgtcgggatgcgatacaagtgactcgtacgggaagaagcttctgctgttcctcaagtggaagtggatggaggccaaggctgtagcgtattactaccatggtctggtgctcgacaagggcggcgaaccggcaaaccatatcagtgcagtctgctgcctctctgcagctgatgacctgctctcagacagcaaaagggcttgcttgagtttttgcttggcaaatcctgtcacgagggtgcctcctccttggggtgtcatgaaaaacatgcacaaaaagatcccagatgtcgcttacaagaagttccaagcgcacgggcatctgtttgagcaaaacaagaacagcgcactccaatccgttcctgacctaccagagtttgcgctgtcgctgagaccggatggatacgagttgccaatcactgattcgatctgggagaatgttgatggccaacctcagattcaaagcctcaaggagcatatgatagatgacgaagatgaagtaggcacaaaatgatagttctcacttccaaatgcttcttttcattgtaccaccaaaagtagcagagttcaaaaacgcttaatccaaaatgttttggattcagcatatggctcaactgaaaaaggaatcgcgatctctgtattattgcaagtattaccatatgatatagtaaagtcttatgtgtaatagaatcataaataatagttggtttcttgctgtaatcgcctttaattttattttcccaactggcagaatagagcatcacagaaaaaaaaaaatacggcacgcatttcaat

SEQ ID NO: 15495 - DNA, 701 bp, Zea mays
gcacgaggacatggagtacaaggagttggctctggaatcaggcattgagaactggggccgggtccctgctcttggatgcacttcgactttcatctccgaccttgcagatgcggttgtcgaagccctcccatctgcctcggcgctgggaaccagaaagcctgaagacaccgattccagcatggatctgatgcattacctgaccaagatgttcttcggctcaatcttggcatttatcctgctgttgtcaccaagactggtttctgctttccggaacaccatgctttaggtggttaggtaggtaagcaaaaagggaatggtgtgataggtaattcttaaaaatttgagattaataatggaaaaactggagagagcttggtgatagtaactagagatcctttaggctttgtttgggtactctagtattgaccctaatccgtgtgttgagatagattgaggtgtaaattagtttaagttatacctcaattcagctcagtacatatagattgagctcaatactagaatactcaaactaggccttagtgcacgaggtagcagcttgtaatttgctgtttttgatattgttcacaggaaacattggtctcataaatgaatctgtgaaagcacataacgttacaaatcaaaggtctctgtgggcccttctctctttgttttaaaaaaaaaaaaaaaaaagcggcccggcc

SEQ ID NO: 15496 - DNA, 2335 bp, Zea mays
ctcgaagcttcgagcacgccacaacccaacggcgcgcgggcggcgggcccgtgagcgtgcagtgctgagtacacacgcacgccgagcggcgccactccgggttagcagcaacaatactgtgggattatatgagatgagaaggagactactagactagcagccgtatcactcactacccgctgcccgcgcccgatcgggcgcactgccctgtggtgtactggtgtgtcacgcccctcgtcactcaccccgtcacccgcaaccccatcttctattcttcccgacggcgctcctggcagcaggaacaagatgtccaatagggccacacattggtgttatgcctgtcggcggccaattcgtctccgtgggcaggatatcgcatgccccaactgcaatgatggttttatccaggaaattagtgagatgggtggcatattgaacacttatgggctaattgaaccagactttgaagagcgtcgagctagaagattcggaatgatggatgccatgtcttcccttatgcggcaacggatggaagaaatgggaagagatggtttgtttgatattcgtggtagacaaggaacaggtactgaatatggaaggaggccaactgctgttcctacattggtatttggcggcatcccttctcctggagttgatagcggtgatgttaatgttgtcctcaggggaggccgcagagttggcgctgcccaaccaaatttcagtagtttagttgttggtcccagtctggaagccctttttgagcagctacttctccagaacaaccgtcaaggcccagcacctgctccacagtcagctattgactccatgcctgtggtaaagataaaccgcaggcatcttgacgacgatccacagtgcgcagtttgcaaagacaaattcgaggttggagcagaggcacgggagatgccatgcaagcacctgtaccatactgactgcatcatcccctggctggttcagcacaattcttgccctgtttgccgccatccactgccatcacagagatcaggcagtaccagtagcgcccggccttcagcttactacaacgaagccgctgatcctcctggggtcaccagagcagatcttgaacctgctccaagagacggtggcagggaaagccaggaaaggcgccgctccttctcgtttctgtggccgtttggcccgtcgagttccagatccagttcttaccagtacgaacagaatgttgatgagcctgcagtatacgatccaaaccagatagcatattctgagtggcactatgaccactgactgaaaccctgcagcaatcgcaagctatctgcaattcgtgccttcaaccctcagctttggagaggcattcatcagctgtaatggctgcttgccgtataaaaaaaggatggttcttgcctgttatattgtgttcagtgcatagccttgctccgtatgtccgtcgtatatataatcccttgcgtgtagtaagcgatgaactgaatgcatccagaatatcatgtcatgataaacttgaatatagtttcatggttgttatttcagactgaaaataaaatcagtcttctgttccggttatactgatttctgaaagaattctagacctccgttcttgctttcaagacctccgttcttgaattgttgtccatttgttgtccgttttatatttgttgtccgttttatttctgagctaaatcatgacaaataaaaaagaacagagtaaatattttgggatcctgtagctggtctcaagctctctggtctgcccacaactgcttgcaagtgttgcttataatactttgataccccagttgataccatctctgcatatctgttagaagccaaatccctcgcactgtactattaatcatttgccagtttgacagtgttcgaaaacgagaagcatgtgcgctgttgaatagaccggataatagttggagtagaaaacgagtaacagacaagtaggcgagtaccaactccaacttacacgcttgtcctcacacggaggataaggctaagctcaacaagaatatgcgaaaatgaaagcagaagccattttggtcaagcatttgatcttttagttgtcatcagtgataatctaaattacgagtgtatctaataaggagaagttaaagcacctccaatggactctatttttacactatttaactttttatctacctcggtataaagattaaactctatagagcatctcattccaataatctctctaacagataagttagttaaactaactaagtttagctagcgagagaacccatttagagagccgaatagcttagtgagttggacgactaatctattgaagagttaa

SEQ ID NO: 15497 - DNA, 957 bp, Zea mays
cattgggccccccggggcattggggacctccagggcgggccgccctccccgcgccacgcgcccgattgggtgcactgcactggtggtgtgcacgcccctcgtcactcacacgctaccccatatcccattctccccgacggcgcttctggcagcaaggaacaatatgtccaatagggccacccattggtgttatgcctgtcggcgcccagttcatcttcgtgggcaggatatcatatgtcccaactgcaatgatggttttatccaagaaatcagtgagatgggtggcgtactgaacacttatggactaattgaaccggactttgaagagcgccagaccagaagatttggaatgatggatgccatatcttcccttatgcggcaacggctggcagaaataggaagagatagcttgtttgatatacatggtagacaagggacaggtactgaatatggaaggaggtcaactgctattcctacgctggtatttggtggcatcccttctcctgcagttggtagcagtgatgtcaatgttgtcatcaggggaggccgcagagctggcgctgcccgtccgaatttcagtagcttagttgttggtcccagtctggaagctctatttgagcagctactactccagaacaaccgtcaaggcccaccacctgctccacagtcagctattgactccatgcctgtggtaaagataaatcgcaggcatcttgacgaagatccacagtgtgcagtttgcaaagacaaattcgaggttggagcagaggcgcgggagatgccgtgcaagcacttgtaccatactgactgcatcatcccctggctggttcagcacaattcctgccctgtttgccgtcatccgctgccgtcacagcgatcaggcagtagtaccagcagcgcccgtgtgccttcagcatactacaacgaaacagctgatcctcctgcggtcgccaggga

SEQ ID NO: 15498 - DNA, 3464 bp, Zea mays
  misc_feature (316)..(316): n is a, c, g, or t
  misc_feature (576)..(576): n is a, c, g, or t
  misc_feature (936)..(936): n is a, c, g, or t
tgaagaatctcgtcttccgtaagcacgataagcacattctcggtcaaacaccacttcatcaggagctacttggatgaggggagtgttaaggccaactacattagcactcatgactagctcattgatttcctcaccaaatcacttgggagggtcaagtttcaggagattagcgatagacttgggatggttcaaatccctctagcggcaccacacaacacttagtgggagaatgataggataagttcagtgatgatatgataagtcccgtgcctatgtcagcatcttatctagtactttgacatcttaccttctaccntatctctaatctagtagttgaaattttatctctactttcagttataacagactacttggtcctatatatgtaaccataaccagccatgtttcaaagtgtggcataagaaatagaaaaatctgccccgaacctgtgctcaactccaacaaagcgtttggtagtgtcgagaaagctcacttttcttggcaagcttgctcggctcagcaaggatttccttgcccatggaggagagccgatatgacgctcccgcatgagcaagntcttactcgctcgtgttcagccgatggacttagaacatgaaggtgaaacgagtcatggcaccagccttgagggtgcataggataaatcaagttttgatgcagccaactagaggccgcatggtctgaatcaagatcctagtaagtcaacgacttgacgagcagcccttggtagaaacatcgtgctgccccaagtcgcctgctagtcctcaaattgaacgtcctgatgtagaccaagctccgtagtgcccaatagagatccttgatgcccaacttgattcatcttttgagatcttccccacgtagatcaagctgctccttccatctcgccttgaatcaagcttgtctcgtggaatcaatctnttgccaagcagaatcggcttggtaagattcaaattgagcctgctgctgttgtatcaagggtctctgtcctaatcttgctcgtcggtgctggtgtcaggctctcccatggatgagctcatggtatgtgagaaggggcagagagaggagaacccagcaaaggaactaaacagacaagcaaatctcatcttcctttgcagagtgagatgaggcgaggatggctaagcatggtgggactggcaaaggttgcaaacatgcccttaattacggaggatgggaccatgtgctgaccgaatccaaataaaatggtagggtcggatttctccagaatcactctgctgcaatccaaacatgctcttaatctaccgctgctgaaggtaatactatcttataccctaatcaagagtagaggtttagatatttgaaaaatgcacacaaaatacagtaaaaatcacacctttctatttggacggctctaattattgctaatataccttcttggccaaacgatctatttttctatctgtaacaagttcaaaatattagactcctttctgagatgtattagtacaatgactccatgatagtgtgcatacgaagctagaaaacatatgatataaattggttgggatggcaggaagaaccagttagtcgccctccctctggaggctatgactctaatgactgatctgtctctgtttatatagaggttaaacctaaaagactaacaaactgataacaatcctatctgtatgatgactgtatctctaactaaccctaacttaattgctagttactactaacatccccctgaccctaacaacttggggactcgactccttatttgtaagcatgccaacctccatcatggacgcatactttccataacattaatgtatcataagttcatataacatttgaagcaaatatgcagcagcttcacttcatgaaatgcataatccttatgaacgcgcataccagttgattggttttgtgggtctatgtggtagaaagctacatgcactttgttttataactgttgtccctagtgctttgtttatggaaactttctgctatgcgaatgcttaatttgtcgcagggacaagatgtccaatagggccacacattggtgttatgcctgtcggcggccaattcgtctccgtgggcaggatatcgcatgccccaactgcaatgatggttttatccaggaaattagtgagatgggtggcatattgaacacttatgggctaattgaaccagactttgaagagcgtcgagctagaagattcggaatgatggatgccatgtcttcccttatgcggcaacggatggaagaaatgggaagagatggtttgtttgatattcgtggtagacaaggaacaggtactgaatatggaaggaggccaactgctgttcctacattggtatttggcggcatcccttctcctggagttggtagcagtgatgtcaatgttgtcatcagggaaggccgcagagctggcgctgcccgtccgaatttcagtagcttagttgttggtcccagtctggaagctctatttgagcagctactactccagaacaaccgtcaaggcccaccacctgctccacagtcagctattggctccttgccgggggtaaagataaatcgcaggcatcttgacgaagatccacagtgtgcagtttgcaaagacaaattcgaggttggagcagaggcgcgggagatgccgtgcaagcacttgtaccatactgactgcatcatcccctggctggttcagcacaattcctgccctgtttgccgtcatccgctgccatcacagcgatcaggcagtagtaccagcagcgcccgtgtgccttcagcatactacaacgaaacagcttgccctcctgcggtcgccagggcagatttcgatcctgtgccttcagcatactacaacgaaacagcaactgatcctcctgcggtcaccagagcagatttcgatcctgctccaggaaactacggcagcgaaagccaggaaagtcacgaccccttctcctttctctggccatttggcccgtcgagttcttaccaatatgaagaaaatgttgatgaacctgcagtatacgatccaaaccagatagcatattctgcgtggcactatgaccactgactgaaaccctgagttaaaatcaagatatctgcaattcgtgccttgagctctcagctttggtgaggcaaagggctgcttgccgtataaaaaatggatggttattgtgttcagtgcatacccttgctacgcatgtccgttgtggagatatcagctgtgtatagaactgggcgcaacaaactctgctgtaatgcccgtatatattccttttcggtatatcaagtctaaagctatagtacataatcctgtatgtgctgtaatcggtgaactgagtgcatccagaatatcatgtcatgataaacatgattataattacatggttgtctttttagactgaaaaaaaaaaaaaaaaaagcggccaaagtactctgcgttgttaccactgct

SEQ ID NO: 15499 - DNA, 2447 bp, Zea mays
ctgcagcatcaatagtgtgttttggcaaaagaggtcaaaccttattgtatcttcgtgtgttatttgcagcttcgaaaccctaaagaggtttcaactgaggagtacaatgaattttacaagaaaaccttcaatgagtacttgaatcctttggcctcctcacacttcactacagaggtacacgtcttcgcatttatattggctgtctgctgtttctttgttttggtgattcaattcaatggttattactgtgatggctgcccgactggtttagatctcacagtatatatgactcaaatgatcaagccctaatgggaccggctgcttcttcttgggctgcctatcaagcccttaggggaacagccggcggctgctactgtagtattgccccaaaggctaccaacctgtcaacctgataacaattctatctgtatctctaactaactctaacgtaattgatagttactactaacatgcagctgaccctaacaacttggggacttcttattcggaggcgcgacaacctccatgatcagcccatactgcccatatcattaatgtatcataagttggtataacatttgaagcaaatattggcttcacttcattagatgcatggttcttataaacgcacttaccatttgattggtttcgtgggtccatgtagtagaagcactttgtttgaccctccttcgccctggcgcactcgctaccccatatcccattccccccgacggcgcctctggcagcaaggaacaatatgtccaatagggccacccattggtgttatgcctgtcagcgcccaattcgtcttcgcgggcaggatatcatatgtcccaactgcagtgatggttttatccaagaaatcagtgagatgggtggcgtactgaacacttatgggctaactgaaccggactttgaagagcgccaggccagaagatttggaatgatggatgccatatcttccctcatgcggcaacggctgtcagaaataggaagggatagtttgtttgatattcacggtagacaagggacaggtactgaatatggaaggaggtcaactgctattcctacgctggtatttggtggcatcccttctcctgcagttggtagcagtgatatcaatgttgtcatcagggaaggccgcagagctggcgctgcccgtccgaatttcagtagcttagttgttggtcccagtctggaagctctatttgagcagctactactccagaacaaccgtcaaggcccaccacctgctccacagtcagctattgactccatgcctgtggtaaagataaatcgcaggcatcttgacgaagatccacagtgtgcagtttgcaaagacaaattcgaggttggagcagaggcgcgggagatgccgtgcaagcacttgtaccatactgactgcatcatcccctggctggttcagcacaattcctgccctgtttgccgtcatccgctgccatcacagcgatcaggcagtagtaccagcagcgcccgtgtgccttcagcatactacaacgaaacagcttgccctcctgcggtcgccagggcagatttcgatcctgtgccttcagcatactacaacgaaacagcaactgatcctcctgcggtcaccagagcagatttcgatcctgctccaggaaactacggcagcgaaagccaggaaagtcacgtccccttctcctttctctggccatttggcccgtcgagttcttaccaatatgaagaaaatgttgatgaacctgcagtatacgatccaaaccagatagcatattctgcgtggcactatgaccactgactgaaaccctgagttaaaatcaagatatctgcaattcgtgccttgagctctcagctttggtgaggcaaagggctgcttgccgtataaaaaatggatggttattgtgttcagtgcatacccttgctacgcatgtccgttgtggagatatcagctgtgtatagaactgggcgcaataaactctgctgtaatgcccgtatatattccttttcggtatatcaagtctaaagctacataatcctgtatgtgcagtaatcggtgaactgagtgcatccagaatatcatgtcatgataaacatgattataattacatggttgtctttttagactgaaacacagcatgtcttctgttccggctatactgaaactgaaagatacaccaggatgtgtttggttgaaatgtggcttttgaaaagactgttatgaaccgtagaaaagcaatttatggatcacctagacgctctagagactcggaattgttgagcggctattcaagattgtagtaggctctaataccctgtttgaatgtagatattgaaacatagaattaggaattggaatcatctttccagaattctattgattggctgcagatagaattgagatttcaaattagagactcgagtccttggaatttgactataactaaaaa

SEQ ID NO: 15500 - DNA, 4290 bp, Zea mays
  misc_feature (1135)..(1135): n is a, c, g, or t
atgtggacttgcatgccgtatgtatgagctcaggctgaaattacgtgccataggaatgctatttctttcatcctacctaagggcctgtttctttcatctacctgtctaaggctgtttctttcatattcatgcctaaagctgtttcagccttgtgtatgaaacagacggagccttgtggatgaaacagacaggccctgaattcccagagttttctgaagtctcatcactcaggagcatgtgacatcgttatagaatatgtgttagtccttcaccttgaaattactaagttttctaggacaaacctttggccaaaaggaaaccatttttttattcatactatgaggttcgtatagaaaaaatgtttgcttacgattatcatttatcatacaaattacatcaatagaataattgctggtcaaaagacttgtcttcaacgaatgaaataaggctttgtaaatttgttaagctttgttttgttgctgtaaatcttgtggttgtatgcctgtatttcagatttgtgacttgaacgatttgtgggccggtcgttaaaccgctacaggtgtctgggcctgatgggccagctccctccccatagcgcttctattctcccccgcccaccgcggcaccgccgccgactccgatctcggtcgacctacccagtccgccaccgtctaccgccgcccccacgacgatccagtctctgtcgctgccccgccggccgcctcccctcctcttcccgctgcctctctcggtctccctgccccgggcgcaaccggatccaggtgactccggcctggacacgtcaccagacttcctctccgccgtctgatcgggttagcaaaaggaaaaccggcctgcttcgtgaggataagaaaaggtagcaatagcacgggtaagtaaaaacgagctgtagctgtctgccggtcggtctgtccggtctccggtccatccccgagacccgactgcgttccttctccttgtcgatggaggaaaccctagccgtcgaatccgccgccggcgagacggcggccgcgcaggcgcccgagctgaacgaagagacgctcgaggaggtgctctcgaggcataggttggtagcctcctccctttccccttgttcgcgtgccctccctgttanatttccgttaacttatgtcgcatcgaaatcgactagttgtggttcgaatttgtacggcggcgtggttaatcgtatttcacactagtgcggccgtgaattgcgagaaaaaagcagtgacttttctctccttttgaagataaagacaaaattaccgagctagtttgcatttgcatatcttcccgcctttgtaatttagtgtggttattatagcttggcggtatttctgcgccttttcttcattatatacttcaaacagatgctaattgatgtataggaaggtttatatttttatcgcgacctagatgactagaatacctcaggcacgaaaatgaaaattttgtgccgcaattgaagttcctcgctgttaaagctatttatatagtgatgtatggattgcaagcaaaatatatacttgcatgctatttattgttcaaatgattacgcaggcacacatgtggcccaagctggttcgctgttgtggatgattactgccaattatttgcctcttggtttcatattgataggcttctcttagatacaacgtgtgcattctatctctaggttcatttgctatacgtcatgactcacgtactgagtgcattgcccctgcatcagaaagatatcacggttatatgattgttggagattcttaatgccaattatttgactcttggtttcgacggatagactagttataatgtgtatctctacttctctaggttaatttgatatatgccatgtactaaagtgcattcccacttaataactataaactgggagtagagaagcacggctatgccaatctttgctgtccaattgctttcataatgaaaatgccatgacccactcttgagccaatcagcctaaatgaaaaagtgttacggtagtaaagcactttgattattcatttcctattcaattaatttcatgaaaatcacatcaatttcatccagaaaaaaatgttgcattgatcactttggttcagtggtttggattgtgttttggtctgatggacctctgtttgataatgtgcatatcggaagatccagtatgacatacaatagtttaggtttgtaaactgtgtattatgacctcaaatgatatacaatatagtagccgagtcattgtggggaacaaagctcacacctgaaggttcttgtcaatttctagaggcgcctttatcccagatgactggttaagtatgcactcatgccataatgtatgttcgcgtcaaaccctataagaatgcgacctgcaaagctgtgcctgtttcatatttctccatttgtcttattgtgcaaaatcaggtgagtagttgagttttgttggtgcgggaacttgctgtttttaattcttacttccctggttccaaactgtagttcacttaagctttgtcctaagtcaaagttctctaacttattaggacaaaactaaagtgaactataatttggaatgaggtattgtcatccttgatgttatttgcctgtttacttgagggtttcatggatgctgagctggttcttttccagttgtatcgcacctcactagtttccttacgagtccaatgtttctgaaacagaaaagagaaatcgaaactccaggataaggaaacgagcctcaagaaagctgctgcaaaaggaagcaaagctgagcagaaggcgaagaaaaagcaggtagaggaagagatcacacgcctctcatctgagttagaggcgaaccatgctgcagagcttgcttcctttgggtacaaaccctctggtagctcagagaagggaaacctcgacaacttagtgaaggccatagccggtgtttcagtttccagcaattcggattcagcaaagctcagcaagggagcacgccggcgagagaagaaggcgaaggaggaagctgcccgagagcagcggatccaagaggaacaaagcaatctcgtgagcgaccgcatgctagaaaacgagaagctcgaaaggaagctcgagcccttggggctgaccgtccaagagataaagccggacgggcactgcctgtaccgagcagttgaaaaccagctgtcgctccactccaatggcgctgcacggtacagttaccaggacctacggcagatgacggccaagtacatgagggagcacgccgccaatttccttcccttctacttagcggaaggcaaggccgatgttggaccagatcccatggcgagcttcgagaggtactgcgaggagatggagtccaccgcagcttggggcgggcagctcgaactcggcgcgctgacccactgcctgaagaaacatatcgtcgtctactcaggctccttcccggacgtggagatgggtaaggagtacaaatctggacctggaggtagtggcgccggcggtgcgagcatcaggctgtcgttccacaggcacgcctatggtctcggcgagcactacaactcggtggttccagccggatcatcctagcaagagaaaggtggatgctctgatggcctctaatacttcttgatttgattgtttacgggtggcacttgtctgagtctgaaacacaataggccacttttctttttcccagttgctgtaatccctgtcatgagtagatgaaggttgagtgtaccaatcaaagctgtaccggggagtttgtttcccaaacaattttgctctcatcagttttatgtctgtggttcgaatttaaagttgtgtgctgctacttatgtacaaaaaggaggaaacaaaacgtctgacatccatcaaaagtgcaaaaaggagacatgggggaaaagccatgccatgcttctcttcagaagccatcctggcactaatgaaaagagaacaaataagaaactcgagagaaactacaagtgaagaagccataaattggactgacaggagtcaggtgtgggactgacgtatcgtctttaggcccattagtcttaggactaaagtttagtcataggactaatggaaccaaatagggcctaaagacggtaacacataaagaccaaaatgctatttttttgttgacaccagttttctaggggtaattaaagtaaatgttaccatttagtcccttttagcacccatgtgagaaactagagactaaaatcaattagtttctactttagtcctccactaaccaaacgagaccttaagcgatcagtcagaggg

SEQ ID NO: 15501 - DNA, 1615 bp, Zea mays
atagcgcttctattctcccccgcccaccgcggcaccgccgccgactccgatctcggtcgacctacccagtccgccaccgtctaccgccgcccccacgacgatccagtctctgtcgctgccccgccggccgcctcccctcctcttcccgctgcctctctcggtctccctgccccgggcgcaaccggatccaggtgactccggcctggacacgtcaccagacttcctctccgccgtctgatcgggttagcaaaaggaaaaccggcctgcttcgtgaggataagaaaaggtagcaatagcacgggtaagtaaaaacgagctgtagctgtctgccggtcggtctgtccggtctccggtccatccccgagacccgactgcgttccttctccttgtcgatggaggaaaccctagccgtcgaatccgccgccggcgagacggcggccgcgcaggcgcccgagctgaacgaagagacgctcgaggaggtgctctcgaggcatagaaaagagaaatcgaaactccaggataaggaaacgagcctcaagaaagccgctgcaaaaggaagcaaagctgagcagaaggcgaagaaaaagcaggtagaggaagagatcacacgcctctcatctgagttagaggcgaaccatgctgcagagcttgcttcctttgggtacaaaccctctggcagctcagagaagggaaacctcgacaacttagtgaaggccatagccggtgtttcagtttccagcaattcggattcagcaaagctcagcaagggagcacgccggcgagagaagaaggcgaaggaggaagctgcccgagagcagcggatccaagaggaacaaagcaatctcgtgagcgaccgcatggtagaaaacgagaagctcgaaaggaagctcgagcccttggggctgaccgtccaagagataaagccggacgggcactgcctgtaccgagcagttgaaaaccagctgtcgctccactccaatggcgctgcacggtacagttaccaggacctacggcagatgacggccaagtacatgagggagcacgccgccaatttccttcccttctacttagcggaaggcaaggccgatgttggaccagatcccatggcgagcttcgagaggtactgcgaggagatggagtccaccgcagcttggggcgggcagctcgaactcggcgcgctgacccactgcctgaagaaacatatcgtcgtctactcaggctccttcccggacgtggagatgggcaaggagtacaaatctggacctggaggtagtggcgccggtggtgcgagcattaggctgtcgttccacaggcacgcctatggtctcggcgagcactacaactcggtggttcctgccggatcatcctagcaagagaaaggtggatgctctgatggcctctaatactttttgatttgattgtttacgggtggcgcttgtctgaatctgaaacacaataggccacttttctttttcccagttgctgtaatccctatcacgagtagatgaaggttgagtgtaccaatcaaagctgtaccggggagtttgtttcccaaacaattttgctctcatcagttttaagtttgtggttttgatttgcaaaaaaaaaaaaaaaa

SEQ ID NO: 15502 - DNA, 5055 bp, Zea mays
tgcagtattcagttatcatcactttgcaacaaataaaagttttagaaaatataggattgtttcttacatttacagtgtgcaacagaaaagatctattgtaaattttcagtttgatttatacagcacataaacacatgtataaaatgcaaaattctgctgaaactaaaagaaggataaatacacacatggacatggcttttgtacaaaagtaatagtgtgcatctggggaggtccttccgtgacattcaatttgatttataaagcacacaaacatatgtacaaaatgcacactcacctgaatctaaaagaatgacaaatacagagttacatacatgaatgcatctagtcgctgtacaacattgaacatagactgaacccaaactttacctgaagatccatcattgagttgtgtggcattaggaccagccacaaaatcttctgctctatcaatttgtggttctggtttgggttctttcacaactagagcatcgttgacagctaaaggatattcatggccagcagcgtgtggctctacagtcaaggaccgagtttgccgacgactcgtttgtggtgaagcaggcagagcaccttgggttgaaacactggattgctggcgtggctgcagctctggtctgaaattagcggtgcccatcctgggcctcttgaccaggggtgtttcattatcatcttcacatgtgtcatcaaggctagcagaaagatattgttgccgatcgtcccttgttgatctaagaggctccaagtccgcatgggctgcttgggtgccctgatagaaaagatcgataatgtacagcggtaaggagttaatggcaaagaaaggaaggtataacctgttgataagcgaggttgataggataatgataattaacctgttgggagggaggggtttgcttgctgtcttgcctatcgaggatggcatctgcgagggcacggtagctctcatcctcaatgggctcccagttgttgttgaagattttgaggagttccttgagtactgggatggcctgcttcttagagaaaccgatcagcttcatggcgcccaacgccttcctggccctttccgtgttgctgcccatgttggtgttgatggtgggagagatgacgaacagggatgatggcggttgctccctgtcccactgcagcaaaacaaaaacacatgagaatggattaatggaatactataacagtaccagtactagttgttgtgggcagtagctgattcaagcaaaacccaaaaaagtaagagaaaatatcaatccccaatgtctgaactgaatcatcagaacaaatcagatcgcgcccaaaaattcatgacggaaatccaagacagaaacgacggtgagaaatagtgagaggcgtgtcgcctcgaaggaagacacgaaatccccagtgcgtgaactggatggcggcttaggttttccgagcccaatgcgtgaactgaatggtagcttagggtttacgagaagcatccgaaagattagattgcagtcgcaccttaaaaaagtgattagtcttttctccctaccaagaactagtattggaaacaagtgcctagacgaaatggaaggtggcttgaagcggtagaacaaggccaatcggcagggggtcaaccacattcgaaccacgggaagagagatgagtgaattctgacggaggactggaagagaagggacaagagcaatacaagaaccaagagagacacacctgtacttcaacggtcaacggactcgggtggacgaggaacggacggatgaaatggaaaggattaaactgcaatcaagagggagagacagcaaatccccactccatcctacagctgtgtgcgtgattcgctcgccgatctcacgcaaacctggaggaggggcggaggagacgaggagggctctccctcagtccgtctacactctagcgtttgcttgctggggtttcgcttctttagaacaactccaaaacagtacttaaaagttttcaaaaaaaatattaagagcatcttcaaggcactctttttttctctctatttacctatctatttaccttttcataaaaattataatttataaaaattataatttatatatagcacatcactccaataaattgtctatatagtttagctgtgactagctaagtttagctagtgaggaaaccaatttaaaaagttagataccttagcgagttacattactaatctgttgaagagttattttgctgttgaatacctaaaatttattttaacaaactattttactaatctcttggagttactctcattaaagacatactaaaaaaatttagaagtgaaatactatgactactccaacggttcccttaaacaaaactggaagacaaaaaaaactagcctcaaacttttaaaaaaacctcgttagtacaagtttaatattttaatatatataatttatttatttttcttatcaaacgcaatattataaatatgaataaaagtttgcataaataattctacacgttattatttttaaaaaaggtgaaaacatattcaatttgaatttcaaatttatatctagcacttgaaaagatgtataataaatttgaaatttatcttttatgaatctttacaagtctaatataaaaataaaaatataaatttatatgacatattctatattctatttattcataataaaaaagaccaaaaaatgatatatgtattcgttttcatccctacactacagtcgtgtgtaagcatatacccaaactatacagaacatttaatctatttcgaacgatttctcccctcacatattgagagagagcattcaacctaaattcattcggtgcaagagtaatatggaaaagtagaaatacaaaaatagcagatattattaaatgtttggaatgatttagtagggaaaaagctatgcgtacgagcagaaatccacagtgtgatcctgaactatgagtggtttacagagatgaaatgaacatgggtagtgtgctcacacaagaaatgcctaataacaaggcaaaaagggtagagtgaaaggggcagtcaaaggttgtggatatgatagtataaaacactttttttttataaagtgaagtttaaaataagagatagagtgagtaagttgtcggagatagaagtgagtaaacactttataaagtgtgtttggtaaattgttgtgagttgtctgctgtgcaaaagattctttagttcaaactgatgttttttatatacactttatttaaataaatctattaattaatatatataacactttttatttatattaaaatatttttattaatattaaacacatttttattttatttattataaggcttaatattttaaatcagattttagtttctaactgtcacatctcatgatgaacgtggataagtagcaaaaatatggtctaaaccattttaaaatttgtataaaaagttgtttttgttgcgtgcctgcagaagcagattttaaaaaaaagaatcaaacgtaccctcagctaatcacatcgtgatttaggccggcccagcagctggactgggccaaagggccgaaataaagcgtaacgcagccatgaaaggcccatatctgatggagtcgtaggtcgcaagcgcacgagtagcaatccccccacgacgccgggttctttcgttcccctttccgccgtgcctcccactaaaccctagatctctctctctagaatgccgacgccttcggctctcagcaagcgcggcggcgacggcggggacggcatcctggccgccctctcccgttcgcaggtggcggcgcacgggcgagaggcggcggccgtggcgaagaagctgctgcggagcacggggaaggcggcgtggatcgcggggacaaccttcctggtgctggtggtgccgctgatcatcgagatggaccgggagcagcagctcaacgacctcgagctgcagcagcagacgcttctgggcggggccccgccgccgccgccgaccaagtagatagatccgtgcatcgaccctttcgtccccccccccctctccctctctagaggtatctgttactatcaagttcatcattcgagttactatcaagttcatcattcgagttactatcaagttcatcattcgagtcgagttgaggctaagggagttaccgagtcgacctgttgtcggttggtcgtaatcaaagaggtcaaaactgctttgttgatgttcgttctcgatgcaacactagtttagtttcccttccatcaattgaaacggattgatcagataagttgagctcgttcgctgctgctgctgctgctgccaggcgctgcgatccgctgcctgcgtttttgcacgctgcagcttgttcttcctatacctgcctgtgttagcgtttttaatgaataaatatacttcttgctgttattcaaaaaaaaaaaaaaaaaaaaaaaaaaaaaaaagaaaaaaaaaaaaaaaattatgtgcaactctgcttcttagaagtcctgcgcgaaactcttggacggcattgctttggtttctacgtttccagttccgatcgatgaaacctggcatgcaaggctgtagaatcgattccttttcagcgagcttcggatgaaattgctcttctccggatgatgacatgctcactgttgcatcaaaatcagtatattcagcaacatggaaacagaatggaattgggttcattaccaaatcaaatcagccttggtattgaaattggccacagctcaattatgttgtttgtaccctaagtaatattcagctattagctgattttagctgaagacatccaaatttcccctacacattgtttggatgtagatattggagcacaaaattgggaattggaatcagctttcctaaattttgttgtttcatagaatttggaattggaatcagctttcctaaattccgttgtttcatagaattgggaattagaaccagctttcctaaattttattgtttggttacacgtgaaattgagatttggaatcagaggcccaattccctgaaattggattattataactacaaaccacatctcccaatgca

SEQ ID NO: 15503 - DNA, 768 bp, Zea mays
caatgggcagacacggactatctttcgttcccctttccgccgcgcctcccactaaaccctagatctctctctctagaatgccgacgtcttcggctctcagcaagcgcggcggcgacggcggggacggcatcctggccgccctctcccgttcgcaggtggcggcgcacgggcgagaggcggcggccgtggcgaagaagctgctgcggagcacggggaaggcggcgtggatcgcggggacaaccttcctggtgctggtggtgccgctgatcatcgagatggaccgggagcagcagctcaacgacctcgagctgcagcagcagacgcttctgggcggggcccctccgccgccgccgccgaccaagtagatagatccgtgcatcgaccctttcgtcccccctctccctctctagaggtatctgttactgtcaagttcatcattcgagttactatcaagttcatcattcgagtcgagctgaggctgagttaccgagtcgacctgttgtcggttggtcgtaatcaaagaggtcgaaactgctttgttgatgttcgttctcgatgcaacactagtttagtttcccttccatcaattgaaacggattgatcagataagttgagctcgttcgctgctgctgctgctgctgctgccacgcgctgcgatccgctgcctgcgcttttgcacgctgcagcttgttcttcttatacctgcatgtgttagcgtttttaatggataaatatacttcttgctgtcaaaaaaaaaaaaaaaacgac

SEQ ID NO: 15504 - DNA, 1077 bp, Zea mays
atgcggacatgtttcaaacctgtgacctagtgactcaatgagacagctctcaccactgcacagctcttctaggatcctcacagcgtaccttaattgaattcagtaacaatctttaatgcacccaccctgaattttgtgcaggtgtgatgtttatagctttggtgtcatcttatgggaactggcaacacttagaatgccatggagtgggatgaatccaatgcaagttgtgggggcagttggtttccaggatagacggcttgatattcccaaggaagttgatcctctggtcgcaaggataatatttgaatgctggcagaagtgagttttcagaaaagcccttttaagagtttaacctgttctctgatgaaagtttcatgtctcgttcatggcattcaaaatttgactcgatttaaatttgtgctaacatgtgcgttgccaatcgccagggccccaaatttgcgcccgtcatttgcacagttaacaagtgccctgaagactgttcaaagactagtgaccctttgtcaccaggagaaccagagcccccatgttcaacaagaaatctcagtgcatttgactccttagtggggctttccactttgcgttgtgcatagttttttgttctgctgctgtttgtgtttgtcaaaaagtcggcaaatgcaccttgtagattgagcgtccgaggtggtagacactttgctgccgcgacaaggaccccaaaggtagggtatgtatagagtcgcccatcaaacagcaatcggatcagtgtgtagcaactcattgttatgccctcgtcaatacctggccaaccgggtgcgagccctctggaaaagcagtgagagctctgtgttcattgtgaatttgcctggctatgctaagtggattttctgtcttgctgcgcaacagacagcatatttgcaagttggaagtgctgtaactctgtacaatcagaacacgtgaatttgccgcgctatctagctttgttgttgctgactttgcgtgtggtttaagagctttagcatcttccatagttttcctaaaaattattatctaaattacctttaagagggtgatttgagt

SEQ ID NO: 15505 - DNA, 3499 bp, Zea mays
  misc_feature (2100)..(2100): n is a, c, g, or t
  misc_feature (2173)..(2173): n is a, c, g, or t
  misc_feature (2211)..(2211): n is a, c, g, or t
  misc_feature (2237)..(2237): n is a, c, g, or t
acgcgggggctgcggcctagctctctgtcccatgggggacctcgagccccgggggcccatcgtagccgtcctcgatctccctcgctccgcagcacaccactcgtagccgccggcaaggcgactgacctctttcctgctgccgagcgccatcgtctcctcggaccatctcacctcagagctgctgcgaccgccggccaacccgtctaggtcttgtccctgccgcttcctgagcctagaacatctttgcattttggagagtctccactcggagctattgtacagtctccatccctttcaacgagatggcacgtcagtctgctctctcgcttgtgagggatcgagcaaagacgggagcgctgaagcgtctgactctgagttcatcgaagacggctgggaggaactcgtctgggcgcatcacctctttccaccgtggtggaggggccaagaggttgcagaggaaggtcgatgtgaaacgcgacgcctgttccacgggtattgtggagcggatcgagtacgacccgaatcgctcctcgagccttgctcttgtgcgatgggtgcaaggggtgcatttccgccgccccaagagtccacaagaactcagtgccatgtctcaaatccaacaatctgctacagctgatgtctccggccggttttcccttgctgcattatctagtagagtgcataaagataaggaagcttctgcactgtactctgctctgggaaatggagatatttctgcatctcttaaatctggtgcgtcatcgagcttaccgaggatagctgtagctggtgccaagcccacattctttgctcaagccaaagcggatgaagaaggaaaacatacattttcctttactgagattcagaaatgggcaacagatgatgtgctttgggcacagagaatgaagcgtcaagctgcactctcctggcagaatgaactgaagaagaaacatttgcttaagacacaagctaacagcttcagtagcttggcagcaaagactagtggtacgagtaaagggccaaagggaaaggctgattgcataccagtgtcttatatattggccagtcaccagtgcatgccaggtagtacagtgatgaactataattcctcgaagccttctaagagttcagcctcttcaccatattccttggaaaatcagttcgatataattgatctcaactcaaaggttggaaattgtataccattagccaatgcacgaattggaacctgggtgcataatattgaatgtcgtcctggtcagggtgggaagatggttcgagcagctggtacatatgctaaggtagtccaggagccaggcgccaagtgtgtcctgcgccttccctcaggtgctgagaaggctgttgattcaagatgccatgctacaattggtatagtctccaacccaagccatggtacacgcaagctaagaaaggcagggcacagcaggtggttaggcagacgccctgttgtccgtggtgttgctatgaatcctgtggatcatccccatggtggaggcgaggggcgtactaaaggaggcaggccttcagtttctccctggggaaagcccaccaaagcagggtaccgatcaccaagtgtggccagtcggaaagcgtttgctggaacaaagctcatacagttcagaaaataaagaatatgtgtttgtggcagagggaactgtgataatcgacttgattctggtgcagcagaagaaatggttgttatcactccaatcgacaacacagaataaatgttttcactccaatggttgttatcgctacttttccccttttgtcattctgcagaaactagctcttcatgaaacctgattagtgaatttcttcctgtatttcttttgcttctttaacacttggcaaatttggctatggttccacggctctgattgagaagggatgctcttacctttttggtcaaggcctgtccaaaactaagaaacacatgttggtagtatgatttttctctctataaaaaaaaaaaaaaaaagcgcgggactggttcccctcgtgcgtggctatgagcgtgattggatgcacttgtagctgccgtgctgcaatattggcggctttgatgcgattgatgtncactcttaccgcgatagcaattagcaggtggcaatccaggtcctccgtatgtaaaattagataaccagcaaantgtgccacagaaatgcgaactgaactatgaattctggntgtcgtgcctttcacccttttcttcngtccttcatatacatctggttgtcgtgcctttcacccttttcttcggtccttcatatacatattagtataatgctcatgcgttggaacggtataatagtaagtgtgtgtaatgggaatggagatgcaggagtcacttgtatgctcagatgttcactgacctaggctatttgcgcggcatctttgaggtaggacaggaacttaacgggacataattatatggatagacgtttgggttcgaagtccgtaagctgaacgaatttgcgagaggagatggtgttagggtttgtcgaaggtaacagggacacgaacagaaggggcagatcgttggagtcgtccatctggaccgctctccgttggaccgcggattgattacacaaaaatatgaggagtttttttttcaaaagtattgacgtgctttaaaggattagacgtacaattgctcacgcgcactggccgtactgacaagatggattgccgagcgaaccgagggctgcaactagtcggactgacaagttagactccgatcaaccgtttgggggctcgactcccacatccaaaggtaggctggcagattgcgtggcattgcaagcccacccgaatgcatgattgactaggtagacacctaaggccatgttcgtttgatcccagaaccatagggattgagggggattgaaagggattggagaggattttgacttgtaggggatttaatccccctcaatccctatggattggcacaaaacgaacaagccctaaaagtctcttccgactcgctccatgtgatgcgcaagtctccctcacgcgcaacgttatgcgcacagcactctggaaaaaccataaaaaaattgagaaaaagagagcgttactagagctcaacccgtgggcctcatgttgctatgtggtttatggctgagcttctaagcaccacaattcatatttgtttgtgttatatgatggatagatattctaaatatcgtgttacacaaaggatatatattgtaaatatatatacatactaataaatttaaaaaatatataatcttgttgtgtcggactaggccggcactacgagccaagaaggcggctcagacacgacatgattcttgggtcgggccacaacattgttaaatgggtcatacctgagattataaaaatatatgaatcatgacaaataaaatttatactattattatcttccattgcattatataccattataaggttatgtttggcatgcttgaaaatgacttaatacacttgt

SEQ ID NO: 15506 - DNA, 3031 bp, Zea mays
caatttcaacctcggacccctgggaacctttaaagccaacctgcagggttgtttattaataagcatgacactgcaccagacaagcttttgtttcgtatgcagccatttggcttcaggtcaaaaagaaggagacgaattcaggaggaactcggatgttctagagataatgaggctcacaatgttttctaggatctgtagaagagctggaagaaaaatcccggagagaatagttgaccatgagtaagaatgatgtgtcatatctaacattgtgaatatatgttccttttcaacatgtttttcctactaatttgtgcactgttggtttcagtaaggtgatatggcttggtgatctgaactaccgtattgcactgagctatgcagataccaagaagcttttgatggaaaatgactgggatgctctttttgaaaaggatcaggtaacttttctatctcgtcaggaacgtgcctgtgctgtgcttgggggtagcgtggggaaaggactgctttgggtctacatcttcttctttagtgaatgcaagtttgagggtagcctttattttaggaaaaagaactcatcagaagcatggagacagttctaaatatggcccatttaaataattaagttaataatgaagatgctaccgctttatgctgacaagcactagaaagaaaatctgaaaagttccaataaatcttttgatagtagatccctccccgatagatttttatgtcattacattgccttatggtgtgtacattttgcttcagcttaaaattgaacgggacgctgggcgagtatttaagggttggaatgaggggaagatatattttgctccaacatataagtactcctttaactcagatgcttatgctggtgagactgcgacatcaaagaaaaagagaagaactcctgcgtggtacgcatcacttttaaatctagtttcgttacgcaaaattagccttcattttcttttttattccaagtctccaagtgtcaaaggaaacatagtattcttttacttaacttacctactattgcatcccatccctctgaagtggttgaactttctcaggtgtgacagaatattgtggcgtggtgatgggattgtacaattatcctactaccgcggggagtctagattttctgatcaccgtcctgtttgtggaaccttcgctgttgaggttgaggtgctaaacaagaagacaaacaggcgctcatcaaatgctgacatgagaattgatgctgaagagctcttacccacgggcaagggcaagggtaaaaggtaatgttatacctattgctgcgttattagggtctgtttgaatgtgagttccaaatcatgttgtagtgatttttttcttcctttttactagagatgagaatcatgtggcacgcgaggaggagaggctagtattgcagccggactcgcagatcccgtacgttccctcctcattgatgttccaacggccagcgctcaagatggacggacgattcaccggctcggcccacaacagctcatcaccacccatgtttccctctcaccacccgtgccaaacagccaattcatcgcagccaccggtaccgcgcgccgctgggcagcatttgctaccttgtcgcgtccgtgcgtggatcgtgactccttgaattgtggcccggggcagaggaggaataagccagccatcgagatcgagattgaactgcatgcatacagtgctccgtagtagaaacataccaaacacacgctcatcaaggggaattattacaagctaggaaacaaatccggaagaatctcgtgcctggaacagctagctgtttgtacgtgaattaacgaactagtaccataatgcacaaacatgtgtgtgctgtaagaagaatgatgacgaagaaatcacaaagtctaagacgaccggtagatgctctagaacatgatcccggcggccgcgaccgcgacgggtagcgcggcgagggcgacgaggcctccggcggcggtgacgcgtcccgcgggggacttggctgagcccgtcggcgtgttggctgcagaacacacggcagcggtcggaggcgaagtcgtcagatgagatagcaaaggactccagtccaggagcatcaatcaaagcaagcgaaggacagcaagttcgttaccaggcacatctgggccgatagaagatggagagaggcctgccatgggcgccgcagtaggcaccaatccctcggggatagggaatccgaaagctgcagataggaaaaaaaaacgtccactgaaacttaaaaacgtgatcaagccatggtcttagttaaaagtgagatctctgaacaagtagattagctgctagagcgacttccatttcgtgagtaattgtgtcgtcgtaacgtgctaaaaaaacaaacaaacaaacaatgcatgactggctgactgtgcacaaggcatgcacgacatggcagcagtaccgtacgtatagtatatatacctgcgcaggcgctaacgggcggcgcggtgaggcggcagatccccgggagcgcgagcgcgcgcttgtagtcgacgctgacgccgtaggactcggcgccgccgcccagcagctggcagaggcagacggggtgggactcgagcagcccggccagctccgggcagcagggcgtgtccgggtgccgcgccttgctgcccgccgtcacgtacgtcaggcagtccgacatgttcagcaccgcgttgaagcactcgtcgctgatcccgggcgccgggcccggcgcgggcgcggcggccggcccctgcgccgacgccatcccgagcaccagcgccgacgccaccaccaccgctgcgacgagcgccgttggacgcggcagcattgccatggggatcactgctagtgtacgtgttagctagccgaggcggcggtgcgtggtttggtttccggcgctttgctgacaagtgtggccgtctgactcgtatgcagctgcctgtactgctactgctatatatggtgtgtcactgtgtgactgacggcagcgtgcgtgccggatcggagtcgactcgtg

SEQ ID NO: 15507 - DNA, 928 bp, Zea mays
ttttttttttttttttggagattgaactgcatgcatacagtgctccgtagtagaattgtagaaacataccaaacacacgctcatcaaggggaattattacaaggaaacaaatccggaagaatctcgtgcctggaacagctagctgtttgtacgtgaattaacgaactagtaccataatgcacaaacatgtgtgtgctgtaagaagaatgatgacgaagaaatcacaaagtctaagacgaccggtagatgctctagaacatgatcccggccgcgacggcgacgggtagcgcggcgagggcgacgaggcctccggcggcggtgacgcgtcccgcgggggacttggctgagcccgtcggcgtgttggcaggcacatctgggccgatagaagatggagagaggcctgccatgggcgccgcagtaggcaccaatccctcggggatagggaatccgaaagctgcgcaggcgctaacgggcggcgcggtgaggcggcagatccccgggagcgcgagcgcgcgcttgtagtcgacgctgacgccgtaggactcggcgccgccgcccagcagctggcagaggcagacggggtgggactcgagcagcccggccagctccgggcagcagggcgtgtccgggtgccgcgccttgctgcccgccgtcacgtacgtcaggcagtccgacatgttgagcaccgcgttgaagcactcgtcgctgatcccgggcgccgggcccggcgcgggcgcggcggccggcccctgcgccgacgccatcccgagcaccagcgccgccgccaccaccaccgctgcgacgagcgctgttggacgcggcagcattgccatggggatcactgctagtgtacgtgttagctagccgaggcggcggtgcgtggtttggtttccggcgctttgctgacaagtgtggccgtctgactcgt

SEQ ID NO: 15508 - DNA, 1332 bp, Zea mays
ccggccgggatccgaccagctactactagcgtttactactaactagtttgccggtcgagcccgggcgacgttagaatagatacgagcggcgtcgaccggcgccggcgagactccgcagccgcagccgccgcccgatctcggttttcgttcgtagcggtagcggaagatgagccaggaccaggagaacggaggcaccaacgggcagcacgccgccgacgtgatggaggtggagccgaagcgccgggcgccgcggctgaacgagcgcatcctgtcgtcgctgtcgcggaggtccgtcgccgcgcacccctggcacgacctcgagatcggtcctgaagctccggccgtcttcaacgtcgtaagtatctgacgaatcccattccccagacccctcaccccagcaagcaagcaagcaagcagccaaagttgttctcgatcgacatgtgtgaatatggagcgtgtctgacgatccttccggtgcgcgtccgtccgtccgttacgtacgtggtgccgacgagcaggtcgtggagatcaccaaggggagcaaggtgaagtacgagctggacaagaagacggggctcatcaaggtggaccggatcctctactcgtccgtcgtctaccctcacaactacggcttcgtgccccggacgctctgcgaggacaacgaccccatggacgtcctcgtgctcatgcaggaacccgtccttcccggcgccttcctccgcgccagggccatcggcctcatgcctatgatagatcagggagagaaggacgacaaagatcatcgccgtctgcgccgacgaccccgagtaccgccactacaacgacatcagcgagctctcccctcaccgcctccaggagatccgccgcttctttgaagactacaagaagaacgagaacaaggaggtggccgtcaacgacttcctgcccgccgccgctgcccgcgaagccatccagtactccatggacctgtacggccagtacatcatgcagaccctgcggcggtagagcgttcctaccagatcccatgccagctgagctgacgcaagagcacagatcgacagaatccttgtggtctcgtctcatgcatggatagccagatcacatgagttgtcgacgaccatgcatctcttcttcccagcgatatatattttagcctgtatcttcccttatttatagtcttttgggtttggtggaatctgtccactgtgtggtttgatctatgtactcctttttctacatttttcacaaaacgaatcgatgagattaataatattgttactaagaaaaaaaaaaaaaaaaaaaaaaaaaaaccgaggaagggcgcggtacccc

SEQ ID NO: 15509 - DNA, 1205 bp, Zea mays
  misc_feature (958)..(958): n is a, c, g, or t
  misc_feature (995)..(996): n is a, c, g, or t
  misc_feature (1190)..(1192): n is a, c, g, or t
cactcctatgggcttcggggggtaccgcgaggccggccgcgatccgaccagcgtttactcctaactagtttgccgatcgagcccgggcgacgtgagatacgagcggcgtcgaccggcgccggcgagcctccgcagccgcagccgcccgatctgggttttctttcgtagcggtagcggaagatgagccaggaccaggagaacggaggcaccaacgggcagcacgccgccgacgtgatggaggtggagccgaagcgccgggcgccgcggctgaacgagcgcatcctgtcgtcgctgtcgcggaggtccgtcgccgcgcacccctggcacgacctcgagatcggtcctgaagctccggccgtcttcaacgtcgtcgtggagatcaccaaggggagcaaggtgaagtacgagctggacaagaagacggggctcatcaaggtggaccggatcctctactcgtccgtcgtctaccctcacaactacggcttcgtgccccggacgctctgcgaggacaacgaccccatggacgtcctcgtgctcatgcaggaacccgtccttcccggcgccttcctccgcgccagggccatcggcctcatgcctatgatagatcagggagagaaggacgacaagatcatcgccgtctgcgccgacgaccccgagtaccgccactacaacgacatcagcgagctctcccctcaccgcctccaggagatccgccgcttcttcgaagactacaagaagaacgagaacaaggaggtggccgtcaacgacttcctgcccgccgccgctgcccgcgaagccatccagtactccatggacctgtacggccagtacatcatgcagaccctgcggcggtagagcgtgtcctaccagatcccatgcgagctgagctgacgcaagagcacagatcgacagatcccttgtggtctcgtctcatgcatggatagccaggtcacatggncttgtcgacgaccatgcatctcttcttcccagcgatnntagcctgtatcttcccttatttatagtcttttggggtttgggggaatctggtcaaagggtgggttggaactatgtacttcctcttctaccttgctaccagaaccaatccatgggaattaatattaatggttactactaaaaaaaaaaaaaaaaacctccagggggggccccgaccccattttgccctaaaagtnnnttttttaaaacca

SEQ ID NO: 15510 - DNA, 1245 bp, Zea mays
ggcctccggcctccggcgctcgctcccctgtcctgtcccctccggcctcctctgccctctctctctatatatgcccgcgggattcgggacctcgaggccggccgggatccgacctgctactactagcgtgtaactagtttgccgatcgagcccgggcgacgttagaatagatacgagcggcgtcgaccggcgccggcgagactccgcagccgcagccgccgcccgatctcggttttcgttcgtagcggtagcggaagatgagccaggaccaggagaacggaggcaccaacgggcagcacgccgccgacgtgatggaggtggagccgaagcgccgggcgccgcggctgaacgagcgcatcctgtcgtcgctgtcgcggaggtccgtcgccgcgcacccctggcacgacctcgagatcggtcctgaagctccggccgtcttcaacgtcgtcgtggagatcaccaaggggagcaaggtgaagtacgagctggacaagaagacggggctcatcaaggtggaccggatcctctactcgtccgtcgtctaccctcacaactacggcttcgtgccccggacgctctgcgaggacaacgaccccatggacgtcctcgtgctcatgcaggaacccgtccttcccggcgccttcctccgcgccagggccatcggcctcatgcctatgatagatcagggagagaaggacgacaagatcatcgccgtctgcgccgacgaccccgagtaccgccactacaacgacatcagcgagctctcccctcaccgcctccaggagatccgccgcttctttgaagactacaagaagaacgagaacaaggaggtggccgtcaacgacttcctgcccgccgccgctgcccgcgaagccatccagtactccatggacctgtacggccagtacatcatgcagaccctgcggcggtagagcgtgtcctaccagatcccatgcgagctgagctgacgcaagagcacagatcgacagaatccttgtggtctcgtctcatgcatggatagccaggtcacatggcttgtcgacgaccatgcatctcttcttcccagcgattttagcctgtatcttcccttatttatagtcttttgggtttggtggaatctgtccacagtgtggtttgatctatgtactcctcttctacatttctaccagaacgaatcgatgagattaataataatgttactactaaccaaaaaaaaaaaaaaacagccgacgggcgccagcggcc

SEQ ID NO: 15511 - DNA, 1212 bp, Zea mays
tctggcaaaacggcactgctctgttgtttttgttaagacactagacaaagacagcttctcagatgctgaaagcataaatgcgttcgtccacccgcgcgcccgacttgagaaagcacggcatcccaatttggtccaatttgttggagctgtcacgcaaaatgtcccgatgatgattgtttcagagtaccatcaaaagggtgatttagccagttatattgagatgaaaggtcggctgaagcctcacaaagctataagatttgctcttgacattgcgaggggactgaattatctccatgagtgcaagcctgagccaatcattcatggaaatttgtcgccaaaaaacatcattcgggacgatgaaggacaacttaaggtggctggttttggatcactgagtttgagtaaagtttctgaagataaagtacaaatggctcagccagttacaaaatttgacaatgtatacatcgctcccgaggtctacaaaaacgaaccatttgacagaagtgtagatgtatttgcatttggtctcattctttatgagatgattgaaggagctcctgcttttcacccaaagccacaagaggaagcagctaagatgatttgcttagaggggctgagaccaccattcaagaataaaccgaaatactaccccagtgatgtgaaagagttgatacaagaatgctgggatccgatgccttccgtcaggccaacattcgcggagataattgtgcgcctgaacaagatacatgcgagctgtgctaagcagggtagctggagagacaccttcaagcttccatggaaacaaactggagagagataattgtaaagccccgcgaggctgccgtgtcaagatttcgccccttcccttcagcaagtgtgagtaaacacgagtcaagaaacgtacagagttacaaacagaaaggcaaagttcctatttagttcaggtttcagaccacagtttgtgctttgtagcctgtatgactgtatctaggcttatgccaccggcccaatttctcttgagctatcttcatccaaacgggaacaacagagtattaatcagtattctgaacattcagggcgtgcctattccttttgaactcctacgtgaacgttgtaaattctgcacgatttcctttcgtgccttttgtgtacgttgtgctaaagagaaccagaggcatacgcatatcccgagaaaaaaaaaaaaaaaaaaaa

SEQ ID NO: 15512 - DNA, 1692 bp, Zea mays
cattgggtacctcgaggccggccggggaaaatgtggcggctgaaaaaaaagcgtattctctcctcccgcattcacttgttgcaaccatcgccttctccctcgccgcgagagtgctcaacctggtgtcctggataaggcaacgggataggaagcgataattggcggagagtgaaggttcccgtcctaggccgaagtcctcgttgttgccggaagaagtaccgcatgacttcgccgggtagcggcggatcgacgactgcaagttatgtagccaattcgcccccctacttgtagatctgggtttttgtaaagtttatccggaagctacttgtagatctgggtttttgtaaagtttatccggaagatttgtatggattggggtagatccgaagtacatatccatcccacgcttggggttttagggtatgacactcgcacctttggattgtagtagatgttcgtccgtatgcaaccattttgttgttgtcgtcggctgtttcgactagaaaaatacaaaccctaggatattacactacgatttagtttcatatctttcgcttcaaatgcggcaaagtgtagttaacatctttttgaatcactgctagatgtcctacactccaaaagacgccctggaatgggctgttcgggagatggaggaccacacctgtcaaattaggtagcttgtcggcagtgctacaagcacaccaatgccaaccgagcatctgaaatgtgttaacctcaagatttttaagctcgcggactggcttgacaaggtttcaatcctatgcttcgaggttgtcgagaaggatggaagcaaccacctcgatgacaacaccacagaggaagaacttgaagcagctcgtgagatagaacttgaaaggctccccactcccgaaactcttaaaaaccttgaggacttttgtgaggaatggggtatgcagtatgacaacgatcaatctcgtgggatcaactaggagtaattgtagaataatgtaaggttcagagagatgtagcacatggaacttgttatgtgtcaatgtaaaatggtaatgtgaactctagtgtcttgtggagtcaatgtgaaccatgaagtgtcatgtttggagttatgaactacatgcttatgaaatgatgatggcttcttccgattttgcattgtgttgttgtgtttaatacaattgcagtcgtactcattactacaaaattttgcccatttatcactcaagtttcctatggacaactcttggcctcgttttccatttcacagtatgtacgaagtaacctatactccaagattggaactgtcaacagatcaagcatggaacaactaggaagggttctagaatcctaacgaggttcatccaccattctttagttaacacattcactttacaaagttcatgtgtattcgttgattgtgctaacccttagtttttttcgatattcaggcaatgcaaggcatacaagaccttgttcaggatgagctgccgccaatgagttctaaaaagaaaacagttcacaagaggctcaaaaatttcactgcaactgaggatgaatgtcttgtatcaacgtacttaaatgttagcacagacccaattgtgggtgtgaaccaaccaataaaaggctactaacagaggatcgctaactactgcgaagacacaagaaaactccagtttctccgaccatatcctccct

SEQ ID NO: 15513 - DNA, 1801 bp, Zea mays
caaattccgattcccccgtctcttcttctgcacagtccacactgttcacttcctgccccctccccgcacctccctccgatcccccaaatcccgaattgaccaacccaaagccgtcgccccgcatggagtggacggtcccgaagcgcgccgcctcgccgccctcgcctccgctcctctgggactgggggggagaccacgccggcgccacgggctcgggctcgggctcctccggcgacgccccggcgcggcgcggcgggagggagcgggaggcgaagcgcgccagggccgacgacggcgaggtgaggtgccaggtggaggggtgcgggctggacctcagcagggtcaaggagtaccaccggaagcaccgcgtctgcgaggcccacaccaagtccccccgcgtcgtcgtcgccggtcaggagcgacgcttctgccagcagtgcagccgatttcatgccctgtcagagtttgatcagaagaagaggagctgcaggaggcgtctgtctgatcacaatgcccgccgccggaagcctcagccagatgcattcgcctttgcctctgcaaggctgccttcatcgtcgttcgcagactttccaggacgaaaacgaaggggcctcctcccgaaagataaaagcatttctttgtttccagatttctcaagctgctatttgcacaacaagtttagtaatatgataggaggcaaataagttttgtctggaataaagctcctgttagccatgtaaggcctttcacttctccatgggacagctcatctgagctccctcatgcaaaggaaataaaagaggtgtcaacgaaagttgggacaattactggacaagttcatttggataaatcttacatgtccaacgctattccatcacttacccatggcaaagatgatccttggccaatgaaaggtccggacatgtctatagctgcttcaaaattcgatggagcaccggatcttcagcgtgctctctctcttctgtcagttggcgcctgcggattgcccgatcctgtacaccaaacatcttgcgtcatccaattcactagtgccagcgagaacagtggcgaccttcatctatcacatggagcgaactctggtctagcgtcatgcggtgatggacagcatatagcttctcagcctcaggctcagctggttcggtttaccatggataccagcaacagtgtctatgagcccagtttcttcagtgtaaaccagataaattaagcgttgaagacacacgccacttggtcatttggataaatagccctgaagatggcctaagcatgtgcaagaagttcttcaaccaaccaccggacataaggatctatctgttaatgttatctgtgtatttattagccatacctgaattaggttgaacccaatctaggccagcttatgtgcaatatgcagttccaacctgtgattgacccattttttctgttgtttctttgcccgtgatgtgactgctctggaacttaagtgtgatactgttgtagttacactttactgccctgacaatgatgtcaaacggctggatatctttgaaactgtaattgatgaatctggacgtgtatttttgtgtgtgtgtgtgtgtatggtttttgcttcttcaatgcttgtccaaggaatatagatatataaaaagctgttgcatcaaaaaaaaaaaaaaaaaaatatcagaagtcacacttcaggtcctgctgctgtttgtattgtgtgtctgtgtttattgatatacaataggagaacaatttatagtatcattccaagtaatcaatcttgtctccaaatcaaaca

SEQ ID NO: 15514 - DNA, 1965 bp, Zea mays
ttcgcctgcgctgcgggcacaccttctttccccttctccaagcgtcgccactcctctccgctgtgctctcccaacaaccgtcgccgccgccacaaataaccgagccagcatcttcgcggcgtattgtacgaggagatgttcctgaacctctaatgaatagaaggcttatttcgttggatatgggagcattacttgctggagctaaattccgtggtgattttgaggagagattaaaggctgttctaaaggaggtcactgcttctaatggacagatcatcttgttcattgatgagatccatactgttgttggtgcaggagctgctggtggagcgatggatgctggtaacctgttgaagccaatgctaggccgtggagaactccgctgcattggagcaacaacattggatgagtacaggaagtacattgagaaggatgctgctcttgagcgtaggttccagcaggtttattgtggtgagccagcagtcgaggataccatctccatactgcgcggtttgcgagaacgatatgaactgcatcatggtgttaagatatcagatggggctcttgttgctgctgcagttctatccgatcgatacatcactggacgttttttgcctgacaaagccattgatctagttgatgaagcagctgccaagctcaaaatggagataacatcaaagcctattgaattggatgaggtagacagagaaatcataaggcttgaaatggaaaagctctcattgaagaatgatacagataaggcctccaaagaacggctgagcaagcttgaagctgaactagaatctctcaagcagaagcagaaaagtctttcagaacattgggaatatgagaagtctttgatgactcgtataagatcaattaaagaagagactgacagagtgaacctggagattgaagctgctgagagagaatatgatttgaatcgtgctgctgaactgaagtatggaacacttttatcacttcagaaacagctggaagaggctgagaataaacttgttgaattccagcaatcagggaagtcaatgcttcgagaagaggtgactgatgtggacattgctgagattgtgagcaagtggactggtattccagtgtcgaaccttcaacagtctgaaagggaaaagctgctgctgctggaagatgtacttcacaagagggttattggccaagacattgcagttaaatcagtggccaatgccatccgccgttctagggcaggcctatcagatcctaaccgtccgatagcaagcttcatgtttatgggacctacaggtgtgggaaagactgagctgggtaagacactggctgaattccttttcaacactgagaatgccctaatacgaattgatatgagtgagtacatggagaagcacgccgtctcccgtttggttggtgccccacctggatatgttggttatgaggaagggggccaattgactgaatcagttcgtcggcgaccttactcagttgttctgtttgatgaaattgagaaagcacaccaggaagtctttaacatattgttgcaactgttggatgatggaagaatcactgattcacaaggcaggactgtcagcttcactaactgtgtcataatcatgacatcgaacattgggtcaccattgatccttgacacacttagaaacaccacagacagcaaggaggccgtgtatgagataatgaagaagcaggtgattgagatggcccggcaaacattccggccagaattcttgaacaggatagatgagtacattgtgttccaaccactggatacaaccgagatcaaccatatcgtggagatccaggtcgactgggttctgttccgggtggggccgcggccggtgcgtataattaaaccatagtatcaaccttatgttatttctccacatttgcacattgtttgtgtagcctgctctttaatttgacatggtctctctacatgcaaaagga

SEQ ID NO: 15515 - DNA, 4865 bp, Zea mays
  misc_feature (3854)..(3854): n is a, c, g, or t
  misc_feature (3856)..(3856): n is a, c, g, or t
  misc_feature (4110)..(4110): n is a, c, g, or t
  misc_feature (4460)..(4460): n is a, c, g, or t
tagacagatctacacaagtgcgtttcacttttatttggtttgtgctggccatgttttcaaatcactgatgctttgttttatcaaattgatgcttatgccacaatataggagagtcagtgctctgaatattgtcatatttactgtttatttctctgaataggagctgctggtggagcgatggatgctggtaacctgttgaagccaatgctaggccgtggagaactccgctgcattggagcaacaacattggatgagtacaggaagtacattgagaaggatgctgctcttgagcgtaggttccagcaggtttattgtggtgagccagcagttgaggataccatctccatattgcgcggtttgcgagaacgatatgaactgcatcatggtgttaagatatcagatggggctcttgttgctgctgcagttctatccgatcgatacatcactggacgttttttgcctgacaaaggtaatttgtatgctataatgtggataagttacggtgaatagcgagctgatctattcattatctaatataatgttctctatttgtgtgtccagccattgatctagttgatgaagcagctgccaagctcaaaatggagataacatcaaagcctattgaattggatgaggtagacagagaaatcataaggcttgaaatggaaaagctctcattgaagaatgatacagataaggcctccaaagaacggctgagcaagcttgaagctgaactagaatctctcaagcagaagcagaaaagtctttcagaacattgggaatatgagaagtctttgatgactcgtataagatcaattaaagaagaggtacttgcattcttcactcttctgtgtattgcctgccatattcctctgatagcttctacttaaagcgctgtttatgctgtggctgtgctgcgcaaccaatcggctgcaattgtgaagagctgagagcaagctccggctgtttgctgctgaatgtctgctatcgctgccactgtttgggctgctgcagcacagcaacagccagagccagctatctgatcaggctgatttccccccctcggtgccatatgggttctaattcttgtcttttatcttgtttagactgacagagtgaacctggagattgaagctgctgagagagaatatgatttgaatcgtgctgctgaactgaagtatggaacacttttatcacttcagaaacagctggaagaggctgagaataaacttgttgaattccagcaatcagggaagtcaatgcttcgagaagaggtgactgacgtggacattgctgagattgtgagcaagtggactggtattccagtgtcgaaccttcaacagtctgaaagggaaaagctgctgctgctggaagatgtacttcacaagagggttattggccaagacattgcagttaaatcagtggccaatgccatccgccgttctagggcaggcctatcagatcctaaccgtccgatagcaagcttcatgtttatgggacctacaggtgtgggaaagactgagctgggtaagacactggctgaattccttttcaacactgagaatgccctaatacgaattgatatgagtgagtacatggagaagcacgccgtctcccgtttggttggtgccccacctggatatgttggttatgaggaagggggccaattgactgaatcagttcgtcggcgaccttactcagttgttctgtttgatgaaattgagaaagcacaccaggaagtctttaacatattgttgcaactgttggatgatggaagaatcactgattcacaaggcaggactgtcagcttcactaactgtgtcataatcatgacatcgaacattgggtcaccattgatccttgacacacttagaaacaccacagacagcaaggaggccgtgtatgagataatgaagaagcaggtgattgagatggcccggcaaacattccggccagaattcttgaacaggatagatgagtacattgtgttccaaccactggatacaaccgagatcaaccatatcgtggagatccaggtcaacttttaacagttccttttagaagcataaccgattcttataattaaaccatagtatcaaccttatgttatttctccacatttgcacattgtttgtgtagcctgctctttaatttgacatggtctctctacttgcagctgaatcgggttcagaaccggctgagacaacagattcatctccagtacactgcggaagccgttgagcttctggggtctcttggctttgacccgaactatggtgcgaggcctgtcaagagagtgattcagcagatggtggagaacgagattgcccttggtgtcctgaagggcgatttcaaagaagacgatactgtcctcgtggatgtaagttcggcggcgatcgcaaaaggactcgctccgcagaagaaacttgtccttcagagggtagaaaacggaaacgacgagttagttgctaatgactaggtcagatgggatcaccttttagcgagaatgttcaagtgtgatgaaacgcagctgttagatctgcgttttcgcgtatgagaaacttggccttttatttaggttctaccatgaagtcgtgtccagtctccggtggcaaaactcaatgttcaaatctctctgaatataatcttgagagctctacctcaagagctgtgaatatctgttcaggcaacccctatctttctcgcccccggaaaagttcttcggttggcctctgtgctccatcgttcctccaagtagcaaatatgtcacgataggtcattctgtactagagaacatgaggcgctcctcggggcgcctacgataatcaatagtcatatacataagtcatagcgaataggtagtagtactcggaatataacgatacaccacaataagacataatatagatacgtacggtgacataaacggtaggtagactataatgcaaccattaagatttttgtctagtcacatgctacactaagtatttgagcatacagaaatgcctttgtgctctggctgccagctaccggctgcctgatgtcaggctccttggcttagggccatccagaccaaggtccgtgacaagttccattagtcaatgcccaagaaatattatcagagctcttaatcataccacccacgtgcttgaagatttctttcaaggttttataggtctcatgaacatgaagtcatgaacaaattcatgtatggcctctatgcatgtaagaacagcatgggacagtacggtggaaataaacagtctgtagtttccttacaagttacatttctctatgttcaataggttaaaaatttcaaacaagtcattggatctttgtgtatagaaatatgaacagtgtgtgcagatttatttggtgtaaattgctacattgtgatgtttaattaatttcaaaaaacaggtttcagtcatcgagctggcaaggtcttatatgatgacaaaactcctaaatacatgacaaacttcttacctcaacatataaagcatgcaagacatacttacaagacctaagaaatcagtcgcttccttgatagtctctctgaatctgtcatcatcaaaccatccaaattttataattcgacaaaccagctgaattaggggcaacatagtttatgacataattcccttcacacggattgccataaaggttagctgtaaataagtaataagaagtatagacaagcatgtaagaaagaaacagacacatattaatttcatctttgatgacacatactgaacgataaacggaaatagttatctttcaatatcattcgagagttggtcatcatcggagagttagtcattcagtacgcttcgcagagttggccggcggantnttggtcggcgagtgggccgtttttgaagggcctatttcagatacccggttcccgagtactcgacagtagcttccgagccttcgtgtaacaccttagagttgcacggaggcttttgcggaggacagaattcttgggtgtgcgcaagcacatctgctagatgtagctcccgagtaatccatgtggatttgcttggggagttcactcggtattcgagcagtttatgggagtgagtctaggtttgctcgactctctcnggtgcgcgcaagcgcatctgctagatgtagccctcgagcaatccacctagattgcttgaggtttattcggtactcaagtagtttaggggtggacccttcctgtgatggtcgtcacacgctgagcgttagtccgtttagtgccggagtcgagcgtagtcttgggtggtgatcctctgagcgagtcttcttccaagggcttgatccttgatatgcacgcatccccctcggaaggccttttgaggtctctttgagaggaggaccgccttccaccgacctagccggggcggagaaggaggtcgtcgagctacgaatgagttatccatgtgagatccgactatccaccaaagagnggccttgtgggcacctcgtcagccgggttactgtaggagaatgtgaggtatgaccttacatggacacgagcaaatgacctatgggtcgatcaccaagcttgcgactaaacactctaaatccatctccaaaaaataacctagtttaatttattaatttccagtagaaaggaaaatatttatgttaccaaataatgaaatggtgatataaacaaatttaaaaattttcttgaatagataaaattctaccaagtgattaatacattcatgcccaatcataaatttgtttgattagatctacgaatccaatccgtggatttcattctctgaggaaaaaaccatttgttaaaataataaagaattgttaaaataataatttttatgatttgttaataataataattagag

SEQ ID NO: 15516 - DNA, 711 bp, Zea mays
attgtgttgggcattgatccttgacacacttagaaacaccacagacagcaaggaggccgtgtatggcacgacgatgaagcaggtgattgagatggcccggcaaacattccggccagaattcttgaacaggatagatgagtacattgtgttccaaccactggatacaaccgagatcaaccatatcgtggagatccagttgaatcgggttaagaaccggctgagacaacagaagattcatctccagtacactgcggaagccgttgagcttctggggtctcttggctttgacccgaactatggtgcgaggcctgtcaagagagtgattcagcagatggtggagaacgagattgcccttggtgtcctgaagggcgatttcaaagaagacgatactgtcctcgtggatgtaagttcggcggcgatcgcaaaaggactcgctccgcagaagaagcttgtccttcagagggtagaaaacggaaacgacgagttagttgctaatgactaggtcagatgggatcaccttttagcgagaatgttcaagtgtgatgaaacgcagctgttagctctgcgttttcgcgtatgagaaacttggccttttatttaggttctaccatgaagtcgtgtccagtctccggtggcaaaactcaatgttcaaatctctctgaatataatcttgagagctctacctcaagagctgtgaatatctgttcaggc

SEQ ID NO: 15517 - DNA, 1298 bp, Zea mays
gtgtgggtaagcttaggtgccatttgtgggtggctcgtggtggtggtgtgtataaaagcagtcgtcgttcgtgaagcacaagctgccccccctcctctccctcttctcgtgtcagcgcctggaccaaagacgatggccgtccctgttggtcgcctcgccgcctccacgctcctccagctcctcgtctggctcccgctccccgcgtccgcctgcgaccgctgcgtgcgccactccaaggccgcatactactacacctcctcgctcaccctcgccggcggctcctgcgggtacggcaccgaggccgcctccttcagcgccgggctcctcgccgccgccggccccgcgctgtaccgcggcggcgccggctgcggcgcctgcttccaggtgcggtgcaaggacaggaagctgtgcggcgcggcgggcgccagggtggtggtcacggaccgcgccaggaccaacggcaccgacctcgtgctcagcagcaccgcgttcgcggccatggcgcgccccggcatggcccggcgcctcgccggcctccgcgccgtcgacgtcgagtacaagagggtgccgtgcgagtacaagcacaggaacctgtcggtgagggtgcaggagaagaggcgctccccggggggccctggcgacctcgccatcaggtttctctaccagggcggccagaccgacatcgtcgccgtcgacgtcgcgcaggtgggctcgtccaactggaagtccatgacgcgccacagcggcgggccggcgtggagcacgaggcaggcgccggcggggccgctccagctcagggtggtggtgacgggcggctacgacggcaagtgggtgtgggcggagcgcgaggtgctgccgcggcggcggcgcgccggcgaggtctacgacacgggcgtccagatcaccgacgtcgcccgggagggatgcgtcccctgcgacacgcgcgagtgggagtgatgcatgcatgtggacgaaccacgccagtgacggcagaagcagaagcagaagcagaagcccaagcgctgaagcttcaactcaacttgaagagcctgcctgtagaattgctctagctagctcctccgtgccactgcccttttgggcttgcctcaaaggtcaccggagacgacgagggagacgactaattaacagacgctgacagagtgacgcgcgagaggagaggagagttccgaaccccccccctctccgctgtactgtacatgagctgctgacgtgtcggataagtagtagtagctagcgtcccggcgggtgctggaaagaataataataataatgtaacg

SEQ ID NO: 15518 - DNA, 1340 bp, Zea mays
  misc_feature (22)..(22): n is a, c, g, or t
gggtacctcgaggccggccggngactaaggtgttgtttgctttggggtcctcccgggcggccgggcgggccctcgtctcgcctgagcagagccaagcccatccatcgttccacacctccgcgatacgatgtccgtccctcctgcccgcctcgccgcgtcctcgctcccgctgctcctcgtctggctccagctccagctcctcctcgcgtccgcctgcgaccgctgcgtgcgccactccaaggccgcctactacacctccgcgctcaccctcgccggcggctcctgtgggtacggcaccgatgccgcctccttgagcgccgggttcctcgccgccgccagccccgcgctgtaccgcgccggcgtcggctgcggcgcctgcttccaggtgcggtgcaaggacaagaagctgtgcgccgcggcgggcgccagggtggtggtcacggaccgcgccaggaccaaccgcaccgacctcgtgctcagcagcaccgcgttcgcggccatggcgcgccccggcatggccccacgcctcgcagcacgccgcgccgtcgacgtcgagtacaagagggtgccgtgcgagtacaagcacaggaacctgtcggtgagggtggaggacaggagccatgcccccggcgacctcgccatcaggttcctctaccagggcgggcagaccgacatcgtcgccgtagacgtcgcgcaggtgggttcgtccaactggaggttcatgacgcgcgacgacgggccggcgtggagcacgaggcaggcgccgccgggcccgctccagctcagggtggtggtgacgggcgggtacgacggcaagtgggtgtgggccgaccgcgaggtgctgccgcggcggcggcgcgccggcgaggtctacgacacgggcgtccagatcacggacgtcgcccaggagggctgctccccgtgtgacacgcacgagtgggaggagtgacggctgcaacggaactcgctgaggactggcgagtgggcctgcggagttgagttgctctgtctggctccttcgtgtcactcgctgccttttgagttttgacggagtggcacttttaacgacgagaggagagccccgaaacccctctccctcccctgtacatgaattagctgcatgcgtcgtcgtcgttcccatgcccgttgtttcaaccggatcacatgcctcgtggtcgttcccccccccccccccttaaacacttgtaatagtcgttgccatggcccggcggcggcacgactcgctgtccgtctatgcaccaggacatcgggcagcaagcgtccgcttggcattcagttgattattactaaaaaaaaaaaaaaaaaaaaaaaaaccaacc

SEQ ID NO: 15519 - DNA, 5048 bp, Zea mays
aggcactttgtgagtttcataagcacaactctgcaatatcacaagtagaggttaagttaaaaagataaagcttcttgctattatgtgcaaaaccctagaaaacatggtgacatcggttcttgtatgtaattagtttgttttatagaattttaagatttcatcaactggatcatataacgatagtagtttcaaaaaacataagattacctggtattttaaatagggtaatctggttttaactactatcaattgacgtgaagttttaatttgaaaatttataaaacatccctctttacctgcacctaagagcaacttagtagttctctaaaaccctataaatcaataatttatgtagttaataaccaaaaaacttttcttcgacagttctctaaataaaatgtttaaatttagcgatttctcatctaactccatcttctctctacatttggcaacaatttaccaactacctaaataaaaaatcggttgtattgtttaggtaatgaagttgactattgacatttgtgacttatttttttgggtgtggatagattcaaaataaaataacaagctaaatttaaagagctagtaaagaactcaatattcttgatatagtgtctccaaggaactctccatttttgactctatatttacatcctcataaaaattacattctataagtagcatctcgctccaatagacttttcatttcccattcttcaaatcccaaccgctacattcaactcttcttctccatacaccaatgtgtgggtcttacacatcatcccacagttggcaagctagtttggctattgtgagtggttagccaaatttggatagaggagggcaatttggagacgaatagcttggcaaattggatgtattggaaagttattttattattgagtattcaaaatttagcttgatgaaacatctagctggtctcttgaagacgctctaaattatttagcaaatctatgatttggataattaaaatttacttcttggcttcatgacttatggcgctgagaaaatggtctaaaaatgatattaagttgttcgggtcaaatatgttttttttctttcgaaaaatgactaaatttaaaaaatacgggcccagcccatggcttcgagatgaaggcagcgccaacgtatgcccaatcataacctgccacgtgttaccatccacgtcataccacgactggggtccctcacggcctcatctcaacatcttcctatccttcaaaattgaaattcattttagaaaaacaaaacaattagagggggcaacgagtaaaaaaggaaaggaagaactcccttctctcctcttcgatcccgacgaacgccgagggccgcggcgatggaatactcaggcggcggtgcgacgctgtcggagatgtaccagagcgcgcggcggctgctactctcggcgcgggatggcgtgggccgcgtcgagcgccttgcctcggcacccacttcgtcctcctactcctcggcgccgctcgtcggtggtgcgtcgggggaccccgcggttgctgaggaggtgcggcgagaggtggcgcagatccaggggctgtgcgcgcagatggaccgactctggcgatccatccccgccaaaggccaacgggacctctggaagaggtgaggatcctctttagatccttattccttttagctgctcggttacaattggttgagttggtagtgaggttagagatgagagatctcacaccgcctgcgccgcagaccattagatttaccgtagtcgcaaagtttgccgtgatatttgccagttcagtcggtaggacgtgaattttgtgtcaagtacaatgagccaaggagtaaccaaactgaatttactgtagtgctgggaatctgcttctgtcagcctgtgactggtagattatttctcggttttctgccgttagacttccgtgtagcttataagtttttggcatacatggataagcatcaatcaatgaaacgattcacatgctgaattcatttttagcatgtaaagtttactgctttccttgactaaccattgactagttagttttgccattatgttcattctctaaggtttggttttgcacatatggtcaataggggctggacagtggacttatgaactaactagtattgatgagatatatgtactctcattgaacatcccagcatgtttgcttctttttccatgagccaaaaagttgtagtgagtttgctttgtgagtatttgggctctggctgacgccctattgtagctgcactgttcatgaagctgttcttctccctcattctcaaaacaatggggtgccagggagccggtgaagccacattttgtggctcctctggctcaagctctgtcggttactatagtgcggagccagagcaagggcgagccatgttcccagaacatgttgcagagccagagcaagggagagccatgttcccagaacatgttgtctgttttcgtcagaacttttattgggtctcattctaaatactgagtaataagaagtagaagtctgcaaaatgaagtcaggtattctgcacctaaggatagtgctactagtgcaaactgaagcttcacttagaattaactaggagtctaggactagcaatttgactccgcagtacaggtgtgcatggccatatagaaaattatgttttcttagattgattctttcacaggttcatcggtaagcgaaaaatattttgatgcacttcaatttcatggtttgtgttagtaaagttagcttaaattcacaagaattggaacaagcaactgtgcaaacatacacttaggatcttcatttcctattggttatttctaattgattagcagttcttatctttttgtattcacttattcaccttcagggtgctttcaagtgctgtaaccatgcacagatacatcattgggagacgaattgactatatttgacccttaactgcaaatagatccaattgaccttaagttgcatgttggtgattgtctcgttaccagatcttctagtacttaaatagatttgggatatgctgaggtctgtaagactcatgtgttgcaattctgcatggattgtccaaattgttcatacaggtttggctctgaaattcataaaaaaacagtgttattgtcatgaaagttctctgcaacccattaacattcttgttggagaacatgatgtctgcattctctagtacaacctctccacttcctcaaagccaaaaagcccaagcgtcagcaggctggccgctggcagcctgacacgcatcatgctgtttgctgcgtggacatgcggttttttctttagaggttggcatttcgtgtggtggatatcagagaaatgctgtagtacgaagaattagggttgtgagttccccttggatgtagaaagtctgtagtttgtattggctaggactaggaactaggaaccaagtgttaaatttatgacgcattatttttttctgtctttgcagaaaagtggagcagctctctgaagaggtagattcattgaaggaaacccttgacaggcattctctgcgacagaaaaaacggattctggaagcaaaagaaagagctgagctatttgaaagagctgtaataattcctctcagcaataatgcggtcttttcttttcccgtatgatttcattgtttagtcgaagaattgaaaaagaaaaattgttgacgcagaacggtgaatcttcacacgtcctccgaatattcgacgacgaagcccaagcaaagcaatcagcccgtaactcctcacgaatgctcgaagaagcttacgagacaggagtgggtatccttcacaagtacgctgaccagagggatcggctgaaggtaatgcatatcatccattcacgacgaagcctcggtttgaagttgaactgtggacagaagatcactgaacgtgaccaatcctaatggctctttttaatggtctaacttgtgcctgctaatggccatcttcactgcattgcagagtgctcaaaggaaagctttggatgtcctgaacactgtcggtctgtcaaactccgttctgaagcttatcgagaggcggcaccgcgtggacaggtggatcgcgtatgctggtatggtcatcaccgtggtggtgatgattgcgttttggcggttaacgcattagtgctgggctgtgtttgttacatatttctatccaagatatcaatgtgcaaacgagggagacggggcagattcagatggtgcagttttttttccgctggtcgtggagcagttcaagtttgcctcgccggtccgtcgcccgcatagttgatgccggacccccaaagtgggttaaatgttcaaattccattgtatgcaatgctgctgtgtagtctattgttacgacttccgtgtaactacacaagcttttgcgggacacagaagagaaaaggcgctgtattatttctgcacgaaatattgtactcgtaatatctagcctgcagttgaatagcacaaaataacggaaacctgtgagacctgaattttcagatttaactgagcaaaagatatgtgtctagcatatgttcctcgtctgggacggcagattttcagtctttcatcactaaaagggtgacattaaggttattagttttaaaaaagcggccagtccactttttttatcctggactgattcataattggaatacaagcccttgttttgttttatttattgatggtaagaacatcaccgtatgaggactcattgagaaacatgggctgatctcatccaggagatggttgccacctttcttgaatgatcagtaacaattagtacggtccaaggctctgatcagcaggccaagcccagagcttatggaagatgttgaaagcgacaccaggcttgccatgcccacataaagatcctactatgtacccctttcacctatcaccccaaaacatttcatcacaactatacatgtccatagcgggaggggcagcccatggcccgacacgcacacgccgaggcacgacatacatgtcgtcgtgcccatgccggtccggtccggcccggcgctcctgcc

SEQ ID NO: 15520 - DNA, 1254 bp, Zea mays
cattgggacctcgaggccggccgggccggccgggcttttagaaaaacaaaacaattagagggggcaacgagtaaaaaaggaaaggaagaactcccttctctcctcttcgatcccgacgaacgccgagggccgcggcgatggaatactcaggcggcggtgcgacgctgtcggagatgtaccagagcgcgcggcggctgctactctcggcgcgggatggcgtgggccgcgtcgagcgccttgcctcggcacccacttcgtcctcctactcctcggcgccgctcgtcggtggtgcgtcgggggaccccgcggttgctgaggaggtgcggcgagaggtggcgcagatccaggggctgtgcgcgcagatggaccgactctggcgatccatccccgccaaaggccaacgggacctctggaagagaaaagtggagcagctctctgaagaggtagattcattgaaggaaacccttgacaggcattctctgcgacagaaaaaacggattctggaagcaaaagaaagggctgagctatttgaaagagctaacggtgaatcttcacacgtcctccgaatattcgacgacgaagcccaagcaaagcaatcagcccgtaactcctcacgaatgctcgaagaagcttatgagacaggagtgggtatccttcacaagtacgctgaccagagggatcggctgaagagtgctcaaaggaaagctttggatgtcctgaacactgtcggtctgtcaaactccgttctgaagcttatcgagaggcggcaccgcgtggacaggtggatcgcgtatgctggtatggtcatcaccgtggtggtgatgattgcgttttggcggttaacgcattagtgctgggctgtgtttgttacatatttctatccaagatatcaatgtgcaaacgagggagacggggcagattcagatggtacattttttttccgctggtcgtggagcagttcaagtttgcctcgccggtccgtcgcccgcatagttgatgccggacccccaaagtgggttaaatgttcaaattccattgtatgcaatgctgctgtgtagtctattgttacgacttccgtgtaagtacacaagcttttgcgtgacacagaagagaaaatgcgctgtattatttctgcacgtactcgtaatatctagcctgcagttgaatagcacaaaataacggaaacctgtgagacctgaattttcagatttaactgaagaaaagatatgtgtctagccaaaaaaaaaaaaaaaa

SEQ ID NO: 15521 - DNA, 1548 bp, Zea mays
  misc_feature (8)..(8): n is a, c, g, or t
cggtccgnattcccgggcaagcccccacttgtgtcctcgcgcccgtcgggaataacgccgcgtgagctgggtgtgggtggggagtttgtcagctgggtggcgcgagcgtcaggcgatggcggaggcgggggagaaggcgagggtcgtggtggttggcggcggcgtcgccggctccctcctcgccaagactatgcagggccacgccgacgtcgtcctcctcgacccgaaagactacctggagatcccctgggctgagctgcgctccatggtcgaaccgtcctttgctgagagatcgttgatctaccacaaagattacctcagcgatgcgaccatcgtgacatcttctgcggtcaatatcactgaacacgcggtccttactgctgacggccactctcttccatatgattatctcatcatagcgactggccatgctttggcttctcctgccagcagagctgagaggataaaagaattccagagagataatgggaagatagagtcgtcagaatctgtgctgataattgggggtggtccaactggtgttgaactggctggagagattgtggtagactacccggggaagagggtgacccttatccatagaggaccgcgtttactcgaattcattggagataaggcttcaaagaagtgccttgattggctgacttcaaagaaagtagacgtgctccttcagcaatcagttgagttgggctcattatcagacacagagaaggtgtacaagacatcaggcggagaaacagtaacagctgattgccactttgtatgcattggaaagccactgagttcgtcgtggctacatgataccatcctaaaggaatccttggatagcaaggggagagtaatggtggaaaaggatttaagagtgaaaggttttaataacatttttgcgattggtgacatcacagatattcctgaaatcaaacaagggtacctcgcccagaagcacgcgctgctagtggcgaagaacctgaagctactgaccaagggtctgcctaacagcaaactggcgacttacagcaccggctatccgctggcgctcgtctctcttggaaggaaggaagggctggctcagtttccattgctgacgctcagcgggtgcttgccaggcatgatcaaatccggggatctattcgtcagcaagacgaggaagcagatgggcctgaatggttgactccagtccgaggaagcttgaaaaaatagctcgggtcctgggttatatacagacgatggattcctttacacagagcttgtgttttgctcgtatggccatatgtgttcgttctgtatctgtgtgatggtgtcgtcgtcgtgtggatgcttggaatggtgactagcagagtgtatgctacgtacatgtatacatggacctttttggtccaacaaaatgttgcttctgtagtatgtatgggcgcattttgtttgctggcaagtaaacaatgaaatcatctttgcttgctggcaacacgatgtcagcagtggcaatttgatgccaaaaaaaaaaaaaaaaaaaaaaaaaaaaaaaaaaaa

SEQ ID NO: 15522 - DNA, 992 bp, Zea mays
acatgtcaagcactcctccagcccggccggggctggtgctatacttcccgtactagttgtcgctgctgccctgttgcggcgacgactccgtgattccctagtcctacccagatcggcgcccgacgcaaggccgagcaggcgatggccgcagcggcgtcaatggggcacccttacgcgccagccgagctggaccttccgggtttcgtgccgctgaagctgtcccaggtcgagatcctcgtgtcctacctcggcgcctccgtcttcgttttcctcgccgtctggctcgtctccggaagatgtgttagattatccaagaccgaccgtctgctcatgtgctggtgggcattcacagggttgacccacataatgatcgaggggcccttcgtcttcactcctgatttcttcaagaaggagaaccccaatttctttgatgaagtttggaaagagtatagtaagggagactctaggtatgttgctagggacactgcaactgttacggtcgaagggatcaccgctgtattggaaggccctgcatcactacttgctgtctacgctattgcatccaggaagtccttcagccacattctccagttcgccgtctgtctgggccagctctacggatgcctggtttacttcatcaccgcgtacttggacggcttcaacttctgggtcggcccgttctacttctgggcgtatttcattggcgcaaacagcttctggatctggataccgatgctcatcgccataaggtcctggaagaaaacttgcgccgcgtttcaagctgagaaggtgaagaagaccaaataaaagctgtctttagctaccgttttattggaactaagggttgtgctgtggagaccgtcattttgatggcttaaattcttgtgttagttggtactggaaactgcatgatgtactctttgctcaaacaaatgaagaccggtttacaaattcaaggaatcgagcgcaggaaaaaaaaaaaaaaagcggcc

SEQ ID NO: 15523 - DNA, 961 bp, Zea mays
acggcgtatacatcctatgggcgattgggttcctcgaggcccgcgtccgcgcgctggtgcgagttgtcgctgctgccctgttgcggcgacgactccgtgactcctagtccctacccagatcggcgcccgacgcaaggccgagcaggcgatggccgcagcggcgtcaatggggcacccttacgcgccagccgagctggaccttccgggtttcgtgccgctgaagctgtcccaggtcgagatcctcgtgtcctacctcggcgcctccgtcttcgttttcctcgccgtctggctcgtctccggaagatgtgtcagattatccaagaccgaccgtctgctcatgtgctggtgggcattcacagggttgacccacataatgatcgaggggcccttcgtcttcactcctgatttcttcaagaaggagaaccccaatttctttgatgaagtttggaaagagtatagtaagggagactctaggtatgttgctagggacactgcaactgttacggtcgaagggatcaccgctgtattggaaggccctgcatcactacttgctgtctacgctattgcatccaggaagtccttcagccacattctccagttcgccgtctgtctgggccagctctacggatgcctggtttacttcatcaccgcgtacttggacggcttcaacttctgggtcggcccgttctacttctgggcgtatttcattggcgcaaacagcttctggatctggataccgatgctcatcgccataaggtcctggaagaaaacttgcgccgcgtttcaagctgagaaggtgaagaagaccaaataaaagctgtctttagctaccgttttattggagaccgtcattttgatggcttaaattcttgtgttggttggtactggaaactgcatgatgtactctttgctcaaacaaatgaagaccggtttacaaattcaaaaaaaaaaaaaaaaaaaa

SEQ ID NO: 15524 - DNA, 1906 bp, Zea mays
cgaaccagaattcataccctgaaatatagcacatattaaaccgaatccggtttaggttcggattcatgtttcggttttaaaatgcgcacccgtggccagcaggcagccaagccaacgctggagttggcggatcgcacggtgatccgacgccgactggtgggacccgaccggcttgtttggcagcgacagcacggtccaagtccacgtcggatccatccgccaactgccaaacggtcccacaggctcccacggcccgcatgccagatagccagctcaacgtggcctcgtcgctgcattcaactctatacagaaaccctggtctgaaagccctcactccaaatctcgcgcactgtcagctgacgccaccgcctgcgccagccctcgccaagccggtgaaaacctcgtgccctccgccgcctccgcccgcctcttccagagtaccgcggtctcatctcctcccgggacgggcatgcagagcacggctgccatcggtctcgttcggccatgcgccgcgcggccactccccacctaccctagcccacggcgcggcgccggcgcgtgcagcggcgccgcacagccgatcctcgcgccccgcggcctctgcctctccgcccgcgccagcctactgccggactcgccgctggaggaggagtaccggagatgcagggccggccggcacgtggccgcggccgggaaggtggcggcggctgatggggccgtagaggaagcggggggagggctcgtcaagacgctgcagctggggtcgctcttcgggctctggtacctcttcaacatctacttcaacatctacaacaagcaggttctgaaggttctgccataccctataaacatcaccacagtgcagtttgccgttggaagtgccattgctttgtttatgtggatcaccggtatccttaaaaggccaaagatttctggtgcccagctttttgctatccttcctctagctatcgttcataccatgggcaatcttttcacaaacatgagccttggaaaggttgcggtgtcatttacacatactatcaaggccatggaacctttcttctcagttctcctttcagcaattttccttggtgagttgcctacgccttgggttgtgttgtctcttcttccgatcgttggtggtgtggcattggcatcccttactgaggcctcctttaactgggctggattttggagtgcaatggcttcaaatgtaaccttccagtcaaggaatgtgctaagcaagaaacttatggtgaagaaagaggaatctctcgacaacattaatctattttcgataattacagtcatgtcattcttcctgttggccccggtaaccttacttacagaaggtgttaaagttagtccagcagttttgcagtctgctggtttgaacttgaaacagatatacacaaggtcattgattgctgcatgctgcttccatgcataccaacaggtgtcatacatgatcctcgccagggtatccccagtcacacattcagtgggcaattgcgtcaagcgtgtggtggtcattgtgacctcggttctgttcttcaggacccctgtttctcccatcaactcactcggtaccgggatcgctcttgctggagttttcctatactcgcaattgaagaggcttaagcccaagcccaaggctgcttgatcatagacctttgcaggtccatccaatagaacttttgaagttatgctatgccattggaatgattagtgagtgccgtagttagaatgatgtttaaagaagagctaccacttcagcagataatttgtgacttgcttgcattttttggacggatttgttcgtgtattaataattttgcagtgacgatacttctgttgtgctgtttataagcttctgaaactgaactgagttgttgcaaaagactaa

SEQ ID NO: 15525 - DNA, 1736 bp, Zea mays
ccggtcccccggatgtagccctcgcatgtggcgacaacacggtcgaagcgcatgtgggatccatccgcccactgccaaacggccccacaagctcagcgcggcggcctcgtcgctgcataaagcccctacctaactccaaatctcgccagcgccaggcctcgccgagccggtggaaacctcgtgatctccgccgcctcgagccctccgcgcgcctcttccagagcaccatccactcttcggtggcgaggccgcggcccccccgagacgggcaatgcagagcgcggctgccatcgggctcctacggccatgtgccgcgcggccgctcgccgcctacactagcccacgccgcggcgccggcgcgtgcagcggcggcacccagccgatcatcacgccccgcggcatccgcctctccgcccgccccggtctcgtgccggcctcgccgctggaggagaaggagaaccggagatgcagggccagtatgcacacggcggcgtcggccggagaggaagctgggggagggctcgccaagacgctgcagctgggggcgctcttcgggctctggtacctcttcaacatctacttcaacatctacaacaagcaggttctgaaggttttgccataccctataaacatcacaacggtgcagtttgctgttggaagtgccattgctttgttcatgtggatcactggtatccataaaaggccaaagatttcgggtgcccagcttttcgctatccttcctctagctattgtccataccatgggcaatcttttcacaaacatgagccttggaaaggtggcagtgtcatttacacatactataaaggccatggaacctttcttctcagttctcctttcagcaattttccttggggagttgccgacgccatgggttgtgttgtctcttcttccgattgttggtggtgtagctttggcatcccttactgaggcctcctttaactgggctggattttggagtgcaatggcttcaaatgtaaccttccagtcaaggaatgtgctaagcaagaaacttatggtgaagaaagaggaatctctcgacaacattaacctattctcgatcattacagtcatgtcattcttcctgttggccccagtaaccttacttacagaaggtgttaaagttagtccagcagtgttgcagtctgctggtttgaacttgaaacaggtatacacaaggtcattgattgctgcattctgcttccatgcataccaacaggtgtcatacatgatcctcgccagggtatccccagtcacacattcagtgggcaattgcgtcaagcgtgtggtggtcattgtgacctctgttctgttcttcaggacccctgtttctcccatcaactctcttggtaccgggatcgctcttgctggagttttcctatactcgcaattgaagagacttaagcccaagcccaagactgcttgatcatatacatttgtaggtccattcaatagaactttggaagttatgctatgtcattggagtgatcagtgagtgccgtagttagaatgataagcctctccgttttgttaccagttgggtggataatttatgatttacttgctagcatttttggacggatttgttcgtgtattaataattttgcagggatggttgtcgttgtgatgtttgctgtttatagacctgaaactgaactgcgatgtttcattggactaaaaaaaaaaaaaaaaaaaaaaaaaaaatcgagctacaatag

SEQ ID NO: 15526 - DNA, 792 bp, Zea mays
cattgggtacctcgaggccggccgcgccctcaaacccccccaaaagcctcctctcccccctacactgtttccatcggcggacggctcccatggaggcggccgagtgaagcagccgcctgccagccagccatcgtctctgcgctgcttccgtggcccggatctgggagcgcggcgctgacagtggaggacagtggactacatcgtcagctgcaatacttcttgatccagatccaggcgttcttccaactcttccttctgcattcgtgtggagtggggattcttctggcctttcgagtgacttcttttcttgtagtgcagtattgtgagatacaacatcagctgatccaatggcgacatataagctgggtgtggaggtcgcaagtgctcatgacctgatgccaaaggatgggcaaggttctgcaagcgcttgtgttgagctcaactttgatgggcagcgcttccgaactgctgtcaaggagaaggacctgaaccctgtctggaatgagcgcttctacttcaatgtatcagatccttctaatcttcctgagctggcccttgaagcatatgtctacaatgtcaacaaaactcttgaaagttccaggtccttccttgggaaggtcaggattgctggcacctcatttgtgccctttcctgacgcggtggtcatgcattatccattagagaagcgtgggatgttttctcgcgtcaaaggagaactgggtatggaagtatacatcaccaatgaccccgccatcaaagcttcaaaccctcttcctggcatggatcctgtct

SEQ ID NO: 15527 - DNA, 3731 bp, Zea mays
agcttttcttatacttagtactgtgtcaaccactatggtatggcaaaccccttgccagagaggctccgacgacgatctcactttgtgcaaccagaaacacccgacgacgcatctgggctccgcttgccatcatccaacgctatgctagaggaatcctcgcgggtgattttcgtgctcctagtaataaggagagcgtcgacggtgcagaggcgccaaaaggaggcacttgttgcatgacaacagctctcgaaacgccagtgctaagctcaacgacacaagggacctgcaaggacatgaaaatcattgacgcgacatgagctccccaagacgcaaatggaggagagggggttccctaacgacgccaccaaggagggcaacgacgcttataagctggcgacttataagctgggtgtggaggttgtaagtgctcatgacctgatgcgcaaggatgggcaaggttctgcaagcgcttgcgtggagctcacctttgatgggcagcgcttccgaactgctgtcaaggagaaggacctgaaccctgtctggaatgagcgcttctacttcaatgtatcagatccttctaatcttcctgccctggcccttgaagcatatgtctatagtgtcaacaaaaccattgaaagttccaggtccttcctcgggaaggtcaggattgctggcacctcatttgtgcccttccctgacgcggtggtcatgcattatccattagagaagcgagggatgttctctcgtgtcaaaggagaaatgggtatgaaagtatacatcaccaatgaccccgctatcaaagcttcaaaccctcttcctgcaatggatcctgtttccaataatcctcctccagccccaagtacagcagagcagattgcagctgatataattggtactaatctgcacaagtctcaggagcataggtctgaggcaaagaccttacacaccattgctaaggaggtacatcataaccatggccatcttccagctagttttggtgagcagccttccaagtactctgttgaccagatgaaacctggatctcaaccacccaggattgtgagaatgtattcagcagcctcccagcagcccatggactacgcacttaaagaaactagtccatttcttggtggtgggcaggttgttggtggccgggtcatacgtggcgaaaagaatgctagcacttatgaccttgtggagcgaacgcagtatctgtttgtacgtgtggttaaggcacgagacttgcccgacatggatgtcactggaggcctggatccttatgttgaagtgagagtaggcaactatagggggataacaaagcactttgaaaagcaaaagaacccagagtggaatgcagtctttgctttttccagggaccgtatgcaggcatccgtgcttgaagttgtggtcaaagacaaagatttgattaaggatgactttgttggctttgtgcgatttgatttgaatgatgtccctattcgtgtgcccccggacagccctctggctccagaatggtacaggcttgttagtaagagcggggataagtccatgggtgagctcatgcttgcagtttgggttggcacccaagctgatgaagcatttcctgatgcctggcattcagatgctgcaacacttgaagatccatctgcagtaacacacatgaagtccaaagtttaccatgctcccagattgtggtacctgcgggttaatataattgaggcccaagatgttgctatattagataagacccgctatccagatgtatttgtgagagcacaggtggggcatcaacttgggaggacaaaacctgtgcaggctagaaattttaaccctttctggaatgaagacattatgtttgtggctgctgaaccatttgaggatcaccttgttctgactcttgaggatcgtgtaggtcctaataaagatgaaatgcttggtcgtgtaatcatacctttggcaatgattgatagacgtgccgatgaccgcattgtccatgggaagtggttcaatctcgagaagcctgttcttgttgatgttgaccaactgaagaaggagaagttctctactcggcttcatctccgtctctgtcttgatggaggttaccatgttcttgacgagtctacaaactacagcagtgacctgagaccaactgccaagcaactctggaagccgtctattggtttgcttgaacttggtgtccttggtgctcaagggattgttcccatgaaaactcgagatggaaaaggttcatcagacacctattgtgttgctaagtatgggtcgaaatgggtaaggacacggaccatcatgaacaacccaaatcccagattcaatgaacagtacacttgggaagtctatgatcctgcaactgtgctgactgttggtgtttttgacaatggacaacttggagagaagactggggagaagacatctagtggcaaagatgggaagataggcaaggttcggatacgcctttccacactcgaaactggtcgtgtgtacacccactcgtatcctcttctggttctacattcgtcgggggtcaaaaagatgggcgaactgcacctggcaattcgattttcctcaacatctctggtaaacatgttgtacctgtattctaggcccttgcttccaaaaatgcactatgtgcgcccaatacctgtgcttcaggttgatatgctacgccatcaagctgtccagattgtggctgcccgacttagccggatggagccacctttgagaaaggaagttgttgaatacatgacagattttgattctcacttgtggagcatgaggaaaagcaaagccaacttcttcagactcatgacagttttctcaggcttgtttgcagttagcaagtggttcagcggtgtctgttcatggaggaaccccattaccactgtgctagtgcacattctctttataatgctggtgtgctttcctgagctcatacttccaacagtgttcctgtacatgttccttatagggatttggaacttccgctatcgacctcgttatcctccacacatgaataccaagatctctcatgcggaggctgttcatcctgatgaacttgacgaggagttcgatacattccctaccagccgcaaccctgaggttgtaaggatgaggtatgacagactcaggagtgttgctggaaggatacaaacagtggttggtgatattgctacacaaggggagagggttcaagcattgcttagctggagggaccctcgtgccacagcagtctttgtcctgttctgtttggtagcagcaattgtcttctatgttacaccgcttcaagttattgctgcattaggagggttctatgtgatgaggcacccaaggttcagacataggttgccctcagtaccagtaaacttcttcagacggttgccagcaaggaccgactctatgctataaataagccactacctggtggtcctatcgttgtaatccctagagaggctctatgttactgtagtctgcttgactttgttggtattcatatctgtgtttgatcaggacttgagagcctgttaatcgtgaattctgggaatacttgccagacctaatttttgtttgagtgttcatcctttgtaaaatatctagttatccaatgtttaaaggcgtgtttaaaatgactttaggttccagctcttgtgaagctgtagtttataatatcaatttaaatagttctaaaagtattttaatttaaataataaaaaata

SEQ ID NO: 15528 - DNA, 1264 bp, Zea mays
ccacgcgtccgtggacaacttggagagaagatggggagaagacatctagtggcaaagatgggaagataggcaaggttcggatacgcctttccacactcgaaactggtcgtgtgtacacccactcgtatcctcttctggttctacattcgtcgggggtcaaaaagatgggcgaactgcacctggcaattcgattttcctcaacatctctggtaaacatgttgtacctgtattctaggcccttgcttccaaaaatgcactatgtgcgcccaatacctgtgcttcaggttgatatgctacgccatcaagctgtccagattgtggctgcccgacttagccggatggagccacctttgagaaaggaagttgttgaatacatgacagattttgattctcacttgtggagcatgaggaaaagcaaagccaacttcttcagactcatgacagttttctcaggcttgtttgcagttagcaagtggttcagcggtgtctgttcatggaggaaccccattcccactgcgctagtgcacattctctttataatgctggtgtgctttcctgagctcatacttccaacagtgttcctgtacatgttccttatagggatttggaacttccgctatcgacctcgttatcctccacacatgaataccaagatctctcatgcggaggctgttcatcctgatgaacttgacgaggagttcgatacattccctaccagccgcaaccctgaggttgtaaggatgaggtatgacagactcaggagtgttgctggaaggatacaaacagtggttggtgatattgctacacaaggggagagggttcaagcattgcttagctggagggaccctcgtgccacagcagtctttgtcctgttctgtttggtagcagcaattgtcttctatgttacaccgcttcaagttattgctgcattaggagggttctatgtgatgaggcacccaaggttcagacataggttgccctcagtaccagtaaacttcttcagacggttgccagcaaggactgactctatgctataaataagccactacctggtggtcttatcgttgtaatccctagagatgctttctctgttactgtagtttgctcgccttcgttgctatttgtaactgtgtctgttcagaacttgagagcctgttaattgtatcagttgctgaattctgggaataattgcgagacatggttctgtgttgatcctttctaaaatatcaagctatcaatgtttagtaaaaaaaaaaaaaaaaaa

SEQ ID NO: 15529 - DNA, 2728 bp, Zea mays
ggttggcgcgtggctggagtctcactcttctctttttatgtgctgcaactaaaatattgtctagaaacaattatagttgtctcctgtaaactctggttttgaaaaaagtatttttctcaacatcgtctgacatggcaatggacttaggctgtctacagcagcttatccactctatctgttatcatatgttttatttaaaacatcattctataaaccatgctataaacaacacgaaagaatattttatatgctcatatacatacatactagagacagccttgctaaagcttgtcaagagtcaagtcaagcaatgaaaaaaaaggcgtcaaacaaatttgccgaaactatgggcaccaaagaggaagacaaacagtcacaaccaatcaccggcgccaaaacatgcagcgcagcttcatgccttcatggcctcatggtcctgctggatatggcggaaaaactgctggcggccgttgcaattgcagccacattcaactcaggctccaggccgctgcaacccaagccgccagcagcctgcccctcctctccgactccaaaccaatccaatggccctccgccccccgctgtctcacctcacgcgctctctgccctggcctgcccccagcatgacgcgatgctccgcactgcgtcggatacatggacgatattgctggggagcgggggaggaaaggagacgactcttcccgtgccgtgctgacgccaccacgcggccccggtctcctctcgccctcctctccgtctagatctgatcctatcccctccccaccctccgccgccgtcctcgccctcccggccgcagccacgagcccgagcgccgggctcctggcctcgtctcgcctcaccggcgagatggacggcggcggggagacgctgctggtgcggaggagcaagggcaagaagaggcggcagccggcggcgcccgcggagaggggctccggcagcggggacaggttccgcgcgctctggcgggactaccacgacctgctgcaggtgacccaggcagtgtcgccgagcctggcgtgctccgcccactgatctcttcgccctttctagttttcgtgcagctctcttgtttcgacctgttcttaaatggatgattcagcgccggcttgattgctgaattcctcgtgctatccccacttgttccggttgctagtactcgtattatgtttgtgcttggctgtttgattctttgctgccgtgggacggggtcacggggattcaagaattccatccaatagcatggctaaaaccaacaattaagtatacctgtgattagacttggaagctgatacaatacaatacaacattgatgcaggagaccgaggcaaagaagaggaggctggcgagcaagaagcgaagaagcctcgccctgcttgctgaagtcaagtatggcagttctccggctcttgctttgtggctccatgttactactagtatcatcttcttattcttcatgctggcattattactgcttttcagcttcactaactgtgtagctgctttttgttgcaaggttcttgcgaaggacgtatcagtcctttccgaagggtgactcgcagcagacacattacaggttgaagaagcaggctcggtacatgccatccccattgggccatggtgcagggaccgaagtgccttctaccagcagaaacccaaaccttgacttaaatcaagattctgtcctgaacgatgtggggaatgattgccaggggcaacatggccatccagaagttgaaaagttagatcaggtcgaggtgaatgaagatacgatgacacctgatgtcaaattatcagtttgtagggatacaggagagtactctcctgtaagtgaaggtaagagggcggttccatggcaagaccggttcgcgttgaagaccgaggccctcagttgatgtggctaagaaataagctgcttctctgacagctagttttgctactgtatccctcaaatgctcagtagtgctctgtacagaaacaatgggacatgatacttatatgcatgttacattgcctgattgacaaactcagatgtttgtagcatgcttctaagcaagttagacaagtgagttgtgattctatgaatggttctgtccagaatttggattggcccatttgattttaaaaatgtgcatcgaatgtttcttcaatcagcaagatcatgaattctgtgaattgcaagtttggagggttaaatttctggtttcatagtttaggtttcaaatagcctctttagcaatgatcataaggacaagtataactattgattggtttttggttttgagttgcaagtttatggtttgtttgtctgggtgaaagggtgcattgtaagttagggtgttgcataatgaaaattcgagtgtaccatggtcaagcggcctgtagattcgtctcaaggaatattagtttttttatatagtctcaaggaatatatgtagcctttagcaattaccatgaactagtttgaagggttaaatatctcgtaaaccaaatttctatgataaaataataatgttaaaaattacatagtgatgattcggaaaaatattaatacattcttcatttattatatttctatttgatgtcacatttttttagaatttgctctataattttggtcaaactcaagatacttgactcttcaataaagttaaaagaatttataatttaaaacggattctaatgtccaaataggctctttatcttcatc

SEQ ID NO: 15530 - DNA, 425 bp, Zea mays
ttgagcttgcagcacccaagcctcggggacgactacgacaaagatcagctgaacaggatggtcgcggtcgcgtcccgctgcatcatgcgaccggcgatgtggcggccttcgatggccgaggttctgcatttcctgtctactactgatgagtgtctgaacgagcccgagaaatggaacattcccgacgacgaggtggacgacatggatgattgtacactgttctctgaatccttttccatgtaattgtagcctcatttttttcccatttccttttagtgtgtgctatgttggcatgccgttcttggcatggggatggaggcattgagctatgttttctggtctttttgtagtcttagatgactggtatttaatcatgcgttatatatatgacggggattttgggatgtaaaaaaaaaaaaaaaaaa

SEQ ID NO: 15531 - DNA, 4075 bp, Zea mays
cgtagcactgccctcttcctctctgtcctctcccctgctgccgccccctttcccaaatctggccgcacgacgcaccagccaccaaccgcacacaccccaaacttgaaggcacaacccgagcgctcgcccgcctcgcctctgcgccgcgtccggccgccggtagcgggccggtcacttaccgggagggagaggtgctttggttcctggatgagctgtgaaggaactgggagcaagaagaattgatgtttactccgcagggcaaaggatggaccggctggtcgacgccaactccggccaaccagcggagcggtggtggggctcctgctgcgtcggcgccccttggaaagggcaaaggaagggtcgccgagctcgagcaggagttgcatgaatatcagtacaatatggggcttcttttgattgaaaagaaagaatgggcagcaaaatttgaagaaatcagtgaagtgctgacacagaaagaggagatactgaagagggagcaggcggcacatctgaatgctatatcagagtatgaaaggcgggaggagaacatgcggaaagcactaggtgttgagaagcaatgtgtcgctgatcttgaaaaagccttgcgtgatatacgagcagagatagctgaggttaaatttacatctgagaaaaagataacagatgctcagtctcttgaggctagtttggaggaaaaatccttggagatcgagggaaaacttcatgctgcagatgccaaacttgcagaggcaaaccgcaagaagtctcaagctgaccgtgatttagaagaggcggaagctcgtcaacgtagactggagaaggagaaactgtattttgagacagagcggaaggcccgagaaaagcaacttaaggagcaggaggaatcactgcaggaatgggagaaaaagctgaaggaaagtcagaatagacttaatgagttgcagagatctataaatgagcgagaggagagagcaaataagaatgatcaacttttcaagataaaacaggacgaactggaggaggcacgaaggacagtggaggccgctaaagttactctgaaagtcaaagaggatgatattaacaaaagactaaatgaattacatttacaggaaaaggatgctgactcaaagcgcagtgcattggaagagcaggggaaaaaattggatgagagagaggcaaaggtcactaatagagaaaaggaggggctccagaagcttcttgaggatcatcaggtggagcttgaatccaaaagacgggattttgaattagaattagagagggaaaggaaatcttttgatcaaaatatgacacagaagcaagcggatttattgaaaagggagaaagatgttaaatctttggaggctaaactttctaaaagtgagcaggcattgaatgataagaagaaatcaatggaaaacttgcagaatgatcttgatgccaaatctaaggctctgaagagttgggatgaatcattgaaaaatgacgagaaaaggttactgaaagaaaagcagcaaatggatcatgaaagagaacaattggagacatacaaattggagcttgaaaagatcaaatcagcattagaagctgagaaggaaaaaatatcagaagagcagaataatctgaaactcacagcgcaagagaggcaggagcatagcttgttgatagcaaaacttaagaaggagattgaggaatacagaatgcgaagcaactccctatctgaggaaatggaggatttaaggaagcaacggcagaaatttgaagaagagtgggaacaactagacgaaaagagagccctccttgtagaggaggacaaaaggttgaacattgagaggatgaatttagaacggtggcgtgacaacgaagaaaaaaggttaaatgatatgaaactcaaaatggatgaagaatacaagcagcagctggagagtcttgagcgcaaggaaaaggctttgagtgatgatatgaagcacaagcaaatggaaaatgatgaatttctgaagggagaacgtgctgatgttcaacgtaaattgcaactcaaacggcatgaattggagatggagatggagcaaaaacaagccacgaaggagaaggaactggaagaaaaggaaaatgagttaaataagaaaatagattttgtggaaaataaactccgacatgcaattgagttgaatgagtccaagattgagaagttattattggagaaaagggaggtgcagatggaaagagaattactgctggaggaaagaaagaaaacggagactgacaaggcagatattagaagggatattgagagtctgcactcattgagcaagagtttgaaggaacgtcgagaggcatataacagggacaggagcagactcatcgaactatttgaaaagtacaaggcgtgcaaaaactgtgggatttctatttttgagggattggattctctgctgcttaaagacagtgctgaaattgagcatccaagtttggctgttgagggagatgatcatgccttgaccaccgatacatcaggtccagatacaggaacccttgttaattcaggtggtcgtttttctttgttacagaagtgttcaaggcttttcaagttctcccctagaaaaaagggtgagcagtcatcagaacaaccatcagagaggaatatatcttttggtgcaagactcgaggaagcaacacagagcgatggagattatgtgccaactcctgtctatgagatagcccacgattctttcaatgcagaggatgagctcccttctgacggtgaaaccagggagaatgaagagtctgaaaggcatgacatagctgataatgcccagatggagtcttctgttggtgtagcagataacagtatagatattctcggtactaagtcatttgatggtgctaacgacatggcagttgaagcaactattgtctctgttgatcaaaatggcgaggactctgtagttcctgctgaagcaggtgtagagcctgaaacatcagagcaaggtcggcgccagcaaaaccagagaggcagaagaaaaggtggtatgaaaagaacacggtctgttaatgctgtagttgaagatgctaagatgatacttggcgaggtttttgaggagaagactgatgatcagggagatacagtcaaggtgggtgctacacgaaagcggcggtttgctggagctacaataagtgaacaagatgaagaagggagcgaagcacattcagaaagtgtttcacttggagggcagcgccgtaagaggcggcaaactgctggggcagtgacagatgccccaggagaaagacgttacaatttgagacacagtagagctgcaaatgctggcgctgcaacagcccaagcagacaaaaaaaaatcttcaaaagcaagaaataaacatacagtagaagcttctgctgatgacaccgaaggaacatcaaaggttgttgaggaacctgcccctgagagcaagagggtatctgaatctgcagactacgatgcatcccagttgcatgagttttcccaggttgaagttggtgatgcccatgctgtagacggtgagggtgctggtgaggaagatggtgatattttggatggccaagatgcactgcctgatgtgccaatgacaccttctggaagcgagtttggagcggaacaggaagatgaggacgatgatgattcagagaggcgaaaccaatcaatcagcaagaagctatggtcattcttcactacatgacttgctgaagaggtcgtcatgtaggttatttctagcttttgtggtttcgattcatgataccccattcttggaactgtaggtcgtgtgcttttggtgattatgtactagatctcccacttgattgtgcttctctcccgtgtaattgaaatatatttgtagtggacatagtttgatggcactcacagaagtagctgatgagatgtacaatggcgatgatggtatgccctgtaaggctgtaacaccagtagcttggtttgtaattgttcttttcccccggttcgtgttacttcgttgaccttattccggggaaatattttagtgctgtgatgatggtctaccaaaaaaaaaaaaaaggcccccta

SEQ ID NO: 15532 - DNA, 1992 bp, Zea mays
gggctttcaatttgggctttcccgtagaaaactcagtccacgcttttgggctttccctttgcccctactcgtcttccccaccgaagcagggtgatgcggagggcgtcgccttcgctgtctccggcgaggggcccggcggtcttcgccgccgcggtcgtggtgtttctgccggtcttattccccgggttgttctcccctcttggccacgctttcccttctgtcttctcggagtggaatgcccctaagccaatgcatccttctcttttgaatgaggccttgcgatggacagctacagacggacaaaagaaagatctatggtcacccttgccatatcaggggtggaaaccatgcttaacgccatcagtttctcacaaattacctctggaaccaagtggatacatccaagtatttcttgatggtggattgaaccaacaaagaatggggatatgtgatgccattgcagttgcaaagattcttaatgctactcttgtgatcccacatcttgaagtaaaccctgtttggaaggattcaagctcatttgaagaaatttttgatgtggatcactttatcaactccctaaaagatgaagtttccattatcaaagtgcttccaaaagaattttcttggagcacaagagagtactatggcacaggcatccgtgctacaagaataaaaactgcacctcttcatgcctcagcaaattggtatttggagaatgtcagtcctatcctgcaaagctatgggattgttgcgatcgctcccttttctcaccgccttgcatttgatgatttgcctgtggatcttcaacgcttgcgttgtaaagttaacttccaagctctggtcttccgttctcacattatctcacttggagaaacacttgtgaagcgcttgaggtctccggtccgggttcattccagtaaatctatccatcaagttgtaggagacacaaatcaagctgaaaaatatgcagttttgcatctccgttttgataaggatatggctgcacattctgcatgtgactttggaggtggcagagctgaacagctagctcttgctaagtacaggcaagttatatggcaaggaagggtattaaattcacagctaactgatgaggagcttcggaacacaggacgctgcccattgaccccagaagagattgggctgttactggtagcccttggctttgacaacagaactcgactctatcttgcatctcacaaggtatatggtggagaagccaggatctctagcttgcgcaaactatttccgttgatggaggacaagaggagccttgcatctgaagatgaacttgctaatgttgaagggaaggcttctgttctagcagctcttgactattatatcagcatgcatagcgacattttcatatctgcatctcctggaaacatgcacaatgctttggtggctcaccgaagctatgagaacttgaagaccataaggccaaacatggcactgcttgggcgcacctttgcgaataagagcatggagtggccagagtttcagcaggttgtacaggcaggacacaaaggaagatacgggcaaatccggttgagaaaggcaacgcaatccatctacacttatcctgcacctgactgtatgtgccaaggataggctactggtttcaaaatttcagaaaaccaatcggttctgcagcaaatgaaggtcgaggatcgccgtctcaaatgttgcattgcggttagtacattccagctgccactagatatgcaagtttgatttttttgggacagctgctatgtactggatctcctctctctctctctctctctctctctctctctctctctctctctcttcacaatacagtttggtgcagatgcagtttatagatattctcatattcgtggttgtgacgggtgttaagatatcacacttgccattaacactttgcgctcttcagcttctacatctattttaatgcatcatgtattcttcagtacaaaaaaaaaaaaaaaa

SEQ ID NO: 15533 - DNA, 2217 bp, Zea mays
gcacgagaccattacctagaacatccttataaccctagtgccctcatctgtctaaaaccctagttcggtgaagcactagcctgagcggcggcgcggaccggcgagacgactgaccgaacgagtgcgccagagagctccctgcaaaccttgccgcgcagtaaatggaacgcagacgtgcagacaaggaggaggcagaagagccgctgaggcccgaggaggaagaagatgaggaggacgaagaggaggggtgggacgactggtgctccgacggcgaagatgttggcggtgggctgctgtgtttgttctgtagctcgagtttcgactccgagagctcactcttcgagcactgcgccgccgagcactgctttgatttccacatgattgtgaaggagctggggctggatttctacagctgcatcaagctcatcaactttgtccgctccaaggttgcagagaaaaaatgctggagctgtggccaagcattctcttccaacacagaactctgcagccacttgcacacagtggagaattgcctaattgagggaaaggtgccatgggaggacgatgtgtacttgaaacctttcatggaagatgactcccttttgcacagcttgtcaatcgatgacgatgatgaagatggggactgtggagtgtcaatggaaaagggacaatattcagctgggaatgaggttttagctgaaccatgggggaacaagctgagcagcatatcagaaagaaatgattctgacatcagtgctcaatttcagcaagagtgtactattggtagtacacaaagggaagtcagagagtcccttcatgtggcgattgatggccacctaaaggttgcacgtgctagtgttaattccaaagcaatcaaaactgtggatgataactactttggatcttatagttcatttggtatccacagggagatgctcggtgataaagtcagaacagatgcttacagagatgcaattttaggcaatcctagcctaataagtggagcaactgtactagatgttggttgtggcacaggaattctaagtctttttgcagctagggctggtgcatctagagttgttgctgttgatgggagtgcaaagatggcttctgtggctacccaagttgcaaagaataatggtctgttgtatgatgagaacgtggaagcagaacagaagcaaggcagtgctcaagttataagtgtcgtacatacaaaggctgaagagctaaaccagaaaatacaagtcccacaaaatggctttgatctattagtgagtgaatggatgggatattgcctgctgtacgaatccatgctaagttctgtcatatatgcacgtgatcattttctaaaacctggtggtgctattctcccagatactgcaatgattcttggtgctggcttcgggaaaggtggaactagcttgccattttgggaaaacgtatatggctttgatatgtcatgtattggcaaagaagtaacttcaacttcagctcgatttcctgtagttgatgtactgtcttctcaggatattgtgacagagactgctgtactccattcctttgatcttgcaagtatgaaggaaagtgagatggattttactgcaagctttgagctgatgctcagtgaaagtagtgccactgtgtcaggagtgacctggtgctatggcattgtcttgtggtttgacacggggtttaccgacagattctgcaaggagaagcctgttgtcctctccacctctcccttctctacaccaactcactggtcacagacaatcttcacctttgaagagcccattgcaatggcgaaggaggaatcaaccctgggttcatctgcattggctggcacagatgagtgcccagctacggcgctcaggtctcggatcagcatcgtgagggcatctgagcaccgcagcatagacatatcggttgaaaccacagcaatcagttcagatggccggaagcgcagctggcctgttcagatattcaacttgtgaccaatcattatacctctttgggcttcctaccaccacaagcaattgttactagaatttgtcttggtcgtttaagttttgcacactgaatggagcactttgtgctactgattttttggtaaaacgatgatcgtgagaattagattggaaggctttctggaatggttagggtgtaatgttgtacaataatctaagtcgcattggtttggccctggcccctagggcc

SEQ ID NO: 15534 - DNA, 1430 bp, Zea mays
  misc_feature (2)..(2): n is a, c, g, or t
  misc_feature (1238)..(1238): n is a, c, g, or t
angactacgcccactggcttcccgcgcgcgcgcgcccgctcccgctgccgggcccggtttcagctccatcaggccatcccctctcccgcaatccccctccgccccccaggccccagccgaagcagacccaatgtcctgcggtagaggcagcaccggcgaagtcgaaggaggcaaatcggtcgccgcgatgacgccgtggcacgacagcttggcgccgccgcctcgcgtcctcatttcccaccgcccttctgatgccagcggtcaagggattgttctgtcacttcaacatccaagatcaggagatgaagtagggtatctatttattgatggccaactacaagagatcaactggtttaaggagcgttatggtgcttggttcttgggagattatgtttgtgaagatggtggcctttattattgcacccctgttgatcccatcttcattttcctaccaacttttgaagctgcacgtatgtcgaacgataaggatccaggaaaattcagacaattggatgaaatattgtatgttgagggatatcctggttatcagcagctaatgaatgtagctaaccaccatatggaattggtttgtgaagtaaaagaagtatctaacatgaagttctttaggctggacaactccaaggtcttatcttggttgtgctgcaaggtatacgacctaaaggaggtcttccccaagttgggtaaaaattatgccgcccaaacagaaaaagaaaaattgaaggaggctgtccaaatgatccgtgaatatctgaaggacgaaccatggttagcattactatgcaagaagctgcagctggatatcaatgcgatcactgttgatgcgaccaccaaaactgctgaagcttcggtttatgcggacagttgtccggcacctgccctcccctctgagagtaagactgcgaatggtggtgccaagtcaagcaaagggaggccagcgaagaaagcaaagacagaggtaggatccaagaacatcaaagatatgttccgaagggtcacgaggagtggatcaggatcatgatgccttcctggaactttcgtgtcactggcgcctattttgatgcatttggtccagcattcccttggtgaaaatctatgtatctgagttgctgtgtctaacaacagattgggattatattgtagcgttaattgttgactcaggcagtgaactctgctagtgtacaaccctcccttccgtcccggatgtatttgtaccacangttgcttgtagtgccgtcagacagatgtcggcagtagtctatccaaagtttattaaaaaacatctgttctacattttagactgcactgttcggagagtataagctgctgaagatgacctaagcggcttgtattgcttgagtcgagaccaaatgggagagcatctctgagaaaattctcttttaaaaaaaaaa

SEQ ID NO: 15535 - DNA, 2472 bp, Zea mays
agtgtttcgattaattaaaatgtataaaattatcaaattaacagaagggaatccaactaaccgctgcctcccatcatatcatgaaccgtcaaattgactcctgtctacagtctcctttgattttcttctcgtcacccccttcactttactcttccctcacttctggccgcagctttgagctcagtagcaaacaagaagcagcaagatagtgatcctccatgggaaacaccctcggctttggcgtaggtgtcggcctcggcctcggcctcgccgtcggcgccgctgctctgatccaggttcgaatccacatcggtcttaacaaagtactgccagtgttcttaatttccttccgctttcgcatcgcgccatattgcaataatttacattgaaaagatgattgctaaactcaaaattttatcatgtggcttacgaatttctatattagttgatctgattgagtttccatcgcatccagggttgagatttttaaccctattgatccctatttcagtagtcctttgtatgtgcttgttcagacaccgctggctgcagactgcagtggtgattttaactcaaagtgtcgccgttaaatttagtaaaatgttctgtccttaacatagagctccactagaaagaatgtcatttaattcacagtacttttttttacctttctaaggatgaaaggttatgatttctttgacgttgtcgaatccgtggtagaatgctcgatcaaaggttatgatttctttgaagtagtcgaatcggtgcgtgcaaggttgtcctctaacagattgtgtggatcaactatgcgtgcgtgccttaatttagcctaggaatatttggaatctcagcctttgacgaccttgccgtgccaagatatttttttaacaaaaaaaaaaacgaaaagacgatgccatagtttgttctttcctcgaaagggacagagtagttcttgcaatttgttcacctgaggtcttatctagatattctcgtattcacttcaatccacacgagagtatccaaacaaggcatgaatgttttcggttccttgtgcttgattgggtatttttggcaggcttttggtccgaaaattgacgaggaagtggtggtttctcagtatcaatgcaagtgagacgctgctctttgtttctttgtcagatgattgcaaaaaacatctcgctgccccttcgattcagttttattgtccctgtggccagactcattttttcactctttgttgttcatagcaccgaggacattgacgagttgtctgccgaggagctgcgcgatgcgatgagctatgtgatgcacaatccgatgctgatccaggtgccggtgttaggaacaacgaagacattctggcgattatctgaggaagccactaggatcagcagaaaactttcattgatactgcgcaaccaccactcagcctgcaagtacctcgaagctcctctgcaggcgtccaagctctggattgggagcactgggagtgtcaagctaaggggggtcagtttcactggcagcggtttctttagaattgagcgtgtgagagatgactacaagcacctttccagggtcctggaactgttgattatgatctcaggtggggatatcaacaaattgcctccagactacaaagaattcctctcgctcttgaggaggaagaaccttacaagggatgatgaattcttaattgtaaacaatgctgccctactacccatgaaaaaccggtaatttttttattcagttttatcatctttgactctttattgtttgccaccacacgctcatttggttatttgtgttcacagcactgaggtattcctgatgctacacgatagaattgtcaattttcttggtcagaaaaatcgagcaaagaagaagaaaatactctccaatctcccttacaagaacaactggttggatactgccacggcaaatgcaaagatcaaccagtgggttgtaaatgttcaaaatgagtacaaaaggactacaattgatctactgcggctcaacagaaatgtaagaagccacttgcatcagtacaaccacgaagatgatattgaggaaattctgtattgtgaatggcccatgctgctcattgtcatggagaagatgttgcacacgcggggtgagctccaagacactggcatccataactagttcggctagggttctactgcaaaacagatgaaagatgtattctgcatttccatgggttggtaagctactgttcttcgatcttcattgagaaagtttatcagttcacggtgatgaagtgtaatgctacctgtagttgttttctctggacacgtcaacttgaaggtaaagctggtcagcttttgtaaagcatgttgtaagatatcacattacaagctctaaaattgtgctgcaaaattgaatggtattgagtttgcatgcatcctttaatttctgattcttataaaatccctattgcacgggtaagcaaca

SEQ ID NO: 15536 - DNA, 1350 bp, Zea mays
ttgggtacctcgagggccggccgggaccggatgcggattggagggactaaaaattgactcctttcttcagtctcctttgattttcttctcgtcacccccttcactttactcttccctcacttctggccgcagctttgagctcagtagcaaacaagaagcagcaagatagtgatcctccatgggaaacaccctcggctttggcgtaggtgtcggcctcggcctcggcctcgccgtcggcgccgctgctctgatccagcaccgaggacattgacgagttgtctgccgaggagctgcgcgatgcgatgagctatgtgatgcacaatccgatgctgatccaggtgccggtgttaggaacaacgaagacattctggcgattatctgaggaagccactaggatcagcagaaaactttcattgatactgcgcaaccaccactcagcctgcaagtacctcgaagctcctctgcaggtgtccaatgtctggattgggagcactgggagtgtcaagctaaggggggtcagtttcactggcagcggtttctttagaattgagcgtgtgagagatgactacaagcacctttccagggtcctggaactgttgattatgatctcaggtggggatatcaacaaattgcctccagactacaaagaattcctctcgctcttgaggaggaagaaccttacaagggatgatgaattcttaattgtaaacaatgctgccctactacccatgaaaaaccgcactgaggtattcctgatgctacacgatagaattgtcaattttcttggtcagaaaaatcgagcaaagaagaagaaaatactctccaatctcccttacaagaacaactggttggatactgccacggcaaatgcaaagatcaaccagtgggttgtaaatgttcaaaatgagtacaaaaggactacaattgatctactgcggctcaacagaaatgtaagaagccacttgcatcagtacaaccacgaagatgatattgaggaaattctgtattgtgaatggcccatgctgctcattgtcatggagaagatgttgcacttggaaggtgagctccaagacactggcatccataacaagttcggctagggttctactgcaaaacagatgaaagatgtattctgcatttccatgggttggtaagctactgttcttcgatcttcattgagaaagtttatcagttcacggtgatgaagtgtaatgctacctgtagttgttttctctggacacgtcaacttgaaggtaaagctggtcagcttttgtaaagcatgttgtaagatatcacattacaaactctaaaattgtgctgcaaaattgaatggtattgagtttgcattca

SEQ ID NO: 15537 - DNA, 1539 bp, Zea mays
taccgatctacactatccattagctcagtgaaactaatcgacgcatgatccataaaattaacctaaggtcacaggagtcggcccattcccatccctgacggccggcctcacgcagtcacgcttgcgcggccgcggcgtctcagactcccacctgtgtccaaatttgtaccttcttcatttttttttataaaaaaacgaaaaagatacgtccaaacttcacaacaaaaactgtgtccatccggatctcttcagggacaggaaaatcgcatccacgagacgaggcaacgagccatggagatcggcactgacacgcgccaacaacccctggatctcgccaggtcccgcgtgccagtgcaagttgcgagatcgatggatggatcggagccaacggggcagccggagccggcaccaagtacaatgctatcggccgcgctgcacgcggccgcggtctgccgtcgccatctgccgggctctcttcttaactcgctatcgacaacgcatcgaaaagtcccgcgcgcacactcgcacgcactcgacgctcattcactgagccatttactcagatcaccaactccagatctcaatggcgcactcgcgcagccaccaccacctcctcctgctccccgcgcccatggccacggcgtgcttgctcctcgccaccctcctcgcgctctgcgccgcgccggcgccgacccacggcgcgcgcgtcctcatgccgggcggcgcgggcgcggtgaccaaggcgcagcagggtggcaccggcagcggcagcaacgcgacggcggacgagtacctggcgccgcacaaccaggcgcgcgcggcggtgggcgtggccccgctgcggtggaacgcgggcctggcttcggcggccgcggggacggtggcgcagcagcggcggcagggcgggtgcgcgttcgcggacgtgggggccagcccctacggcgcgaaccaggggtgggcgagctaccgcgcgcgccccgccgaggtggtggcgctgtgggtggcggaggggcggtactacacccacgccaacaacacgtgcgccgcggggcggcagtgcggcacgtacacgcaggtggtgtggcgcaacaccgccgaggtcgggtgcgcgcaggccagctgcgccacgggcgccacgctcacgctctgcctgtacaacccgcacggcaacgtgcagggccagagcccctattagcttgctgaggtcatcaggtcatagcgacggagccccactgtcgccggcggcggcagcggagtacgtaggttcatcactcttctctagttcggtcacggaaaggctgttttgtggtgtgatccggtggtgttcttggtgttgttgagaactgctttggtttggtgtatcagcttttgttgccgggtaaaaacgcctgtgagctgtgatgtgatgcttcatcctcgtggactcttctgtggcctgtggatgcgtgttggctctcttgaatcttgattcatcgcatatagtacttaaactttttagaaaaaatgtatagtacaccacatgggatttgctagaaagag

SEQ ID NO: 15538 - DNA, 2510 bp, Zea mays
gcggccgccgggcggtacccctgagggcgttgaagatcaaggaaggctaaccagggttgcagcgtttcctattgggatagactctgatcgtttcaagcgagcattggagcttccagcagtgaaaaggcacgtcagtgaattgacagaacgttttgccggtcgaaaggtaatgcttggtgttgaccgacttgacatgattaaaggaattccgcaaaagattttggcctttgaaaagtttcttgaggaaaacccagactggaacaacaaagttgttctactgcagattgctgtgccaacaagaactgacgtccctgaatatcaaaagctaacgagccaagtgcatgaaattgttgggcgcataaacggtcgatttggaacgttgactgctgtccctattcatcatctggaccgatctcttgatttccatgccttgtgtgctctttatgcagtcactgatgttgctcttgtaacatcactgagagatgggatgaaccttgtgagctatgaatatgttgcatgccaagggtctaagaaaggagttctgatacttagcgagtttgctggggcagcacaatcacttggagctggtgccattctagtaaacccttggaatattacagaagttgcagactcaatacggcatgctttaacgatgccatccgatgagagagagaaacgacacagacacaactacgcacatgtcacaactcacacggctcaagattgggctgaaacttttgtatttgagctaaatgacacggttgctgaagcactactgaggacaagacaagttcctcctggtcttcctagtcaaatggcaattcagcaatatttgcgctctaaaaatcgtctgctcatattggtattactatatttcttattgcatacttgatagtcatggacattttttttccatcataataactgggtgttctagtcagaaaatgactcacttgcatctggtagcaactctgttctatgtagagtcacttcgaacagttgcttcttttgctcttctgcagctactgtcttcattctggttgttgccttacattttctggtagactagatcatcatggcacatttgtggcatactccagtaaaactttcactttcgaatttccataagaaggctttctggacccatgaactctcaactactctatgagtcacattcgctgttatttgacagtaacaatttcaacaattcttgttatctatacatgaccggatgtagggttttaattcgacattgactgagccagtcgaatcctctgggagaaggggtggtgaccaaatcaaggaaatggaactcaagttgcatcctgacttaaagggtcctctgagagccctctgtgaggatgagcgcactacagttattgttcttagtggcagtgacaggagtgttcttgatgaaaattttggagaatttaaaatgtggttagcggcagagcatgggatgtttttacgcccgacttacggagaatggatgacaacaatgcctgagcatctgaacatggattgggttgacagtgtaaagcatgtttttgaatactttacagaaagaaccccaagatcccatttcgaacatcgtgaaacatcatttgtgtggaactacaagtatgctgatgttgagttcggaaggctacaagcaagagatatgctgcagcacctgtggacaggtccgatctcaaatgcagctgttgatgttgttcaagggagtcgatcagttgaagttcggtctgttggagttaccaagggtgctgcaattgatcgtattttaggggagatagttcacagcgaaaacatgattactccaattgactatgtcctgtgcatagggcatttccttgggaaggatgaggacatctacgtcttctttgatcccgagtacccttctgaatccaaagtaaagccagagggcggctcagcatcacttgaccggaggccgaacgggaggccaccatcgaatggcaggagtaactccaggaacccacagtccaggacacagaaggcgcagcaggctgcatccgagaggtcatcctcatcaagtcacagcagcacgagcagcaaccacgactggcgcgaagggtcctcggtccttgatctcaagggcgagaactacttctcctgcgccgtcgggaggaagcggtccaacgcccgctacctgctgagctcgtcggaggaggttgtctccttcctcaaagagttggcgacagcgacagctggcttccaggccacctgtgctgactacatgcatgttcttggataggcagtaaatagactgaagttgaagcctccgtgctttaccagagacagagagaagaagaatattcattcctcgtatgcgcgacagagctacacccgtagctagtcagcgtgctgtacaatcatgtacaaaatttatgctcgtgataaaactgcgagaggggagctagcaaatgggaaaggataaaggagtttagttgcttctggtacgagacacaatcgcctgattttgagttctcttc

SEQ ID NO: 15539 - DNA, 4989 bp, Zea mays
ctgcagatcaaaagctcacgagccaagtgcatgaaattgttgggcgcataaatggtcgattcggaacgctgactgctgtccctattcatcatttggtagctttcacacctcccatcgctgcctccatatctgtcttaggacctaatttttcttaagtgttatcctacatctgctgctgcgaaggcactagccgtttgtaaggttctattttgtagaactgatactatctgatttgcttttctcagtattacgaataagtataagtatcaatattttaacaccttgcataaaaagagcttcgatgcattttctttacaataattttgaaacggtgtgttccttgcaggaccggtctcttgatttccacgccttatgtgctctttatgcagtcactggtaatcattaaaattctatttatactgacatttgggcagatttttttgcacttcaatatacctgatttacaccagtgttttaatggaatttttcatgcgtatgttaattttcactgtttttgttcagatgttgctcttgtaacatcactgagagatgggatgaaccttgtgagctacgagtatgttgcatgccaagggtctaagaaaggagttctgatacttagtgaggtagctgatcgattatgcatgacttataatcaaggggtggaggatgttttgtttatttacttgtttttgctatcactgcaatttcagtttgctggggcagcacaatcacttggagctggtgccattctagtaaacccttggaatattacagaagttgcagactcaatacggcatgctttaacgatgccatccgatgagagagagaaacgacacagacacaactacgcacatgtcacaactcacacggctcaagattgggctgaaacttttgtattgtgagtttctcatttccatggcccaatatcattcatccggtggaccaagccccttcacttataattttgtttgcaactcaagttttctggtgattatccttttctttttcatgtagtgagctaaatgacacggttgctgaagcactactgaggacaagacaagttcctcctggtcttcctagtcaaatggcaattcagcaatatttgcgctctaaaaatcgtctgctcatattggtattactatatttcttattgcatacttgatagtcatggacatttttttccatcataataactgggtgttctagtcagaaaatgactcacttgtatccggtagcaactctgttctatgtagagtcacttcgaacagttgcttcttttgctcttctgcagctactgtcttcattctggttgttgccttacattttctggtagactagatcatcatggcacatttgtggcatatcaagtctccagtaaatctttcaatttcgaatttccataagaaggctttctggacccatgaactctcaactactctatgagtcacattcgctgttatttgacagtaacaatttcaacaattcttgttatctacatgaccggatgtagggtttcaattcgacattgactgagccagtcgaatcctctgggagaaggggtggtgaccaaatcaaggaaatggaactcaagttgcatcctgacttaaagggtcctctgagagccctctgtgaggatgagcgcactacagttattgttcttagcggcagtgacaggagtgttcttgatgaagtaatactcagagcacatctctgttattttaggtttggttgatattttccattaagaccaatacatctctccatgtgtacagaattttggagaatttaaaatgtggttggcggcagagcatgggatgtttttacgcccgacttacggagaatggatgacaacaatgcctgagcatctgaacatggattgggttgacagcgtaaaggtgtgtctgtttcatgaataatgttctgttgcgtcaaattaatagcaagtttctgatatttttttttctccagcatgtttttgaatactttacagaaagaaccccaagatcccatttcgaacatcgtgaaacatcatttgtgtggaactataagtatgctggtaagtgtttatcttccaaacattctttttaagcaaggtctgtgcagtaacattttatttccaccttctatctcaaagatgttgagttcggaaggctacaagcaagagatatgctgcagctcctctggacaggtccgatctcaaatgcccctcctgatgttgttcaagggagtcgatcagttgaagttcggtctgttggagttaccaaggtaagtggtgctgtatgatggtccatgacagtagatggtttggcctacttgaggttttaaacatcagttgtctccttcctatagggtgctgcaattgatcgtattttaggggagatagttcacagcgaaaacatgattactccaattgactatgtcctgtgcatagggcatttccttgggaaggtaatttccaattcttcacgttattgttctgatctggttttagttctgtggataggatcaagaaacttatgaatgaagaaatggaagggtttagaacattcaaaatgcattgccaaggaaaggagaaggatgtggacttaattagaaaaatcactatggtttactttatatgtttggtctgtccctattcttttcgactttggttctgttttgtaacatctggttcctcgtgtttcaggatgaggacatctacgtcttctttgatcccgagtacccttctgaatccaaagtaaagccagagggcggctcagcatcacttgaccggaggccgaacgggaggccaccatcgaatggcaggagtaactccaggaacccacagtccaggacacagaaggcgcagcaggctgcatccgagaggtcatcctcatcaagtcacagcagcacgagcagcaaccacgactggcgcgaagggtcctcggtccttgatctcaagggcgagaactacttctcctgcgccgtcgggaggaagcggtccaacgcccgctacctgctgagctcgtcggaggaggttgtctccttcctcaaagagttggcgacagcgacagctggcttccaggccacctgtgctgactacatgcatgttcttggataggcagtaaatagactgaagttgaagcctccgtgctttaccagagacagagagaagaagaatattcattcctcgtatgcgcgacagagctacacccgtagctagtcagcgtgctgtacaatcatgtacaaaatttatgctcgtgataaaactgcgagaggggagctagcaaatgggaaaggataaaggagtttagttgcttctggtacgagacacaatcgcctgattttgagttctcttcgatttgttgtcctttaaattgcgcttttgaactggtttgggtgcacctgaaatacgcctgcgctatatatgagaccacatctcatatttttcatcttaacatcatatgacacgccaaatgaatctgcctgcttattactagtttatttagagactgaaatcttgtctagattatgccagataattttgtttaaaaaaaacttttctggatgcatgctcagagaaggtgatgttgaaaggaggtttggagtaacgtcagggtgggcaaggatagattgtaggcccctgacggaatcaacttgcacacgatggatcggagaaagctgccattagcaatataatatactaatgcagctcatgcaagcaataagacatctcaatcatgtggggctgatgcttggattggatggcttcatctctggggctcctcctccccaatcccaaccgaattcctgcattacttggtcagacaagcaaatgcagtttttggcatttcttatgtgctcgcttgcgtcacttgataatctcatcacaaaacaaaacagtatttcgcacgataatattaatatacatggtctttcgagcataacctacgaaaatgaaatggaacgaagaatgttccgtacgccacgtcagcagggcagagggccatagcagccccccagccaacggcacacacaaacgcgggctagattccccggctgccgaggtcggatggaggaggagttccaagaagccgacgtcccccaacccccaaatcagagcaagaacgtgaagaattggacataaaatgctcgagctactcgcccgccccagctgcggaggacggatggaggagttccaagaagccgacgtcctgtggacatggccgatgccggacacgccaacgccgtcgccggaggaggggagctacgacctggcggcagcggcctacgagctgtacgagtacgatgccgccgcagtcatcgacttctcgtgcgacgaaccgttcagcaaaccagtcgcggcgtggagcgcaagctcgacgacgagctcaacgttgagcgccctactgtcgtctgacaacggcggcggcttcttcctctctggcccttccaccgtttctgccaccgggctcgggctcgacgcggcggaggagttcctggaggcggacgtgctgtggccggacccggacacagccgacgacgacacggcggggtttttgtggcgtcgtcgtcgttctcgttcccgtcgtgtagaggaggccgccgcatcggctgcggccgctgtcttctgcggtcaacgagaagggtgcagcgggcctttggtggcgtcgtctccgatcgatatccccatggccgccagaggtgctgctgccgccgcgcgtcgccgtcggccttgacgactcgtcgtcgttgcccgttggtacaacttgtactggcacgcgttgcttgcgggtaatagcttcgctgtctttcgatgatgctgtgtacgtatacgaaatgtttggagagtcagagtgtgccgagatcgggatcggagttcagtaagatttcctctttatttctttaggactgtgtcaagtctgaacacacgtgtttctaagagagcagtcccattcccctcttcatatttaggtgaggtttgatttctagttactaatttttatttcc

SEQ ID NO: 15540 - DNA, 1563 bp, Zea mays
cttcagggctatggttttattgaattcataagccgcgctcccgcgcgtccggttcttcagacttacaacgggacaatgatgccaaatgttgagttgccattccggttgaattgggctagtgctggtgaaaaacgtgatgacacccccgactatacaatatttgttggtgatttggctgctgatgttacagactatgtattacaagagacatttagggcacattacccttctgtgaagggtgcaaaagttgtaacagacaagctgacaatgcgcacaaagggttatggttttgtgaagtttggtgatcctaatgagcaagctcgtgcaatgactgagatgaatggcatgctatgttcttctaggcctatgcgtattgggcctgctgcaaacaagaaagctactgttgttcaggagaaaggataccaacaggctcttcatataggacttgagctgcgatgcgtgtcttgtgtaatgcatgacctctgttagtaccaagtgctcagggagttcagtctgacaatgatcctaacaatacaaccatttttgttggtggtcttgaccccaatgtcactgaagatatgttgaaacaagttttcaccccttatggggacgtagtccatgttaagattcctgttggcaaaagatgtggttttgttcaatatgctaacagatcttcggcagaggaggcattggtaattctgcaaggcaccttggttggagggcagaatgtgaggctttcatggggtcgcagcccttcaaacaaacaagttcagcctcaacaggactccaaccagtgggccggggctaatgctggatattatggctacggtcaaggctatgaggcctatgggtacccccagtctcaggaccctaatatgtataattatggagctggagcttatgctggctatccaaattaccaacaacaaccagtagcacagcaaccgccgcagcaacagtgagaggtccagtgacgctactgtcatttgggtgattgacgtggaaatatttatgagttgtaagatgagcttcggatgcaagctggattaggtatacagacatgattttcgtagtactcagattctgagttgccctcgtatcagagcttgtggtcccaatagcctgcagctgcagctaaaacgatctattttggtagcggaatgttttatctgcttattttgtaccgtgtcttccgctactgcggagccttgataacttgctatgttggatttttcccgagtgttatcgcatgaatgttgtcatttgccttggtgccatggttggtgttggcaaacgagcgagcagaacctgcagatcgagcagtacctgagcaccattttaacatggtttaacctttttagctggctcttgttaggattggtacattttcactgagtagggcacctagccgaaccgctcggttttcggtattggcattttgagaagttcggtcatccgtgtcggctttctgttttgttaggtttgtatcgtagatagtactatacgtagaggtgtttgaaatagtgatgagataagaaatgagataaaagagttgttggatcc

SEQ ID NO: 15541 - DNA, 1791 bp, Zea mays
tagtcggcacgaggcttctccaccgctcttgctcgtccaaccttctccatcgtctcaccttaggtttcgctccccgccgccgccgccatgatgccgcagcagcagcagcccggcatggcccctcctcctccacaggccgcccccggagcgccgccacactggggcggcatcccgccgcctatggcccctcagcatcagtacgcgccaccaccgacccatcaggccccgcccccgccgcagatgtggggccaggcgcccccgcccccgcccccgcctcaggccgcgtacggtcaggcgcccccgccgccccaggccgcgtatggccaggcgctcccaccaccccaggccgcgtacggccaggcgcctcccccgccacaggccgcctactacggggcggtacccgcgcccgcggcggtggccgcggcacctgtcgggcccagcgaggtcaggacgctctggatcggggatctgcagtactggatggacgataactacatctacgggtgcttcgcatccacgggggaggtgcaaaatgtgaagctaattcgtgacaagcatactggacaacttcagggctatggttttattgaattcataagccgcgctgctgctgaaagagttcttcagacttacaacgggacaatgatgccaaatgttgagttgccattccggttgaattgggctagtgctggtgaaaaacgtgatgacacccccgactatacaatatttgttggtgatttggctgctgatgttacagactatgtattacaagagacatttagggcacattacccttctgtgaagggtgcaaaagttgtaacagacaagctgacaatgcgcacaaagggttatggttttgtgaagtttggtgatcctaatgagcaagctcgtgcaatgactgagatgaatggcatgctatgttcttctaggcctatgcgtattgggcctgctgcaaacaagaaagctactgttgttcaggagaaagtaccaagtgctcagggagttcagtctgacaatgatcctaacaatacaaccatttttgttggtggtcttgaccccaatgtcactgaagatatgttgaaacaagttttcaccccttatggggacgtagtccatgttaagattcctgttggcaaaagatgtggttttgttcaatatgctaacagatcttcggcagaggaggcattggtaattctgcaaggcaccttggttggagggcagaatgtgaggctttcatggggtcgcagcccttcaaacaaacaagttcagcctcaacaggactccaaccagtgggccggggctaatgctggatattatggctacggtcaaggctatgaggcctatgggtacccccagtctcaggaccctaatatgtataattatggagctggagcttatgctggctatccaaattaccaacaacaaccagtagcacagcaaccgccgcagcaacagtgagaggtccagtgacgctactgtcatttgggtgattgacgtggaaatatttatgagttgtaagatgagcttcggatgcaagctggattaggtatacagacatgattttcgtagtactcagattctgagttgccctcgtatcagagcttgtggtcccaatagcctgcagctgcagctaaaacgatctattttggtagcggaatgttttatctgcttattttgtaccgtgtcttccgctactgcggcggagccttgataccttgctatgttggatttttcccgagtgttatcgcatgaatgttgtcatttcccttggggcccaaaaaaaaaaaaaaa

SEQ ID NO: 15542 - DNA, 1026 bp, Zea mays
gcacgagaccattacctagaacatcctaatcgaaaatgctcaaccgctacatgcacctctcgggccgcttccacatgcgcgaggtggagcgcaccgtgcagcgcctcatccgcgacggggtgatagtgcacgcgccggcgagcccgttccacggcttcgtctacgtcgccttccaggagcgcgccaccgccatcgcgcacggcaacacggcgcgcctcgtgggcgcgcgcggggccggggacgccgctctcgcgcgcatctgcggcaccgtcgccgccgacgagaagcggcacgaggcggcgtacacccgcgtcgtgggcaagttcttcgaggccgacccggacgccgccgtgcgcgccatggcgtacatgatgcggcgccggatcgacatgcccactgtgctcatcaacgacggccgccacagcagcggcgacttctacgctcgcttcgtcgccatcgcgcagcaggccggcacgtacacggtttccgactaccgcgccattctcgagcacttcatacggcagtggggcgtcgaggaacttgcggcggggctcaccggcgaggggaggcgcgcgcgggactacctgtgcgcgctgccgcacaagataaagaggatggaagagaaggcccacgatagagcggtcaaagcacaaaagaaacccacacccatccccatcaactggatcttcgataggaccattcctgtcattctaccttagtgtttatctttttcgatctttgtttgggtatctatgctgttattgtaagctaattccatggaccttgatagcgtcgttcatgcctacgtgtcgatagcatcattagtgtcgttctacccttaatcctgttatgccacgttaggtaccatttttttccataagagaatatttacaaatttataatttgttggatcgaggtgatacagggaactaaaaaaaaaaaaaaaatctgcattacggtcttacgagctttttacatggttgagacacactaataatatttaatttatagacaaaatctttatta

SEQ ID NO: 15543 - DNA, 1789 bp, Zea mays
cccccagatgcaaatgcctactgagaaaaataaccgaaagaaacgttgggagctgtacctagttaaatttgcaagctagacaatcaaatgaaaggattctgtcaggtcggttacgcaggaagacacttcgttggcagttcagtacttcagtaacagatacttgcaacaagaaaacatacgggatttttcaagcccgaaggctgatcgtatatggagtgcagtcggtctatgaattcaatatgcacgactactcgtttcataagacatggagtacaagtaagggttctcatgctattaaatcaagcattcattttgaagcagttcaaatcatgtgaggcaaggactgctggtcctgcgtggtacatctcagcacctctaattaaatgaatgctaccgtaaatcttcaaaaatgttatataagattgcagcatccaaacctaaaatgtcctgtaaatgtccaacaatttgacaggtacacatctacctaaagagtgcagtacaatgcaatttccaaaccttaatttcagcggaagaaacaaaaaaaaaaaggactggggcccaacaggcaggaccgaaaaccaaaccgagatctcttctggagttttctggtaccagaactggcaacctaatatagtttcaggaatagaaagaagatgagatttgactacaatagattatcttatcagatccagcttttcctcgcccgcctctataccacattaccactgatgggcaaccacaacggtgaacaccctaaggccctacttatgtttccaaaaaatacttcaagcattaacagcgaatgcaataaaggggatcctttgcttgtaaacatcctttgcttaatcctaacactcagcttcacaagtttaggccagaaatgatcacctccattattaatcaacctcgctagtctgccgaacagccgagctggtctcccagtgtcccactttacctgtagcactcaaaatttgacaatcatacatctaacccaaagaattttactcaggaagccttgtttgggtacaacacataagaaaggataccttttatgtgtgactacacttccataacaatctggcacatgaagatcagcaagcagatagtgcactccacaatgcatcattaggaggctggctgataaaaccccgatcaaccatcagttcaacaagctcttcgtgcttcttgagctgcccagcctttctcaaaaggaccaataccatatcgcgcacctgctttgaaggtttaaaagatttctcctcgatcatttcctttagtgttgtgtgtgctcgcttccagtttcccctcccacagaatgcctcaatcagagccgcataggtgtgcatgtttggctcgattccttccgcatccatgtccttcttcatccttagaaccatatccattgacttctccttattgaacaaccttagaaggcagttatatgtcacgacatttggcttgcattgaagctccctcattttctcatacaacttatgtgcagcacctatgttgccaagcacaagtaacagcctgaacatgggattgaacgtgtggcagtcaggaacacacttttttgccgtcattttgtcaagcaccttcagcgctgcatcaagattgccctgccccttcccacaatgtgtttcgatcaagaaattgtatgtgataacgtctggctcacaccgaagctgctgcatctggttatgcacctgcagcacctgctcagaacggccggccttgacatgcgaccgcatgatagcgttgaacgtcgtcgtgtttggggggcacccag

SEQ ID NO: 15544 - DNA, 1850 bp, Zea mays
  misc_feature (24)..(24): n is a, c, g, or t
  misc_feature (1797)..(1797): n is a, c, g, or t
ttgggaccctcgaggccggccggngaacagatgcagtgtttatcaagtcagatgtaattttccaatgacggtgtcagaaaaggacattgctttgcactaacaaatatcgttacggcaataatgaaatgggagccttgcagcttgcgccaccagagagctactaaacacaattcgatcgagagcgcgcgcgagagagagagagagagagagagagagcagggctgaagaagttggaggaatcgctgccagtggaaagcggcagcagcagaagcaagaaccagcaagaaagagggagagagaaagccgaaggacttttcctcggattgcatccttcgcttttgagggaaggagaaggaccctctctgtcctcgcggggggcggcaggaggagcagatgttcccgcctggcctgatccaccaccgccctgacgccaccgctcccggcgatgggccaccgcgctccggccccggtgggccgagccttgtactgacggcggaccccaagcccaggctacggtggacggccgacctccacgagcgtttcgtcgacgccgtggcccagctcggcggacccgagaaagcaacaccaaaaactatcttaaggacgatgggtgtcaagggtcttactcttttccacttgaagagtcatcttcagaaatataggttaggtaaacaatctggtaaagaggggtcagagcaatctaaagatgcttcctatcttctagatgctcaaagtggaatgagtgtgtcccctagagttgctgcccaggatatgaaagagtatggttcatcagatgtttcttgtccagcatattattcttctttttaggcagactgagtactcttagcatatttgctgtgattgtgctatttgaaagagataatgtcatgatacttgctgcagaagccaagaagttaaagaagcactgagagcgcagatggaagtgcaacgaaggctgcatgaacaagtggaggtccaaaagcgcgtgcagatcagaatggaagcacttgagaagtacatcgacagtatcctagagagcgcatgcaagatggttactgaacaatttgcttcgagtggcttcagtatctccaaccctgatctcccggagatatcccctggaggggtcatgtgtggctccacggacacgttgggctcgtcggtgttgaaccagctttctgtgagctccatcgactcgcacagtccaggaggcaaaccttctccatcaggcatggaaggtccgacactgctccagaagtcgcctgagctcaagcggaggtcctcttgaactgtgacagcgaattctgaggttggcggtgatggctgtctctgtggagtgtctgaatatggtggtgacaatggaaatggtggcccagtcttgtggtagctgactttctctccaggtagcaggacgtgctgtgtttgttgatcaatccaagtatcaaacggacctactatgttcatgtgaacttcctcaagtgctagttaaaaagttttcatgcttctgtcatgagattatgatcctagtagcatccttagcacacttgaaacgttgactcgtgtcctagtgtcgtttgtgttagtccatatgtgaacaatgattcatgttggaacatgctagctaacaccagatgattcaagcttcgtatttttgtcccaaaaaaaaaaaaaaaattcccagcacttgctgcaatttattcccagcacttcctgcaatttattcgacttaaaggctactgtatttagctatgaaaggtccatgctgactttgtaatacacaaatggctagttgcaacttanaaaaaaaaaacaaaaaaaaaaaaccataaaatactaaattagcgttacaagat

SEQ ID NO: 15545 - DNA, 1572 bp, Zea mays
ctcgaggccggccggggcagcttcagccaccaagagaccagggctgaactgctgaagctgagataggattgagaatcgctgccagtggaaagcggcactagcagcagggcagaagcaagaaccagcaagaaaggggagagagaaagcggaaggactttttctcggattggatccttcgcttttgggggaaggagaaggcccctctctgtcctctctccatccttgcggagggcgctagcaggagcagcggaaggaggaagagatgttcccgcctggcctgatccaccaccgccctgacgcccccgttcccggcgatggggcgacacgctccggccccggcgggccgagccttgtactgacggcggaccccaagcccaggctgcggtggacggccgacctccacgagcgtttcgtcgacgccgtggcccagctcggcggacccgagaaagcaacaccaaaaactatcttaaggacaatgggcgtcaagggtcttactctttttcacttgaagagccatcttcagaaatacagattagggaaacaatctggtaaggagggatcagagcaatctaaagatgcatcctatcttctagatgctcaaagtggaatgagcgtgtcccctagagttcctgcccaggatatgaaagaaagccaagaagttaaagaagcactgagagcgcagatggaagtccaaagaagactgcatgaacaagtggaggtccaaaagcgcgtgcagatcagaatggaagcgtttcagaagtacatcgacagtatcctggagagcgcgtgcaagatggtcaccgaacagttcgcttcaagtggcttcagcatctctgaccctgatctcccggagatatcccctggaggggtggtcatgtgtggcggccccacggacacgttgagctcgtcggtgttcaaccagctttccgtcagctccatcggctcgcacagtccaggaggcaaaccttccccttccccatcaggcatggaatgtccgccgctgctcctccacaagtcgcatgagctcaagcggaggtcctcttgaactgacaaatcggcgaagcctgagggcgcggtgatggctgtctttgctagtgttgtcggatatggtggtactggtggtgacaagggaaattggtggtccagtcttgtggtagctgactttctccaggtagcaagatattgctgtgtttgtttgatcagtcaaagcatcaaacagacagacctacgttcatgtgaactgcctcatgcatgtgctagattgaaaaaaaaagttatcatattttgtcatgagattatgattctactagctagcatccttagcacacttgagatgttgttgactcgtgtcctagtgtcctctgtgttgatccatgtatgcacagcgattcatgttgggagttgggactgggacatgttaacaccagatgtttcaagcttcgtactttgcctcagttgtccatgcatgcagcaggcatcccagtacttcacctgctgttgaacttgaagactagtgtattcagcttatgaaagattcatgctgagtttgtacccccaaaaaaaaaaaaaaaa

SEQ ID NO: 15546 - DNA, 1575 bp, Zea mays
  misc_feature (1522)..(1522): n is a, c, g, or t
tactaaacacaattcgatcgagagcgagcgagcgagagagagagagagagagagagagagagagagcagggctgaagaagttggaggaatcgctgccagtggaaagcggcagcagcagaagcaagaaccagcaagaaaggggagagagaaagccgaaggacttttcctcggattgcatccttcgcttttgagggaaggagaaggaccctctctgtcctcgcggggggcggcaggaggagcagatgttcccgcctggcctgatccaccaccgccctgacgccaccgctcccggcgatgggccaccgcgctccggccccggtgggccgagccttgtactgacggcggaccccaagcccaggctacggtggacggccgacctccacgagcgtttcgtcgacgccgtggcccagctcggcggacccgagaaagcaacaccaaaaactatcttaaggacgatgggtgtcaagggtcttactcttttccacttgaagagtcatcttcagaaatataggttaggtaaacaatctggtaaagaggggtcagagcaatctaaagatgcttcctatcttctagatgctcaaagtggaatgagtgtgtcccctagagttgctgcccaggatatgaaagaaagccaagaagttaaagaagctctgagagcgcagatggaagtgcaacgaaggctgcatgaacaagtggaggtccaaaagcgcgtgcagatcagaatggaagcacttgagaagtacatcgacagtatcctagagagcgcatgcaagatggttactgaacaatttgcttcgagtggcttcagtatctccaaccctgatctcccggagatatcccctggaggggtcatgtgtggctccacggacacgttgggctcgtcggtgttgaaccagctttctgtgagctccatcgactcgcacagtccaggaggcaaaccttctccatcaggcatggaaggtccgacactgctccagaaatcgcctgagctcaagcggaggtcctcttgaactgtgacatcgaattctgaggttggtgatgatggctgtctctgtggagtgtctgaatatggtggtgacaagggaaatggtggcccagtcttgtggtagctgactctctctccaggtagcaggacgtgctgtgtttgttgatcaatccaagtatcaaacggacctactatgttcatgtgaacttcctcaagtgctagttaaaaagttttcatgcttctgtcatgagattatgatcctagtagcatccttagcacacttgaaacgttgactcgtgtcctagtgtcgtttgtgttagtccatatgtgaacaatgattcatgttggaacatgctagctaacaccagatgattcaagcttcgtatttttgtcccaattgtccatgcaggcttcccagcacttgctgcaatttattcccagcacttcctgcaatttattcgacttaaaggctactgtatttagctatgaaaggtccatgctgactttgtaatacacaaatggctagttgcaacttanaaaaaaaaaacaaaaaaaaaaaaccataaaatactaaattagcgttacaagat

SEQ ID NO: 15547 - DNA, 1226 bp, Zea mays
ccagcagccgcaccagctcgcaccctcccacttttcgaagtagcagcccggaactccggatccaccgctaccgccgccgcgtctaaaccctccaccgccgcggtgcgtcagaggcagaggcagagaggcagaggcagaggcagccatggggagccgcctcgggcgccgcgtgatccactttgccaacctcccgctgaaggtcatgctgccccccgcgccgctctcctccgtgcaggagttcgccgtgcggaccgtcccctccgcttccaaggtggacatccggcgctgcctcgagtccatgtacggtttttccgtcgccgaggtccgcacgcttaacatggagggcaagaagctccgccggggcccctttctctccgccaagcccgactacaagaaggcctacgtcacgctccgcgccccgctcgcggtctcgcgcgacctgttccccatcggggccatcctcgcggagcgggagcggaaagccagcgcagccgctgcgaggaggaaggcggtggagggcgccgaggtggagggggagagcaaggggaagcactggatggaggacgagagggagggcttctccagggctggctgcgggaaggtcgtgtatgggaaccctgggaggctggggaggaagaggaggggaggggataaggtgaaggagcaagctggggacgaggcggccaagttcccgtggtccgggatgcgcctggctaccgagaaaccgaggagggtgagacgctctccatcgaagaagggaatagtcctgaagcaaaaatcacggaaggtatccctgcagcaccgctcaaagaagttgaaagcttgatagtacttgacttgagctgctgtaccgaaccactggaggatcctgccatcgagcgtggatgcaggccgtggacccataagttcgctggcggacctgccttgtttttaaattaccaaataaacaccgaacgttgaaggacttgtaaggattttgtgcctttgatatgggatttagaaggctgcatcgggcatgtgtgctggaggaccagacctggaagggttcatgggcgttccctatcctatactgtcccttcgtttgatatgagaattgagatttgtttagtaattaactgactactagcattgctgattagagatcatgtactgttatttttcaaaaaaaaaaaaaaaataatgtttacctgctccgatgatcctttatagcaaaaaaaaaaaaaaaa

SEQ ID NO: 15548 - DNA, 1126 bp, Zea mays
  misc_feature (523)..(523): n is a, c, g, or t
cgggagcagcccggaactccggatccccactaccgccgtcgcgtctaaaccctccactcgccggggcgtgagaggcagaggcagagaggcagaggccgaggcagaggcagccatggggagccgcctcgggcgccgcgtgatccactttgccaacctcccgctgaaggtcatgctgccccccgcgccgctctcctccgtgcaggagttcgccgtgcggaccgtcccgtgggggtgggggtggacatccggcgctgcctcgagtccatgtacggtggttgcgtcgccgaggtccgcacgcttaacatggaggggcaagaagctccgccggggcccctttctctccgccaagcccgactacaagaaggcctacgtcacgctccgcgccccgctcgcggtctcgcgcgacctgttccccatcggggccatcctcgcggagcgggagcggaaagccagcgcagccgctgcgaggaggaaggcggtggagggcgccgaggtggagggggagagcaaggggaagcactgngatggaggacgagagggagggcttctccagggctggctgcgggaaggtcgtgtatgggaaccctgggaggctggggaggaagaggaggggaggggataaggtgaaggagcaagctggggacgaggcggccaagttcccgtggtccgggatgcgcctggctaccgagaaacggaggagggtgagacgctctccatcgaagaagggaatagtcctgaagcaaaaatcacggaaggtatccctgcagcaccgctcaaagaagttgaaagcttgatagtacttgacttgagctgctgcaccgaaccactggaggatcctgacatcgagcagggatgcaggcagtggatccatgagttcgctggcggacctgccttgtttttaaattaccaaataaacaccgaacgttgaagaatttgtaagaattttgtgcctttgatatgggatttagaaggctgcatcgggcatgtgtgctggaggaccagacctggaagggttcatgggcgtttcctatactgtcccttcgtttgaattgagtgtgcactttgcggtccgagttccattcgagaattgagatttgtttagtaaaaaaaaaaggtaaaaaaaact

SEQ ID NO: 15549 - DNA, 1162 bp, Zea mays
ccacgcgtccgaccattcccttctccctttcctcttctccacgcttcgcccctcgccgactattttaaacccacgcttcttttagttctttcttccccgtcggcttccggagtggaaaccattttcctaccacccgcgggagatccacacgcccacgagcagtggagctcggcagcgaggcttcggagttctgccattaatgcagctcatgtggaagcttcaagtgctgaaaagggaataggtttagtgaagcttatgggtcgctatagtggatttattgccatgtatgctactcttgcaagcagagatgtggactgctgcttgattcctgagtcacccttttatttggaaggggagggtggactatttgagtatatagataggaggttgaaggagaacaatcacatggttattgttgtcgcggagggagcaggacaggatcttattgctcaaagtatacctgctgcagatcagcaagatgcatctggaaataagctgcttcttgatgttggtctctggttgactcacaagattaaggattattgcaagagcaagaagatggagatgactattaaatacatagatccaacttacatgatccgtgctattccaagcaatgcatcagacaatgtctattgcaccctgctcgcacatagtgccattcatggtgcaatggcgggatacagctttacagtcggaatggttaatggcaggcatgcatatataccatttcatagggtaacatctacaaggaacaaggtgaggataactgacaggatgtgggcgaggctgctgtcttcaacaaaccaaccgagtttcctgagccagaaggacatcgacgcggccagagaagccgacaaggcggccaaccgcacgaagagcagagaggatgcgaagaagcaatctacaccagtgttggcaaatggtgagaaatagtgtgcttttgacagttctttgttgtatgcagtagctgctgcaagctggctgagatcagtaggccaaaactgcgaggtcgatgagttttacttccatttgcatccgaacagaattcacgtaataaaagcttcatagtgtgtatttgcgttagtaaacaaaaaaaggtgcgctccaaattgctcgtgttggtcgtaaaaaaaaaaaaaaaaaaaaaaaaaaaaaaaaa

SEQ ID NO: 15550 - DNA, 2085 bp, Zea mays
aggccggccgggccgggagatctccagaccattcccttctccctttcctcttctccacgcttcgcccctcgccgactattttaaacccacgcttcttttagttcttccccgtcggcttccggagtggaaaccattttcctaccacccgcgggaggcgggagatccacacgcccacgagcagtggtgcttggcagcgaggcttcggagttctgccatggcgtcgtcccacatcatcctgcccaaggaggaggaggaggaggcggcggcagcggtggcggaggccgggttgggagcggcggtggaggcggaccacgaccaccggccgtaccaggagcaggcgcccgggaaggcggcgctgccgttctcggcaacgtgcgtccggatctcccgcgactcgtacccgaacctccgcgcgctgcggaacgcgtcgaccatgacactccacgatgatgacgccgccttcgtcaagctcgaggagggcgactacggatacgtgctcgacgacgtcccgcacctcaccgactacctcccggacctccccacttttcctaatcctctgcaagatcatccggcgtattcaactgtcaagcaatattttgtcaatgcagatgatacagtccctgaaaaggtagttgttcagaagaacagtccacgaggagttcacttccgtcgtgctggacctcgtcagagggtgtattttgagtcagaagaagcgaaagcttgcattgtaacctgtggaggcctttgccctgggctcaatactgtcatcagagagttggtttgtggcttgtcccacatgtacaacgttagcaatgtcttcggaatacagaatgggtacaaggggttctattcgagcaattatcttcccatgacaccaaagagtgtgaatgatatccacaaacgaggtggtacagttcttggaacatcacgaggtggccatgataccaaaaagatcgttgacaacattcaagatcgtggaattaatcaggtgttcattataggaggagatggaactcagaagggtgcatatgagatttacaaggaaatccggagacgtggtctacaagtagctgttgctggtattcccaagactattgataatgatatagcggttatagacaagtcatttggttttgatactgctgtagaagaagcccagcgtgccattaatgcagctcatgtggaagcttcaagtgctgaaaatggaataggtttagtgaagcttatgggtcgctatagtggatttattgccatgtatgctactcttgcaagcagagatgtggactgctgtttgattcctgagtcacccttttatttggaaggggagggtggactatttgagtatatagataggaggttgaaggagaacaatcacatggttattgttgtcgcggagggagcaggacaggatcttattgctcaaagtatacctgctgcagatcagcaagatgcatctggaaataagctgcttcttgatgttggtctctggttgactcacaagattaaggattattgcaagagcaagaagatggagatgactattaaatacatagatcccacttacatgatccgtgctattccaagcaatgcatcagacaatgtctattgcaccctgctcgcacatagtgccattcatggtgcaatggcgggatacagctttacagtcggaatggttaatggcaggcatgcatatataccatttcatagggtaacatctacaaggaacaaggtgaggataactgacaggatgtgggcgaggctgctgtcttcaaccaaccaaccgagtttcctgagccagaaggacatcgacgcggccagagaagccgacaaggcggccaaccgcacgaagagcagagaggacgcgaagaagcaatctacaccagtgttggcaaatggtgagaaatagtgtgcttttgacggttctttgttgtatgcagtagctgctgcaagctggctgagatcagtaggccaaaactgcgaggtcgatgagttttacttccatttgcatccgaacagaattcacgtaataaaagcttcatagtgtgttttgccgttagtaaacaaaagaaaaaaaaaaaaaaaaaa

SEQ ID NO: 15551 - DNA, 764 bp, Zea mays
cagtcaaccccataaacggccccccggggaagaaatcacgggcagacatcatcagcaacgccggccggcgtcaccgccaccctcccctctcgcggaccaccggaaaccatcacatcaaaccggaaaccacccttccctccagaactccagaccattcccttctccctttcctcttctccacgcttcgcccctcgccgactattttaaacccacgcttcttttagttctttcttccccgtcggcttccggagtggaaaccattttcctaccacccgcgggagatccacacgcccacgagcagtggagctcggcagcgaggcttcggagttctgccatggcgtcgtcccacatcatcctgcccaaggaggaggaggaggaggcggctgcggcagcggtggcggaggtcgggttgggagcggcggtggaggcggaccacgaccaccggccgtaccaggagcaggggcccgggaaggcggcgctgccgttctcggcaacgtgcgtccggatctcccgcgactcgtacccgaacctccgcgcgctgcggaacgcgtcgaccatgacactccacgatgatgacgccgccttcgtcaagctcgaggagggcgactacggatacgtgctcgacgacgtcccgcacctcaccgactacctcccggacctccccacttttcctaatcctctgcaagatcatcctgcgtattcaactgtcaagcaatattttgtcaatgcagatgatacagtccctgaaaagggtagttgttcag

SEQ ID NO: 15552 - DNA, 3833 bp, Zea mays
tcggaatggttaatggcaggcatgcatatataccatttcatgtgagtacaactttcgctgcatacctttcatacagggataatattagtatgctccttggtgccatctttttcattctctgaacatgcaagagagtttatatcatttcattaacatcctgtttggatccttggaattgaattccattataatagtagtaatttaggcaaagatcaattaagataatatggttttatgtgaaatgtatttgtatactattattagcaatataagttgtagagtaaaaacatatttcactgatacataaaatcattttttatcctccacccccatgaatttaagatagtcttatatgtgaactttggaaagtggtggaatgtcaattcccaatccaaatagactattttgttaagtaaatttcagttcctccaacatgaatggatccaaacggctcattagctgaagatgcctaaactttttggtacattttgacacaaccttagtcgctgtatacccaaaaagaaatgaattcaactcaatgtagtgctgaggaagtctttgtgctcgacagaacacgcacataaggagtctacactaacctgtagcaatcaagcaccttggtacacattgaagttttaactaaaatttcttttgtatatttgcttccaagagagttcatgtgtcttccggcaggaaagttgagaggaaattcatgattagtatttccgtatgggacaactacaaaaattttcaggtctccctgtattttactcttgcaatcctctcgtccatgcctacctaccacctctccatcttccctctagcggcttgggcaaggaaacgtattggcaagatccgtcgctccttcttttggaaaggcaaagcggaaacaaatggtggccactgccttataagctggccgctgattagcaagccgaaagacctaggtgggctgggagtcattaatatcgaaagattcggtcgtgacctccgccttcgctggctatggcgagcttggggggatgaggaacatccgtggctacgccaggacactccctgtgatcgcacagacagatcgttcttttgcacctccacccaggtctcgttgcgcgatggtagaaaagcgaagttgtggcacgacagctggcttgatgggatggccccgaggaaccttgcgccacacctaacatgtcgccaggaaaaataaatcagctgctagtgaactactcagagacagatggataagctcggtgaggaacaaaattacaactacagagattgtggagttcgtctcgctctggactagaatccaggatgtgcacctactgccaggagttcccgacacaattacttggaagtggaccccagatggcgtttttgttagattctatggtgcctacagagggcaccttttgggatccttcagacaccttaaggttgacctcatttggagagcccgcacggaactcaaatacaagatcttcgcatggattctacttcaaaataaaatcctcatagcaggcaatctcgctgctcgaggttggcctcaccaacaggcgtgcaccctttggtctggcccgctggaaacaggactccacctatgtttgcactgcccgtttgcccaagaggtttggaatcaggtgttggcgcaggaaaacttgaccctacccccaagccgacttcagccttttccctaacattgcatatttgcatattggtggaagtttgcggctgcctcattcccaaagaaccttaggtgtggcttcaatggtgtgtgcatcttcatcatatagaacatttggaaggaacggaaccgtagaattttcgaggggcactcatatagaacatggctcaggtggcagccatgtctagagatgccattgcttgtttcaggagagcattatcactttcgctttaagttgtggtttatgtgatggtgttgtaggggtgtgttccttgcccagggctgtgtgagcctgtggtgagcggggaagttgggttcccgctgttcaaacctgtactttgtactgctttctctcttaattgattggcagagctcctgccttttcgttaaaaaaaatacatgacaatttattgtgacaagggcggacgcgtgggttaatggcaggcatgcatatataccatttcatagggtaacatctacaaggaacaaggtgaggataactgacaggatgtgggcgaggctgctgtcttcaaccaaccaaccgagtttcctgagccagaaggacatcgacgcggccagagaagccgacaaggcggccaaccgcatgaagagcagagaggacgcgaagaagcaatctacaccagtgttggcaaatggtgagaaatagtgtgcttttgacggttctttgttgtatgcagtagctgctgcaagctggctgagatcagtaggccaaaactgcgaggtcgatgagttttacttccatttgcatccgaacagaattcacgtaataaaagcttcatagtgtgtatttgcgttagtaaacatatactggtgcgctgcaaacatatactggtgcgctgcaatttgctcgtgttggtcgtatgtgccggactcccggtctccatccgctgccgttgcggtttatctgaagcaaggcagtggccacagcagatagatactctggtggtgtgggcggcagctcttgtactaggaagtttcatgtgaccgtgtaccgtgcatggaccatgatcttctttgttcatgttggcctcgagacatcggtgcttgcgtttggtcagcaggtttccatgctcggttcttccatgatgcctgatatggccctacgtttttgcatgggtagaaggcaccgacggcgtcgaagcgcaactcgccgcgccgatactcccacagcagccggcaaccgatggtcctgtgccacaacctgcaagacccgacgtcaacaacgcgacggcacctgatgcaggtgatcaggaggaagcacgaaccacggggaccgacgttgcaggcggaaccctgacgcaggcggaggtgaagccgacacccggaacaaacgtctcgtggcccacgacaccacctgatacgccagagcgcgacgtggcgccggcgcctcgaaccgagcacgcacaggcgaccgagatggaactggacgtcgacaccgcgaggcccgaaggctgcaccacgccgccgccggtgcaggactcggaggggtccgacacgcagagcgccgactgccgcgggagccccatgcatgggatgcaggcaggcgcgagcgtgaagcgggacgatgtggccgcctccaagtcgaggctgttcgcgttccggtccttcacgcgggacaagaagaaggtgatcaagcccgccggggccgcagacacggcatctccagatagtcgcaagacggaggaggcggccgcggagaacaaggagaggcggaagagattctggaagcgatgatggatggggtgtgtgctagtttttgccatgcacgtcacacagcggtgactgcagagttgtttagcaccatgtgtgtaataagtatcatgacaaggtatatataacatgaatttatcgctggttctcttttcgtgtaatattttgtcaacagatgaaaagttacgagcacgacgctggaggaggtgtacctagctaggaggctaggaccaccaccctggctagggaaacaatgtacccacaagcttagaaacatcaaacatttggacgaaatagaagtgcgatccgttgttgccgagttcaggggcagaaatgaagcaagtctagaaacaaaaattcagtgccggagctaaactctatttaatttctacgttcttagagcaactccaacagaaga

SEQ ID NO: 15553 - DNA, 598 bp, Zea mays
tcctatcatcacaaaactcatgatgctccggctgctcagttccctcctccttgtggccgttgcctcaggctatggcccaccttcctctcgcccttccagccgcgttgtccatggtgaggatgcggtcccctacagctggccctggcaggtttccctgcagtatgagaaaagtggaagcttctaccacacgtgtggcggtagcctcatcgcccccgattgggttgtgactgccggccactgcatctcgagggatctgacctaccaggtggtgttgggtgagtacaaccttgctgtgaaggagggccccgagcaggtgatccccatcaactctgaggagctgtttgtgcatccactctggaaccgctcgtgtgtggcctgtggcaatgacatcgccctcatcaagctctcacgcagcgcccagctgggagatgccgtccagctcgcctcactccctcccgctggtgacatccttcccaacaagacaccctgctacatcaccggctggggccgtctctataccaatgggccactcccagacaagctgcagcaggcccggctgcccgtggtggactataagcacggcgccaggtggaactgg

SEQ ID NO: 15554 - DNA, 797 bp, Zea mays
tcgggagctcgccttgtgtcggtacccggggttcccccttccggccggggaccaccattccgagcacactagtcttccctgcgcttgctcgctccttcttgccccccatggcgctgctcgccgtccagggcatggccatgtccaccgccgccgcggccctcccatctcacaaccacggcgccgtctcatcctacgtctccacctcctcctacgcgcttgcagcctccccccgcgcccgagctgcgttcgccgtcggcaccgtcttgtcggccaccgtcactccagttcttgacgtctactgcgggagaggggacaagaaaacgaaaaggggcaaaaggttcaaccattcatatggcaatgcgaggccgcgcaacaagaagaagggaactgggcctgcgcggctctttgctcctccagctcctccaaggaaggatcagttcgatgatggggagatcatttcaatcgagattgacgaggacatcctggaataggttgtccgagttctgccttgctttatatttgccctgagcttaattggcctagtttgtaccaaatcaaatactacatattttaagtaattatttcctcgcctataattatcgatgggtaggctgccacactttcatttggctagtaatgttcctactactgactgggttcttcgttttcctttccagctgcgcggccctttactctcttcaaaatgaaactgtctaaataaggcattttcatttgtaaggggattaagggtgattaaatcactttctattgaaaaaaaaaaaaaaaaaaggccccta

SEQ ID NO: 15555 - DNA, 816 bp, Zea mays
cattggcctacctgtggcccgcggaccaccggtccgggagtacccccgttccgagcacactagtcttccctgcgcttgctcgctccttcttgcccccatggcgctgctcgccgtccagggcatggccatgtccaccgccgccgcggccctcccatctcacaaccacggcgccgtctcatcctacgtctccacctcctcctacgcgctcgcagcctccgccgccttcccccgcgcccgagctgcgttcgccgtcggcgccgtcttgtcggccaccgtcactccagttcttgacgtctactgcgggagaggggacaagaaaacgaaaaggggcaaaaggttcaaccattcatatggcaatgcgaggccgcgcaacaagaagaagggaactgggcctgcgcggctctttgcccctcctgctcctccaaggaaggatcagttcgatgatggggagatcatttcaatcgagattgacgaggacatcctggaataggttgtccgagttctgccttgctttatatttgccctgagcttaattggcctagtttgtaccaaatcaaatactacatattttaagtaattatttcctcgcctataattatcgatgggtaggctgccacactttcatttggctagtaatgttcctactactgactgggttctttattttcctttccagctgctgagttctttactctcttcaaaatgaaactgtgtcaaaggaagtttttttgagaagatattaaatgattcatctagtggtaacggagagattgcgcccttcatttgtaaggggattaataagatttaatctctttc

SEQ ID NO: 15556 - DNA, 2987 bp, Zea mays
tgcggcccagctcccgtgaggccgtgagccgtcagcgtgaggcagcgagggttttaccggctgcccttgcttgttgctggcccgcgcccctcccggcccggttcctcttcagtatttccctcgccgccgccggcgcccaccaaggcagcgcaacgctcgttcctccaaaggagagatgacgctctaccgtcgtgtcctgctcctccgtcgcctctcccacctccacccctcgcccgttccggccatctgctcctcaccaccacccaccctcgcggggctgctcacccccatggggcgccgccacttcgccttctcgtccgccgaggaggccgccgccgagcgccgccgccgcaagcgccgtctccgcatcgagcctccaatcaacgccctccgccgcgggccacctcccccacgggaccccaacgcgccccgcctcccagacaccacctccgcgctcactggcccgcgcctcagcctccacaaccgcgtccagtccctcatccgctctggtgatctagacggcgcctcagccgctgcccgcgccgccgtctcctcgcgcgtccggcccaccgtcttcacctccaacgccgtggccgcggccatggtccgcgccgcccgccacgatgacgctgtcgccctctttgatttcttcttccgccgctctaatatcgtccccaacatcgtctcctacaacaccctcatcctcgcacactgcgaggccgaccgcgtcgacaccgcgctgcaggtctaccaagacatgctcgcgtctgcgcccttctccccctctgccgtcaccttccgccacctcaccaagggtctcgtcgctgctggccgcatcggtgacgcccttgacctcctccgcgagatgctcagccgcagcgctggcgccgactcactcgtctacaacaacctcatcgctggctacatcgacctcaacgactgggacagggccttcgagctcttcaacgagctcgcagagaggtgccttgtctatgacggtgttgtacacaccacgttcatggagggctactggaggcagggcaaggacaaggaggccatggacaactaccagtcccttcttgatcggggcttcaagatgacgccggccacctgcaacgtgctgctcgagacactcttcaagcacggcaagcacaaggaggccaacgacctatgggagaccatgattgacaaccacaccccgccaagcttcatcggcatcaacgcagagtcctacaatgtcatggttaaccagtgcttcagggagggcaagtttcaggaggcgattgaggtcttccaccgccagcccaggaagaatgtccaaatggacgttggttgcttcaacaacatcattggcaaactctgtgagaatgggatgctagctgaggcaaaaaagctctttgaggagatggagaagaagtcagtacttccagatgtgtacacctacacttaccttgttgactcatgcttcaaggaaggctatgtggaagatacactggaatatttctataaaatggcagatgagaaaccacatgggccaaagttcaatattggtttctttaaccgcatgtttgaagggcttacagaagctggccgtattgatgacgccttgaaggtgtacgggaggatgcctgacaaggaaatcaaaccaaacatgaccacttttgaaatccttgtcaaagccttgtgcaaagaagaggacttggatcaagcaaggggcctagtgatggacatggcaagaggtggtattgtgcctcctcaagggttccgtgagtctgttgttaactttttcaaggaggctggtcgacaggaagaaattgagaaagcttttgaagaaaaacctatgccaacacctcagcctagaacagagtatcagcctaggactgagtatcactctcgcaatgcagacggtgctgctcaaataaaacaacctggctttagctctgctccagcggtgggacctgaatttcttcactctcagccacaacaatccacacttagtaacactccaaatcagcagcctgagtttggctcatctcgatcatggaattcaggtttcggtgctcctcaagcgcagcctggatatggtgcacctcagcctgtacagacaccacagccacagtttggtgcttctcggggtgaaccaggatatagcaacataggaaatcagcatgttcagtttcgctctccccagagagaaccaaaatttagcaaccatccaccacaagttgggtatggtgcccaattgcctcagtcaggatatcgctttgagctccaacaagaacaggttggatttggaaatcaagtagcacaacctgcacatgtggcttcaagacaaccctcatatgacacccgctggagctcgagagattatggatcaacccaagggcaactgggatatggtggtcctcaagcgcagtcatatgaatctcagttaccacatcaccagggaagttttggtatgccacatgtccaaaataacaatggcttctatcgatacaaccctggatatggcccatctaatggttcgcagggatttgatgctccccatggtgattctaaaactgctgagagtaccactcctgaagaccggcaacaagcagcatttctgaaagcatgagggctccaaacatattttggctccaaatcaaaaggtttctcagccacaaaatgaattaggtcttcagatattaagatatcaatgaataattttgaatcagacttcactattgttccgatgggtctcactgctgtaccttttaactgaaatcttctgctgtttctcagacatgatatggcagcatgaggagttgttttatcagttagcatatatgcatgtggttcaaaaattgaaatatgtccttttgttctcaggatgaacacttttactgattgtttaagttggaactattagtcgccatgcatgggggtttggaagtatatttatctatttgatattggcaatgtaatttttatttgcaggtattgat

SEQ ID NO: 15557 - DNA, 1943 bp, Zea mays
  misc_feature (120)..(120): n is a, c, g, or t
  misc_feature (1629)..(1629): n is a, c, g, or t
aattaacttatgaatatattttgtatataaatctacattcattcgaatgcgaacggaaaaaaaagctagaagcctagaatgattttaggcgtcacatgtgtttgttggttgactatatanggtccaattggttcgtggcccaactgagcctgtatgagatttagagccagactgagttaaaacggtatgcaatggagaccagacatatttgattagtttcgtttctctgttgtgcatgcccaatacaaattctgaatagttggtttggtgagaaagaaacaaaaaagcaagtgagatgtagttttgttcctacaaataccatcaacacaaaaataaaaatcggtttcttatttggatgcgttaatcaagcgagacatcaactggtactgttatgatctggatgatgcgatatttaaaatctcaggtactagtatttggatcagtaaccggtttggaacaaaagttaatggccggaaaccctctgatgtgaccacgcttagtgatcgatccgagaatattatatattgatcgagaatattatattgagtgtgtatttacatatgacagctaggaaatttgcgtgtccggccgccagtccatgtgtgcctgccatgaccaacatccaccttggccaagtttaattccgtccttattagtacacactcaatctcatcatatatatagtccatttcaaatggagtacatcaattacacgcacacgcatgtacattataaaaagtaagctctatgtaatttcaaatcgggtacatatatgttcaatcagttctattttttattttggtttagtaaacatgtaggtatttttttatttggatgataaagcttgatagcatgaataatctcacccgttagtctcaggaacaaatttaattattcatcgctttgttgctcttcctttgtgaaagtaagatgttcttctagttctctttaccatggtagtgtaccacaacattcatgtagtttgtgtgtttatcatgctttcatcatgaccatacctactactttgtttatttaactcaacttttggcttctgtgtagtttcgaatgcctttacttgtgtgttatgtactccttccaacggttgtcctctaaccaataatattttttcacctaatgaatattgagcttttattttctttaccccaaaacaaaattatgctagttctgagattttagagtaaactaaaattgagtgttgcgattagactatgtccataggcatgagaattacaaaatatatatgtccttacttattgttggttatttctttgtgctaatgactacactgttgaagttattgttctcgtgaggaattatttgtgaaagtctccaattttctgtacaacgttgatatgattcatgtcggcgttgtggagcatgctcatatgcgtgaaagagaagatcatgtactcatgcttcgacgcgaacgcgaggcatgaaaccatcgtcaacacttcatcgtgtccgccatgctccatgttcaccacaacttcaggcgccgcagtgacatcgtagccatgctccggatgcagacggactgccactgagaccgtctttcaggggaaaagaacgcatctcagcaatatggttgtgacggcagttatcgcntggcatcaggagtggagatgaaactctacaaccaaaagtgaacaaatcggaaaacacggagatggcagctccagacagtgttggacttggaggtgaatgaagacgtactagattatatgggtccgatctgaccaaaattaacatgaaaaagtcattgtgtgcggggccaaatcctagttcaacagattaccatgttggtactaattgcacatacgtttctaacaaaaaaagcatattcaattttgttaaatttagttaataattgagatttatgcaacaaaaccacaccatcatatcccctctgccaaaaaata

SEQ ID NO: 15558 - DNA, 638 bp, Zea mays
aaaatgtctttacttgtgtgttatgtactccttccaacggctgtcctctaaccattgaagttactgttttcgtgaggaattatttgtgaaagtctccaattttctgtacaacgctgatatgattcatggcggcgttgtggagcatgctcatatgcgtgaaagagaagatcatgtacccatgctttgacgcgaacgcgaggcatggaaccgtcgtcgacacttcatcgtggccgccatgctccatgttcaacacagcttcaggcgccgcagtgacattgtacccatgctccagatacagacggactgccactgagaccgtctttcaggggaaaagaacacatctcatcaatgtggttttgacggcagtcatcgcctggcatcagcggcggaaacaaaactccacagccaaaagcgaacaaatcggaaaatatggacatggcagctccagacattgtgttggacttggaggtggatgaagacgtattagattatatgggtccgatcagacccaaattaacatgaaaagtcactgtgtgcgaggccaaatcttagttcaacagattaccatgttggtgctaattgcacaaacgtttctaataaaaaaacatattcaattttgttaaatttagaaaaaaaaa

SEQ ID NO: 15559 - DNA, 702 bp, Zea mays
acggcccccagtgtggcttgtcttcgcccttagcagcagtggtaacaacgcagagttcttttttttttttttttttttttttttttttatatccccctcccggggaaagaagagtaggacaaaagatatggaatacaatacaaaaaaggatctttatttattctttccttcctttatccctattcatacagaattcctcatgaactaatgccaaattctttccatttattaattgctataacgagggatttattccaatattaagttattaccgaacaaagcaaaattatattatataaaggatgagatcaattcggaagcgcttttttgttattctagcagacgtaattgctttggtctaattttgggctttccaatcaattttatcttatctaattctatctcccgcgtactctgcgttgttacccctgcctatcctttccttttttctgatcatagaggagccgtatgaagctaaggtttcatgtacggttttggaatagcggtgggaactgtgatgttatcatcgactatgattatctaatagttcaagtacagttgatatagttgaagcacagtccaaatatggtttttttggatggaatctttggcgtcagcctatagggtttctagtttttctaatttcttctttggcagaatgtgaaagattaccctttgatttaccagaagcagaagaagaat

SEQ ID NO: 15560 - DNA, 3960 bp, Zea mays
  misc_feature (2429)..(2429): n is a, c, g, or t
tacatacaggattagtaatgagagaatctaaatcattagacatttttcctcataaaaggaatcataataaggacttgaaattagcgtggtcgcggccgaggtactttcttcagattccggtctagagtatgttcccattcacttgttaaggaaatggctatcaagaacgaattaaccctttattcttttttttaagtatacccctcccggggaaagaagagtaggacaaaagatatggaatacaatacaaaaaaggatctttatttattctttccttcctttatccctattcatacagaattcctcatgaactaatgccaaattctttccatttattaattgctataacgagtgatttattccaatattaagttattaccgaacaaagcaaaattatattatataaaggatgagatcaattcggaagcgcttttttgttattctagcagacgtaattgctttggtctaattttgggctttccaatcaattttatcttatctaattctatctatgcccagaggatgataccgaaacgaaacaatcctttccttttttctgatcatagaggagccgtatgaagctaaggtttcatgcacctgcccgggcggccgttcgagcatgctatagagggggcatccgcgatgttatcatcgactatgattatctaatagttcaagtacagttgatatagttgaagcacagtccaaatatggtttttttggatggaatctttggcgtcagcctataggttttctagtttttctaatttcttctttggcagaatgtgaaagattaccctttgatttaccagaagcagaagaagaattagtagcaggctatcaaaccgaatattctggtattaaatatggtttattttatcttgtttcttacctaaatttattagtttcctctttatttgtaactgttctatacttaggcgggtggaatttctctattccctatatatccttttttggatttttccaaatgaataaaataattggaattttggaaatggtaataggtatctttattacattaactaaagcttatttatttctcttcatttctatcacaataagatggactttacccaggatgagaatggatcagttattaaatcttggatggaaatttcttttacctatttctctgggcaatctcttattaacaacttctttccaactagtttcactataaataagaatacaataacagtaagaatattttcaacacaaaagttctctcaaacaagagaaagaaacatacctttttcatatatagatttagaatatgttccctatgctaactgggttcattagttatggtcaacaaacaatacgcgccgcaagatacattggtcaaagtttcataattaccttatcccacacaaatcgtttacctataacgattcactacccttatgaaaaatcaattacatcggagcgtttccgggggcgaatacactttgaatttgataaatgcattgcttgtgaagtatgtgttcgcgtatgcccgatagatctaccccttgtggattggagatttgaaaaggatattaaaagaaaacaattgcttaattatagtattgatttcggagtttgtatattttgcggtaactgtgttgaatactgtcccacaaattgtttatcaatgactgaagaatatgaactttctacttatgatcgtcatgaattgaattacaatcaaattgctttgagtcggttaccaatctccataatgggagattacccaattcaaacaattaggaattcgcctcaaagtaaaatagacgaagaaaaatcttggaattcaagaacgattacagattactaggtattaggatttttttattagaaaaatccatttttactaactctaacgaaaaaagaataactactgcttaacaacttatatgtatatacaaaaaaatatcctaatacctttttccttccttgaatcttttagttttagtcagttcatgaaaaattttatactagaaatttcttcttatccataatggatttacctggaccaatacatgagattcttgtgctatttgggggatttggtcttctactaggaggtctaggagtagtattacttaccaacccaatttattctgccttttcgctgggattagttcttgtttgtatatccttattctattttttattaaattcctactttgtagctgtcgcacaacttcttatttatgtgggagccataaatgtcttgatcatatttgctgtaatgtttgtaaacggctcagagtggtctaaagataagaattattggactattggagatgggtttactttactcctttgtataactattcctttttcactaatgactactatcccagatacgtcgtggtatggaattctttgggactacaagatcaaaccaaatagtagaacagggntctcataaataacgtttcaacaaattgggattcatttagcaaccgatttttatcttccgtttgaactcatttccctaattcttctagtttctttaataggtgcaattactatggctcgacaataagaaatacttagaatgagtcaaaattcttagaatttcaaatataaaataaataactaaagaatcacaattttgatttagtaaaacccatctactgccaatacaacaaataccttcttttctcttttgttgcgtaattgttctattctaattaattgaatcggttcaattcttgtcctcatattgaaatgaatcgagattgataaggagttagttaatgatgtttgagcatgtactttttttgagtgtctatttattttcgattggtatctatggattgatcaccccccgtaccctgcgttgtgccctctgctgtcttgaacttatactgaattcaattaatctaaatctcgtaacattttctgatctatttgatagtcgccaattaaaaggagacattttcgcaatttttgttatagcccttgcggctgctgaagcagctattggactatccattctttcttccatccatcgtaacaggaaatcaactcgtatcaatcaatccaattttttgaataattagacatagaatcccctaaacaaaggggcatatataataataagaaacattaagatgaatagaaatctaatcttattttcttattagtgtttaataatatcctttttttgagtaggttatttcagagtattgttttttacttattgaatattgcatttttgcaattcattgatattgcaatttgaatattgcaataatttatattgaaaagatgatagccaatttattggctaattcgaattagtatgtagaattcgtataattataactgttgaagccttaaattcaagtctcttggctcttttcacgctttctcacaaacagattacgaaatatattgcattatttgttaaagtttggataaaccattgcttcgtctggtgtctacaatacatctaatttatatagtactaatttcatttttaccagatcgaaaatttttatgttgaaaaggaaaatttagagatccaatgtcacattctgtaaaaatttatgatacatgtataggatgcactcaatgtgtacgagcttgcccaacagatgtattagaaatgataccttgggatggatgtaaagccaagcaaattgcttccgcgccgagaaccgaagattgtgtgggttgtaagagatgcgaatccgcctgtccaacggattttttaagtgtccgcgtttatttagggcctgaaacaacccgcagcatggctctatcttattgatacgttacaaaaaactccacttgaatcgtctgattcctctttaccgaagaagcctgtgctcgaaataatcgagcatgggcttttctggtcaaaacgtatcttgtctttattactttatcatgagttattttcctttggtaaacatactttgttgtttttgcgatatttgcagg

SEQ ID NO: 15561 - DNA, 1684 bp, Zea mays
acgagcgagaactgttgtcatttcatgagacgttactccggatgcacttgtaacgggatagtgtagtagcaagcataggagtaaggagttttgctagtcttcttcagcttcagtagttcagtccaatcacagatcgcagtacaactgaacccgccgcacaaggcatccaggatttgttcggccttcggacttcggagggtagagaatcgaagcgacgagaacaaagcaatgaacgaggcggtgcaggaggcgaagctgctgcggcaggtgaacgcgctcatcgtggcacacctccgtagccagaacctcgggcaggccgcagccgccgtcgccgccgccaccatgacccccatctccgctgccgaatccgtccccgccaatcacctcctgcgtctcgtggccaagggcctcgccgcggagcacggaggaggtgacgccgcttccgcattcgactccgccgggttcggtgtggcggtgcagccgcccggctccagtgccgtggatttcagtattcaggatgtcaagggctcatccaaaagcttccccaagcacgaggtgaagcatgtctctgaccataagaacgctgcccggtgtgtgaaatttagtcctgatggaaagtattttgcaactgggagtgctgatacatccattaagttttttgaggttgctaagattaagcagactatggtaggagactctaaagatggccctgccaggcctgtggtacggacattttatgatcacacacaggccatcaatgatctggattttcatcctgagagtccaatactgatatcagctgcaaaagacagtacaataagattctttgacttttcaaaaaccaatgcgaggaaagcgttcagagttattcaggatactcataatgttagatctgtatgttttcatccttgtggggattaccttttagcagggactgatcacccagttgctcatttatatgatataaatacttttacatgctacttatcagcaaatgcacaggattctagttctcccattaaccaggtacgctactcttgtactgggagcttgtatgtgactgcttctaaagatggttctctgcgcatttgggatggagtatctgctgaatgtgttcgacctattattggagcacatggatcatcagaagctattagcgcgattttcaccaaagatgagaggtacgtcctatcttgtgggaaagattctcgtgtcaagttatgggaagttggcactggacgacttgtgaagcaatatgcaggagcaattcgcagacaatttcgttgtcaggctgtcttcaatgaaaccgaggaatttgtgctatcagttgatgaacaaaacaatgaggttgtcgtctgggatgcacttactgctgaaaaggttacaagattgccttctggcagcactggtgctcctagatggctcgaccattccccagttgagccagtttttgttagttgtggaaacgatagatcgatcaaattctggaaacaaaccgtataagcttgtagattcaaccacgcaaatcaaaagagtatgttttcagtattactgtttcaggaggaatgtgctagtgtaactttagttgtatatgggagaaatttgcataagcgatttttttttgaaactgcataagcaattgtttgacctaatagcaaatcccaatcagatgttttttttgggg

SEQ ID NO: 15562 - DNA, 1253 bp, Zea mays
ttttttttttttttttttttcagaagcaattgcgttctgccatttcagcgtcaatcatatagtgctcgctgaccctcttcatctattacaccaaaaaggaccctccagacttctgacatgttatttagttgataaggatattaactcctcaagagtaactgcactgcgccgcctccagccatactagtgtccctctaatgcatgccgcgagcttaaactgggatttatccaacaaacacaacggctcacaagataattaaccggaccatctttcccaagtactggaagcattttgcagcttctttcaagcacaagttcctgtccttccgagtccagtgcttgctgagctcattcagcttctccctggcatcttttagtagaagttcagcatcagtatcccacttgtagaactccagatcccttccttccagaatcttttcgcagatcttattgcctattgtgacacctccagttatatgagcaaaatagatattgtaataatgagagaggaatgcaggagcgttgctctcagccagttcagtcagataagctgcataagttgatcccgaagtactcggctctgggattgcaatcccttgttttctgaaccactccaaatcttttgaaatgctagctgaacgctccaaaccacttttcaggcgacatcggtggactcggccacgacccgctcgatggttccgaagacgagcctgctgtccaccaggtatcgcacgaacccctccatgctgggcatccattccccttcctcgagctcgccctcatcctcctcctcgtgttcctccttcacgccgccgccgtcgtcctcctcagcctcgccctccgacacccccgccccggcgtccgcgtcctccgtccccgacttgtcttttatggtggtgcgcttggggttacgcaggcgcatggcgacaaagcgcatctcctcagcaacgcccaccgactcgccggggtactgcttcgggtaccgccgtggcctcggcttcgacttcgcttcctgtggcgccgcaggcacctccgcagcgaccgggggcggaggggagggggagcagctggtggcagttagggataggattccgggtctgcgagtgctgaagaagcggagttgagccactcgccggggtgggggcggcgcgaccgccgaggcggcggcgtcgattagcggcatgggtttaaccgtttgaggggttggttagcctgttctaggtaatggtctcgtgcgcgataccgcgggtctt

SEQ ID NO: 15563 - DNA, 1345 bp, Zea mays
tccgacgaatagggtaaactgtaacttcacggttaactcacaacgaaggcaacgactaggcttggaattaatgcccgccgggcggcgcgtccaaactccaaagacacgattgtagttggattaattcccaccccacaaccccccaccacaagaacttgttcgatcgaattcttcttcaactacccgccgcgggaacccaaggaaggaggcaaagcaaaggcttctcgcagggtttcccgtcagcggcttctgcggcgggcgccatgaacagcagcaagcaggcgctgatttacagcttcgtggccaagggctccgtcgtgctggcggagcacacggccttctccggcaacttcagcaccgttgccgtccagtgcctccagaagcttccccccaacagcaccagatccacctactcctgtgacggccacaccttcaacttcctcgtcaaccgcggcttcgtgttcctagtggtcgccgatgaggcggccgggaggagcgtccccttcgtcttcctagagagggttagggaagacttcatgcagcggtatgggtccagtatcgatgaggaggggcagcacccgctcgctgatgatgctgatgaggatgactttctgttcgaagaccggttcagcattgcctacaaccttgaccgtgaattcggcccgaggttgaaggaccatatgcagtattgtgttaatcatccagaggaaattaacaagctctccaaggtgaaagcccacctatcggatgtcaaagggatcatgatggacaacattgagaagatattggatcgcggggagaagattgagcttttggtgggtaagacagagaccctacagtcacaggcggacagcttccacaggcatggcagagagttgaggcgaaagatgtggcttcagaacctgaggtttaagctgatggtgggtggcggcattgcggctctgatccttatcatttggctgatggtctgcaggggattcaaatgttagagcacaccaagttgctcgccttttttttttcttttcaggcgtttgatatgcacagactttcaaccaaattgtgttttcagtgtcacggtatcgcaatgtagtggacttcaatccccgcagtctttcccatgttccattacttccatatgataatggtaaaaggtaggaagctggagtacgcggtcagaactgtctggaggagatatgacatcacgacttaaatatctgtacattccaaaaatgcaagctcctattatttcggtaccttctgtactggtgccaacgatcattgtaaatgcataacgtactttggtgtatgtgtgatgtctcaagctgtttccctcgccatcattcgc

SEQ ID NO: 15564 - DNA, 2783 bp, Zea mays
ctcgaggccggccgggccgggaccatcattcttctcccctttcctttattttgaaccagcgaacggacgctcctcggggcccaaacccggctggtctctctcctctgagttgcccttgccccacattacaccacaccaccccctcccactccatgctgtcaggagcggaaggccgaagcgccaccgcgcccaccctgatctgcccgcccacctaacgtcggccgtcaatcggccgccgccgcgatggggtttgacgggctggtcgtggtgtcagatccttacctgctgcgtcgcttcacgcaggccgaacttcgcgcgctccaggcccagtatgcggcgctgcgggacgcgtcgcctaacgggaggctgcggatgcgggatctccccgccgccatctctggcgtccgcggtgcggccaagagcagggacgccgagaaggagaatagcgcgccggagccaggcccctgccatggcctcactgacgaggagtgggcctccgtgcttaaggccgtcgcgcgtgctgacgagaagccgcaccaggacgcgagcttcgagctcttcctccgcgtctacgctgagatgcagctgcgactcaaggcagtaagcgtctgctccggccgcgccggaggaatcgtgcgctcctcctcctcctctgctgttgccttcctcacggcggccaccaccacgctgcttcacaccatcagcgagtccgagaaggcgtcctatgttggccacatcaacgcttatctcgcggatgatccgtccctgaagagcgccctccccatcgatccggcgaccgatcacatcttccatatcaccaaggacggcgtgctcctatgcaaactcatcaacttggctgtaccgggcaccatcgatgagcgagccatcaataccaagagggtccttaatctttgggagaagaacgagaaccacacgctttgcctcaattctgccaaagcgatcggctgcactgtcgtcaacatcggcacacaagacctcgccgaagggaggcctcatctggtcctgggcttaatatctcaaataatcaagatacaactgttggcaaatgttaatctgaaaagcacacctcaattagttgaattggttgaggacagtaaggagatggaggagcttatgagtttatctcctgaaaagattctactaaggtggatgaactttcaactgaagaaagcaggtttccagaaaagagtaacaaatttttcatcagatataaaagatagtgaagcctatgcttgtctattgaatgtcctagcacctgaatgcagtgcaaaaccatctgcgatgtctgtaaaagatctacttcatagagcaaggttaattcttgagcatgcagataggatgggctgcaaaaggtacctgactccaaaagacatagttgatggtttacccaatctaaatcttgccttcgtggctcatattttccaaaaaagaaatgggttgtccaaacaaatgaaacaagtttcctttgtggatggactctctgatgatgctcaagtttccagggaagaaaggtcattccggctgtggattaacagccttggaatttcaacttacatcaacaatgtgtttgaagaccttagaaatggatgggttctccttgaggtgattgacaagattgctccaggctcagttaattggaagatggcaaatcgcccaccaatcaaattaccattcaggaaagttgaaaactgcaatcaagttttgaagattggaaaagaactaaaattttctttggtgaatattgctggaaatgatattgttcaagggaacaaaaaactgatattagcttttctatggcaattgatgcggtacaacattctacaactgctgaagaatcttagatttcactcaaatggaaaagagatcacagataatgacatattggcatgggccaataagaaagtaaaagattctggaaagcaccactcttatatgcaaagtttcaaggataaaagcctttcaagtggcacctttttccttgacttactaagtgctgtggagcctcgagttgtgaattggagccttgtgaccaaaggggaaaaagacgaagagaagcaaatgaatgcttcatacatcatttctgtggctaggaagcttggttgctccatttttttgttaccagaagatatattggaggtgaaccagaagatgatgctaactctgacagcaagcattatgtactggtatttgaaaaggccaacatcacaatcattggactctgaaaacgggagttcatgtgaaacaacctccatcacaacttcagatgattctgcatctgaatcatcgattgatgacaatacaactagataaaagagcagggtcatgaaaataattgatatgacctgtcattttgaaaacttgggattgattgtttgctgtaattttaagggcaaatacattcaagaccgaggcaagggaaatggttaagggctttgggtgtttttttgaggtttaatagtgtgattgggtgaaagatgtttgacatcctgtaaatatatctataactagtgacaataggttgtccaaaatccactatttgagttagaacaatttgagttacaatgtacaataaattagtgtcctatccgttaaagcttttaggcgcatgttgtcatatgcttatggaataactacaacattttccttgaaatatgcttaaattaacacgagcttaaatcgcttgtgattcccaaaaaaaaaaaaaaaaagcggccaaaaaaaaaaaaacggacgcgtgggcggacgcgtgggcggacgcgtgg

SEQ ID NO: 15565 - DNA, 1050 bp, Zea mays
catttattgagtcgccatggccaacaaatgagataagaactcaaccgttgaagccttcgctcatcatttctgcaagcaaggatgaatctgttaggctatggaatgtccatacagggatctgtatcttgatatttgctggagctggaggtcatcgcaatgaagtattgagtgttgacttccatcctagtgatattgaacgttttgcaagttgtggcatggacaacactgtgaaaatctggtcaatgaaagaattttggctatatgttgacaaatcatattcatggactgaccttccatcaaagtttccaacaaaatatgtccagtttccagtcttgattgctgcagtacactctaactatgttgattgtacaagatggcttggtgacttcatcctatcaaagagtgttgacaatgaaattgtgctttgggaaccgaagacaaaagaacagagtcctggggagggaagcatcgatatccttcagaagtatcctgtcccagaatgtgacatttggtttatcaaattttcatgtgattttcacttcaatcagttggcgataggcaaccgtgaaggcaaaatctacgtgtgggaagtacagtccagccctcctgtcctcattgctcggctgtataatcagcagtgtaaatcgccgataagacaaactgcagtgtccttcgatggaagcacaatccttggagctggtgaagacggcaccatctggcggtgggatgaagtggaccatccgagctccagaaactgaagaagtgttgccgctcaatgctggactgatggttacgctcggttggggttgtgatggttgaatccgttggcggaaagtgccacctggtgtttttttctagtcaaaatggttgatgttaacagaatattgaatgcttcgaatgttgaaagttgggatgcttgtgctggtactctgctccgcggacgagtgaacttagtttgttgcaactttgggaaccgttgtcatctgtttgttctgcatttctaaaaagagagcaaatttcaggataaaaaaaaaaaaaaaaaaaaaaaga

SEQ ID NO: 15566 - DNA, 1880 bp, Zea mays
gatccttttgcccccggacccctccgccccgctcgcgcaaacccacaaaaccctcgccgtcgcgccgcgcgattgcctctccggccgccgcgagcccgcgacactagtaacggtctacaccactagaatgactgaagaattgaattccagcaaattcaagcttttgttttagccaagatttgagattcgatttgaagtgtggaagtccttacaatttgccaatcctatatttgatctctgctgtgctgcgttaaatccctaaacttcacagcgcggcgccggcccagccacgccggaagaagtcgccgcgtgaggtcagtgtccccgttgctgccgcctctaacccgaagcctaggccgctgccggtgcataacaaggagaatcaggcggaggggaaagtagcagaggagggggcagcaactgaggagggggagaagtaccgggcggaaccggaaatcttgccgctgccgccggccatggcgaagctgggcccggggcaggggctcgggtgcgaggcggcggaggggtcgctcgtgcccagccggaagcgggagtacaagccctgcggcaagcacactgaggggaagcgcccgctatatgctatcgggttcaacttcatggacgcgcgctactacgacgtcttcgccaccgtcggcggcaaccgcgtgacaacttaccgctgccttgagaatggtagtttcgctcttctacaagcttacgttgatgaggataaggatgagtcgttctatactctaagctgggctcgtgaccatgttgatggctcaccactgctggtggcagcaggaagcaatgggatcattcgggtcatcaattgtgctacagaaaagttagctaagagctttgttggccatggcgactcaataaatgagataagaactcaaccgttgaagccttcgctcatcatttctgcaagcaaggatgaatctgttaggctatggaatgtccatacagggatctgtatcttgatatttgctggagctggaggtcatcgcaatgaagtattgagtgttgacttccatcctagtgatattgaacgttttgcaagttgtggcatggacaacactgtgaaaatctggtcaatgaaagaattttggctatatgttgacaaatcatattcatggactgaccttccatcaaagtttccaacaaaatatgtccagtttccagtcttgattgctgcagtacactctaactatgttgattgtacaagatggcttggtgacttcatcctatcaaagagtgttgacaatgaaattgtgctttgggaaccgaagacaaaagaacagagtcctggggagggaagcatcgatatccttcagaagtatcctgtcccagaatgtgacatttggtttatcaaattttcatgtgattttcacttcaatcagttggcgataggcaaccgtgaaggcaaaatctacgtgtgggaagtacagtccagccctcctgtcctcattgctcggctgtataatcagcagtgtaaatcgccgataagacaaactgcagtgtccttcgatggaagcacaatccttggagctggtgaagacggcaccatctggcggtgggatgaagtggaccatccgagctccagaaactgaagaagtgttgccgctcaatgctggactgatggttacgctcggttggggttgcgatggttgaatccgttggtggaaagtgccacctggtgttttttctagtcaaaatggttggtgttaacagaatattgaatgcttcgaatgttgaaagttgggatgaatgtaatggaactctgctcaacgcgcgagtgaacttagtttgttgcaactttgggaaccgttgtcatctgtttgttctgcatttctaaaaagagagcaaatttcagg

SEQ ID NO: 15567 - DNA, 1804 bp, Zea mays
acaaaatgtgcatcgccgccgccaccatatagaaccacttatcatgaaccgccgccatcacatccactgcctcaactagtgttaccacctatggttcattgttgtgtctgcttcttgtagcactgttggtctacaaacattcatatttctctcaacatctggcacagcatgccgccttccaaagcacgccgaaagaggtcacttcgtgatatcactgccaccgttgccactgggactgttgccaactcgaaacctggctcatcatcgacgaacgaggggaagcaacaggacaagaaaaaggagggtccacaggaaccggacatcccaccattaccgccggtggtggtgaatatagtcccacgacaaggattaggatgtgaagtagtggaagggctactcgtgcctagtcggaagcgagagtacaagcccaatagcaagtatactgtgggaaatcacccgatctatgccatcgggttcaatttcattgacatgcgctactatgatgtctttgccatcgccagttgcaatagtgtgataatttaccgatgccttgagaatggtggttttggtcttctacaaaattatgttgatgaggataaggatgagtcattctacactctaagctggaccatcgatcaagttgatagctcaccgctgttggtggccgcaggaagcaatcggatcattcgggtcatcaattgtgctaccgaaaagttagataagagcttagttggccatggtggttcaatacatgagataaggactcatgcctcgaagccatcactcatcatttctgccagcaaggatgaatctattaggctatggaatgtccatactgggatttgcatcttagtctttgcaggggctggaggccatcgacatgatgtgttgagtgttgacttccaccctaccgaggttgggatttttgcaagttgtggcatggacaatactgtgaaaatttggtcaatgaaagaattttggatatatgttgaaaaatcatattcatggactggccatccatcaaagtttccaacgaggaatatccagtttccggtcttgactgctgcagtacactctgactatgttgattgtacaagatggcttggtgacttcatcctatcaaagagtgtaaagaatgcagttttgctttgggaaccaaaaccagacaagcgtaggcctggggaggggagtgttgatgttcttcagaagtacccggtgccaaagtgttcattatggtttatgaaattttcatgtgatttttactccaaccagatggcaataggcaacaataaaggcgagatctatgtctgggaagtgcagtccagcccgcccgtcttaattgaccggctgtgcaaccaggaatgcaagtcgccgataaggcagaccgcagtgtcattcgacggaagcacgatccttggagccgccgacgacggcgcgatctggcggtgggacgaagtggaccctgctgcttccagctccaaacctgatcaagctgctgcgcccgccgccggtgtcggtgccggtgccggtgccgacgccgacgccgacgcctgagcgagaggaccgtcgccgcccgccggttcacatcgatcgtactccgtgctggttgattagctttacccattggtatgttttggttcagagtcgccagatctagtgtgtggctgaacgttgaatgttaggatgctgctgtttgttatgctctgagtcttgagttcactttgttaatttgcaccgtggatgagatgaataacttgacgttgcaaaaaaaaaaaaaaaagataccgcaaaaaaaaaaaaaaaa

SEQ ID NO: 15568 - DNA, 763 bp, Zea mays
agcagtgctggcttcgccgcgtctttcacatctggagctcgatatgattcatagtaatgcaacggtgaccattgatctttagcccttactacacgtgacacggaaacccacatgtgtcatcaaaggaagaaaaagaactgttggtcctttggaaatctattgctcactgaatgatgccacatcgctggtcccgtgttgcttggcatatctgccgtgcctattcacatcttattgtgcctagactttcatggggaagctgaggaaattataatggaaaagatgagatttattctatatcggttgcccaaggttgaatgagtggttaggaaaaatcagatttgggttcagtatgtttcttgcttgcatttgacttggtacataggacagaacaagtgcaacgatgccgctgatactagctcactttggggactcctgttgtggatacgcggcacttgaagttgtgaaaagagttttggggggtccattctttcttccttgtctttggctcggttagttggcttttttttttacatcggatcagtggtggaactgcgaggttgtggttttatcatgtaggcaaatttgccaaatgtgtacatcggaaatatgggaataaaagcctctatcaatcagcattcagcatcatgcagcgctcaagggcctgtttggttggcatgctgattgccaatttgccataaaaaaaatgtatccgcctacatgtactgtctgggttcaagtctgttacaataggtacaagggtacc

SEQ ID NO: 15569 - DNA, 2270 bp, Zea mays
acggccgatacagaagcacataaacacattcgacgaggtcacgactcacgaggggactcccgagtcccgagcgcacgcgcgaatcgccgcggacctcgccggaggcggcgacgagctcggatcccggcgatctagtcgccggaggcggtcccgatggctcggcggtcgtcttcctcgtcgtcggggacctggcggtacctgaacccggcgtactacctcaagcggcccaagcgcctggcgctcctcttcttcctcttcgtcgcagccaccttcgccttctgggaccgccagtcgctcgtcagcgagtacgagtctgagatttcccgattagaagatgatataaatcggttgcatgaccagctaagaaaggctggagttaatctggatgaaaatccagtagtaagcaacaagaattccagaaaagatcttgtagtagaaattgatcctgtcaataatgaaagacgggaaaaagttaaagaggcaatgctccatgcttggaattcttatgttaagtatgcctggggaatggacgagcttcagccacaatcgaagaatggtatcaacagctttggtggtcttggagcaacccttgttgactcacttgataccctatacataatgggcctgaaagatgaatttcagaaagctagagactgggtggcggagtcattagactttgacaaggattatgatgcgagtgtttttgaaacgaccataagggttgttggaggtctgcttagttcatacgatctatctggtgataaagtatttcttgataaggctaaagatattacagatcgactcttacctgcttgggatacaacatctggcatcccttataatagaataaacctagctcatggacgagcccataatcctggatggactaacggtgatagtatccttgcagattctggtacggagcaacttgaattcatagctctttcacagaggactggagatcccaaataccagcagaaggcggagaacgtcattaaacagcttcaaaagatatatccaagtgatggtttactgcctatttacataaatcctcattctgggacagcatcatactcaactatcacatttggtgctatgggagacagcttctacgaatatttgctcaaggtctggatccaggggaataaaactgagcatgtaaaacactacagacaaatgtgggagacatcaatggaaggtctattaagtttaaccaagaaaactacaccatctaattactactacatttgtgaaaagaatggtggctcgttgtctgacaagatggatgaacttgcttgctttgctcctggtatgctggccttaggtgcctctggttacgggccagaaaaatcagagcaaattatgaatcttgcaaaagagcttgctaggacctgctataatttctaccaaaccactcccacgaagttggctggagaaaattattttttccatactggacaggacatgggtgtgggcacgtcgtggaacatcttgagaccggagactgttgaatcactgatgtacctgtggcgtttgacggggaataaaacataccaagattgggggtgggacatattccaggcatttgagaagaactcccgcatagaatctggatatgtgggactgagagatgtgaacactggtgaaaaagacaacatgatgcagagtttcttcctggcagagacgctgaagtacctgtacctacttttctcccctccatcagtcatatccttcgacgagtgggttttcaacactgaagctcacccattgagaattgttccagtaaatgataacaaaggcattggaacaccggtccgacaattcgggagaaaacagggaaagcctgagtaaccttggatatagagcagtggatttttgaatccgccgtctgattctgacctccctgttgatgtgttctgacacgagggaactttctgcctgaagcagtaagggttagaaattacggcgatagattgtttagagcaaaaatcataggtagaggatgatgttatatgcggggcagtgacctccgtgaggtcaagagccccatagaagcttttatctttggatttgcttacgcaccctgaggtgcattgttgatgtgtagcatacatctaactcactgtccatatgttgttgctttcctgggggctctgcgagctgtattgtcattatgtaccccctagttattacttcttttcagatatgattcatataaatataaaacgtaaagtatctacgttattagttgggttttcgtattaatatta

SEQ ID NO: 15570 - DNA, 1788 bp, Zea mays
tgaaagatgaatttcagaaagctagagactgggtggcagagtcgttagactttgacaaggattatgatgcgagtgtttttgaaacgaccataagggttgttggaggtttgcttagtgcatatgatctatctggtgataaagtccctcgcgtccgggctaaagatattacagatcgactattacctgcttgggatacgacatctggcatcccctataatagaataaacctagctcatggacgagcccataatcctggatggaccaacggcgacagtatccttgcagattctggtacggagcaacttgaattcatagctctgtcacagaggactggggatcccaaataccagcagaaggcagagaacgtcatcacacagcttcagaagatatatcccagtgatggtttgcttcctatttacataaatcctcattctgggacagcatcgtactccactatcacgtttggtgctatgggagatagcttctatgaatatttgctcaaggtctggatccaggggaataaaactgagcatgtaaaacactacagacaaatgtgggagacatcaatggaaggtctattaagtttaacaaagaaaactacaccatctaattactactacatttgtgaaaagaatggtggctcattgtctgacaagatggatgaacttgcttgctttgcccctggtatgctggcattaggagcctctggttatgggccagaaaaatcagagcaaattatgaatatggcaaaagagcttgctaggacctgctataatttctaccaaaccactcccacgaagttggctggcgaaaattattttttccatgctggacaggacatgagtgtgggcacatcgtggaacatcttgagaccggagactgttgaatcacttatgtacctatggcgcttgacggggaatacaacataccaagattgggggtgggacatattccaggcatttgagaagaactcccgtgtagaatctggatatgtgggactgagagatgtgaacactggtgaaaaagataacatgatgcagagcttcttcctggcagagacgctcaagtacctctacctacttttctcccctccatcagtcatatcctttgacgagtgggttttcaatactgaagctcacccattgagaattgctccagtaaattataacaaaagcattggaacaccggtccgtccattcgggagaaaacagggaaagcctgagtaaccttggatatagagcagtggattttttttttgaatccgacgtctgattctggcctccctgatgaagatgtgttctgacacgagggaactttctgcctgaagcagcaagggttagaaatcacggcaatagattgtttagagagaaaaatcataggtagatcatgatgctatatgcggggcagtgacctccatgggtggtatggtcggagctcaagagcccccatagaagcttttatctttggacttgcttacgccccctgatgtgcgttgttgatgtgtagcatacatctaactcactgttcatatgttgttgctttcctgggacctctgcggagctgtattgtcattatttggcccatagttattactttttttcagatatgatttatatatatataagttgtttatggctttccttcaacgcttcgttctcctctggagtcatttactgcttccagtcgctgatacttgacccattaacatttaacatgcgaattgtgtaaactctgctgtctgttctgggcccttaggggctgagttttgtgaacttcagggtaccgagc

SEQ ID NO: 15571 - DNA, 389 bp, Zea mays
attcggctcgagggcatgtcctactactatctatagctagcttccaacaagatttgcgcttcagactttttggaggtctacttgggtgacatttttcagtaaggtccatgagagaagtgtgtagcttgtggactaggtagaggacagcaacatcgacagtccagcaaatgacatcaaggtatgtcgaggaagattggagctttcaagtcgataggtacaagtcacaagccacagtccgagaatctgaaaagcttaagctaattgttggtacgtagggagataccccgctcttgcttctcgtttttaatttgcggctagtttggaaactccatttttctaagggatttctgtttttccaagaaataataaactaatttttttttggaaaa

SEQ ID NO: 15572 - DNA, 1639 bp, Zea mays
  misc_feature (1575)..(1575): n is a, c, g, or t
atatatatatatatatatatatatatatattagattttaaaaaataacaaaactgttaatagtagtcaaagttttatatgtttgactcaaactttatgcaaaacggtttcttttttaggacttgacggagtagattattagttgattgctttgcagctcaagaagctaattaatactgtagttgctaacttttaattatatagatccaaattctaaacatggccatatagacgagaaaattcgtttctaaaccagtatcaatacagatgattgatctcgcaatgtggatcaatacaaggatgggcaagctgtgagaagtcgaaaacaaaacgacgagatagcatgggaagtcgtaaacagaggaatttttccctccttttaaacatggggacaagcacactgcacacggacgacgccgcggcgggtctgcgggttgtcgaaccagaccgccgctgccgggtgctgactcgaaacggcgtcgggcggcggccaggcgctgtctcgttccgcccaccaaccccgttcccacatcaaccgccgagatcgtttccgtcctgtaaaccaacgaccgatcgtgcgcgaacgtttattaataacgctcctccgccgcgccgcccccgactcctccctcccctcctctgctttccccccatttcgcgtctcggggtttggaccagccacccggcggaggcggccgggcagactgggccgagcgaccggagcgccgccgccatcggcaaagccacgggacggcccatggagtcgcgagcgctcctgcacgcccggcccgccgccctccctcaccgcgccggcctgcgcctccatctcccgctcctgcgcccgcgtgcagtctcccgctcccccgccgccaagcccgcgctccagtccccgctcctcgcgtcgaggggccccttccttcaacggcacgatgcggttctgggcaacgggttcgtgaaacggagagcggccagcgctggcggtgatgtgtccttccgcgcccaggcggcggcctcggcggcggtgccggcgccgcagccggaggagtccacaaaaaagctccttggcatcgacgtgaagacgctcaagaagatcgtgccgttggggctcatgttcttctgcatcctcttcaactacaccatcctgcgggacaccaaggacgtgctggtggtcactgccaaggggagcagcgccgagatcatccctttcctcaagacctgggttaacctgcccatggccatcggtttcatgctcctgtacaccaagctttccaacgttctctcacgggatgcgctcttctacaccgtcatcttcccgttcatcgccttcttcggcgccttcgcctttgtgctctacccgctcagggacgtcatccatcccaccgcgctcgcggacaagcttctcgccgcgctcggtccgagcttccttggtccggtggcgatactgaggatttggagcttctgcttgttctatgttatggctgagctctggggcagcgtcgtcatctctgtgctcttctggggggccgctaatcagattaccacagttgatgaagcaagagaattctaccccgttatntggcctttggggctaatattgctcttaatggttctgggcgtcctgggaagatttctcaatttgc

SEQ ID NO: 15573 - DNA, 2339 bp, Zea mays
cattgggtacctcgaggccggccggggcggcttgccgggcgcctgaccttatctcctcctccaccccgagatatttccacgtctcctccgccaccatggagtccggcctcgttgcaagccaccgcctccgcgtcccgcccccctccgcctccgccgggcaccaccacctcatccgccaccgccacgcccacgccccggtggccgctgcgcccctccgcctcagtctcccgcgccacctcccccggtccaccccgctccgcctgcccgccgcgctcccgctccgccactgcctcccgcccctccgcgccgcctccgccgccgccgccgcagtcccagcgcccggggacgacgcgtcgcccaagttcctgggcgtggagacgaagacaatcaagaagatcgtgcccctggggctcatgttcttctgcatcctcttcaactacaccatcctgcgggataccaaggacgtgctcgtcgtcaccgccaagggcagcagcgccgagatcatcccgttcctcaagacctgggtcaacctgcccatggcagtcggcttcatgctcctctacaccaagctcgccgatgtcctctccaaggaggcgctcttctacgccgtcatcttcccgttcatcgccttcttcggcgccttcgcctacgtgctctaccccatgcgcgacgccatccaccccactgcgctcgctgatcgcctcctcgcctcgctcgggcccagcttcctcggacccgttgccatcctccgcgtctggagcttctgcctcttctacgtcatggccgagctctggggcagtgtcgtcatatccgtccttttctgggggtttgcaaatcagattactacagttgaagaggccaaagagttctacccgctgtttggccttggtgccaatgtggccctcatcttctctgggcgcacggtgaaatatttctcaaacatgaggaagaatttgggtcctggagtggatggttgggcaatttcgttgaaggccatgatgagcatagtggttgtactgggtcttgtcatcaccggtatctattggggagtgaacaagtttgttattgataactcatctgtgcccgtggttgagcggaaaaagaaggacaagccaaagctcagcatgggtgagagcatgaaggttctgttgtcatctcggtatgtgagggatcttgctacattggttgttgcttatggaataagcattaaccttgtcgaggtgacatggaaatcaaaactgaaagcacagttcccaagcccgaatgaatattcttcattcatgggcgatttctcaactgccaccggcatagctacatttacaatgatgttgttaggaagagtgatcctcagaaagtttgggtggggagttgcagctacgatcacgcctgcagtgttactcctcacaggagttgggttcttctcactgattttgtttggtgagccattgactcctcttatgaccaagtttgggatgacacctttgcttgcggcagtctatgttggagcaatgcagaacattttcagtaagagtgcaaaatacagtctgtttgatccttgcaaagagatggcatacattcctttggatgaggatatgaaggtgaaaggtaaagcggctattgatgttgtgtgcaaccccttggggaaatctggaggtgctctgatccagcagttcatgatcctgtcattcggttctctcgcgaactcgacaccctaccttggcggaatactcctggtgattgtccttgcatggctgggtgctgtaaggtccctcgacctgcagttctcttccctggcgaagcaagagctcggcagagagaagctgctgaaaacgcaggccgtcgaaacggtcgccgaagtagtcggcactggaaacggttctctccaagaaactctagctagtgagccgtctgcaaatggcgcggccaccaaacagtcgcaagaacctgagagcacagcccctgagaaatcaggccagcagtctcaataagttctccccccaagaaatttagctagcacgagcctttggaggaaccggaagtttcttatctggagctactgaagaaggcaggaatcatgccagaaataagaaggcctgttcttcttctgttgttgtagtgtttttgtttttaaacttcgccgtatctgtagctgtttgtttcattccataggtatgaactgtttatgttcgttattaaaattttgggaggtctgcttcatcgtaatcttcattagcagctggtccttgttgtgaaaaaaaaatattttgcatggttttgatagtcatgggtaccatatatccaatttattcatattaatactaaaaaaaaaaaaaaaaaaa

SEQ ID NO: 15574 - DNA, 2315 bp, Zea mays
gcacgagaccattacctagaacatcctaatcgaaaaaaacaggcacagccctccctcctccactcctcgccctctctctctctctctcgtcccgtcccgagaagcggacaaagcgcggcgctgcagatttcgatccggttcccaatgcctcccatgctcgccgtcgccccgtgctagctctctctcccgtctccgcttcctccacctgccgcgccagcgccagcgccagcgccacgccgcctggatccggcgagcgcgtggccgggagcctcagatccgagcgaaacccagccttcccgtggtgacggccttcgctctagctccagattggctggcgggtgccattcctcctcctcctcttctcgctcgaggttccaaggcgggtccgttcagctctgtgctggcgtgagacgcgtgacagtggaaaggcttactgttgccatggtattggtgtgacgacccgtcaaggttttgcgcaagatgtggaagcagctcctcagcaagctgccccggaagtcgccggcctgcggggattcgggccagtgcagcaatggcaccggtatacagcgcacgagcagctgcgggagcatcccgcccggccgcccggcctccgccatccggcgcatgtcatccgccgtcttcccctcgagtgtcgtggccggtatcgagccgctggtctcgttcaaggatgtccccaactcggagaagcagaacctgttcgtcagcaagctgagcctgtgctgcgtcgtcttcgatttctcggacccgaacaagagctcagtggagaaggatatcaagaggcaggcattgctggatcttatagagtttgtcgagtcgaccaacgctcgcttctcggaggcagccatcgcggcctgctctaggatgtgtgccatcaacctgttccgggcgttccctccgagttgcagatctggctcatcaggtggtggtgagggcgacgaggaagagccaatgttcgaccccgcgtggtgccacctgcagcttgtttatgagctcctgctgaaatttatcggatcctcgtccttggacgcgaaggtagggaagaagcactttgatcactcattcatcgtgaagctccttaatcttcttgactccgaggatccaagagaaagggattgcttgaaaactattctgcacagggtatatgggaagttcatggtacaccgtcctttcatccgcaaagcagtgagcaacatattctaccagtttgtctttgagactgatcggcacaatgggatcgcggagctgctggaggtctttggcagtgtcattagtgggtttgcattgcctctgaaagaagaacacaagatctttctttggagagttctgattcctttgcacaaaccaaaatctgttggtgtgtatcttcagcagttgacctactgtgtaacacagtttctggaaaaggacccaaagcttgcaagctcagtgataattggtttgttaagatattggccgataacaaactgtcagaaggaagtgatgtttctcagtgagattgaagagatcttggagtctaccagccaagcagaatttcagaaatgtatggtaccattgtttcggcgaattgctcattgtattaccagttcccacttccaggttgctgaaagagcgctcttcgtatggaacaatgatcacattatcagcttgattgcacaaaaccgccaagtgatcatgcctcttgtcgttccagcgctagagcagaacattcagaatcactggaaccaggcggtcctgaatctgaccgtgaatgtcaagaaaatgttatctgagatggacgacgatctcttctcgtcatgcctggccaagtacaaggacgaagaagaaaaacgcgtgtcgctagaagcgaagcgtagacttacgtgggagaagctcgagtcagctgcagctttccagccagtgactggccatacagccgtcctagtaggccaccggccgtcagcaaatctgatcgccaccatgatctagctcatgcatgtatgccgaacaagcgaaggtggtgctctcccccccttttggtgaggcgcagcaagtgtagtgttctctattttgctcctgcttattattattttccttttgctggtatgggtaatcagtgtagtagtaagttgtaactatttccggatgtttatgttcttaaggcaaggatacctgtaacttaagactgccgagtgctgacactctacatgtatctttgcctgtttatggatgaacaggtgtcctacagtttaatttcaaaaaaaaaaaaaacaaaataaaaaaaaaaaaaaaaaaaaaaaaaaaaaaaaaaaaaaaaa

SEQ ID NO: 15575 - DNA, 3941 bp, Zea mays
  misc_feature (3677)..(3677): n is a, c, g, or t
  misc_feature (3711)..(3711): n is a, c, g, or t
  misc_feature (3727)..(3727): n is a, c, g, or t
  misc_feature (3745)..(3745): n is a, c, g, or t
  misc_feature (3748)..(3748): n is a, c, g, or t
  misc_feature (3767)..(3767): n is a, c, g, or t
  misc_feature (3774)..(3774): n is a, c, g, or t
  misc_feature (3781)..(3781): n is a, c, g, or t
  misc_feature (3788)..(3788): n is a, c, g, or t
  misc_feature (3790)..(3790): n is a, c, g, or t
  misc_feature (3793)..(3793): n is a, c, g, or t
  misc_feature (3800)..(3800): n is a, c, g, or t
  misc_feature (3815)..(3815): n is a, c, g, or t
  misc_feature (3828)..(3828): n is a, c, g, or t
  misc_feature (3833)..(3833): n is a, c, g, or t
  misc_feature (3837)..(3837): n is a, c, g, or t
  misc_feature (3839)..(3839): n is a, c, g, or t
  misc_feature (3841)..(3841): n is a, c, g, or t
  misc_feature (3856)..(3856): n is a, c, g, or t
  misc_feature (3865)..(3865): n is a, c, g, or t
  misc_feature (3871)..(3872): n is a, c, g, or t
  misc_feature (3881)..(3881): n is a, c, g, or t
  misc_feature (3894)..(3894): n is a, c, g, or t
  misc_feature (3898)..(3898): n is a, c, g, or t
  misc_feature (3900)..(3900): n is a, c, g, or t
  misc_feature (3906)..(3906): n is a, c, g, or t
  misc_feature (3908)..(3908): n is a, c, g, or t
  misc_feature (3915)..(3916): n is a, c, g, or t
  misc_feature (3919)..(3919): n is a, c, g, or t
  misc_feature (3925)..(3925): n is a, c, g, or t
ttgagaacaagtccccaacaatagccttatagaaaaggtgtacagtcgccctaagcactgcgcctttgtgacggtagcctacgcctcgttcagcaaatgtcctttacaagtactgggcagggaccatggcgccaatataatgagggcaatgagcgttcgaatcagtcatctgtcacactactaactaggcatgaatgcgtgcatgatggaggccctggaccggagttgccaagacggtcagaactgaagaattgccggaggagctcgtgttccgtgattgtttttgcatgagtatgcctgcactgcactgcaccctctcattgcacaactgtgacggatgggcgctggttccgcacatgccgagtgtctgctgccacgctctcccgacgccgagccgagcccgcggccaactacaggcaagcacgctcgcgtccctgcagcgcggccggcaggccccctgcggcgggacagcgacggagccggccagccggggctgctggtccggcccaccgcacggccgccgctgaggtcacacggtacgcgggcgcggccgacccatctgccccctccgtccccgcacccggccgacggacggccgggataatccctccccgcccgtgaccacgtctcctttcgaattaaagcgccgtgcccacccaaggacgggggcgccggaccgccgattaaagcctgcggtttgcacatgcacccctgcgttcctgcgcaattacgcccgtttaatcgtcgacaaagcgggagcaattcccaagtaaagccaggatcctcttcgatacagaagctgtgaatccacctcgcttcttgtctcattgccacctgggccccatacgttagggtgcaaaatgaaaaaaaagaacacagttttctctgaaagaaaaaaaacctagatccgtttttttcttggattagagttaggagagctgtagacaaagcccccgccaccggatttggggtgatgagatttcgcttcatctatctgcacgggcctcgtgagccgtacaccgcagaccgtcactttaattgcttctttgtccgtacatgccccgtgataaacaaaccattccccgcaagaaacagcaaacaggcacagccctcccctcctccactcctcgccctctctctctctctctctctcatcccgtcccgagaagcggacaaagcgcggcgctgcagatttcgatccggttcccaatgcctcccatgctcgccgtcgccccgtgctagctcctctcccgtctccgcttcctccacctgccgcgccagcgccacgccgcctggatccggcgagcgcgtggccgggagcctcagatccgagcgaaacccagccttcccgtggtgacggccttcgctctagctccagattggctggcggctgccattcctcctcctcctcttctcgctcgaggtttcaaggcgggtccgttcagctctggtgggttttcgggtttgctcatactttttcttcggttggtttgcttcagcgtggtccagatttagctgcattttctcgggctgtgttttttctgtgccagaaatctacggaggagtcttgccgccgctttaaacgtagaggtagagctgtagtatatattttggcgagtaatcctgcttcttgctccgttcccgtgctagtgctggcgtgacagtggaaaggcttactgttgccatggtattggtgtgacgaacccgtcaaggttttgcgcaagatgtggaagcagctcctcagcaagctgccccggaagtcgccggcctgcggggattcgggccagtgcagcaatggcaccggtatacagcgcacgagcagctgcgggagcatcccgcccggccgcccggcctccgccatccggcgcatgtcatccgccgtcttcccctcgagtgtcgtggccggtatcgagccgctggtctcgttcaaggatgtccccaactcggagaagcagaacctgttcgtcagcaagctgagcctgtgctgcgtcgtcttcgatttctcggacccgaacaagagctcagtggagaaggatatcaagaggcaggcattgctggatcttatagagtttgtcgagtcgaccaacgctcgcttctcggaggcagccatcgcggcctgctctaggatgtgtgccatcaacctgttccgggcgttccctccgagttgcagatctggctcatcaggtggtggtgagggcgacgaggaagagccaatgttcgaccccgcgtggtgccacctgcagcttgtttatgagctgctgctgaaatttatcggatcctcgtccttggacgcgaaggtagggaagaagcactttgatcactcattcatcgtgaagctccttaatcttcttgactccgaggatccaagagagagggattgcttgaaaactattctgcacagggtatatgggaagttcatggtacaccgtcctttcatccgcaaagcagtgagcaacatattttaccagtttgtctttgagactgatcggcacaatgggatcgcggagctgctggaggtctttggcagtgtcattagtgggtttgcattgcctctgaaagaagaacacaagatctttctttggagagttctgattcctttacacaaaccaaaatctgttggtgtgtatcttcagcagttgacctactgtgtaacacagtttctggaaaaggacccaaagcttgcaagctcagtgataattggtttgttaagatattggccgataacaaactgtcagaaggaagtgatgtttctcagtgagattgaagagatcttggagtctaccagccaagcagaatttcagaaatgtatggtaccgttgtttcggcgaattgctcattgtattaccagttcccacttccaggtaacatgcccccgacaaatctaatctaataagtgtttcagttgcttgttgcagtatgcatctcagtaacccaggtgccatatggaattaggttcattctatattacttgcacctaccacttctactataaacctaatcttattggtggcaagtctggaaaaaaaggagtagatataactcaagcagactcggacaaccaggttattttagtcccttcatgtgactagcatttgaaggtcataatttgtcaacatgccaaatgaataaacatctgaaataattgtggacactaacaacagtgggcaatcatgtcacagtcaccactaaatcatgccatgcataggcccccctatatgctgtttaatatggaaaacatcagatacttggatttggaccagcattaagcattggaatggtctaaacataaaaacacagttggatgctctgtctttaaggtttgccttaacagttggcagttgctgccttaacaaatcctctatgttggcagttttgttgtcgtcgtcgttgccctaacaagttgcattgtttcaggttgctgaaagagcgctcttcgtatggaacaatgatcacattatcagcttgattgcacaaaaccgccaagtgatcatgcctcttgtcattccagcgctagagcaaaacattcagaatcactggaaccaggcggtcctgaatctgaccgtgaatgtcaagaaaatgttatctgagatggacgacgatctcttctcgtcatgcctgggccaagtacaaggacgaagaaagaaaaacgcgtgtcgctaagaagcgaagcgtagganctttacgtggggagaagctcgagtcagctgcagntttcccagccattgantggccatacagccgttcntanttaaggccaacgggcgttncagcaantcttggntcggcancntgntcctagntccatggcatgtatngccgaacaagcgnaagtngtgntntncccccctttttggtnaagggcacnagtgtnntgttccccnattttgccccggntatnanaaattncncttttgnnggnatgggnaaccatgtagtagtag

SEQ ID NO: 15576 - DNA, 839 bp, Zea mays
cattgggtacctcgaggccggccgggaatcggcacagccctcccctcctccactcctcgccctctctctctctctctctctcatcccgtcccgagaagcggacaaagcgcggcgctgcagatttcgatccggttcccaatgcctcccatgctcgccgtcgccccgtgctagctcctctcccgtctccgcttcctccacctgccgcgccagcgccacgccgcctggatccggcgagcgcgtggccgggagcctcagatccgagcgaaacccagccttcccgtggtgacggccttcgctctagctccagattggctggcggctgccattcctcctcctcctcttctcgctcgaggtttcaaggcgggtccgttcagctctgaaatctacggaggagtcttgccgccgctttaaacgtagaggtagagctgtagtatatattttggcgagtaatcctgcttcttgctccgttcccgtgctagtgctggcgtgacagtggaaaggcttactgttgccatggtattggtgtgacgaacccgtcaaggttttgcgcaagatgtggaagcagctcctcagcaagctgccccggaagtcgccggcctgcggggattcgggccagtgcagcaatggcaccggtatacagcgcacgagcagctgcgggagcatcccgcccggccgcccggcctccgccatccggcgcatgtcatccgccgtcttcccctcgagtgtcgtggccggtatcgagccgctggtctcgttcaaggatgtccccaactcgcagaagcagaacctgttcgtcagcaagctgagcctgtgctgcgtcgtcttcgatttctcggacc

SEQ ID NO: 15577 - DNA, 1198 bp, Zea mays
gtgatgaggtcatggtggacgtagaagaagctattgaaggacaacctgaagtcaatggagtttccaatcagttgatcaaaactctgaatatcactaaagatggctcaatcagctacgtaggccccccccccgattcaacagcacaagaatcatttttggaggcggtgaagcccagtggtcgtatcaatgcatgcttggccgtagggaaagatatgctctacttgtatggaggaatgatggaagtgaaagatagagaaattactcttgatgatctatattcacttaaccttagcaaacttgatgagtggaagtgtatcatatcggcctcagaatctgaatggttagaaatttctgaggaagaggagatgatgatgatgatgatgagactgatgatgatgaaaatgaagagggggatgctagccagacagatgaagatgaagaagagtctgatgaagatgctgcaaagaacgtgtccagtgctgtgtctctgctgaagggtgaaagtaagaccatgcgtagaaaagagaagcgtgctcggatagaacagatcagggtcatccttggcctttctgattctcaaaggactccagtgcctggagaatcactgagagatttctacaagaggacaaatatgtactggcaaatggctgcctatgagcacacccaacacactggaaaggagctccgcaaagacggttttgatctcgccgaaactcgattcaaggaactgaaaccgatacttgacgagctggctgtgctggaggccgagcagaaagctgaggaagaggccagtgcgtcgactagttccaagagggacaccaagaaacccaagcagaagagcgcacgaaggtagctttggttctgaacgagtgtgtaagcggaagccagctttagatgaagttgctccaggaagaggccagtgcgtcagctagtcccaaggtgtgaagaggggacaccaagaaaatccaagcagaagagtgcagggagatagttttggttctgaacgagtgtttaagcgtaagacggttttaaacgattgctccaaatgctcaagttccttagaggggatttccattttctttttgaacccaagtagacaaaattgatatttgttgttttataatagtgtatgtatatactcgtacgttgaaatttgaattcatgtgcaatcttgacagcaaaaaaaaaaaaaaaaaac

SEQ ID NO: 15578 - DNA, 2389 bp, Zea mays
aaccgccgaggatatgtttccctcaccttcgaccaccactaacctctgcatccgcatctctctctctcgcgcgcgccgcccttcccagcgccgtcggctgccgctcctcccctccaccgccgcctctgctccgcccgtcctcgcgccgtcgcgaccgctgcggcttcgtctctccccattgtctgtcccctctcaacgcactctacgacggaccgatgacttgacggatctgggggtttgtctagggtgggtgaacggaaggggatggagttcacggagtcgttcaagcagacgggcccgtgctccttctcccccgactcgcgcttccttgctattgccgtagactaccgtctcgtcgtccgcgacgtactctcactgaaggtggtacaattattttcatgcgtggacaagataagctctgtagaatgggcaccagattcagaatatattttatgtggactttacaagcgacccatggtgcaagcttggtcactgagtcaacctgattggacctgcaagattgatgaaggtccagcagggattgcatatgctcgctggagtcctgacagtcgtcatatattaactacatctgagtttcagctccgtctcactgtgtggtctctcgtaaatacagcatgcgtacatgtccagtggccaaaacatggttctaaaggtgtttctttcaccaaagacgggaaagtttgctgcaatctgtaccagacgtgattgcaaggattacattaatttactatcatgtcactcttgggaaataatgactgtctttgctattgacacggtagacttagctggtgttgaatggtcaccatatgatagtgctattgttgtttgggattcacttcttgaatataaggttctgatatattcgccagacggaaggtgcttgttcaagtatctagcttatgaaagtgggttgggtgtgaaaactgttgcttggtcaccatgtggacagtttttagcagtgggaagctatgatcaagcagtacggactttgaatcacttgacgtggaaaacttttgcggagttctcacatgcagggtatattcgtagtccttgcaatgctgctatatataaggaagtggatgacccatggcagcttgatatgtcagaattatgtctaagtgaaggcctctctcgaaacatgccagacaatggtgcagaaaatggcaccgagggaggaggctctagagttaaatatgctgtgatggatgttcccatcaccttaccttcgttgaaaccagcttttgacaagcctaaccccaaacaaggcattggtatgctgtcatggagcagcgacagccactatttcttcaccaggaatgacaacatgccaactgttctttggatatgggatatatgccgccttgagcttgccgctgtgctcgtgcagaaagatccaatccgtgctgcagcatgggaccctacctgcacacgccttgttttatgcacagagagccctcacttgtacatgtggacgccatccggtgcctgctgtgtcaacatcccctttctgaacttccgaatcgttgatttgaagtggagctcgaatgggagctgtctcctcctgaaggagcgcgaatctttctgctgtgccacaatcatatctgccctgcctgaggaagaacctgatcattctgatgatacttctgaagatgaatgagtggcctcatggtatgtctagcagcttatgcgaatggaactgggaactaacagtacaaatgatcttgtgatggtgaatgagtgacactgactgactacttagctacttgtagaatccagagtggattgcgataccatgaatcgataaggtcatttcgctgcttagatggcaaatgctctatcaccaggcactacagaatggacagagaactgtgtggttctatttgttgtattcttgctcttgtttgtctgttgtagtttctccaaggttgtactgcttgaccttacttgttggatcttaatcttacatatccagtcaccagggtattttcataaaaaaaaaaaaaaaatacttatcttactagcgtttttgccctctcgttgaagcgtggggttgttgagccgctgaagcagcgaagcgtgccaaaatgtgatgacgacgaggcgcccatgacatttctctatttttttttgttctgacgccaaattcttcggttatgggcttatgacaaatttaggaaacatgggcctctttggtatggctccagaactactatgagcttgtttgatatgactccggaacaaaactctaaggatgagctgtccagagcatgtcaaacatcctaactccagagttgtaaactctacgaagtttttggagctacacattctaactccagagttataaactctatgaagtttttagagctgc

SEQ ID NO: 15579 - DNA, 2013 bp, Zea mays
ttttttttttttttttgggtgtttacatattactataaatttacttagagatgattatctactaagatttacaagtatatttatagtcgtagagccatacaatgagtagggaactctccggccatatctccctggtgccctttgtcatgcacaacctctcccagttgcacaaactgaattccctatacctcccatgcctatccttccctatacagcctgtaggcttgtcattggtttttctccctcgttttaacaaatgtttttgcaataagaccactatatatatatatactgttcctagcatgtgtgtttaaacgcaacggtcaagctgaacttgttcaacaaaattcctcatgggtcttctccaaaggtctacaccatttcagctgcatgaaacaaaggtaactgactaactgaaagtaactaagacactctttctgtctttcaaccttatcaaactacagggatgcagaacatttgtgtggtcacctgtggaacgagctgctttcggtctcttattatatactcctagctagaggtgcaaggtagtttatttaccagcaacacataaaaggaataattgcagaaaatcatttcagtctcttatatagatgacatggctgtatttctgccacgagttccctatgcttcttaattacgcccagttctacaacaaccatatttaccccttagcagcatgctgatcttgaaatcagaagcctgtatttttttagtatctttttttgtttctacatatgcttgtcaaaggccgagcgagtgcaaaatcctcactgatatgtcatgaaggtggcaattgatagccattaatagctcagacatgtgttggggtaaatatgagcgatttttctcatcatggctattctgcttcacaggttccccatgcatcccaagccaatatataatggtgtagttttgaagcacatatgaactttctctccataaaattggagtgtatcgatcagttaaggtggagcaggctacatatcaatatatcatggacatcactgagtcgtctcgccattttatttcacgcctaccacaggacaggaacatttaggatacataatgcttagaactttgaataaatgaacaaagaactagagcagctctatttattagtgcctcaggaaagttatctgcttgggatccaaaagtgctgacttgtttaaattgaagataaaattagaaattgttaatagaaccaatggctcacattatatttattttagtttgaaaatattgcaattcatggacgtaaaacatgttgagatatttggtgattccttactgataatgcaacaagtagctatatagaatttcgatatttagaggggtcactcgacatttattttaatgcatgccttgatattattacttcttttatcgaatttcagatatggcatattccaaggtatatgagattataaggaaaacatgttggctcaataggcatctagcttcgatgttactgggcataacttttctatcaaagaaaagccaatgcctatttgactttgaacggtccaagccagttttagatgttagacaggctgactttggtagtatttgtgcacatgagataaactcagccaagccaactccaaatggtggcctagcttgactacccaagctaggctggcttctgaagtcggctagccgcactttctcgttgaagacctaaatctgctaaaattttaactcttgttctcgtaataacatatttatataatccaagtgctagagtggctagaagtgttgcacggagtgcatttaaatttgtgttgtacaatgatgaattataccaaagaattgtcgaagacttgttgtgtaagtgtttggcttctgatcaagcaagagtagctatgggacaagtttacgaagttatttatagtatgcatcaataggctccaataatgaaatagctattgtgtagagatgttttttattagcctactatgatgacaatttttttgcttaaaaaaaaaaaaaaaa

SEQ ID NO: 15580 - DNA, 2565 bp, Zea mays
tcttaaatagcactgtgctcagtcaggcagttgtttgagctccatgataaaaaacaacagaatagatttacctttccaaacgatccaatgggtcctcaagaagagacacaatgacagtcactgcaacattgcgtgtcagtgcagccttcaaatcccacagatactctatctgttgtgcaacatcctcagacgagggctccacaggcattgtaaggaacaccaatactttcactaagatacaaaaataaagcggaaagccttagcaatagggcgctacatcagaacgccataaaataaaggtatttgaatatgtagtttcagagctatattagtggggaacaaagatacagggaatatcggagatgctattcacaatgaaagcccatacacataactttcgtatttcaaagaatcaaagtggaagaacagttacttgcagtgatgacaagattgcggtcggcctggtaattctcgatgatgggcaccagatccctcgacgcaatcttccacttgcagacctgcttgaaaacctcccgccgctgcgggtcgtcccgtcgcaggaatctctgcagatccttcagattatcttcacaaatgaaaacaaacgcgcgcgcagcgaaattagccaggaaacactcgccagccgatcagaaatggggacggggtcaaaaccgatgccatcgccgaagaaacgcaggaggcgggggtacctaagcagtggtcgctcttggcgtagccgatgacggccccgtcctcgtcctcctgcgaggcgccgaggcccgcgcaggtgagtgagagcaccgccgagtccatggcggcgcacggtagggtttagccgcctggccggtgcgcgcagttgaagctgaccacggtcggacggatgcggagcgaaggcgacggaggggaagttagaaggatagatgcgcaacggaggatcggagcagagagtgacccgagtggggaacagggagaggcagcgagatcggttgctgggtgcagatgagaatggggaattttcccgccgccgcgcgctatttcggggaggattttcccgcgcttttgttccgcttcgctttttttcccctcccgctgtttataggccggcccatttagaagcctaaaatttgggctagaaggctccggacaattaggcctataactgacagcccaacagacggataaggtaaaggagaggaagtaaggagcagcagccggacgcgtccatgcccatggccctctcgagctcgctccgtggcctggtggccctgattccaccggccctccctcccgctcgcccgagcggggcagcggcggcggccccggcaccccgcgcgcggggtcggacggggagaggggcgggggtcgtggcgctggcggcggcgctgccgtcggacgcgcagtggctggagcggctgccggagaagaagaagcctctgtacacgcacagcctgccgtgcatcgaggcgtggctgcgcagcctcgggttcacgcagtcccgcgaggaccccgccgtctgggtcgccgagaagccgctctggcacgcgcgtctcagcctcgatgtcaccgacctccacatcaggtacagtaatgcaaaccgcagattagtgccttcaagtcttgctgcgtcgatgtcttctagcttggttggggggttcaattcatgctcgtagtctaaccaaaatgctcccgcgttctgatgatccttggctgtgttagtgtcagtgccctaccccttttcagctactctctgagttacaagaatcaacagtcatcgaatcactgttaatatgaatcgctgcccgattagtgtcagttgtgtgtgaattgaaggcgaaagcgctaacattatcttcaactaggtacttgaaaagcggccctggaaatcttgacaaggatatggagagaaggtttagctacgccctaagcagagaagacatcgagaacgccatactcggaggaccttaagctgaacacatggccaaggggctcagagctaggaattgcttagtcgaggttggcactgaagaaataatcgctccagtgatctgcgtgctaccattacgccattgtaagagcaaatggatcatgtgtcgagaaataatattcatgagcaataatctcgaactaggctggaaatgttggatgcctcctggtgacatgcgcctggtttgttggcctcgttgtgtcaaatctgcctttgagccgaaacttgctcatttgtgtacggcagaatagtgagcttttctactctctggtgatgtgatcggtggcactagaacccatgtaccaaacttggatcagtctaacaagaacacgtgcagaagtagcacgtttttacccaggacagtgttttctgatctacggtttttgtcaggagaacgtatcctgtagctcttgtgctcatatgatcactttgaatttggtgccttcatttctcatccaatgggtgtggacagcagtgagacacaaaagagacaggcggcgcggcgcaacaagagcggtcaagggtgacacacagaagaaactagaaattgtttattcaccactatgagaaataaagacacc

SEQ ID NO: 15581 - DNA, 925 bp, Zea mays
gtaccctccgggaaggaggggacggggggtcggaaggaaggagcagcagcaatcgacgtctatgtccatggccctctcgagctcgctccgtggcctggtggccctgattccaccggccctcccttccgctcgcccgagcggggcagcggcggcggccccggcaccccgcgcgcggggtcggacggggagaggggcgggggtcgtggcgctggcggcggcgctgccgtcggacgcgcagtggctggagcggctgccggagaagaagaagccgctgtacacgcacagcctgccgtgcatcgaggcgtggctgcgcagcctcgggttcacgcagtcccgcgaggaccccgccgtctgggtcgccgagaagccgctctggcacgcgcgtctcagcctcgatgtcaccgacctccacatcaggtacttgaaaagcggccctggaaatcttgacaaggatatggagagaaggtttagctacgccctaagcagagaagacatcgagaacgccatactcggaggaccttaagctgaacacatggccaaggggctcagagctaggaattgcttagtcgaggttggcactgaagaaataatcgctccagtgatctgcgtgctaccattacgccattgtaagagcaaatggatcatgtgtcgagaaataatattcatgagcaataatctcgaactaggctggaaatgttggatgcctcctggtgacatgcgcctggtttgttggcatcgttgtgtaaaatctgcctttgagccgaaacttgctcatttgtgtacggcagaatagtgagcttttctactctccggtgatgtgatcggtggcactagaacccatgtaccaaacttggatcagtctaacaagaacacgtgcagaagtagcacgtttttacccaaaaaaaaaaaaaaaaaatttgcggcc

SEQ ID NO: 15582 - DNA, 1870 bp, Zea mays
acccacgcgtccgattagttgatattatttggtttacatggagaatgaagcttttgtctgggcgaagaggggttgctatactgtatgcttacatgttcctaggtcttggttttctaagagctgtgtcccctgactttggggatcttgcaaaccaagaacaagaacttgaaggcacgttcaggttcatgcactcaagattgcggacacatgctgagtcaatagctttctttggtggtggatcaagggagaaagctatgattgacgctaaattcatgacattgctcaaccactcgaaggttctattgaggaagaagtggctttatggtatttttgatgattttgtgacgaaacagcttcctcataacgtgacatgggggctgagtatgttatatgctttggagcacaagggagaccgagctttgacttcaactcaaggagagttggcacatgctctgaggttcttggcatctgtggtgtcacaaagcttcatagcgtttggtgatattcttgagttacacaagaagttccttgaactctctggtggtattaacaggatatttgagcttgaggagcttctacaggcatcacaaagcaatcctgtcatgccttctgatgccacaaatgccggttccgaagaaataatttccttccgtggcgtgaacattgtgacaccatcgcaaaagctattggctagccaactgtcttgtgatgtatctcaagggaaaagccttcttgtgactggtccacctcgtggccggccgggttccctctttagggtgcttcgaggcttgtggcccattgcttctggtagtcttagcaagccatctgaaggaatttttaatgttcctcaacgtccatatacttgtcttggaaccttgagggatcagatcatataccctctctctcacgaggaggcaaagttgaagatgctctcaggcgaaacaagtgacaagtctacagcttccgagctgttggatgatcacctgaggacgattctagagaatgttcgcttgctgtatcttctggagagagaaggttgggatgctaccactaactgggaagatactctatccttgggagagcagcagaggctggggatggctcgtctgttctttcactgtcccaagtatggcatcctcgacgagtgcaccaatgccacaagcgtggacgttgaggagcatctgtacaggctagcaaccaacatgggcataacagtcatcacatcctcacaaaggcctgctctgattcccttccattcgttggaactgaaactcattgacggcgaaggaaagtgggagctatgttccatccaccaataaccgattgacatcaaccagtttatttatgttcatcggagtagggtatttacaagttgcaacgcacagagaaaaaaaaactcgtccactcgggtgtagagtgtgtgacggagtcttttttttttttggtttcccttttctttttctctcccctttgatggaaatcttgcgatacggaaagggagggaggaaggaaatatacggcaggaaaggaaagtattaggagaggttatagatgcaggcttcgtcatttgggatagcatagtacatgttcctggcatgatatgccagcctgattgatttttatacgagatacagaataagttaaaataaaaatggatatggcacaaagtgtgcccttgtaaattaaatgggaaactaatctataggaaattcatcctctctgtgtcgcccttgcatcgaacgtatcccaatccatatgtaatggcctaatgagaagataccatgtgcaatcactcatatttgcgagaaaaggaatcggcaattaaaatactacacattctgtgaaaaaaaaaaaaaaaaaaaaaaaaaaa

SEQ ID NO: 15583 - DNA, 3333 bp, Zea mays
ccgggtatagggtttttagcgccgcctcccacctccaggtcccccactcttccgcggttccgccatcgcgtcgcgaacggcggccagaaaaaagaaaaagaaaaaaaaaaacagctcgccgcaccaatctcccctaccatatcgatcgaccctgcaaggtttaatccaacagaattccaccggaaatttggtgaagtgctaatcgcttgcggcttgcctgcccggtctcgtggctttgtgctgctcccgctgtggtgaggaaccctaggatggcgggggtttcgatggcggcggcgcctgagggggtgctgcaccgccggattgagtttcatcttgcacggagaccgcatggctctgtggcggtgggcggcggcgggttccggatggagacgctgaacccggacgccgctggtaaggtggggcccggggaggcggtcgggagcagcgagggggatgcgaggaggccggagaagggagacagtggcgggatcgatccggagctcagcgtcgcaaggatctacctcgggagaattggtgctggattggaaaatcttgggaatacctgctatctcaactcagttctgcaatgcttgacgtacacggagccgttcgctgcctatttgcagagcgggaagcacacgtcctcatgtcgcacatccggattttgtgcattatgtgctcttcagatacatgtcaagactgctctagaatcaactggaaaaacagtgacaccatttcgtattgtcaagaacttgcgctgcatttctcgcactttccgaaattcaagacaagaagatgcacacgagttaatggttaatttgcttgaatccatgcataaatgctgtttaccttctggggtatcgactgagtctcaaagtgcttatgacaaaagcttagttcacaaaatatttggtggccgccttagaagtcaggtcaaatgcacacgttgcttacattgctccaataaatttgatcctttcttggatctcagtcttgagattgccaaggccacgactttggtgcgggcacttgaaaattttaccgaggatgagctactagacgagggtcaaaaggaatacgagtgtgaacgctgcaggcagaaagttgtagcaaagaaacgacttacaattgataaagcccccaatgtcttgacaattcatctgaagcgcttcagccctttcaatcctcgtgagaagattgacaaaaaagtggacttccaatcaattcttgatttgaaaccatttgttagtgactctaaaggaacagattttaaatacagcctttatggtgtcctagtccatacaggttggagcactcaatcaggccattactattgctacgttcgtacatccagcgggatgtggcacaatcttgatgataaagaggtgcgccaagttcgtgaagcagacgtattgaagcagaaggcttatatgttattttatgtacgtaacagtattgggaagtcggtggtgtgcaaagataataatgctgctaatttgctcaagaagaaaacctctgaaaaaatctcaagtttgaatggtattgcacaaaccaatgtaagagcacaaaatttgaatggtgtgtctccatttggtgataagacgcacggcacaatcattggctactctacaatttccagcaagactaaaacaatccactgttcaaagaatgaggtcaaagctgaagatgctccagcctctcaaaacaatgctctaccttccacacaagcccccatagctcgaaatgatgttggtatcttgccaactaaaccaatgcagtttgctgtaaaaaatgaggagaaaacctcatcccaccaacctgcgccatttacaaatacttgtggtgaacaaacagttgttgggaggcccttgcaggaaatggaacctaaggctggtgcaggggaaaatacttctgttgtctctgctgttgctaatgatgccgctacattgtccaaggcagacaaactaacttctcagcctcaaacagctccatcttccaagccaactgccaatgtaaaggacacagctactgagtttgctacactgtctttatcaaagaaggattctgttgtttcaaatggtgctgtgcttagcattggatgtctcacatccggtgagaaagcaatgaacttatcagaatctgtggatcaagctaatgaaatcacaaaggcacttcctacgagtcagaacaatactgcaccagtaattgctcaagcagattgtggagtagagatcagctctggtgtcatcatgcacgttgctgtgtctgcttcatgcaatggaactacagagaaaaaggtgaattcgaagtcaaagaagtttgtgaggtatcctgttgtgaacatgtggttagggtccagacatctaaagccagggaagaaagcgaaccgcaagagaagtaaaatgataagacgtgttgtagcctgcaaggacgcggcaaatttatcttgtttgagtgagcagctgacgtcaacatcgtccactgcatgctctgaaaccgtagaatgtacctccagccatcagaaacggtcacatgctagtgcaaggtccaaagatgacgcccagtcctcgcaaaacaagcagaaggtcgacggagctcgtgtcggtgctggcacaagtgcaccttcttgcagtgccggcgttccaaagtctgatccgaactcttccacagatgctaaggttgtagcgacccagcctgccagtattcgcgcaacggacctgatggaagctaccgttccgcgctgggatgacgtagacgtgccaaatataaaggtcgctgagccgcagtccaaacgcaagagcggtggctacatcttagatgagtgggacgaggagtacgaccgagggaagacgaagaaggtgcggagatcaaagcaagactttggcgggccaaacccgttccaggaggaggcggactacgtatcgcagcggaggacgaagcagaaatcctaccgaggcaagtcttggaacaagcgggcctaacacggtagtagagggggagttgagagaatacgcgagagagaatccctggacgcacatgctgtttgttgttacgttttagcacccattggtgagggagatttacgtttaaaaaccatatccgtcgtcggtacggtagtccccattagttgtcgacgatatgacgttttgggcagttttcgtagaacatttgaaacatttgttctgtttagttgagttggggggaacaaaattggcgagactattttgctgcattctgctctgttgtttagttactgatgaagaataaaacgatggtggtgatcagttttatgattcagtgcttgccaatgcgatctttatccttttgggaagt

SEQ ID NO: 15584 - DNA, 5612 bp, Zea mays
  misc_feature (3)..(3): n is a, c, g, or t
  misc_feature (16)..(16): n is a, c, g, or t
tgnacataaaagtggnaccttccaatcagtgtctgtggtgtggaaaccatttgccacgcgccctaaaggaacagattttaaatacagcctttatggtgtcctagtccatacaggttggagcactcaatcaggccattactattgctacgttcgtacatccagcgggatgtggcacaatcttgatgataaagaggtgcgccaagttcgtgaagcagacgtattgaagcagaaggcttatatgttattttatgtacgtaacagtattgggaagtcggtggtgtgcaaagataataatgctgctaatttgctcaagaagaaaacctctgaaaaaatctcaagtttgaatggtattgcacaaaccaatgtaagagcacaaaatttgaatggtgtgtctccatttggtgataagacgcacggcacaatcattggctactctacaatttccagcaagactaaaacaatccactgttcaaagaatgaggtcaaagctgaagatgctccagcctctcaaaacaatgctctaccttccacacaagcccccatagctcgaaatgatgttggtatcttgccaactaaaccaatgcagtttgctgtaaaaaatgaggagaaaacctcatcccaccaacctgcgccatttacaaatacttgtggtgaacaaacagttgttgggaggcccttgcaggaaatggaacctaaggctggtgcaggggaaaatacttctgttgtctctgctgttgctaatgatgccgctacattgtccaaggcagacaaactaacttctcagcctcaaacagctccatcttccaagccaactgccaatgtaaaggacacagctactgagtttgctacactgtctttatcaaagaaggtttgtaagacggttgctgtatgtttttaaataaaatttgaaggattcatatatttatttattaaattccaggattctgttgtttcaaatggtgctgtgcttagcattggatgtctcacatccggtgagaaagcaatgaacttatcagaatctgtggatcaagctaatgaaatcacaaaggcacttcctacgagtcaggtagcaccccacttctcccttgctgttgcttttttgcagacgaactaagttataatagtaccacaattttgttgaacatgagctgttttttttaaatatttgttatacatgtccctgtaaacagaacaatactgcaccagtaattgctcaagcagattgtggagtagagatcagctctggtgtcatcatgcacgttgctgtgtctgcttcatgcaatggaactacagagaaaaaggtgaattcgaagtcaaagaagtttgtgaggtatcctgttgtgaacatgtggttagggtccagacatctaaagccagggaagaaagcgaaccgcaagagaagtaaaatgataagacgtgttgtagcctgcaaggacgcggcaaatttatcttgtttgagtgagcagctgacgtcaacatcgtccactgcatgctctgaaaccgtagaatgtacctccagccatcagaaacggtcacatgctagtgcaaggtccaaagatgacgcccagtcctcccgaaacaagcagaaggtcgacggagcccgtgtcggtgctggcacaagtgcgccttcttgcagtgccggcgttccaaagtctgatccgaacccttccacggatgccaaggtggtagcgacccagcctgccagtattcgcgcaacggacctgatgggagctaccggtccgctcatcttctctcggcagatgctcaatctattttagagatgaaacgtgctgctgtgccgtcagttctaactgtgctctatcgtttgttgatgttcagttccgcgctgggatgacgtagacatgccaaacataaaggtcgctgagccgcagtccaaacgcaagagcggtggctacatcttagatgagtggtgagttttatctcttgcagtattcatgtttgaagcctcagcggtgtactaatattctgtcatgtcctgtgattacatctacttactaatattctttcatgtcctgtatccatgtttgaagcctcatcggtgtacttcagacttcacaattttctttcaagggaacagatacttggttgagcttacgttcacttggcctctctttttttttttacagggacgaggagtacgaccgagggaagacgaagaaggtgcggaggtcaaagcaagactttggcgggccaaacccgttccaggaggaggcggactacgtatcgcagcggaggacgaagcagaaatcctaccgaggcaagtcttggaacaagcgggcctaacacggtagagaggggggagttgagagaatacgagagagagagagagagagagagaatccccggacgcacatgctgtttgttgttacgttttagcacccattggtgagggagatttacgtttaaaaaccatatccgtcgtcggtacggtagtccccattagttgtcgacgatgtgacgttttgggcagttttcgtagaacatttgaaacatttgttcggttgtaacggagtgctgtttagttgagttggggggaacaaaattggcgagactattttgctgcattctgctctgctgtttttagttactgatgaagaataaaacgatggtggtgatcagttttatgattcagtgcttgccaatgcgatctttatccttttgggaaggaaaaaaaaaatccatctttgcaatttggaatgtaattctcctcctttttctttttgactgtgctgtaactgtaagtgcagtagaaggccgcaaggcaaggaaaccagaccggtggcgcggtgttgtagttgtagctggcgatcccacttgtttttattgtttttgaagtaataataatagcaatagcaggtgatcccacccgttaatggcgagcggggcagtacgaggcagttcgacaagctggattggctggagctggattggccctcgaccggggagtaattgcggcaacgggcaagtgatacggcggtcgcgcggcggcggcgtgcgttggtctgtctggtcctgctctcagcctccccccgcccgagggatcggatccgtcttgggattcagctccggtacggtggcttgggacgccgcttcaatgcgccatcgccggtacctctggcccgccgcacgccgtgcagtgcagtgcggtagacgccggccgcttgcgctgggaagtttgaagcggcgatggatcacatggatgggcgaaatatgtcatggatggactgcactgcaatgcaatgcaacaactaaccctcctctgttgtaaattgtgaaacgtctgtccaagtaaaagttgcactgttttaattgtggtgtctgcagtacagcatattgcacctaataataaacacacggtgaaaatcagaacgttttttttttgtaatttgaacacaaggacgttggtgaattgaactattgaaaaaggcctgcatgcgcgcgtgcgcccgtcccgccccagctggtcctccccatgctgcagccaaacgggcagagacccacccaatgacgacacgtgcacatatacggctagcagaaatgaagtgaagcagaggggggtgatgatggatgcacgagtgtccgcagttcgctcagcctggtcgatcgagtacgtagcacacgcgcatcgtcgtcgtccatgcatgcagcagcagtggtatgtagggccgtagggggggagggcgtattaaaccgccccgtgcacgagtaaatgtgtcgcgcggggcctcacgcgttccctatgatcgacgacggggcgcgcgcgctctcgtgtggcctgctggcggcggcggcgtcgtctcgcgcgcgcgacacggcctccgtcgtcctcatcacgcacgcacgcgctagcttgccgagacgtggtcgtcgtcgttactgcaaatgattcttctctctcccccctccgccgtagtccgtacgtccatgtccatctgtacaactggatgtcatttccaaagctacgtacccgcccccggcccccgactcccgcgcgcattgatggaagtgatcatcgtcgtcatccatgattgcctgccggccggctcgacgatggacgatgatcaatgatgcagggtggtgcgcgcgcgcagcattgatatgccggatcgatcggagagatccccggcccggccggaggggggtttcaaaatccttcgtatagcgcgcggaaattaaaattctcgatcgcgcgcgattgaagtgcatgctatgcacgtgacgcgcgcggtgttcgttcgttgctgcccgcgctagctactagctccacgtacgtacgctgaggggtttacgtacgtacgcacgcatgcacacacgagaaggaaggaagcacgttggaagtggtggagccacgcacacgaatccctccctccctttcttcgtgtggctggccggccggccggccgacaagatcccgcgagcctgcagcaattgcaatcatcgtcagcacgtatactgtagtacgtacgtagcgagctgagcattcatgagtagtagtatctagtatctatctgctggctgactggctccgtccagcccccgggccggcggctcatgcatatctcatgcatgcatggatcatggatagatcccggatcggagttttggaaaattttgaacggcgcgccatacggccgccggactcgcgcgcgcgcgtaccgtaggttctgcgccgagatgtgggttctgttctgtaccgtcgcctaggaatgaatggcgtgccatgcatttggcaggcaaggcatatatgcatactgtaaaaaggaaaaaaaaaagaaatacacggtaataccaccgcgtacgtgtctatttctttattcaaaattttaactcccacacgtaatgcgtcttgcttagaatgacgattgcttggaagtaaaagtaaaagtaaaagtaaaagtaattagaatgacgattgcttggaagtatagaagtaattttatacagtactccgcaagcagtctatagctctaattaatcccctagctaataacgacttcgtcgctagccggccggcccttgcatgcatggctgctggagtgcgtagtaatttaaacaaataaagctatcgtctgtcagcaattaataatgcaattaagtacgtagtttgtagactagtctcccaacaagccactcttcagttaataacttcacttttccctgttttattagtgctataaatcaagaatgttacggagaagtgtacgaacgagctgtgtgtaaccgtaactttttttttgagctcacagtacgctcaaattagacatcttttaaacagtctctagggtgtagtaagtgcaataaataaataaataaatcaagagacagtctcttcgtggagagcccgtctctacaccactctctatacatattatgtcttaactgtatttatgatttataggctctgagttgtattatgcaatttcttaaccgtctcttatactttacaaatcgatcctaataagcctctgggttgtacaagtttgtagtacatgccctaaggtctgtcctcgtcagtcagacaacaagtatttatcgccctaataacagtgtacgagaaccagttgctgctgcatggttcggtttggcggcgt

SEQ ID NO: 15585 - DNA, 2480 bp, Zea mays
caaaagcttagttcacaaaatattgtggtggccgccttagaagtcaggtcaaatgcacacgttgcttacattgctccaataaatttgatcctttcttggatctcagtcttgagattgccaaggccacgactttggtgcgggcacttgaaaattttaccgaggatgagctactagacgagggtcaaaaggaatacgagtgtgaacgctgcaggcagaaagttgtagcaaagaaacgacttacaattgataaagcccccaatgtcttgacaattcatctgaagcgcttcagccctttcaatcctcgtgagaagattgacaaaaaagtggacttccaatcaattcttgatttgaaaccatttgttagtgactctaaaggaacagattttaaatacagcctttatggtgtcctagtccatacaggttggagcactcaatcaggccattactattgctacgttcgtacatccagcgggatgtggcacaatcttgatgataaagaggtgcgccaagttcgtgaagcagacgtattgaagcagaaggcttatatgttattttatgtacgtaacagtattgggaagtcggtggtgtgcaaagataataatgctgctaatttgctcaagaagaaaacctctgaaaaaatctcaagtttgaatggtattgcacaaaccaatgtaagagcacaaaatttgaatggtgtgtctccatttggtgataagacgcacggcacaatcattggctactctacaatttccagcaagactaaaacaatccactgttcaaagaatgaggtcaaagctgaagatgctccagcctctcaaaacaatgctctaccttccacacaagcccccatagctcgaaatgatgttggtatcttgccaactaaaccaatgcagtttgctgtaaaaaatgaggagaaaacctcatcccaccaacctgcgccatttacaaatacttgtggtgaacaaacagttgttgggaggcccttgcaggaaatggaacctaaggctggtgcaggggaaaatacttctgttgtctctgctgttgctaatgatgccgctacattgtccaaggcagacaaactaacttctcagcctcaaacagctccatcttccaagccaactgccaacctcgcggccgcagctactgagtttgctacactgtctttatcaaagaaggattctgttgtttcaaatggtgctgtgcttagcattggatgtctcacatccggtgagaaagcaatgaacttatcagaatctgtggatcaagctaatgaaatcacaaaggcacttcctacgagtcagaacaatactgcaccagtaattgctcaagcagattgtggagtagagatcagctctggtgtcatcatgcacgttgctgtgtctgcttcatgcaatggaactacagagaaaaaggtgaattcgaagtcaaagaagtttgtgaggtatcctgttgtgaacatgtggttagggtccagacatctaaagccagggaagaaagcgaaccgcaagagaagtaaaatgataagacgtgttgtagcctgcaaggacgcggcaaatttatcttgtttgagtgagcagctgacgtcaacatcgtccactgcatgctctgaaaccgtagaatgtacctccagccatcagaaacggtcacatgctagtgcaaggtccaaagatgacgcccagtcctcgcaaaacaagcagaaggtcgacggagctcgtgtcggtgctggcacaagtgcaccttcttgcagtgccggcgttccaaagtctgatccgaacccttccacagatgctaaggttgtagcgacccagcctgccagtattcgcgcaacggacctgatggaagctaccgttccgcgctgggatgacgtagacatgccaaacataaaggtcgctgagccgcagtccaaacgcaagagcggtggctacatcttagatgagtgggacgaggagtacgaccgagggaagacgaagaaggtgcggaggtcaaagcaagactttggcgggccaaacccgttccaggaggaggcggactacgtatcgcagcggaggacgaagcagaaatcctaccgaggcaagtcttggaacaagcgggcctaacacggtagagaggggggagttgagagaatacgagagagagagagagagagagagaatccccggacgcacatgctgtttgttgttacgttttagcacccattggtgagggagatttacgtttaaaaaccatatccgtcgtcggtacggtagtccccattagttgtcgacgatgtgacgttttgggcagttttcgtagaacatttgaaacatttgttcggttgtaacggagtgctgtttagttgagttggggggaacaaaattggcgagactattttgctgcattctgctctgctgtttttagttactgatgaagaataaaacgatggtggtgatcagttttatgaaaaaaaaaaaaatcaaaaaaaaaaaaagcccggcccgtcc

SEQ ID NO: 15586 - DNA, 2130 bp, Zea mays
ggggggggggacccccttggccccccccccccccccccccggaacagattttaaatacagcctttatggtgtcctagtccatacaggttggagcactcaatcaggccattactattgctacgttcgtacatccagcgggatgtggcacaatcttgatgataaagaggtgcgccaagttcgtgaagcagacgtattgaagcagaaggcttatatgttattttatgtacgtaacagtattgggaagtcggtggtgtgcaaagataataatgctgctaatttgctcaagaagaaaacctctgaaaaaatctcaagtttgaatggtattgcacaaaccaatgtaagagcacaaaatttgaatggtgtgtctccatttggtgataagacgcacggcacaatcattggctactctacaatttccagcaagactaaaacaatccactgttcaaagaatgaggtcaaagctgaagatgctccagcctctcaaaacaatgctctaccttccacacaagcccccatagctcgaaatgatgttggtatcttgccaactaaaccaatgcagtttgctgtaaaaaatgaggagaaaacctcatcccaccaacctgcgccatttacaaatacttgtggtgaacaaacagttgttgggaggcccttgcaggaaatggaacctaaggctggtgcaggggaaaatacttctgttgtctctgctgttgctaatgatgccgctacattgtccaaggcagacaaactaacttctcagcctcaaacagctccatcttccaagccaactgccaatgtaaaggacacagctactgagtttgctacactgtctttatcaaagaaggattctgttgtttcaaatggtgctgtgcttagcattggatgtctcacatccggtgagaaagcaatgaacttatcagaatctgtggatcaagctaatgaaatcacaaaggcacttcctacgagtcagaacaatactgcaccagtaattgctcaagcagattgtggagtagagatcagctctggtgtcatcatgcacgttgctgtgtctgcttcatgcaatggaactacagagaaaaaggtgaattcgaagtcaaagaagtttgtgaggtatcctgttgtgaacatgtggttagggtccagacatctaaagccagggaagaaagcgaaccgcaagagaagtaaaatgataagacgtgttgtagcctgcaaggacgcggcaaatttatcttgtttgagtgagcagctgacgtcaacatcgtccactgcatgctctgaaaccgtagaatgtacctccagccatcagaaacggtcacatgctagtgcaaggtccaaagatgacacccagtcctccggaaacaagcacaaggtcgacggagcccgtgtcggtgctggcacaggtgcaccttcttgcagcgccgacgttccaaagtctgatccgagcccttccacggatgctaagttggtagcgacccagcctgccagtattcgcgcaacggacctgatggaagctaccgttccgcgttgggatgatgtagacgtgccaaatataaaggtcgctgagccgcagtccaaacgcaagagcggtggctacatcttagatgagtgggacgaggagtacgaccgagggaagacgaagaaggtgcggaggtcaaagcaagactttggcgggccaaacccgttccaggaggaggcggactacgtatcgcagcggaggacgaagcagaaatcctaccgaggcaagtcttggaacaagcgggcctaacacggtagagaggggggagttgagagaatacgcgcgcgagagagagaatccccggacgcacatgctgtttgttgttacgttttagcacccattggtgagggagatttacgttaaaaaccatccgttgtcggtagtccccattagctgtcgaagttatgacgttttgggcagttttcgtagaacatttgaaacatttgttcggttgtaacggagtgctgtttagttgagttggggggaacaaaattggcgagactattttgctgcattctgctctgctgtttagttactgatgaagaataaaacgatggtggtgatcagttttatgaaaaaaaaaaaaaaaaacccgtcgggggccccggggcccaatt

SEQ ID NO: 15587 - DNA, 867 bp, Zea mays
  misc_feature (29)..(29): n is a, c, g, or t
tcagggtcatcatcaacacgggagaaatncgatacgttgtctctcttctttttcctgggggccaattttcagcgattgaaatcgcccaactcagagcaaacgggcacttcacacattgagttgcgctactcctataccagtcacattcacgtggatggcaatgttcagaatgttcatcttacaaaaaactcgtgcgctgtttaaaccttttataggccgtgaggcactccctgaaaaccatggtttcagacgaccatgtcgtttgttaaaatgctgacatgaaagcctacctcttcaaccttaatcttgcatttcaacatcggtggattcaacctccatattgtttgattgaatggaggcaaccagatcctcaattctcagaggaacatgccttgccgcatactggaacaaaactttcgaatggctgtcagcaaaagcacgagctcggtttggctttccaacaaattgcagctgatctatatgcatctttccatccacgagtttcacactttcatctctaacagcaaagcggagaaggttccctggtcgcagatttgacgtctgtatgaatgcgctgtccaagctaccaaacacaacatgaggatcatctgaagtaaccacctttccatcttctagcagctccagcacaagatgttgttcgcttggtatttcacccttgttgttcgtatcgataacatactggctacaggtctcatctttccatactagggcaagaggtgtgattccagcttgataatgtgcatgcttgttgtagaacaccaaaccatctttgacataaggcatgctgcctgagtatgctgcttggagaccctcaagagtgccactcatataccggaaccggccggc

SEQ ID NO: 15588 - DNA, 1650 bp, Zea mays
gcaataacccaagagagaaactcacagttcccacattgatgtgctaaatatattttttttaaagggcacttagatttatatgtccccttgggagtcagggtcatcatcaaacacggagagtgccggggcttttttttttttttttttgcttggggccaaatttcagcgattgaaatcgccaaactcagagcaaacgggcacttcacacattgagttgcgctactcctataccagtcacattcacgtggatggcaatgttcagaatgttcatcttacaaaaaactcgtgcgctgtttaaaccttttataggccgtgaggcactccctgaaaaccatggtttcagacgaccatgtcgtttgttaaaatgctgacatgaaagcctacctcttcaaccttaatcttgcatttcaacatcggtggattcaacctccatattgtttgattgaatggaggcaaccagatcctcaattctcagaggaacatgccttgccgcatactggaacaaaactttcgaatggctgtcagcaaaagcacgagctcggtttggctttccaacaaattgcagctgacctatatgcatctttccatccatgagtttcacactttcatctctaacagcaaagcggagaaggttccctggtcgcagatttgactttccatcttctagcagctccaacacaagatgttgttcgcttggtatttcacccttgttgttcgtatcgataacatactggctacaggtctcatctttccatactagggcaagaggtgtgattccagcttgataatgtgcatgcttgttgtagaacaccaaaccatctttgacataaggcatgctgcctgagtatgctgcttggagaccctcaagagtgcactcatatacagggagtgcactgaatctatatctgtggtacgttgatggaggatcaccagcagaagtttctgcgatcttagagttgacccagaaaaacctgaactcggcggtgcagtcatatagtgaatagcctcgccaacagatcatatgaatgatatagtatgtttcatcaggctcgtgaaaaatgcaatcgaggatggagtacgagcttgctggtccagaaatgtctctctttgaaccattgggcagagcggaagggaagcgatgaaggatggatccattacgaaccctgctgatcgtcatgccattggatgacacaaccaaacatcgtttgccagaaggtcgggcaaaaacatgccagtcggtggcgaggtggggtggggcatcgaccatccactcggggagcataacctggcgcgcgaaccaccggcgcgcttcggagccgcggagcctggaggcggcggccgccgccgcgacgccggaggcagtgagctcgcgctcctcctcctcctcctcatgctcgtactcctcctcctcctcgtcgcgactggtggccgcggtaggcgcccgggtggtgaggagagaagtggcgagggcgcgcgcgcgagcctgggcgtcggcccgccgagccgactgcgcctggagtgcgagctcccggcggcgctgctggtcggagatggccggccgcttgtacgggcggcggggctccggcgtcggcgccatggtctcagacgtcgtgcgcccgtcgccgccaccggcgctagagggagagggtt

SEQ ID NO: 15589 - DNA, 4097 bp, Zea mays
  misc_feature (1194)..(1194): n is a, c, g, or t
  misc_feature (4054)..(4055): n is a, c, g, or t
aaaaaagttgagttaatccgagctggcccatctcttatcgaaacataatttgcaatatcaacccagattaaattaacatatcattataacacaatagcgaggtggatagatggccaatgattttccttcattttcagattcattttgaatttttgcatagaccaagataatctatctttaaaggcatgtgagtagtgtttatatatcataggagcatggcttttgtttagatatgaacaagtaacaattaattccttgttctcatgcaagattagtaaccgactaatcagagcacacatatgatgcatgatctacatatgagaactggtcatggtggtaggatgacttgatactaggccaggttcagacatagaacactcatgagtgaaagatttgaatttgcttgctctatataatcttgtatgcaactagaaattcataactctagttttttgctattgagtcctgacaataagttgtattgaatttgagatgttggagcaaaacaatgcagtttgtttccagattgtcataaattaagtccccaaattattaagaggtcttaacttgataaagttgaagctagggctgcacgattttccatggatttttgacgtatgctgctgcatgttctttattatggtgctagttgtcacaatatactgagttgtagcaattgttacatttagtttattgtactggaggacggatcaatatggatactatatcgatgacgctatgtctccttgaactgctaaatatgaatcatatgatagtgacattgtttctacttcaccaacattagcagaaccaaacctaaagtcatgctagtgtagtagaagaaatagatagcgataaaatactagctttaccggaatatgaggatagctaggtcatcatgatggcttaccagaagacactcaaacaatgaaatctagacaccatcgttcctacctcaccaatgtaaccactgcaatacagctaccgctctagctcagctcaaatgtttggtctattggtatgattgttagtacaatcatgtgtaatacccagattttaggaaataaagatatttttatttagacaaaaaaaaaaaaaaaatgtttattcagtcccattatttgtttgaacccatttaaataaagggataattgatagagtatatatatatatatatatatatatatatatatntgcatcatgctggaatttctgtttgtgcatttagtttaagttgaaatttaaaattggatttgaactttgaatttgaaaaatataaataagaaatgaaaacatagaaaaggaacaaaagagataagaaacttaactatcacgaaggctcaagctcggcctaggcaatagtgtgtcacactatcaccacacccccacattgtcgtccggctagtgtacatgtgagccctgctggtcagctacacatgtcacatgcgcacataggaaccagccactgccatgtgggcccatccatcagaagcttctcctccctcgcatcgtaacaaactcgttcgtagtgtcacgccaagactcgaccaatgacctatcgccctaggctccgtacttggtgtatatatgcatacatcgtgacattctgtggccatagattgagagagcaagaaccttgggtcgccgagccgtgcacctggatagagggtgaggtagccgctgagaaagagaacattagtcgtcatcatcattgtacgtctataccgccgaccgagccctgatcgatagctccaagcattcaccaaagaggggtcacaagaatgccaatgctaatgcctcaccctaaatcctaatccacagaaggatccatctcctaggtgtcggagtgaccggaagagtgacatcctaatggtggtactggatctgcccccttttctacaggacagcggtgggaggcgacgtcagtaaggaccagatccatctccactactgcagggagaaggtatgaactcctattcccctctgcggtcgtgttttatgtgcactgatccaagatggattagttccctgttatcttctaaagtaatctcggagttctaagtatacacagttagatccctaatttctatcagatatatgttgctctgtttatctttatacactttcctccttgatagcctcttttcgggcaaaccatgtgaagcaacttggcttttattcagtcttgtagcatcaacttttgatgttcacactttttggtcatgcagtttctctttctacctggttgattacccgcaccattccatcctgaatcatcgcgtgcgttgacttttctgtacacgaggaacgattactgcatgagtggatgcaaaataagtcgttttgaggccatccacctgcatctgtatatacgccagatatggtcgtacctggccggccaggctcgcgtgggactggctgtgcgggcgcagtaaaccaatcaggcactttgtgttcggggtcacttggctaatgtagctaaaaactgcagattttacggcaaacttcatgaggtgtcagtgcttaactgcttaagttagagtgctacctttagagtgcaatggagtgtcatctgcacaaatgatctatagtgtggttataacaatgtaaactgcagagtttcatgattagaaataaataaaggaaccacaaaatcaagggatcatacactttgccgaggtcatgtgcacaagggattttttttttttgatacgagggcatcaccatttatattactttcataacagaaatgcatcacagttcaccaaagagtacctgaccgacagacggacaacctccgacaaaagacggcaaccagaaacctgaagtttcgccaagagttgtctagacagcctctgattcagggagccagcacgcaggacaaaatgggccatcaagttcaacgggcattaacccaccaacatatatagtagagtaatacagctactgctcaaggactcatgcaggagccaaaagcataaaaaactacgatcgaatccaagcaggcagcaacattttgttcctcgctttccaaatcgcccagcaaacagctgaaacaactattgtatgctttttttttttaatttgaggagcacaaacaggcagctatgtccagcactgcttaatattaccaggaatattatcagagttcaaacaatatgccaccacactccaaattactctagagatagggcaattgaaaaaagggtgatccacagattccacatgttcacaaaagcagcaagaagcatccccattccaattccttcttatcaaattatctttggttagaagcacattatttttcaggaaccacataaaaactttgaatcttgttgggagggatcttgctgttccatatatgcttcatatatggaccaagatcatttctaacaatatgagaatatatagatttgacagtgaacattctacttttctcccatttccagataatcacatatggatcagaatgatacttaaaattctcagccttcatacatatattttcccatttctttagcatatccacacgaagcaatcttctgaaagataattgggcatttacctcccggacctgctttaccgtaatatctttgcaatcacatatatcatataacttcgggacaatacagcgaagaggttaattctccaaccaacaatcctcccaaagtctagttttatcaccagatttagtaatcacttgtctacccaacaaatagaaattcttgaccttcagcatcatgctaaacaggtgaaccatgaacactgtgagagactttatgcacatttttattgtacatatatttttttcctaattaacttctgccagagcccttcctcattctctaatttccaccaccacttgcaaagcaaactaatatttaacaacataaggtccttaataccaagcccaccattctttttctcatcgcaaaccttcccccggtttatgacatgatatttctttgtcaccgcctccctgctaaaaaaactttcccctgatggcatccatcttttttactgttgttttgggcagaaggtatatgggcatatnnggtatagataggagtattagacacccaagaattaatgggccc

SEQ ID NO: 15590 - DNA, 2028 bp, Zea mays
ccacgcgtccgatcagaaagaaaatatcaactagactagatcgaattttaaacatggcgcctcctcctccagcgctggcagaggagactgctgccttccacccaagcctgtggggcgatttcttcctgacttaccagccgccaactgcgcctcagcaagcatgcatgaaagaacgagctgaggttttaagagaagatgtcaggaagattttgatggggccatgtgagttaccagagacactgggtcttatattgacgttgcaacgtcttgcactggattactactacgaaaacgagatcgacaagttactccactgtatttacgacgacgacgactctgattacgatgataaagatctaaacctagtttccctgcgcttttatcttcttcgaaagaatggttacgatgtgtcatcagatgtatttctagtcttcaaaacagaagaagggagcttcgcttatgctgatgacacggcaagcttgttaagcttgtacaatgcagcgtacttgaggaagcatggagaggaggtactggacgaggcaatttccttcgctagacgacgttgccttgaagcaggtatccttcgcacccctcttttcagaagggttgggatactagaggcgagaaattacatacccatctacgagaaggaggcggcaagaaatgacgccgtgttggagcttgccaaactgaactttaaccttcagcaaattgccttctgtgaagagctaaagcattgcacattgtggtggaaggatttccttgccaaatcaaagatggcttttgttagggatagaatagtggaggtgtatttctggatgaacggggcatgctatgatcccccgtactctcgttcccgaatcatactaacgaagatcacatctctcgtaacaataatcgatgacatgttcgacacatatggtaccactgaagactgcaccaagttccatgaagcaattggcagatgggatgaaagcgccctacctcttcttccacagtatatgaagggtttctacttatttcagttggagacatttcgttcatttgaagatgagttggggcccgagaacagctatcgtgtccattacctaaaaaaatcgatggagcgtctagttcagcaatactacagggaaataaagtggcgtgacgaaaactatgtgccgaaaacaatgaccgaacaccttcaagtgtcaatggaaagcataggatccgttgctctagcatgtgctgcatatgttggaatgggtgacgtcataacaaaggagacccttgactgggttttgagctatcctcagtttctgacgacttacggtatcgtacgactgtctaacgatgttgtatcaacaaagcgtgagcaaacaaaagaccatagtccctccactgtccattgttacatgaaggagcatggaacgaccatggacgatgcatgtgaaaagataaaggagcttatcgaagattcatggaaggatatgctacagcaatcccttgcgctgaaagggctcccaaaggctgtgccacgaacagtgtttgactttttaagaaccgcagataatatgtacaagaattgcgatgcgttcacttcttcagaagtactccgagaaatgatacgactactgttcgtggagccaatacctgaataatgaaccgaagctgcttgcttgtcagaaaaaaaaattatatatgtgcttttgaaataattgtcacagtcatgtttgaggacatgcgtggtgtgatattatgttacacgagataaagtcaacacctacatatatagggttgttgacacaaataattgtactgtgttcttggtctagcgtagtacaacagtcctaatgcttaattgttcacaggttatatttggaaacaaaaaaatgttaccctagctataattgttttgtactttgcatggattctcagataataaagaactgggtttcccttaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 15591 - DNA, 1665 bp, Zea mays
agttgaggtgagacccgaatcctctaggtgtggcttgtacaatctatgttaactagtcatccgttgaaggttcttactacaatttgggaatcatcgtgctcatgcaactcacacaatagtcatctgttgcaaatgaaaatagcatgcatgctcacacatttcgtttgatatgcataataacattgattgtaataatatatatacatacatacacatctctattaaaatatgcaattgcctgacgcagaggctataaccttaattagggtttagggtttaccatatgcaatctaaaaatgtatgacatgtttttggcaagcagtgctggaacaagcagtgatatttgatttgtagtgttgagatattagagtgaaccaaatcaacaaagtcaaggtttcaatctatgctgtccataaaataagataaaattagatatataattggtcatagttccctcacgaccaactgaagtgccttatctatacccctatataactcaccacttcaaaaattgcaaaagccaaccaatcaaatgtccaccatagtctacacctcttctaaatgcacccagatcaatcccaccgttaaaaccaatgaacaagatcaactcaaacctttcatttctcttactcactcaaatccaacgatcaatctttagatcatcccacctcatcatcaatcactcaaatggtggtgacagagtgttcctgttgcctgtggctttcatgtcgagcttctcgttctttcccatgtggaacaacacgagcctactgagacaccgcagctggtggctacctccttgactccaaggaccgcgcgggggcctacaccgtggggtttagtgggcgtcaacggtaggtagaaccccacgatcggtagcgacaggtgggagcacctggacgtggcaatgtccaagtccagggtggaactcgtgcccactagagcacgacatgacaatgacttccacgtcgtcctcaaagccctccaagcagatcacacatcctctagtgttgttgtcgcacgctgcctccgccgtgggatagaagacatgaaatcgacctccatgaagacaccaccgagaactcgtgcccgctagagcacgacatggcggcgacctccacgccattctcaaagtcctccaagcagatcacacatcctctggtgctgtcgtcgcacccagcctccgtcatgggatagaagtccattaagatccaaaccatcaccaacatgacatggtcatcatcattcgcttcctcgagaaactctgctgttgtgcgttgttcttgtaaatggcgtcgtggacataccgtgaacaatagatatgggattgtgcctagctgtcagggctcgctttttattatgccagtggcacaaagagttctaatctattcaattaggatgcgagaaggcggtctccacatcagtaattattacgccttgagtgatatatgattttcttttccatgcatctctaatcctattcgccctgatcgggttccttcaaggtaccccttcctcgcttcctattttctccactctattctaatctataatatattttagttttttctagatttttactatgtgtcgtatatatacacaccccacaaccagttaaaacttcactaagtgcactcaataaattacctctaacaaaatcccatc

SEQ ID NO: 15592 - DNA, 2132 bp, Zea mays
acctcgagccggccgggaagctccatgtaagctccggcccgatcgatgagaggagtcagacggaggcaagggccggggtcggcagcagaggggagcagagagatctcattctccgatccgcccaggccaccatggcggaggatgctacgagcagccacccgtcacgctacgtcaagctcaccaaggaccaggacgcccccgccgaggacatccgccccggcgagctcaaccagccagttcacgtcccgcagctcgaaggccggaggtgtagcgagtgcggtcaggtcctgcccgagagctacgagccgcccgccgacgagccctggaccaccgggatcttcggatgcaccgatgacccagagacctgccgaactggattgttttgcccctgcgtgctgtttgggcgcaacgttgaggctgttagggaggacatcccttggacaactccttgcgtgtgccatgctgtattcgttgaaggagggatcacgctggcgattctgacggcgatatttcacggtgttgatccgaggacgtcattcctgattggagaaggtctggtgttcagctggtggttatgtgctacctacactggcatcttccgccaggggcttcagaggaaatatcatctcaagaactctccgtgtgacccatgcatggtccactgctgcttgcactggtgtgccaactgccaggagcatcgcgagaggacgggacggcttgcagagaacaacgcagtgcccatgacggttgtgaacccgcctccggtgcaagagatgagcatgctggaggaggtggaggagaagggagcagagaagagtgaacacgatgatgtggaggtcattcctctatagataatagggtcggagtccgagtgaggatagcactagcagcatcagatgacgatcacaacttctggtcattcctctatagttagttagttattgatctttcaacaacaaaatgtggtggtgtggcaactgtccatttttattatcccaaataataatactgtactacgttacggcccacgcccaatttttctttcaatctttcgcggtcagaaggagaaagaagaacatatagggcctgtttggttcgtggctaactgcgcacgctttgtctaaggttagtcgttcaaattgaagaactaattttagacagaaaagttaggcaaagtgtggcaagttaggcagagaaccaaacatgcttttaatccggatcgataatgatcttacccccttcgtttaggtaccatctatccacgaatctgacattcgatatgacacgagctaaactttatctctatggccctgtttggcacagcttattttcagcttcttcacaaatttaagcagaagttctgccaaacagctagcttctccagcagcttattagttcagttgcttctcagaatacactaaaagcagccaacaagcagaagctgcttttcaccagtttatcagataagctgctttttcaacaagcagcagctgtgccaaacatggcctaagtgtcttcttcatctaacttatcaaccttgcaaggatcactgcaaaaacaaataggcactgaaacaccccttggtaaaggcagcaggtcgaaggcaatactggtcaacggacccttcctaaattttaataagtaccgttatacaaattgcttcgattagataatacattctatacagcgcttacctttatttgtcagatttaccgcgcctagacattctactatcaaataatatggactttaaaaattagtcgaatatatacatgtacaaaaatgatagagaatctccaataaagatatgtacaaaaaatgatagagaatctccaataaagattaccgtgccaccagcgaccaatagattgaataaaataactgaaacaaaaatcaagtaaattaccttgacaccactaagagtatgtttgatgtagtgaaaaggagaaaaacgatatacagggataaaaccaacgccgtattttataggcacacatgtgtcggcacacgtaggtgccgggtcaccatcaccacatcgccacatctaagacctaggcaccaatagcattggcgccagcctgtgttagcttgatgctaatgctattgacgtcgaactagggatccattttttg

SEQ ID NO: 15593 - DNA, 1448 bp, Zea mays
tgggtacctcgaggccggccgggaaaaagtctcggcccaccaccggcccgatcgatgagaggagtcagacggaggcaaggccggggtcggcagcagaggggagcagagagatctcattctccgatccgcccaggccaccatggcggaggatgctacgagcagccacccgtcacgctacgtcaagctcaccaaggaccaggacgcccccgccgaggacatccgccccggcgagctcaaccagccagttcacgtcccgcagcagctcgaaggccggaggtgtagcgagtgcggtcaggtcctgcccgagagctacgagccgcccgccgacgagccctggaccaccgggatcttcggatgcaccgatgacccagagacctgccgaactggattgttttgcccctgcgtgctgtttgggcgcaacgttgaggctgttagggaggacatcccttggacaactccttgcgtgtgccatgctgtattcgttgaaggagggatcacgctggcgattctgacggcgatatttcacggtgttgatccgaggacgtcattcctgattggagaaggtctggtgttcagctggtggttatgtgccacctacactggcatcttccgccaggggcttcagaggaaatatcatctcaagaactctccgtgtgacccatgcatggtccactgctgcttgcactggtgtgccaactgccaggagcatcgcgagaggacgggacggcttgcagagaacaacgcagtgcccatgacggttgtgaacccgcctccggtgcaagagatgagcatgctggaggagaagggagcagagaagagtgaacacgatgatgtggaggtcattcctctatagataggggaggatagcactagcagcagcagatgacgatcacaacttctggccattcctctatagttagttagttattgatctttcaacaacaaaatgtggtggtgtggcaactgtccatttttattatcccaaataataatactgtactacgttacggccgacgcccaatttttctttcaatctttcgcggtcaccaggagaaagaagaacatacaggacatgtttggttcgtggttaactgcgcatactttgcctaaggttagtcgttcaattaggcaaagtgtggcaagttagacagtgaaccaaacatgctcataatccggatcgataatgatcttagccccttcgtttaggtaccatccatccacgaatctggcattcaaacatctaatatgacacgagctaaactttatctctataaccaaacaccaacccctgacccactcaccaatctggcctggtatcatgttcaccagcagcagcaagtgtagcagtttaaaacgcggggaaaaaactgaaggaatctctgcatattcaagtagcaggtgtagtagtttaccaaggaatgggattgggaatccatatcatccaccaa

SEQ ID NO: 15594 - DNA, 1976 bp, Zea mays
  misc_feature (108)..(108): n is a, c, g, or t
  misc_feature (220)..(220): n is a, c, g, or t
cacatattttatgcaatggttttttgggattaaattaagcaataatttgcctaaatttctaacaccaactacataagatttttcatgtttaatacttgtcaaaagctngttaattaggagggttattatagtgtataggaaatatggagaataacttcatcattttacatcctatttttaaaatattgattacattttcaaatgtccatttactcgtcangatcataattggatatttaaaaccaatttcaaaattgaatataccttttgtgttttgaaaagggtggttgatgtatagaattattgaaatgaattaagtctagaaggcaaataccatagaccccaccaaagcctctattgcatgagcgatcacaacattgaacgattgaaaaaagacacattgagtctatctgtttcaagctcaaggctacaaacatgtgatgtgtgctataacaaaattttgttactttgtacatgaaacatgtgaagaacttggcatgcttttgataaaaaaattactgagtacgttattccttagcataccaaatctataaggatgggcatgaaacaacatttgtatgcatctgattagcactatatggatgaacatgaaacaacatttctatgaatcatattaaaagaaaacattatgtgaacattgagagctatatagaagaatagtttagaccatcagtgttccaacttcatatagaccatagttagtgacaatattaaagttcgagatgttgaatgctaaaaaacaattagtgacaatattgtttagataaaaatttgagatgtcggaggaagctgctgaaaaaggtaggaaattccaaagaaaactaaaaagaacgtagagagtttttgaaaaagattatagaagtaggaaaaagatggggaagctttgcatgaaagtgatgggttttgttgctcgtccttctacgaccattgttgagcaaattcgtgatgttattagtattcatatttactttctacttaattttaaattgttggtatgctcgtaggttaactttatctctagggctaagcttcaattcgacatccgcccattcttcagtcttaatgtcgttgccgccgagtacaatagtgattccccggtgcatccacaccaaggatttcatcaccaccagccccatcaacgactacaatggtgaagagtttgtcttctactctacaaggaagtaccgtgccaaaaactcaataatagagtaccacaccaaccaaaatggctaattgttgccactagagagaatgtatagcctattttgtctggcacttagggaatcgatagctttaaggtgaagtcatccactcaagtggctaccatagggaagggaggccttgcaaggcaagaaggtgcttgttgtccgttgtgataacaccttttcaacaataatgttcatacctacattgttcgttcgtcgttgggtaaaaacattgctatatctatttatttttattatcatatatatatattattaatacttttgtttgcattttgattatatgttctttcactttatgtacatataataattcttttatcatgcatcaattgtatcaaattgtaaacttgaataattggaaaagaaaaaggattgacatggtatgtttcacttcctgttctaagaaattgtgctatacctagaaacatatttcttgctttgtaaatgtcatgataaaaaatatttgatgaacgaattgataaaattattattccacatgtagaattcacatggaacaaaatgatgcaacatatgcatgcatctaattggcatactcacattttgggaaccttgtgattattaatggccaagaaaaattctattacttttttttgtcatgggtggtaacattgatttactttggatagcatgagctgatgcagcgtgttgaatgttttagtttggtcgggttggatgagtccaatgtgttaattgtaatgtggcaccagg

SEQ ID NO: 15595 - DNA, 588 bp, Zea mays
agtttagaccatcagtgttccaacttcatatagaccatagttagtgacaatattaaagttcgagatgttgaatgctaaaaaacaattagtgacaatattgtttagataaaaatttgagatgtcggaggaagctgctgaaaaaggttaactttatctctggggctaagcttcaattcgacatccgcccattcttcagtcttaatgtcgttgccgccgagtacaatagtgattccccggtgcatccacaccaaggatttcatcaccaccagccccatcaacgactacaatggtgaagagtttgtcttctactctacaaggaagtaccgtgccaaaaaactcaataatagagtaccacaccaaccaaaatggctaattgttgccactagagagaatgtatagcctattatgtctggcacttagtgaatcgatagctttaagggcaagttatgcactcgagtgactacaatagggaagggaggccttccaaggcaagaaagtgctcgttgtcggttgtgataacacctttccaaaaataatgttcatgcctacattgtttgttcgtcgttgggtaaaacctttgctatattt

SEQ ID NO: 15596 - DNA, 1059 bp, Zea mays
gcacgagaccattacctagaacatcctaatcgaaaaatctgattagcactatatggatgaacatgaaacaacatttctatgaatcatattaaaagaaaacattatgtgaacattgagagctatatagaagaatagtttagaccatcagtgttccaacttcatatagaccatagttagtgacaatattaaagttcgagatgttgaatgctaaaaaacaattagtgacaatattgtttagataaaaatttgagatgtcggaggaagctgctgaaaaaggtaggaaattccaaagaaaactaaaaagaacgtagagtgtttttgaaaaagattatagaagtaggaaaaagatggggaagctttgcatgaaagtgatgggttttgttgctcgtccttctacgaccattgttgagcaaattcgtgatgttattagtattcatatttactttctacttaattttaaattgttggtatgctcgtaggttaactttatctctagggctaagcttcaattcgacatccgcccattcttcagtcttaatgtcgttgccgccgagtacaatagtgattccccggtgcatccacaccaaggatttcatcaccaccagccccattaacgactacaatggtgaagagtttgtcttctactctacaaggaagtactgtgccaaaaaactcaataatagagtaccacaccaaccaaaatggctaattgttgccactagagagaatgtatagcctattatgtctggcacttagtgaatcgatagctttaagggcaagttatgcactcgagtgactacaatagggaagggaggccttccaaggcaagaaagtgctcgttgtcggttgtgataacacctttccaaaaataatgttcatggctacattgtttgttcgtcattgggtaaaaactttgctatatttatttatttttattatcgtatatattattaatacttttgtttgcaatttgattatatgttctttcactttatgtacatataataattgttttatcatgcatcaattgtatctcattgtaaacttgaataatttgaa

SEQ ID NO: 15597 - DNA, 1380 bp, Zea mays
cactgccccctaccctaactagccgccgcgcgcgcccaccctgctcccagccagccgccgctccctgttaccgccgccgccctctgcttctcttccccccacccatctctctctcccagccggctctctctctctcctctcttctccctgcttcagccgattccaagccgctggacaccaggacgccgagcaagccaggctgcccagccgcgaccccgagcgcccctgcccgaccgcgccaagcgcgcgaccctgcgcgacgacccgccgcccagcgcacgacgccctgcaacccgcgcgcctcaagccgaccgaagccaggaaccgaccaagccgccaagatccgaagcgcccgtgaccgttcttcttcgcgagtaaaggagcatttagtcatccggcagcgacgatcctacagggggcaaacacgatctctgcccctccttccccaaaatcatctctctcccgatcttggcctccccagattcaccacctgctctcctctccggctacgaccttggctcatcctgattcggacacgcaacatggtttaccactctagtttcgctgatgatgatgggatcacaaaagcttgcagctgtcctttgcttccactgaaaactcatatcaagggcccggcaccagcctctgaccctgataaagcggacattgttgatgaagccataactttctttcgagccaatgttttcttcaaaaatttccatgtgaaaagctcagcagacaagttattgatctatctgacgttttatatcaatattgccttaaaaagactagacggttgccggacactagctgttgggactaaagcaatcattaatctgggattggagaaagttcctgtacctggggaaccagggtttcctttccctggacttttcactcttccccagtcccaggaggaagcagaattgttgaggaattatttgaagcagataagggaggaaacaagtggaagattgctcaactgtgcatacagagctaatggctttccaaacaagtggtggttggcttttgctaagaggaagttcatgaacattgtcatcctttagacttgggctttttgtaccaactggttcaagctgttttttcactcatgatcgtgtgaagtatccacacacaacaaagatagttatcctacatcccaaagtaacaagccaaagacttcgatgataggatagatgaatgacataagataaattatttattcccaatttgcgatatataaccgtgggaacagtaattatcatgttgtattgccttttgtaattctcaccctgctatatcagagagacgaaacctgatatagggtatattctacaatgatgtctaaaacgagacagtttaaatgttctaaaaaaaaag

SEQ ID NO: 15598 - DNA, 1011 bp, Zea mays
ccggccgggaaaaaaaaaccggcgcggcaccggaacttctcctgtcgacgggtgctcggccggggggcataaccctgccggcaaccacgggtcaaggctacgatctacgtagccgaggtcctcctaccttgggtttaccactctagtttcgctgatgatgatgggatcacaaaagcttgcagctgtcctttgcttccactgaaaactcatatcaagggcccggcaccagcctctgaccctgataaagcggacattgttgatgaagccataactttctttcgagccaatgttttcttcaaaaatttccatgtgaaaagctcagcagacaagttattgatctatctgacgttttatatcaatattgccttaaaaagactagaaggttgtcggacactagctgttgggactaaagcaatcattaatctaggattggagaaagttcctgtacctggggaaccagggtttcctttccctggacttttcactcttccccagtcccaggaggaagcagaattgttgaggaattatttgaagcagataagggaggaaacaagtggaagattgctcaactgtgcatacagagctaatggctttccaaacaagtggtggttggcttttgctaagaggaagttcatgaacattgtcatcctttagacttgggctttttgtaccaactggttcaagctgttttttcactcatgatcgtgtgaagtatccacacacaacaaagatagttatcctacatcccaaagtaacaagccaaagacttcgatgataggatagatgaatgacataagataaattatttgttcccaatttgcgatgtataaccgtgggaacaataattatcatgttgtattgccttttgtaattctcaccctgctatatcagagagacgaaacctcatacgggggtatatttgtatgagtatattctacaatgatgtctaaaacgagacagttcaaatgttcttactattggtttagtatccccaaaaacttcatagtattg

SEQ ID NO: 15599 - DNA, 2236 bp, Zea mays
tttatgcagtagttctctgcacaaggtcctgtatgtttcctcggttggtggttcgcagtaacagaagatgaccgaaggagcacaggattcactgagcacctcagtgaaaggtcgaagtccgataacattatatgcccatcttcacggactaaaatgttctccggctttagatcacggtatatgacccctaacatgtgaagatattccaaagcaaggagaacttctgcaacataaaaccttgctgctggctctggaaagctttttccaggttgcctttggcgaagaacatgcaaatcaccgcctggacagtactccatgaccaagcatgagagattgtctgtggtaaaatgggcataaagagtcgggaccaccggatgatctagcatttctagtatctccctctcagcctgtgctcgtagcatcttctttctcccggccgaggtactcgatgtccataaccttcaaagcaaataagcaatctgaatcaaccaactcagcaagatatacagttccaatgtcaccacaaccaagcctcttcagaagcttgaaattgtcgagtcctaaggaaccctgttgcagtgccaactgacgaatggttagccagcgcagatccttcgccatgtgtggcctgttactatagccacacaatccaaattggctctcaccgctgatacttgtgctgcaaccatactcactaatgctgctctttgagttctgggaacattcattttgctctgccaaccactcagaagatgtgccatcagatttttctggcccaggagatgatttctcttctgcacggttggcgggatttgtaaaactagatgttgaagagcagctggttgatgtgagggagattgactcctttgaagagcagaatttagtactattggaggaatcacccaacgaagatggttcttgtttcactttcttcttaccggaaggcttgcatcgaaagactggcttgacaagtcgagatgtagtgataggtttgctcaagattgggactttgggagagccatcatcagtagctgcagaaaatttatttcctaggttgccattttcccccaaggaactctcgttatccatagggtcaccaatgatgacatcttggattctgatcttcctaatatcggtgtaggttgacgaagcagaacagatagaggtagaggtgactgcacttccatcagctgtctcaaattcacagtcttcactgaactcacttgtacctctagatgaactcttatcaatcttctctggagtgatcgatacttcaatcaggttcatcttctcatcatcatgcagaagaccctcagaactactttggaccatcaaagaggcataaagcctgtggatagtcccagcttcggatgaacttgaagatccaggtgacatcgacaacctcttcattgcagccatttctgatgcctgggaaatgcatagccttcttagcgcttgcttcatattaacagccttggaggatatcccaatgcctgcattttgagacaacccagacctagctggtttcttcagaacactcttacccagcgcatctccacctgtactgccaggactaagcgcgcgtcggaaggtcctgctatcgatagctttaaggagctggtcgaggtcatcttccacagaataatcatgacttttgccgcgtttctcctcatctttgagtttaatatgcagcaagctggatccaccagagggtgtagtatcgaattcctcggtggactcaactatctcagagctacagccagatgactccatggcccaattagactaattcaacactggcagacaaggaatacgccaactcagtccgtcgcctgcaggggcatcctgggcaggcaagcctgcaccttccactgaacgtcttccaagatgagagcaccagggagctcccagaaaagtagccttttaatggcaagcgcagcaaccagcgcacacccaggaaatgccggctcagatctccacgcgtggaaggggcacaggcggtggaatagtggtgccgttggcacttggcactgcgtcctggcaggacgagctcagctgctggaatggcggcttcggaggtgtactggtgtatagagggcaaggagcacacagaggagagagaaaggggtagagacttaaagagcaagagagagaggagacgaatcggcacccggggcgtccaggatcctccgtgcagactggagagggccaccagtggcaactcccggtccgtaat

SEQ ID NO: 15600 - DNA, 2057 bp, Zea mays
tctttctacaggctatacacaggctacagctaacttttttttttttttttcacggcacagagtttttttttctaccaagacatattcacaacccacgcgcaaaacaacccaggaagctcaaccaccatcttgtattgtacctagtagctactacatcacagatgaatcgtacaggggacacagcgcctgcgcctgcgcctgtcctatatggccttgaactgccagctccctcgtcgaccatttcggcgcttgtgactcacaagcaccacacaacgagatctgctgcactcacccgtgctagctgtgaaacaggaagcactgatccaacatgatcgggcgccgcgctcaagaaatttgcgatatatggtgattaattataagctgtggagctgcgttagcatggcgacgagctcgtcgctggatggccggtcggttggcgagtccgagaggcagacaatggcaacccgaatggccatcagcatctcctcctcttctccctcgtcccccaggatgctggtatccagcgtttctttcgggtccgcggactgctgcgtgtgccggagccatcttgggaggccgcccccgccctgcccggtagtctctcccgagaagaaagagtctgtcgggtctctcccagtgagcagcacgcccaggatcatgccaagggcgtacacatcactcttatccgtgtacctgctgctttgatagcattctggagcagcgtaaaggccagtgcacaattctggatcacctgaacctgctgcaattagccttgcaacaccacaatctgccaataatggctccaaaccttcgtctagcatcacattggacggcttgaggttgcagtggactatcctcggattgcactcaaaatgcaagtgcctcagtcccttggcaatcccaacagcaatcctgctcctcgcatcccaaccgaggctgacttgctgcgacctcaccctcttcatcagatcctcgaggctgcccccatggacgaagtcgtacacgagcgagaggcggtccgcctcgcgaacgtatgccttcaacgacaacacattctggtgcctgacccgagcaagtgcctcaagctgcctctgcaccctcctcatgtccgacttggacgcgctcggggacatggacggcgaggcctcggggcggctggccgcctcgaggcgcttgacggcgacggtgaggtcgttgtcgagtgccagcttgtagtacttgccatggggcccatgggcgagcggctgcgcggcggggagcgcggccaggaggttcttggcggagatttgcggggcgaaggagacggggcccttggcgatcgcgggcgtgctcttggcgtggaggatggcgaggcggatggcgtagaggaaggcgagcgcgaggaggaaaccggagagagagccgaagaggaccccgagcgcaatgcggcggaggcgtgcggcgccgccggcctgcgcccggggaatcgtggaccccggcggcagcggcggcggcggcggcggggactgcgtcgccatgggctccgagtggagcggctgggcggaggcgggcgcgcacagcgcgaggaactcaagcagcagcaggagagtggtcaggaccgacagggttttggtagggttcctgctcgtcatcctagctcctacctccacgaaacaagcacacacgacttgctaggagaaacgaataaaattccttggacgagaataggggagaatcgatcaatgtccaggacgagccaattgttgcctgctccacgcccacatcactggcacacccagcatctttcctccatggaaatcagaggaaaacaacaggagacaagttgcaaaggatgcaagaagcgaggaagctgcggagctacaagaactcgagcatggtgctcgtgatatttacctacaggaagagaaaatatgcatcaaggaagacgaatcgaaaaggcagtcgcccaaggcgcgcgcggcgtggagcccggaaggaggagtacctgacgacgacgaacccaaacagagacgagtgcgaattttccgattaggatgttctaggtaatggtctcgtgc

SEQ ID NO: 15601 - DNA, 2043 bp, Zea mays
ccacgcgtccgggccgcccttttttttttttttttttttttttttttttttttttttttttttttttttttttttaaacaaaactggctctgaacaataagccctgaatcatggtctcattcctacaacaggtcccgcatcgatgcaacatgtcctgattcttaaaaggaacatgttgtcatccacacaactacaaatccgtactatgaaaatacatttctaattagaccgaggaaaccatgaagatggatggaagcagaacacccaaggagaccaaaagggagaccagcaaggcaggtccgttcgaggtggctgaagccgaaccagccggccggccgcctgaaccagtctgcggggtagcagccttggagcccgtccccgaaagcatgtctctgaaccagtacgccgagtccttggggtaccgcttcagcgtcgcgaagtcgacgtagacgatgccgaacttggacgtgtagcccgacagccactcgaagttgtccaggagagaccacgcgaagtagccgatcacgttcgcgccgccgtcgatccctctctttagctccgtcaggtagttcttgtagaagtcgatcctcacggcgtcgtgcacgtactcctcgcgcgtgaggtttccaggctgatccattccgttttccgatatgatgatgattggattatggtacttttcctttaggtagttcacgactccatacatgcccgatgggacgatgtaaagccaaattgagtgcgccatctgtccaatttgcacgccattcctttgaaagtaatattggacgccccagtcggacgagtagctcggtggtccctgcggaggagtttgttgatctgcaatgtagtatgtagtatattgattgatcccgaaatagtctgatgagcccttgactagcttggcctgttcaggtgtgaaacttggtagccggtctttcacaatgtcttgcattatctttggatattgcccatttattaatggatcaagaaaccaaccaatatggaagtccctggccctttgcgctgctttttgatcttcagttgagtttgtaaaaggttcataccagttgaagtcaagaactatcccgaccttgcctttctgagttgcctggtatttattgcggtatcttgcaactgcagtagcatgagataggagaatgttatgaacaacaatgtaaggttctgtcgatgagttcccaccggcagtgcattgtgtgcaccggttaggggggttaagccctttatcataaccaaggaatgctactatccttggctcatttaatgtgaaccagttcttgactcgattgccaaaagtcttgaaacaaaaatcagcatagtcagcaaatatgtccacaatttttgggcctaaccagccttggtacttcttctgaagcgcaagcggaagatcatagtggttaaggttggcgtaaggagtaaggccttgcttaatcatgtagtctataagattgttgtaatactgtactccttcttcattaattttcccttcgccatctgggaagatcctggaccaggagattgaaaaccggtatgcatcaaaatttaggcttttcatgagatcaacatcttccttgtagcgatgatattcatctgttgtaacatctgcgttggcgtcttcagcaatctttccgggggtgtggacgaagggatcccagatgcagggcccgcggccgccggacgtcgccgcgccctcgacctggtacgcggacgtcgccgtcccgaagacgaaccccttcgggaacgcgtcccggctcagccctcccgtgtccgcccccgcggcacggacgcgaagcccacggctgccaagcggcgcgacggccagggcgagcagcagcagcagctggatgcagcggcggcgatgcgttgccggcggagccgcaggccccgaggcgcccatcccggcgggctagatcagcgcggcagtttcttcagctcaagcgcgtgcgcctccttcacactcaacagggcaacaggtcaatctggtcggcgtcgggtcatctccctgtcgcaggccccgccggc

SEQ ID NO: 15602 - DNA, 1759 bp, Zea mays
aattcggcacgagggagctttcgaagctcgcccattgcctcccagtctcccaccctcgcaaccatcaccgccgcccaccgttcccaccgccgcggcctttatttctcccccttccatgccccgctcgcctccgccacctccccctcctcccgcccctaggtgactgtgactccctccggcgcctgaatctccatctcgctccccacccgccgcctccgccgcgagatctccggctgcccgcgccatggtcgccgcctccggccttgcgctgccgcgggtggccgcaccctgcccggcgcgcccgcggggtggtctccgccccgccttgctccgattcgcgccgcccgtggcactgccaccgcaccagctccggtgctgcgcgtccaccgtcgatgacggcgtggtgtccgcagcggcctccaagccccgcctccccagggtggttggtatgggttcaaagcttgtcggatgtggatcagccatcccaacacttggcgtttcaaatgatgacctttcaaaaatagttgagacgtcagatgaatggattgcagctcgaactgggattcgtaacaggcgagttctttcaggagatgaaacattgcgggggctctcaataaaagcagctcaaagggcacttgaaatggccaaagtaaaagctgaagatgttgaccttgttctcctttgtacatctactccagatgatttgtttggaggtgccactcaggtgctgacggacgtggggtgcacaaaggcttttggatttgatattacagctgcttgcagtgggtttatagttggcttaatcacagctactcgttttatcaaaggtggaggttttcagaatatcctagtagttggtgctgatgctctttcaaaatatgtggattggacagacagaggtacatgcatcctttttggtgatgctgctggtgctgtgttggtacaggcatgcagcgctgatgaagatggcttgctaggtttttgtgttcaaagtgatggcaatgggcaaaaacacctaaatgccgcaacggcaaacgatgagtcaatcttgtccaataccaatggtgttcctggatttccgccaaagaaggcaacctactcatgcattcagatgaacggaaaggaagttttccgctttgctgtccgatgtgtgccacagtccattgagaaggcactccaagaagctggtttgcccgcctccagtatagactggttgttgttacatcaagctaatcagcggattattgatggctgccagtcgattagatatcccgtctgacaaggtcatttcaaatcttgccaactatggcaataccagcgcggcatccatcccgttagctttggatgaggctgttcgcagcggcaaggtgaaggctggcgatattattgcggcgtcaggttttggtgctggacttacctggggttcagctattgtcaagtggggctaattattcgacgtgaaccgtgacaacatatcaatgagacagatagcttcaagccttcgaaggccttgggaggcctacatctgttggttcttttccgtgtttttctgtgcaacatttttctttcgcatgtgccagttttccttgcacatgaaaatgcagtgccattttaccgtaatccatctgttccttaggctcattacacagttgagagagattgtaatgtagttggcagtagtttgagtggtggatgtaatgtaagttcttgaattttgcatggagataaatttggtggggttaaaaaaaaaaaaaaaaaa

SEQ ID NO: 15603 - DNA, 3837 bp, Zea mays
  misc_feature (318)..(318): n is a, c, g, or t
ttacatacgtttctctttatttacatgtaggcacctaagtgccatagcggctaatgacgagtctatcttgtccaataccaatggtgttccaggatttccgccaaagaaggcaacctactcatgcattcaaatgaacggaaaggaagtttttcgctttgctgtccgatgcgtgccacagtccattgagaaggcactccaagaagctggtttgcctgcctccagtatcgactggttgttgttacatcaagtgggtgtcctaactgaaaatatacctgacctgaatcatcggtgttctaaatgatcttctgtgttacaggntaatcagcgtattattgatgctgctgccagtagattagatatcccatccgacaaggttatttcgcggccgcctaattacggcaataccagtgcggcatccatcccattagcattggatgaggctgttcgcagtggcaaggtgaagactggtgatattattgccgcatcaggttttggcgctggacttacctggggttcagctattgtcaaatggggctaattattctacgtgagccataacaacatcaatgagatcttcataggccttggggacctacatctatttggtctctccccccttccacccattttctgtgcaacatttttctatcgcatgtgtcggtcttccttgcacatgaaaatctagtgccattttaccgtattcctttggctcattacacaactgagagtagattggtggatgaaaatggttgaattttgcatcgaggatgattgtggtggtactaaagatgagattacactgtaaagttaatgagcctttttgtcagggaattttactgaataagcatgtacaaggagaggtgggccgtggacatatgctgtaggacaattcttagtaattttgttctgcttttattatacacctattgttcggatattttgttctattatgcacactaccgtgaaaaaaagtaaccttggtttgcgcgctgttagatgttttgtattttagctatctgatcgatcaggttggcacatgaaaaatggtattgcaagaatgtagttaacaaaaagtaaccatgtttttctttctgctgaataggctcgttgagcgttcaacctggcgatagcatatatttttcgtactggaagtggcaaatttgattggtgatgtatttgttcataggtccaccttaaattgcaacgttgtttggtgggtttgtttggtagggattttttttcagctttgtgaggttgttttgatagcgtctgctaacaaattaggtttataacaagaatgcctttatgaaacagttctccaggtgaagtaacatacacagttctcccggtactatgttttctctagccacatacacagcgagtggtctcttagctattttctatgaaaagttattttaccaaatatatatatatatatattttaaaaagttataaaaaaacattgattagtttctccctgagaccgaactactatactagaacgctgatggcggaaaaaatggaaaggaaaaatgaagtgaacccttgggaaaatgaaaatcccatgggaaattagtgttcccaaactagccctaaaaaattttccattgccgggatttgaacccgggtcgcctgggtgaaagccaggtatcctaaccggactggacgacaatggacttgctgcaaaatgatgtttcaaaattttattaccttattatactgaagcaccttcaaaagcgactattttttggtggttgctcttgctttgcctggtctttatttcatacagaacaagaagtgggtagtgtgtagagtagaggagatacacctccaggtttttgtacatacacgggccttgcttctgcatttctgccctgtagagatccagatttgttgctgaactagatcgcatagtgggcgatgtcgacgacgtcctcgggcctggtcggcggatgtgtcttgttcctcacgcgcagctgctggtactccttgtacaggaaccccctgtacagcggcgcctcgccgatattggccgtgaactccggcagcggttcgacccacctatctccgtgcgggttgaagaagaaggagaaggagtgcctgtgcgcgggcttcctcaccacccggtgcgtcgcgctcttcagactgttgttgctcagcacctacattaatttcgaacaagggagatttttactacgtcgtcgtgacgtcgtctaagggttcatgttggttgcatcaacaactcgtcgattctcagttgtcgtgtgctgcctgtatggcgtcgccgatgttgacgatgatgctgccgtcgaggggctccgccgggacccagtggccgtccttgaggacctcgaggcccccgacatcgtcctgcaagatgagagtgatgcagctggcatcctcgtgctcgctgaagccgatgctcgtgctctcctccgccgccgccgggaagtagcgcctcaccgtcatgaggtcgaagctgcggtcatcgttgtagttcttgaggaagcccggtgggaggcccatgcacccgttcaggatctcttggatgagcaatcccagttcggtgaacttgctgtagcactcctccactgtctctctgaagatgaaagatggttgcgtcagttgtttcttgctagatcacagtatcaggtgtttcgttagttgtatgacgaaacatttagccctcgaatcttttgaaatttcttactagatcaaagccgctatttggagtttggagccccctcccccctaagaattttacccgatgttattcaatcaaagattcaagaactcataaggtcagcggggacgggattttgcccccgaacccgaactgacctgaatccagcaggaccagcggggtacgcgttgagcccgagcttcgggtcaaataccaccaggtactcgttcttgtcggccacgtgcgccggctgccgtccgtaaccgcctgggagaggcaccttggacccttcggccgcccggaccttggccttctcctcgttcggcagcgcgaagaacgcggccgacagctccagcgcgcgcgccatgagctcaaccggcacgcggtggttgacgacgctgaagaagccgtgcgtctggcatgcctggagcacggcctcgctggcgccggcgatgcagcccttgccgtcttcggtgaagaaaggcgccaggtccaccacggggagctcgccgctagccgccatgtctgtcggctttcgcttctgttccccggttgaaatggcagacttcgatagtagtaaagccaattagccaatgccgtaagagcctcgtcgttgcgcatcggggcatcaatggcttgagtcggaaaaaaatgcggtccatcaacgttgattgtttcgccctttcgttttgacaagaatatgaaccttagaactttttctgattgcctcacgctccagtacacaacacacgccagacacatattaccacatcctataaagagaaaatgcgcctggtacgacggggccgtccagttcaatgagaaaaagagaacgaagctcccttggcatcccaccaggtccagcccacagctccctgacggcccacttagcccccatgcgccgtcacgggcctcgacgtgcgccgccagccgcggtcaatttgcggctgcgcctcttgtccagtcgtccccgtccccgcgttgagcggttcacggtccggactccggagtaaccgaaggaaggcagacggcaaagacctcgttaggccctgttcggttgttccagattggacccccggattaattcctagccggattacttctctaatttatatagattttgatgagctaaaatgaatcctagctcattctgg

SEQ ID NO: 15604 - DNA, 8377 bp, Zea mays
ctgcagtgttctactggtgttcaattggtttctaccatatgaaaagaatgtgccagccaaaattctgttttgatctgttagatgatgtatacatgcccatgtgatattggagttacatatggctaatataaaaaggacacctgaaccttaggcaagatgaaaggcagctttcttcttgtttccattcattgttcctgttttgactcatttatgctgaaattgctgatgctatttacttcttttctgaccataaggatgggggttgcaacttctttgagtggtgcgatgctccatctcccgcccctgccaatgcacgaaataacatggttgtacactcagagacatcagcaacagatatgctttgcccatgcagtgctggaacttgcttaattctcaccacaaagacagggaaaaatgttgggaggcagttcttttgctgcccattaaatcaggtaaactcaggattcaccaatgttacctgaattcatgacattttgccgtaccagatagcggcctatactggtttgtttttctggaagaacttggcccctttttatctgacacaacttgtttaattataacattgaacatctgcaaccctactccttcctgaatttgagtaatcaacatttgtgggattttgaacttgtttaattataacattgaacatctgcaaccatcctccttcctgaatttgagttatcaactaattgtgagatttttattgcaggatgccaccgatatcaattgtatagatagaagttgccgtagtgatttggattgtaggcgggaatttgaactgtttatcttgcagctgtgactcattagttggatctcatgtgttactttaatagataacagaagatgcagacagtatgatagttactgttgcagaatgcatttatcgattagctttcagtaggcaacatcagagatttggattttcaaaacactaacccatgactcatttgtctccccctcttgctcttatgtcaaacaactggtttacttttgggctattctttaatctagacatcagcataattattcttgttgtggtaaaatggcctgcttatacagttaaacttacacatgccatttcctgttggctgcctggtatagtagtgcatttcaagtcttggtcttgttagtggtaatgaaagatatatccttgtcctaaattgtttgtgtttaaactacatggtaatattgtgaagaataacattgttttcttgtcacgcttaaagcagccatgttgttagaccaggactagggatcctaacaatttaatctactgccatgtttggttttcatactaaaaatgtccagttgcactaataaaatgctacccgttcctttttttatatatagaaaaaggtaaatcagtgattcaatcctagttcctggtcctagatattgttccttctcttagtggagcacttagttacatctgtatcttcacgtacagcaactgatgctaggataccattattattatattttttattttaactcatgtgatattccacattccttttcatctttttcctctattagttttataatgcaccctcttatttttttctaacttgggcctttcatgtctatttctggtgcacgacggggacaaatcacccagggtggtggtggtggctcttgtggctttttcaagtggtgtgacgagctacagcctagggttggtgcaccactgcaagcttcagcgcaataccaagcggattccatgccaagcatccaaaaccccagccagaggagctcgtcttcctgcttcaagtgcgggcaggagaaccactgggctcgagactgtccgaatcaaccgtcggatccttatcctgacaagggtgggagaccagtagctccagcgggctcacctggtgcgtgctacaactgtggtcggtccggccactggtcccgcgactgcccaacctcgaatagtggtggtggtggtaccggcaccagccgtgccaggtcgtcctcagccttgagctcgtggaatagtcagagatactgataggaggctcctgtgaactcaattgaactgacatggacatgctgtacgaaacttggacaattgcccccctccacgtgttgcttaggtatgtgctcacgtcgatgccttttgctgctctacgctatctctctatatgtaagagagaactgttgctgttctctgtcttcaccctcaccctgttttatgctcctatctctgtcgaacttgggtctactgtttttttatctactctaggatttttcacatataaaatattgtatgtgtgggtctaaggagaaccatatcgtccaagcatttctttccatgaacttccatgcttatatagttctgttcagttcagttctgttcagttattgtctccttttgaagacttggttttagatattaactaatgatgatatgaagtagtcatttctaaactttatttattgtaccctggactttgtgaggtgggggcccaaacgaaacagcctttaaaagtctccaacagtagttcagttgtgttgatgagcttataatacgcacacccactgtaccattgtattaaagggatacgaatactacgcacgaaggctggtcctacgactggcccagcgttgccacccgctgaagcgcacatggacacatggtttagcgctcgcgcggcaaaggaatctccggggagctttgtcggggcctgcagcagtaatcgtaatcgtctttggcggtgggggtcctccgcctccggggtggcgtctgggcaccaatagcggtagcggagcagttgaactgcactgtggtacggttggtggtgcatcggtgcccttcactgccccctttggcctttgggacgacttggacagtctggggccgtggaggtacggcacatcacacgtcggtttctcgcggggatctgtgggccccccccctcccctctgtgacggagtagatctgagatgcctccagcgcaaacgccgaaacttcactggcgcagaattgctgttcatttgttttgctgtctactccagctggccggcccgctttcatgatcagtgcttgattcactacatcacgatcatggctagtctgtgcttgttgttactggtcatagtgtacggaactgggctgtgatggttttgccgacatgttctagtgcacatgtgtagaaaggaactcaggtcaggtgtagtatgtaggagtagctgccgagtcctcgctaaccaatggttgttggcgctatccaacgccttccaaggaggacaggggagtggagtcctgcaggggtagttagcaggcgcagccagagcccagagccagtctctggctattcaaactcctaaatatgctacaaatgcaagtcttttcacgtgactatcccaactcctaaatgctgcaaatgtcaaacccctgctgtggatggctctcgttacagttagttagttagttagttacgctatatatagttaacgagcacgagatgtacacgcgacgatttgcaagccgtacgtacgtatccccttccctttgggttggggggctggcgtggcatagtattattggccggaccaccggcgcagtgccgccagagtccagactgcgccattaaccgctagaaacaccatcgtttgtctcttccgcgctcgccagatccccagcaaagcaaactcccgcaagctggagccgcggggacgcccggtcccgaatggatggaccagcaggacgccaccgatgtttacgccgtaccactgccgccaaccgaccgagctggactgctgcacgatgctggctgcatgcacaagcacaactcatcacagtggcgtgtcctctgccgccgtggctgcatcgtcgcatcgcccccggacagggtgcccctagcgactccggccgggggcgcgtgcgtctccgtcgtcctttctgccgccgccacaggccaaagttgccgacgccgtcccgtccccggctccgctagctgcccagttcgcttgctctcagcagatcgtctcaggcagcgctctcacttgcctaacgctcgttggccggggtgcggcggcaccgtgtggcccacggctgtacgtcagcgcccagaaatagtatagtacctgtgcagctgcgcgtttggcctgccctcccatccatcacctgctttgggcggggtcgggacgtcgggtgaccaccaccaccaccagttcgacgagtgacggtcagttcggcttcgacggcatcagccggcttttcttttccggcaccgcgcacagtgctgcgcggcatcttccggtcttcccgctgtccggctgtccctgtggtagccgtagccgtaggcttcactggctggccgcagttggtgttgcattgcacgtagtggtcgggggcatcatccactgtacgcgccccgcgtgcggccttccctgtggcaccacctctccactccactccactccagattcgtgtgggggcacatgtacaatggaggtccgtcttgtcacgccaaatgaggttagtcactaattgctcccaccgccaccggaccggttcccttccccattctgcccaggatatatacacagattgggaatcttggactgggctgaaaccaccaccagacgcacgtatgaggttgaatatttaacgcattactagtacgtgtacgtctgttggacgattgctacacaggattctgtggtcggcactgctggatgctactctagatcagttgcacagttcacagctggtaccagcgtctccgtcgcagttaaagggtcagccttggcatgttcgaattcatccgtctaaattttagacatcaaagctaaagtatagcccaccttagaatctaaataggctctaagtttaacgcctagtcctacactagggcgcttcaagcttgcctactatacacacgtctaaagctccgcactagttgcagacttgcactcctgctttgcgaaagctgcaggcctgcaaaggttagtttgtaaaaacgactttacggtggagggagcagtaactaactttgatgtctgagattgtgaaccagcttttattacatggcgtgcgtgaacccaacaggaccggcctttctgcagccgccgctggctgctcctgtgtgctgacggtggccggcggcgagcctcgttctccacttctccctcccggcaggccccacgaagtaattgtcacggtacggatcggaggagggctgagctcagtatgggctccgctgtggcgcggcaccatgtgggcggccccgctgccctcccccgcccaatcacccgcgcccgcacgactcggcggctgactcgtggcccccgcctgcctgcgaccgcgccttcactccactcacgctcacgccgccgcacatattccccgtctcccgcgagcgagccagtggcagtgggtggtgggccttgtcgtttcgtctataccctttcgatattcttttattttatatatatgtaatgtaacaaaataaaaaagactgagagctcccaccgttgctcttccattttctttctccacccgggtgtgaattcccggcttttttatgtccagtcgtactccatgtccctcccttcatccatggctatacccgtactagtttctccttgccagcagcccagcagccgcctcctctcgtagcagtgctcctagtgtactcatcgctactgcttgccaatacagtactgcttaaaaaaagcacagcagcagtacctgaacctcccaaaaaaatcatgccccgctgtgctgttgggctccgcctggctagttttccatatatagaaaaaccgcagctctagacgaccaccagatcggactaggtagaccacacttcccttcacctctcatcggcgctctttcccttcctcgcagtcccaggtctcggctcccctctcagtcaagccgtttcatttcctccctcctacaaatatcctgatatggacgacgacgacgactccccgcctcatgagtcggcggcggcggcggcggcagacctatcgctgacactggcgccggcgccggcgctggcgcctcccgcgccgcctccggcgctgcccgccgtcgcctccgacggaggcgtggcgacggcgcgcgtggacggcaaggacgtgcgcctgttcccgtgcctcttctgcaacaagaagttcctcaagtcgcaggcgctcgggggccaccagaacgcgcacaagaaggagcggagcgtcggctggaacccctacttctacatgaccccgccgcacccgcagcccaatgcggcgccggcgagccccaccgccccgccgcccgcctacgcggcgggcggcctcctccccgcgccgtacgcggcccacgggtacgcccccgcgccggcggcgccgcccccgccgtcgggcccccccgcctcgcacggctccagcggggggctgcggtactacgcgccgccccacgaggcggcggcggcggcggcggcggacgcggggacgggggcgccgacgaccgcgggcgtcgtgcttgccccgcgcgcgcgctacgccacggccacgcaccagcagcaggcccagcagcccggcggcggcggccgcgatgacttgatcgacttgctcaactggaggaggggatcccacggcgcaccggccgccgccgccgccaccgcctcgccggccagcaccaccaccactctcaccacctcatacgccggcgcccccgacggcggcaccagcaccaacgacgacgacgacgctgacgacgccggggagctcgacctcaacctcagcctctagcactgcttgtatctacatctacctacgcgccaaggttattaatcgtgtgccggcctatccgtaagctacgcgtgtcacttaattagctcttagtaggcacgttaatccctctctctctatctctgctccctccctctgtatgtcctgttattattagtacgtctcgtcatctcccgtcccttctcccatggcctcatgaattgtttttttttggctcttgtttttcttgaggatttgtctgattgcgccccatcatcatccttgctggggcatccggttgtttgttgggggttcgccattgcctcgcgtgtatcgggggagtgaccgctgctgcctgatggtccggcgcgcggcagcaatcagcccgcaccagtggcaagcgcaatgcccgcccgcgcccagacccacgccacacccacggcgttgctgttgagctccttcctgcgtgctcgccatctaccgctgtgctgtgctgtacctgtaccacctgccgtcgtgacgtacgtacgccgtccggcgaccggcacgggcggggcggggcggggcggagctggcatgtcgtcgctgtgcatgctggcccgacggggggcacgcacggccaatcaatttactgatgctattggggtgcagatggccatatattttttgttcggtccgcgtcccatcttgctgggatcatgttttaaaaagcaagtggacgtgcaacagaatcccttctcgactcaacgtgttttttttattggatactatctatttattactatttttacctgaactactgtactacttgtttgtcgtatagtaaaacagcagcaaataaaaaagaaagtgtgtaaaatgagggcagtccggagatgtagcaagttctaggatgcgttgctgtccgtgtctgcaggagtagagtaggacgggccaacttgcatctcagtttccttttccaaaaaatactcgcaccggttcgtcacgagcccaagggacaaaaccggtggccgtccgatggcgccggagccccggtggcctggacgggaccttgctggttgctgccacctgcgcgcgctggcgctgggcccttcccgcgcgtgcgtggtccaatggtacgaacaggagtcgcggcagcgacatgggtatgggcagtgcccggcggcagcgaagagcgcagggggagccgtcggatcggatcggatcctctgcggcccgatagcaaccggaccggccgagacaccgattgagcgcggcgtgacagaaacacatgtacgcacaaggccttgcttgcctggccggcccatcagcccatgggagggtcgaaacgccagccagtgtcttggataggtgggggtggcagccggcggggcaggacactcacccaaaatttcgtatgcatcaaatacaagttattgtttctaaaatataacaatatgtagcacaacttacacgaccatgaaaaaaaatataatctttatagctcggcgtactgagcatgtgttacaatatggacgagtcaaaataatatgcatatgacattggttacaaatactcgtatttattctcaaatcgtgggaaaccccttccagcacttggtggtaaaaatttgatattcttcaaaatccggggggta

SEQ ID NO: 15605 - DNA, 2066 bp, Zea mays
gccagatattattgcagcctccggtcctcccttcccttcccctcctcgtctccccctctggttgatttgagagctcgggcaccagatctgaagccctcttgttctgtggttgtgtgcctttcggctggtgtagcattgagaggaggcgctgttccagttccagttccaggatgagcaaggaggatgtgctcaaggtgcagactttgatgctgagagtgaacatacactgtgacgggtgcgagaagaaggtcaagaagaccctccacaagatcgacggtgtctaccagagcagcatcgacgcggaacaggggaaggtgacggtgtccggcctgctggatccggacaccatcatcaggaagctcaacaaggccggcaagccggcccagctgtggggctccaagcccggcgtccctcagaacggccatggcggcggcaagggccagcctaaggacgccggcggtggcaagggccattccaaggatgccggcggtggcaaggcccagaagggcggtgcgggtggcggcggtcacaagggtgccggtggtgccggtggcgggggtggtggggccaaggatcctaagatggtgatgccgcagccgacgccgcagcagctccagcagctgcagcagcagttgcagatgaaggggctgaagctcccgccgcacctcctgggcggcaacatgccggcgttccccgcggccgcgccgttgaaggaccaccccaagtccgtcaagttcgccctccccgaggacagcttcgacgacgacggtggcagcgagttcgacgatgacttcgacgacgacgacttcgatgacgacgaggactacgacgacgagggcttcgacgacgacgtctacgacgagcccaagatgatgaagcccatggccgtgccgccgccgtccggcgggggcgacaagaagggcggtggtggcaagaagggtggcggcgggagcgagatcccggtgcagatcaagggaaacaaccagggcggcgggcagccgcacaacgcaaagggaggccccccgggcggcgggaacccgctggcccaggggaagaaaggcggcgccgttggcgggccgatgggcggcatgctgcctcagcaggccatgatgaggcctaacatgctgggtggcgctggtgccggcttccccggtacggcccagatgggcggcggacctatgggcatgccgatgggccacccgcacatgggtatcatgcagcagggcggaggcggcggcggcggcggcgtgccgggcctggggttctaccagggaaatgccaacggcggcggcggcggcatgcattctggcgcggagatgcttcaggccgcggcggcgtccgggaaccccatggcccagcagcagtacatggccttgctgcagcatcagcaacagcagcagatgatgctgcaacacgggaacggcggaggagcagggtacccggcaatgggctacggctatggccggccaccgatgatgcattacccaatgcccccgcactcgcaccccgagccatacaacatcttcagcgacgagaaccccaacagcacctgctcactcatgtgatcagcatatcgtctcttgctgccctgttccaagtaaaaaaaaacatctgaaggagctcaataccgctggccgccggcggacgtccgccatggttgaagcgccgtccgtgaatcaatcataaatcagtgtgcttggttgggggggatgatcgtagctagaatctgccccttttcctcctcccgtttcacctttttctctacgcttattttcgccttcctttcagaaaaaaagaacttccttgaatgcgaagtttggtatagtaattatgaatagtttccataagggaggagatggtgggggccttcttcatagccaacccacccaatagggggtgggtgggtggttcgcttgcgtcttcttccattctactagcttcataaaaggtggactgatggaagagcaaagttgtcaatctcagtaaaatcagtgtgcatatgtcgtggttccttttctgaccatatataatatatatatgtaatggtaataagttctgtttacggt

SEQ ID NO: 15606 - DNA, 3702 bp, Zea mays
gactctctctgaccattaccctgtacatcttggttatttaagatttatttattatttttttgaaaccatgtaatatttgtatggctataatacatattattagcataaacaggattagtatcgcaaacaaacaaacgtaactaaagtataaagagagcatattaatcttatatacaaggagatttcttatgcgtgtatattcagagagtatataggaggggcagttatcgggctcacttgaagacagccttaaaacacctgtgaaattccaccgattttaaaaatagggtacaaagtacttctaaaactatgctacatgaaagcaactgcttaaaaaaactacattttgtgtgtgtttggttgggtttctattttttttagtaaacacatttttcacagtcggcgtgtcattgaattattgaaaccggctgcagatctcaggctcagcaaaggtggatgggtcatcaccacctttgacctgttctgttcgtaagctagtgcaacccaacgcagcacgcagagcttatagaaatgtattttcctttgttaagttttacattttaatggccttataatttacatagatttttttatacttcttaacatatggtacgataaattagaactcaaaattttaaatattggttgaataaataatagagtatctataaaatttttaagattttatgatttttggtagtttgactgtacgataattgtacgaaaagtttaaatgcgtatcaattttcatcgacaaaatatgatgctctaccactacaagtatatttatatatgctcatgtacgtccaaattcagcttggacttgatgcacgcatgatggaacaatcttggactaacaacacaagcaaatctctagtttacttgcaaggaccaaatctcatcaccatacgagtcaatgaatgaattcaattcatcattcctcctcctcctcctccaacagcagctatggtggagtctagttagctacctcggctgccgacgcgtaccggcaccggcgccgccatggctctacccatccgcctgctttcgtggctcgcgctcgccacgcttctctccgtgccaggtgctgccgcgcaaccggtcaccaacatcaccgcggggaactccctgcaggcggccgccggcgccgcctggccgtccccgtcgggccgcttcgcgttcggcttctacgtcacggacgggggcctcgccgtgggcgtctggctcgccaccacccccaatgtcaccgtcacctggacggccaaccgcaacgtcacgccatccacgggcggcgcgctctgggttacctacgacggccgcctggtctggacgggccccgccgatggtcaggacaggcccctcgcggtgccgccgcggcctgccaccgccgccgccatgcgcgacgacggcagccaggtgtgtgtgtgtgtgtgaggcatttgctggcctgttctcagctcctctactgttcatcttctcttgcttcttttttcttttctttttgctgccattttcaatcaaggcaggcgggaggcagctttgcttgtgtgctcgcagcatatgttccctctcctgcagtcctgccatgtttgttcttgtcccttgaaatgaaatcccctctgtttctgttgttttccgtgacgttttccttcctcgttgcagacattgatgctgagagtgaacatacactgtgacgggtgcgagaagaaggtcaagaagaccctccacaagatcgacggtacaagaaaaaaaaactcatcttttgcggcagcgatttgcttgctgtttgtttctgtttctctgtcaacgtttggtctgcgtctgcttctgacggagacgtgatgaaatttaacctgtaggtgtctaccagagcagcatcgacgcggaacagggcaaggtgacggtgtccggtttgctggatccggacaccatcatcaggaagctcaacaaggccggcaagccggctcagctgtggggttccaagcccggcatccctcagaacgcctaccatggcggcggcaaggcccattccaaggaggctggcggcggcaaggcccattccaaggactccggaggtggcaagggccattccaaggatgccggcggcggcaaggcccagaagggcggtgcgggtggcggcggtcacaagggccctggcggtggcggtggcggaggcggtggcgtgggcaatcctaagatggtgatgccgcagccgacgccgcagcagctccagcagctgcagcagcagctgcagatgaaggggctgaagcttccgccgcacctcttgggcggcaatatgccggcgttccccgcggctgcgccgatgaaggaccccaagtccgtcaagtttgccctccccgaggacaacttcgacgactacggcagcgagttcgacgatgacttcgacgacggcttcgacgacgacgaggacgactacgacgacgacggcctggacgacgacgtctacggcgaccccaagatgatgatgaagcccatggctgtgccgccgccggccggcgggggcggacaagaagggcggcggcgccacgaagggtggtggtggggggaacgagatcccggtgcagatcaagggaaacaaccacggcggtgccggtgggcagccgcacaatgcaaagggaggcgccccgggaggcggggcccacctgggccaggggaagaagggcggcggcagcgccgccgccgtcggtgtcggtggcccgatgggcggaatgctgcctcaacaaggcatgatgaggcctcctaacattcttggtggtgctggtgccggcttccccagcacggcccagatgggcggcggacctatgggcatgccggttggccacccgcacatgggtattatgcagcagagcggcggtggcggttgcggagctggcggcatgccgggcctggggttccacccgggattgggcggcggaatgcattctggggcggatatgcttcaggccgccgcggcatccgggaaccccgtggcgcagcagcagtacatggccttgatgcagcagcagcagcagcagatgatgatgatgcagcagcagcaacagcagcacgggaacggcggtgcaggatacccggcggcaatgggctacggctatggccggccaccgatgcattacccaatgggctacccagtgctgcccccgcactcgcatgctgagccttacaacatcttcagcgacgagaacgccaacagctgctcactgatgtgatcagcaattccgcatggaatggccctgttccaagtaaaccatctcaaggagctcaatgtcaccgctgatcaccgacagacatcgccatggttgaagcgccgtgaatcaatcaacaatcagtatgcttggggatgagtcctagctagaaccctgtccctttcctgctccttccccccctttctctagcttattttcgccttgcttttaaaaaaaaaggaacttccttgaatgcgaagttaggtatagtaattatgaggtttccataagggaggggaggagagaggagacgatagggacttcgtacggggtcgttcgcttgtgggttcttcttccctcctggcttcataaaggtggactaatggtagaacaatgttgtcaatctcagtcgtaaatcagtgtgaatatgtcgtgatttctcttctaatctaactaactatatatatggtaataagttctgtttatcggagtcagctcc

SEQ ID NO: 15607 - DNA, 2163 bp, Zea mays
cactcgcacccttccgcccgcccgcccgcttgaatcttgagcacagagtaggctcgctcacaggacagtcacttgcctgggaagccagatattattgcagcctcatacaccgcccttccctactgcttcctgagatttgagagctcgggcgccagatctgaaacctcttgtgttgtgcctttggtagttcggtgtagcattgagctagcagaggtgctgttctagttccaggatgagcaaggaggatgtcctcaaggtgcagacattgatgctgagagtgaacatacactgtgacgggtgcgagaagaaggtcaagaagaccctccacaagatcgacggtgtctaccagagcagcatcgacgcggaacagggcaaggtgacggtgtccggtttgctggatccggataccatcatcaggaagctcaacaaggccggcaagccggctcagctgtggggttccaagcccggcatcactcagaacgcctaccatggcggcggcaaggcccattccaaggacgctggcggcggcaagagccattccaaggactccggaggtggcaagggccattccaaggatgccggcggcggcaaggcccagaagggcggtgcgggtggcggcggtcacaagggccctggcggtggcggtggcggaggcggtggcgtgggcaatcctaagatggtgatgccgcagccgacgccgcagcagctccagcagctgcagcagcagctgcagatgaaggggctgaagcttccgccgcacctcttgggcggcaatatgccggcgttccccgcggctgcgccgatgaaggaccccaagtccgtcaagtttgccctcccggaggacaacttcgacgactacggcagcgagttcgacgatgacttcgacgacggcttcgacgacgacgaggacgactacgacgacgacggcctggacgacgacgtctacggcgaccccaagatgatgatgaagcccatggctgtgccgccgccggccggcgggggcgacaagaagggcggtggcggcaagaagggtggtggtggggggaacgagatcccggtgcagatcaagggaaacaaccacggcggtgccggtgggcagccgcacaatgcaaagggaggcgccccgggaggcggggcccacctgggccaggggaagaagggcggcggcagcgccgccgccgtcggcgtcggtggcccgatgggcggaatgctgcctcaacaaggcatgatgaggcctcctaacattcttggtggtgctggtgccggcttccccagcacggcccagatgggcggcggacctatgggcatgccggttggccacccgcacatgggtattatgcagcagggcggcggtggcggtggtggtggcatgccgggcctggggttccacccgggattgggcggcggcggaatgcattctggggcggatatgcttcaggccgccgcggcatccgggaaccccgtggcgcagcagcagtacatggccttgatgcagcagcagcagcagcagatgatgatgatgcagcagcagcaacagcagcacgggaacggcggtttaggatacccggcggcaatgggctacggctatggccggccaccgatgcattacccaatgggctacccagtgctgcccccgcactcgcatgctgagccttacaacatcttcagcgacgagaacgccaacagctgctcactgatgtgatcagcaattccgcatggaatggccctgttccaagtaaaccatctcaaggagctcaatgtcaccgctgatcaccgacagacatcgccatggttgaagcgccgtgaatcaatcaacaatcagtatgcttggggatgagtcctagctagaaccctgtccctttcctgctccttccccccctttctctagcttattttcgccttgctttaaaaaaaaaggaacttccttgaatgcgaagttaggtatagtaattatgaggtttccataagggaggggaggagagaggagacgatagggacttcgtacggggtcgttcgcttgtgggttcttccctcctggcttcattaaggtggactaatggtagaacaatgttgtcaaaaaaaaaaaaaaaacagtgtgaatatgtcgtgatttctcttctaatctaactaactatatatatggtaataagttctgtttaacgt

SEQ ID NO: 15608 - DNA, 1950 bp, Zea mays
  misc_feature (12)..(12): n is a, c, g, or t
agcgtccgcggncgcgtgggcgagagctcgggcgccagaatctgaaacctcttgtgttgtgcctttggtagtttggtgtagcattgagctagtagaggtgctgttctagttccaggatgagcaaggaggatgtcctcaaggtgcagacattgatgctgagagtgaacatacactgtgacgggtgcgagaagaaggtcaagaagaccctccacaagatcgacggtgtctaccagagcagcatcgacgcggaacagggcaaggtgacggtgtccggtttgctggatccggataccatcatcaggaagctcaacaaggccggcaagccggctcagctgtggggttccaagcccggcatcactcagaacgcctaccatggcggcggtcacaagggccctggcggtggcggtggcggaggcggtggcgtgggcaatcctaagatggtgatgccgcagccgacgccgcagcagctccagcagctgcagcagcagctgcagatgaaggggctgaagcttccgccgcacctcttgggcggcaatatgccggcgttccccgcggctgcgccgatgaaggaccccaagtccgtcaagtttgccctcccggaggacaacttcgacgactacggcagcgagttcgacgatgacttcgacgacggcttcgacgacgacgaggacgactacgacgacgacggcctggacgacgacgtctacggcgaccccaagatgatgatgaagcccatggctgtgccgccgccggccggcgggggcgacaagaagggcggtggcggcaagaagggtggtggtggggggaacgagatcccggtgcagatcaagggaaacaaccacggcggtgccggtgggcagccgcacaatgcaaagggaggcgccccgggaggcggggcccacctgggccaggggaagaagggcggcggcagcgccgccgccgtcggcgtcggtggcccgatgggcggaatgctgcctcaacaaggcatgatgaggcctcctaacattcttggtggtgctggtgccggcttccccagcacggcccagatgggcggcggacctatgggcatgccggttggccacccgcacatgggtattatgcagcagggcggcggtggcggtggtggtggcatgccgggcctggggttccacccgggattgggcggcggcggaatgcattctggggcggatatgcttcaggccgccgcggcatccgggaaccccgtggcgcagcagcagtacatggccttgatgcagcagcagcagcagcagatgatgatgatgcagcagcagcaacagcagcacgggaacggcggtttaggatacccggcggcaatgggctacggctatggccggccaccgatgcattacccaatgggctacccagtgctgcccccgcactcgcatgctgagccttacaacatcttcagcgacgagaacgccaacagctgctcactgatgtgatcagcaattccgcatggaatggccctgttccaagtaaaccatctcaaggagctcaatgtcaccgctgatcaccgacagacatcgccatggttgaagcgccgtgaatcaatcaacaatcagtatgcttggggatgagtcctacccacaaccctgccccgttcctgctccttccccccctttctctagcttattttcgccttgcttttaaaaaaaaaggaacttccttgaatgcgaagttaggtatagtaattatgaggtttccataagggaggggaggagagaggagacgatagggacttcgtacggggtcgttcgcttgtgggttcttcccctcctggcttcattaaggtggactaatggtagaacaatgttgtcaatctcagtcgtaaatcagtgtgaatatgtcgtgatttctcttctaaaaaaaaaaacaaaaaaaaaaaaaaaaaaaaaggaaaaaaaaaaaaaaaaacccggccctcgagct

SEQ ID NO: 15609 - DNA, 5939 bp, Zea mays
  misc_feature (3985)..(3985): n is a, c, g, or t
  misc_feature (4100)..(4100): n is a, c, g, or t
gtcgggttatttacttatttttggcgagcaccaacgacaagcgacctgaaaaaacaaattttgcacttgcagaggaacctgaaggggccgactaatgcacaatctagccttaaatgcaatcgtacagatttgcactaggctacaaatgacaagattttgtcatttcgtcccctcgtcttgatgtctgcgctttgtgaaaaagtaccgctgatttgcattaggctacaaatgaccgacaagcacgtggtctgcgagcccggcatatagcccgttatttaggcttgattcgagtctgacctgactctatacgggctccaatctatcccggcacaagcggtgtgacgagtgtgacgagcttgttcagagtttttaggacatcgggctagctcggatacgacccgtttttaaataggctaaggatcgacccatttaataagacaaacattacaaaaataactctatttttaatttaagatctattatttatatgtgatatgtgtattatttgtaatatatgttatgtgtttagttatatccttccattgtgatttgtaaatgtgttaatttttatggtgatctagttttaaacttgatttatttattggcggacttagaccgacacaatgtttattttcgggccggtcttaccgtgccggcccgacacagttagacccattctatgacgggctcatttgagatttgagcctatcaaatagtctgtcccggcttcaatgactatacagatctaacggtactgtgcttaaatggatttaacgggaccgaaccaaattagatcgatctgtttggacatctctacgaggcacgggttcagaccggatcgggccgtttgaacatctctacactagacacagtactaggtaacgaagattcttccttaggcttcgttttgtaccaattcagggcttgttcggttagctctcaatctatgtggattgagtgggttgaatgagtttaaatcccaagcaaatcaaatttctttttaattttttccaatcctatccaatccataggtaacggaagtaaccgaacaagccctcatggggattgagggggattaaatcccctacaagtcaaaatcctctccaatcccatccaatccccctcaatccttatggttttaggatcaaacgaacatggccttacgcgtcacaggctaaattcaaacattagcacgtttgaaatagttattaactaaaaataattattggagaatatattttttactctctattacttcctccgtcctaaattataatttgtttgacatttttactatatttgacaggcttatcctattcaatttattttaaaaacgataatttgaaaaccacatttagagtatattatatgctaaatgatgtcattataaaaattaacaataattataatttttttaataagacgaatcgattaaatttagaataaaaaagtcaaatgtattataaattggaagggagtaagtattgtttagcaactcaatacatgtatgcttagctttttttttttttttttgctggaaatgccgtgagcgccacacgtgtacgtccgcgccagcggtctcatccgctgacgtgccgccagcctgacgtccacgccgcagggcgacgcgtccacgccacggaagcaacggtggcatcttctgcgcgtggcccctgggacggacgcgcgccgctgccgacctgccgtgtcgcctctctgcctgcctgcgctagtttaagccaactgcgcgtccgcctttctgaagcggttgacacttgacagacagccagcggtttagattctagcctttgaggcagcagtaccgcagcctaaatgccgtcacggcattgttaatgccagactgcacgtaatcaggccttgtaatatccactcctttaattttttttttcatttttttctggtgcgtgaagcatgttgaatcgaggtgaggtttcgttcggttgtatatagatagaacgaagggaattgaggcttaaatctttttctgtttatttttgaatttaatctcatccgatcctttttcaattcacttcttctaaccgaagaagcatgaggtggattcgtgattattgttgtatgtatatctcctgtacaatttgacctgctggctgtgtagtgtgtacacaggaacctcgcaagtcgcattcgcagctgaaggagaaagaggcaccacgccaaaaccaccacagcaagcggataaatatccaatgtcaaaagggttccttttgaacaagcaaccgaaaagatttttcttcgtcgctcgctcaccacccatcccacccccacaggccacaggccacaggccacagacgagacgatccccggtcatcgcctacctccctgtcctctgccgtccttcccttcgccacgtctccaagtatataggaggaggctctccggcaatgcccgctcccccatcatcctaccaatcacggcagccactccccgtcgtcgaccaaaagcactccggtgagctagccccggcagaagaatagccagcctgccggcgatccgcgcagaccacgccagccgccccacaagtcccagacggcagggattcctaaacataacgcgctattcctattattagccagccgcctctcgattcgcgcggcttaaccgccctcgtgcgcgtgcgcgcgcgcgcgcggtaggaggccacacgttccggaggcgcgcgcccagaccagggccgcccccgcgccatggacgtgctgcggttcgtgcgcgccgccgcggcgccgcagcctgcggtggcgccgccggcgtcggctgcgacggtgccggcgcagcgccagcggctgcgcatgtggccgcgtggcgggggagaccagccgcccccggtcggcgccgcctccacgcgcggcgcggagccgaggagcccgcccgacgaggagcggaaggcggagggggcccagcgggggcagggcaactgggtgctgcagatgctgcgggtgcagccgcggtgggtggatgcggcggacgcggaggccaccggcggcggccaggaaccggacgaggagacggcggctgcggctgcggctggcgctggtggcgtcgaggagtgcgcttcctgcggctgcggggaagacgacgaaggctgcgccgtggggtacggcgacggcgacggcgaggtgttcgaccgcgcgtcgttctcgcggctcctgcggaaggcgtcgctcggggaggctaaagagtattccatgatgtcctacctctgcaacatcgcctacatgatccccagaattcaggtaaccgtcaccgtcgtccatcgccacggctagctagtagtactgctactcttcctctctctctctctctcacgcgtcaattgcagtgcagctcgtcctcggtgaatgtggaattgctttcggtaaacgctcgtgagcatgtgattgtgccacacacttgtcgtcctcttgttcatgcgtgtattttccagcgtcaatgcaggggcgcgcggggtggtggtatttcctaggaaagcccatgccgaatctggtctattttggatttttactgtctacttctcctttccagtgtgattttccaatagctagtcttggactagtccgagtccatccttgagttctgcttgtcttcgccaattggttaattgccctgaactgtttttctggtctacagaaatatcgtcggagtttcctctgaaccagagtttcttacctttcccaccgcctaactcaggaatccttttgctttcatgcttcccatcccagccaaaatgtcttcggcgatacaatctgcggttcgtgacgtcgtcagtgcaagacaaggccggagttagcaaccctgaccagaagcaggagcgtagcaccaagaaagacgaatctggcgatcaagcatccgaagctgtcgacgacgcggtgccacgacgtgggctagggacgataaaaccgtttggtgcgtaccatgtagtgtcttctgctgcctcttacctgcactnccgggccatgggcgttatgccatttggtcccgggaatggcgtcaaggacgatcatccagcagccgtcacgtcgctcgtgagcggcgcgagcggtgacggattgagcgtggacgangcttcgttcgtggccacgacgagttcggtgacctccatggtcgcggcgaaggaggagacgcggcaagccgttgcggatgatctcaactcttcgagatcttgcccttgcgagtggttcgtctgtgaggatgatcagaacagcacgatatacttcgtggttcaggtaccggtaccgctagcttgtggcccaaatactcatggtgattcgatatgtagtttctgttcacttttttttttttgcttctgaatccaatttttgtgccattgtggtttgttttgctttttgtgacctacgtacagggctcagaatcaattgcttcttggcaggccaaccttttgttcgaacctgtcaaatttgaggttcgatgatactatacttgctgactgttgctaaaaaaataatttcagtttcaggagttggtagtagtatacgactacgagagcagccgagcaggtgaatctaaattcagttttctgatgcggcggcgctgcaggaggtggacgtgctggttcacaggggcatatacgaagccgccaaggggatgtatcaccagatgctaccctacgtgaaggcgcacctgaagagctggggcaaatccgcgcggctgcggttcacggggcactccctcggcgggagcctggcgctgctcgtgaacctgatgctgctggtgcgaggggaggcgcccgcgtcgtcgctgctgcccgtgataacgttcggcgcgccgtgcatcatgtgcggcggcgaccacctgctccgccgcctcgggctgccgcggagccacgtgcagtccgtcacgatgcaccgggacatagtgccccgggtgttctcctgccactaccccgaccatgtcgccaacatcctgaagctcgccaacgggaatttccgcagccacccgtgcctcgcgaaccaggtaggcccgtcaagatatctatccttgggcaagaaatggcttgcatggtggattctcgacgccggcaatctcctagcaaacatccatcatcatgattcatggacccgatccattgcatgcagaaactcctgtacgcgccgatgggggacgtgctgatcctgcagccggacgagcggctgtccccgcaccaccacctgctcccaccggacagcggcatctaccacctgggcggcggtggcggtggcggtggggcgggaggaacggcggcgaatgcgggcgaaggctccctgccgcagctccggtccgcgctgtcggccttcttcaactcgccgcacccgctcgagatcctcaaggacggcgccgcgtacgggccccggggctccgtgtaccgggaccacgacgtgaactcgtacctccggtccgtgcgcgccgtggtccgcaaggaggccaggcgcgcgcgggaggccgagcgggagcgctggcgcctgctcctctggtggccgttcggcgtgcacggcgtgtcgtcggcgtcggcggggcggcgcgggggcctcgtggacgccgtcagcgaggctgccaggcgcgcgcatctcttgctggtggtgctgctgcccgcggagctgctcgctctcggcgcgctcctggccgtcattaggttcaggtgattagataggctctcacgcgggttcatcaatccgttcgttcgttcgtacgccgtcgacacgcgcgattcttttgtaccaaacacacacgtacacacatacacgtctgcaaagcaaacgcgacgttgcagctgcgtcgcatgtatgtaaaatgaatgaaatgaaaaaaaaaacacaaactcgaattctttggttccgtccaacggttccctctcgacttcactcactcctcgaactatcaactatattttgagtcccctatgaact

SEQ ID NO: 15610 - DNA, 4038 bp, Zea mays
gcacccctttaagattaatttgagcttccattctatttttgctccctatatgaaacaataaaagatactctaattatgctatttaactccaagggtggaggtggaatgggtgactcgccccccctgctggttgtgtacatatctttagtacatatccattatgctatttaactccgaaaggagacaatatgcatcagtttcaacaactttgttgtttccttttcatgctgtcttatgggatggcattttctgctcaatttgtctgttgctgatttcagtcgggtaatgttctttctgcacaatgacttttgcttgcaaagtcgagtttggcattatgctttgtgtagatgtatctgagaattgcatgactgcatacccttaacatgaaatttcattttttagagattagattagattagatatgtcgctgatggaagtccaactaatggcgaactgaagaccgccgaccttgtgtctacacccgcacattctgttgcatctatacctccttctacaccagcacttcatgttgctcctgcacttttgtctacccctgtcagatgctcatctctatttatcacgccaccatactgttcctcaggtatgcaagcaatttttatttttgatctttctccttgttagcttgattgatctttctccaatacttatttgtgggcttggttaatctaggttccatttagttgttgaattagttctaaaatcatagtggaaccaaaatagtgtgtggatatttgcaaacgagtttctcttgaagtcatggtgtgaggaaaaaaggtaatgtccttcacattattctggcttagtataccttgttgattattgacatatgttggtcatgttggtgctccactaccttgttcgtatattaaggcatgctacatttcttaactacgtaccaatgatgtggatacgatttttgcagcaaagctatttttatcctggtgttatcttatctattctcatgacagtgaatttagttttattgttgacctcccacggttcttgacttcctaacatcggccactttatttttagttgattgactggcatgagggtggatacttgactgttgatttaccaatgtctcggggagaagttgtcattgggggtccaaatgtaactaaaggctatttcaaggatgaagctaaaacaaatgatgattgtgagcccatatatggagaacattataatcaatactgatcctttccataattactgtgttgcgcttgtggcagctgcacaaattgagctgtaaagctaggcttcccaacaaggagttaaaacaacaattcctcaaatttgtgctagaagcaagaggctgttaaagaagtgctctttagcaaaggtttcgtcattcttgcctaccgctgtccctttgcttcagaatacggtgaaacagaagtccttcattggctcttctcatcttggctcacatgcagtacttgaataccagtttcttcctgagcagccaagtgatgcatatgagaggggaagccagttgcgcttctatgatgctctagcagaagtgttaaactcaagggtagattcgttttctataggatcacactttacccatgtagttgagcaggcacctagctatacatttcacagtcaatcatctggttctagctgtttgtcaaatattattgctagcatggctcaaatccgaatattattgctagcatggctcaaatccacggtcaaaaattggcatccctcaagttgtcagatttgaaagctccctcgcatcccctaaaagattgggttatcatgatgaagaacatgtcacgtggacagaaaaacacaagaactatatttatggatatactatttttttcttcttttgtattattatattcatatccttttttacctttatattattattttttatatatgttgtatttgtctaatattacttcatcataatgaggaagctaagattgctagggaggttgaggctcatgaaaagagaattaaaaaggagcttgagagttgagaagcaaggtctactaaatagaaagaaagtgatgtgttgctaatctttttcgtatttttgcagaaagaagaacaaatgtagagggaaatggagagacatgatcacgagagatgtaatgaagagaggttcatgcgtgaaaggcaaaggaaagaagaaaattccattagcaacagagacgtatacttataactattatggtagataaaaaatgttacaatgtctctcttctatagaacgaaactgggatatcattcattgatatatgttcgattttattcaataattattatataattgtgcaccgtcgcaacgcacgggcatcgtactagtatatatatatatatatatatatatatatatatatatatatatatatatatatatatatatatatatatatatatatatatatatataagccacatgccttctccccctccactgtcttgagcaaaggagctgggaaccgtcctgaaagagagcgcgtgggcagagagagatcgaggagagataatccgtctccgtcgttgattcatgcgtgcgccggcgtcgagttcttagggccaggacaggaagctttgccacgtcttcggtaacgtgtccgtagccttcacgagaggggagtaccaccaggtcaccgatgatttctcaccggagccaccaagccgtcgtctaccgtggctagctcgagccatcgtaattcgtcaccggtaagtagcctcttcgagtttgtgatcttcttctacatgtattgagcgattcgaggggaaggaacggggcaccagtaccacggatgggttaccccggccatggcgtcgccgggtatgggtcacaacaccgctctgactcggcaaaaaggtgagaggagtgtggtggtgcactatgaccatcggatccttattgaacgcacaagattagatcattcaagtaccagttcggggataggtctggaccgttgatctatttgcggatggctaagattagattgtgtcttcattaaacctagatcgtcgagatcgaaacggtctaattgagttagatatctgcaaaccccttcacgcgttaaatcagggccattgatctagatctgagcggctcatattaaccgataacccttcgcccgagcatttttgcaaaagagacctcatatattttaaaaataaacctgttgtcccctgtacgataaaagttattaaaaagaggtccaagaatttatgattacacccttgcttttatgtaaatagtgcctgcattccaataaagcccaagaaattataaattaaatctgaaaatgatttttagtataaaataaaatccaaaagttagaaaatcaataacttctctactttaaccctattttagtccgttcaaattgcgttagtttcgtaataaaatttcctatgcaatagcaacatcatttgtgctatatcacacatctgtataattagatattgtgtaacctataactattaaattaacttctctaattagggataatctgactataattataatttaattaaaagatgacctctaacctacttataacctagatttgttatttatttgtaatatcttttatcacaagatttatattaaccaaaataacatagatctttcgaaaatcatatatttttaaccgtaactctgattttagtggttcttgaatctatgatctcgtagcggcgcgtaaaatattcttatgctgtttgtttatatgctttggtgtaatattaccatacccgttatttgtttgattgtatgtattgttacgcatagaagcgagatgacgagaaatcagaagaccaacttggtaaatcacttggatatcacaagtctaaggcaagttgtgtccttgtcactatttttacctaataatgttcatgttattcactgtgagattctcaggttaattggatgggacctaataggttaccctagttttgtttaccccacacgttgcaaacaaatgaactattgggtagtttagatatgatctacctagtttttgggaagta

SEQ ID NO: 15611 - DNA, 1554 bp, Zea mays
gacgccactcctacagttttacgtttacccatcaccaccagtccagcaccgagcaccgaccagatcaaccaggcccgccccgacccgaagatgcagcggtggctcccggcgctcctccgccgcgccgcgcccggcggcggggcggcgcggctcttcgcctcgtcctccctcctcttcgacgacacgcaggagcagttcaaggagagcgtgcgcaagttcgcgcaggagaacatcgcgccgcgcgccgcggccatcgacgcctccaaccacttcccgcgggacgtggacctgtggaggctcatgggggacttcaacctccacggcctcaccgcgccggaggagtacggcggcatgggcctcggctacatgtaccactgcatctccatggaggagatcaccagggcctccggcgccgtcggcctctcctacggcgcgcactccaacctctgcatcaaccagcttgtccggcacggcagtcccgagcagaggctcaagtatctgcccaagctcatcagtggggagcatatcggggcactggcaatgagtgaacccaactctggctctgatgttgtcagtatgaagtgcaaagctgacaaagtggacggcggctatgtccttaatgggaataagatgtggtgcaccaatgggccgtctgctcagacgctggttgtttatgcaaaaacagatctagctgcgggatcaaaaggaataactgcattcataatcgagaaagggatgcccgggttcagtactgctcagaaattggacaaacttggcatgagaggaagcgacacatgtgagcttgtttttgagaactgctttgtgccacgcgagaatgtcctcggtgaagaaggcaaaggtgtttatgtcatgatgtcagggcttgatctggaaaggcttgtattagctgcgggccctattggccttatgcaggcatgccttgatgttgtacttccatatgttcgacagagggagcaattcgggcgtccaattggtgaatttcagttcatacaggggaaaatggctgatatgtacacctcattgcagtcatcaagatcatttgtatactcggttgctagggactgcgataatggcaaagttgatcgcaaggattgtgcaggggtaattctctttgctgctgaaaatgcaacccaagtggcacttcaggcgatccagtgtcttggtggaaatgggtacataaatgagtacccaactggtcgtctcctgagagatgcaaaattgtttgagattggtgctggtactagcgaggtaagaagaatgataattggccgtgagctcttcaaagaggactgaaacttctattttgcaagccagataccagtgcatattgttagctgggggaggcgagcgagatttaggtatttagcaaatcacccctgtggttcaatgcttttgtataactgcagacatacatcaaataaagttcacttccttgtacttgctgcttacagtggctctatttttctgccaataaaggttttttgttatgactctaaaaaaaaaaaaaaaactagagggggggcccggtaccca

SEQ ID NO: 15612 - DNA, 1818 bp, Zea mays
cggcccccatgcagtccggtcggtggatccaatgcgatcaggccgccagctccctggccggctcccagcccgagcccatcattgcgccgccgcctccagctccagctcatccggatgagggggaaggaagacgataccagacgctactcctacaactcaccaccactacactatcccctccgctctctctccgcactactgcgtattaggtagcctctcgcattgacaagccagccggtggtttggttcgctttgctttgcttacgtgctgcgctgcgcgctccgaccaggcccgccccgaccggcgatgcagcggtggctcccggcgctcctccgccgcgcggcgcccggcggcggcgcggcgcggctcctcgccacgtcctccctcctcttcgacgacacgcaggagcagttcaaggagagcgtgcgcaagttcgcgcaggaggccatcgcgccgcgcgccgcggccatcgacgcctccaaccacttcccgcgggacgtggacctgtggaggctcatgggggacttcaacctccacggcctcaccgcgcccgaggagtacggcgggatggggctcgggtacatgtaccactgcatcgccatggaggagatcaccagggcatccggcgccgtcggcctctcctacggcgcgcactccaacctctgcatcaaccagctcgtccggcacggaaacccggagcagaagctcaagtatctgcccaagctgatcagtggggagcatatcggggcactggcgatgagtgaacccaactctggctctgatgtcgtcagcatgaagtgcaaagctgagaaagtggacggtggctatgtccttaatgggaataagatgtggtgcaccaatggcccgtctgctcagacactggttgtttacgcaaaaacagatctagctgcagggtcaaaaggaataactgcattcataatcgagaaagggatgcccgggttcagtactgctcagaagttggacaaacttggcatgagaggaagcgacacgtgtgagcttgtttttgagaactgctttgtgccatgcgaaaatgtcctcggtgaagaaggcaaaggtgtttatgtcatgatgtcagggcttgatctggaaaggcttgtattagctgcgggccctattggccttatgcaggcatgccttgatgttgtacttccatatgttcgccagagggagcaattcggccgtccaattggtgaatttcagttcatacaggggaaaatggctgatatgtacacttcgttgcagtcgtcaagatcatttgtatactcagttgctagggactgcgataatggcaaagttgatcgcaaggattgtgcaggagtaattctctttgctgctgaaaatgcaacccaagttgcacttcaggcaatccagtgtcttggtggaaatgggtacataaatgagtacccaactggtcgtctcctgagagatgcaaaattgtttgagattggtgccggtactagtgaggtaagaagaatgataattggccgtgagctcttcaaagaggactgaaacttctattttgcaagccagatatcagagcatattgttagctggaggaggtgagggcgatttagatatttagcaaatcacccctgtggttcaatgcttttgtataaccgcagacatacatcaaataaagttcacttgtacttgctgcttgcagtggctctatttttctgtcaataaagttttttatgtctctgacttatgcaatgttgttcagttgcattttactatattagtgtagacaagacagtaatataaatgtttcaatgagtgcaaaaaaaaaaaaaaaa

SEQ ID NO: 15613 - DNA, 1723 bp, Zea mays
attcccctcgaattagatccgagcccacagtctctcctcgggcccaccgcgtccgaccggcgatggcaaagaccccgtcgttcgcggtggcggcggtcgccggaggccgcgggccggttcacaaccggacccggctcctcctcctcctcctcgtggccgtcgcagcctccgcatccacagcggggttcctcctccgcggtgccctgcgagacccttgcgacggccgtggggaccccgccgccctcaacaccgccgtcgccagcgggagtcccctcgggttcatgaggtccaagctcgtgctcctcgtctcccatgagctctccctctctggtggtccacttttactgatggaattagcatttcttctgaggcatgttggctcgcaagtggtgtggataacaaaccagagatcacaagaaacaaatgatgtcacatatagcttggagcataggatgttgaaccatggagtgcaggttttaccagctagaggacaggaggcagttgatattgctctaaaagctgatctggttatcttaaacactgctgttgctggcaagtggcttgaccctgttctgaaagatcatgttcctaaagtccttccgaagattttgtggtggatccatgaaatgcgtgggcattactttaaggttgaatatgtcaaacatcttccctttgttgctggagccatgattgattctcatacaacggctgagtattggaatagcaggactagcgatcgcctgaaaatacagatgccacaaacttatgttgttcacctggggaatagtaaagaactaatggaagttgctgaagacaatgtcgcaagaagagtcctacgggaacatattcgtgaatcccttggagtacggagtgaggatctcctgtttgcaataataaacagtgtatcacgaggaaagggacaagacttatttcttcaagcattttatcaggctttgcagctcatccaacacgagaaacttaaagtgcctagaatacatgctgtagttgtgggaagtgatgttaatgctcagaccaaatttgagactcagttacgtgactttgtggtgaagaacacgattcatgaccgtgtccattttgtgaacaagacattggcagtggccccttacttggcagcaattgatgtgcttgttcagaattctcagggccgtggagaatgctttggaaggataacaattgaagcaatggcattcaagttgccagtattgggcacggctgctggagggaccacggagatcgtcctggacggctcgactggccttctgcatcctgctgggaaggagggcgtggcgcctcttgcaaagaacatcgtcagactcgcaagccacgccgagcagagggtctccatgggggaaaagggctatggcagggtgaaggaaatgttcatggagcaccacatggctgagaggatcgcggcggtgttgaaggatgtcctgaggaaatcacaggagcactccaggtcttgagctttgccgtgcccatcagcttgcgctaacatgttgaactagattttacgggctacgcctacgtggttcaggctgtaaactgtagattgcactctgttggtctactttttcacattcatgttttacctattaggccatgtccgattctattccaattcatataggttctatttcaatccatatagattaagagggattgaggagatttcaatcttagtaagtcaaaatctctttcaatc

SEQ ID NO: 15614 - DNA, 1076 bp, Zea mays
ctggggaatagtaaagaactaatggaagttgctgaagacaatgtcgcaagaagagtcttacgggaacatattcgtgaatccctggagtacggagtgaggatctcctgtttgcaataataaacagtgtatcacgaggaaagggacaagacttatttcttcaagcattttatcaggctttgcagctcatccaacacgagaaacttaaagtgcctagaatacatgctgtagttgtgggaagtgatgttaatgctcagaccaaatttgagactcagttacgtgactttgtggtgaagaacacgattcatgaccgtgtccattttgtgaacaagacattgccagtggcccccttacttggcagcaattgatgtgcttgttcagaattctcagggccgtggagaatgctttggaaggataacaattgaagcaatggcattcaagttgccagtattgggcacggctgctggagggaccacggagatcgtcctggacggctcgactggccttctgcatcctgctgggaaggagggcgtggcgcctcttgcaaagaacatcgtcagactcgcaagccacgccgagcagagggtctccatgggggaaaagggctatggcagggtgaaggaaatgttcatggagcaccacatggctgagaggatcgcggcggtgttgaaggatgtcctgaggaaatcacaggagcactccaggtcttgagctttgccgtgcccaccagcttgcgctaacatgttgaattagattttacgagctacgcctacgtgtttcaggctgtaaactgtagattgcactctcttggtctaccttttcacattcatttgtctttgttttacctattaggctttgtctggttctactccaatccatatagactgagagggattgaggatgtttcaatccttagtaaatcaaaatatctccctatccatatcaatctcttccaatctatatggattgaaaataaccgaatgaagctcttagggataggactaagataggaccgagggggtgtttggtttaagaaattaaatcatctaaaacgatgtggtgtatcataggtttatttc

SEQ ID NO: 15615 - DNA, 1663 bp, Zea mays
tgcaggaacctccaatggcgagccatgcgtgcaggcagcacgcatacgcgccctcgtcacctgtgagttgtgacgcaacctgtccctacctaccggacccaccaccaccaccttcctcttccctcggctcttcgcgcctcgcctcgcctcgcctatatataacagtctcgcgcctcgccccccattcatcagacggactcacagctcgcagcacctgcaccacttgacaaccagccagctagctaaccaaccggcggagccaagaacaagcaagagacaacttgccccgtccaggcagcatgtgcaactccaacgtcaagtccgcgggcgtcgcccagatcgacggccgcccggtgctgcagccggcgggcaaccgcgtggcggcgccggacgccgcccgcccgctcaagaagtccctgcacaagtccttctccatgccgccttcctacgacaacaatgccaccgtgcccgcccgtcccgcccctgccgagaacacccgtgcggcgccggcgccgccttctctgctgcctcctacgacgccggccccggccccggccgccgcgagggcgaccaaggcggcgggcgccgtgcccgcggagaagcccaggtccaaggccaggaagcccggcgccgtgctgccggtggcgacgttcgcggcgccagaggcgttcgagccggcggggagcatcgccgcggcgcggcgggagcatgccgcgcaggcgcaggcgcagcgcaagtcgcggatcgcgcactacggccgcaccgcgtccttctcccgggtggagggccgagtcggcgccaccgccacggccgagccggccgtcccagcctcccccaccaccgggctcgacgagaagcgctgtagcttcatcacgccctactctgaccccttgtatgtggcgtaccacgacgaggagtggggagtgcccgtgcacgacgacgagttgctgttcgagatgctcacactgtctggcgtgcaagtcggggccgattggacttccatcctcaagaaaagacacgtctacagggaggcgttctccggcttcgacgtggatgcggtcgccaagtacaccgagaagcagatggcgtcgctgagcgccgactacgggctggatttgggcaccgtcagaggaaccgtcaacaacgcctgccggattcttgaggtgcggagggacttttgctcgctggacaagtacgtgtgggcgttcgtgaacaacaagccgctgtcgccgagctacaagtacagccggaagatcccggtgaagacgtccaagtcggagtccatcagcaaggacatggtccggcgcggcttccgcttcgtcggccccactgtcatccactccttcatggaggcggtcgggctcaccaacgaccacctcgtctcgtgcccgcgccaccgcgtctgctccgccgccgcccgcgtaaataactgattctgctgacgaccaccaagcaaaacacaagagggaattatctaaggacaaccaagacgagagagagagagagaggtagcagtagtaatatacaaaagagagtgttggcggtttgcatgtgtgtatgatgacccagtgtgcttgtgtagattaattacggcctctgattagcgaatgaatgatcttgcttgctgtgaaaaaaaaaaaaaaaaaaaaaaaaaagaccttag

SEQ ID NO: 15616 - DNA, 1577 bp, Zea mays
ctcgaggccggccgggatcaaacggactcacagctcgcagcacctgcaggacattgagaaccagccagctaaccaaccaaccaaccggcggagccaaagccaagaaggaaggcaacgtgcccatccagtcaggatgtgcaactccaacgtcaagtccgcgggggtggcccagatcgacggccgcccggtgctgcagccggcgggcaaccgcgtggcggcgccggagccggacgcctcccgcccgctcaagaagtccctccagaagtcgctctccatgccggcctactacgacagcaatgccaccgcgggcgcccgtcctgcgccggccgagaacaccacccgtgcagcggctaattcgtctccgctgcctcccgcgaaggcggcgacgaaggcagcgggcgctttccccgcggagaagagcggcaggtccaaggcagccaggaggccaggcgccgtgccgccgccggtggtggcgttcgcggcgctggacgcgttggagccggcggggagcatcgccgcggcgcagcgggagcacgccgcgcaggcgcaggcgcagcgcaagctgcggatcgcgcactacggccgcaccgcgtccttctcccgggtggaggggcgagtagtcggcgccgcggccgccgcccccgagcgggccgtcaccgcctcccccgccgggcaggacgagaagcgctgcagcttcatcacgccctactcagctactcagaccccctgtatgtcgcgtatcacgacgaggagtggggagtgcccgtgcacgacgacgagttgctattcgagatgctcacactgtctggcgtgcaagtcggggccgactggacttccatcctcaagaaaagacacgtgtacagggaggcgttctccggcttcaacgtggatgcggtcgccaagtacaccgagaagcagatggcgtcgctgagcgccgactacgggctggatttgggcaccgtcagaggaaccgtcaacaacgcctgccggattatcgaggtgcggagggacttcggctcgctggacaggtacgtgtgggcgttcgtgaacaacaggccgctgtcgccgagctacaggtacagccggaagatcccggcgaagacgtccaagtcggagtgcatcagcaaggacatggtccggcgcaggttccgcttcgtcggccccaccgtcgtccactccttcatgcaggcggtcggcctcaccaacgaccacctcgtctcgtgcccgcgccaccgcgcctgctccgccgccgccgttaactgattctgctgaccaccgtccaccgatcaagagccagacgtaaggaagaaaagagaccttttatctaaggacacgtacaatacaaccgagaaaaaggagaaaggttagtagcctctagtagcactagatcgaagtagtagtatacgaaagggagagtgctggtttgcaagtgtgtgtgcatcatgtacgtatgatgatcgagtgtgcttgtgtagattagttacgcccccacccctaattattagtcaatgaatgagcttgcttgctgcgacttcaaagaaaaaaaaaaaaaaaaaacgcgtgggcggacgcgtggg

SEQ ID NO: 15617 - DNA, 697 bp, Zea mays
gacgacgagttgctgttcgagatgctcacactgtcgggcgtgcaagtcggggccgactggacttccatcctcaagaaaagacacgtctacagggaggcgttttccggctgcgacgtggatgcggtcgccaagtacaccgagaagcagatggcgtcgctgagcgccgactacgggctggatttgggcaccgtcagaggaaccgtcaacaacgcctgccggattcttgaggtgcggagggacttttgctcgctggacaagtacgtgtgggcgttcgtgaacaacaagccgctgtcgccgagctacaagtacagccggaagatcccggtgaagacgtccaagtcggagtccatcagcaaggacatggtccggcgcggcttccgcttcgtcggacccactgtcatccactccttcatggaggcggtcgggctcaccaacgaccacctcgtctcgtgcccgcgccaccgcgtctgctcctcctcctccgccgccgcccgcgttaataataactgattctgctgacgaccaccaagcaaaacacaagagggaattatctaaggacaaccaagacgagagagagagagaggtagcagtagtaatatacaaaggagagtgctggtttgaaagtgtgtatgatgacccagtgtgcttgtgtagattaattacggcctctgattagcgaatgaatgatcttgcttgc

SEQ ID NO: 15618 - DNA, 2296 bp, Zea mays
tctgtttgtaaattaggtgttcttcatacagtatggtaaagaaatcctggtagcctcaagaattattgaaatgacactactttgtacttatatagttatatttaatagagacaatggctatagcgttcttcaaaaagaacaaataatgcacagcaaaccaggtagatttttgaaacggtagtgaactagaaattagacattttatgcatgggattgttgcagaatgacatcctttcgcatagtaacaaagcagataggtgaatccacatggctagaaagagtgactagaagcaccttgttcgggaatacaaattagagctcttgtaatattgcattgcatcttcaatgaccctcttatactcaattgacccaggatacagcccgtccaagcacccagttgcctccaaactcttcctgtaaacatcccacgtgctacatttaccttcctcgccctgccgtttcctctcctgatacatcatctcgaacccacaggcaatcttcatccccagctctgcctccatccatttctctggcccctcctccctcctaggcatcgggtaccccctgggagcctgaaagttctgctgcacaagctgtgcgtacattgcccgcgtcatgcgtactgtggttctcactatctcaatcccttccccaccaggccctttgaggaatttttccatcctcgccgcatgtttcatggtgtcaatgtcccggtcgtagaaaccctcgatggcacgcgcgatcaggcatggctcctccttgagcacctttgccacgggcgccgggacgataacgcgtgctgtgtgtaggttctccgccgccctctcgggcagcccagcgatacggcgctgtatggctgcctggatggcgccggcagcgcgggtgtcgatggagtcgtcgtagacggcggcaagggcggcttccagggacggcgtctcggggaagagggagggcggcaggatgtggagctccccgcggaagatgaagacgcgattgggggcggattccgggtcgagccaccgtgggagcgcgaaggcggcctcgatgaggaggaactccccgtcggagtcccaggcgcgggccgcaatgtcggggaaggcgcgggtgagcgcgaagaggagggaaacggcgatccattcgtcggggagggagtcgccgaaacggagcgcgccgtggaggtggggcacgggcggcgaggcgcaaagcgcgcagggggcggccgggtccgccgggagggtgagcgtgaagggatcccggtggaagagatgggaggataggaagggggcgtggtgcgagaggagggagaggtggagggactggagcgaggcgtggagtgcgggcgcgggaaggtggctggggagtagtatcgggtagacggcgtagaagaggctatcttccggcgagcgacgggaggggaacgggaacgggttggaggcggtggccgccatggaaacgaggcaataggctgggggggagaacgatgacaggtccgggcacggggttttggccttttgggtttctttttctgaaacaggtatcggagattttgataggggccgacgggctcgaagcctcggatgccgccatggccgtccgggaaggtgcgagatttttgtgattaggacggtagcagaataggtttcgctcgaaggtaaaagagagccgacggcttcgcttttaacaataactcttctaaatggacaagctcaatcgttttgtagtgttaaagtctcgtaatccattgtcgtcaccattagtttagggtttaggaaaggttataggccatctggaccatgtccgtaagatgctagagaagacttccattatttatgaacaagatttgaagaataagtttccttcttgggacttcgatgtttacccttcagatgttgatgacccagagcttaaataaatctcagaagatccggagctgtgggaaatggtgtccgaggacctaaatgaagagaataaggaagttgtctctttgtatgagcaatgtcgtgctatgggttataatttcgaagagatttatggcattagttagatgtggctgcaacattttgttttcagggcaagagataagttgttattttcatcatttgaatccatagaaagtcaaaccctatgtgtaatgagttgtgtctggacttatgtactatggtggagttgtgttattgtaaggaaagcctgctttctattctaagtttattgatgtactttggttgcaagtctatttattgtatggaagagccttctttatatggaacaacatattttcggttttagttaactctct

SEQ ID NO: 15619 - DNA, 1426 bp, Zea mays
gacagtcaaaacctttgccaacttaaaagcaagttttctttccttttttatcacaacaaataccgcccaggtatggaacggaagataagtttttcctatatatcccagcttcacaagatgtcacgtgtacactagaatacaaaaatcacatctttttaacatctggagggacctttatgcccatgagtcctagcagactggaagccggaccgggaagaccttgttgcgaggagtacgagttcagaatactctcgacaaggttcagatctacatcaactggagtcatctctgcatcagtagctgcatcatctgatggaccctcattgttagtttccggtcgtggtgcatgagcaaagcttttctcaagagtggtactgcttagctctttatttaaagcatctgaatatgattccataaaagaatcatctgcatccttgtcacctaattcttcagcaaaatcgtcgtcttcatcagaatcatcaaagtccatgtccgacaatgaggattttctatcaaatccatcatcactgtcagcttgctcttgtgaacctccacctaaaactgattttatggccttgaagaactggttgacatctaggtccactgattcagcatctctcctgtctgcaggaatctcggctccctcaaagctggacattttgcgaatgaattcttgcatggactctgtaatctctccaagcttaaacttgtctgtctgggattttgaactgctagggacactttgcttttgacttctttgcttcttcgcagcttcatgctcttccagttccttctgcctttcacagagttccgcatttaactcatcatccccaccatacaaccaagagtcattatcactaggaggaagatcagtgcctttaaattcatcagttgagtacagcattgataggatttcatcaattcgccgcactggttcactcagtatctcccttgttcgggaatacaaattagagctcttgtaatattgcattgcatcttcaatgaccctcttatactcaattgacccaggatacagcccgtcaaagcacccagttgcctccaaactcttcctgtaaacatccccccggcggcccggacccgccgcgccctgccgtttcctctcctgatacatcatctcgaacccacaggcaatcttcatccccagctctgcctccatccatttctctggcccctcctccctcctaggcatcgggtaccccctgggagcctgaaagttctgctgcacaagctgtgcgtacattgcccgcgtcatgcgtactgtggttctcactatctcaatcccttccccaccaggccctttgaggaatttttccatcctcgccgcatgtttcatggtgtcaatgtcccggtcgtagaaaccctcgatggcacgcgcgatcaggcatggctcctcccggacgcgtgg

SEQ ID NO: 15620 - DNA, 1298 bp, Zea mays
agctgcggatcccccactacggccgcaccgcgtcctcccccccggccgcccgcccgcccggcgccgccgcgcccgcggccgcggccgccgagcgggccgtccccgcctcccccaccgggcacgacgagaagcgctgcagcttcatcacgccctactcagaccccctgtatgtcgcgtatcacgacgaggagtggggagtgcccgtgcacgacgacgagttgctattcgagatgctcacactgtctggcgtgcaagtcggggccgactggacttccatcctcaagaaaagacacgtgtacagggaggcgttctccggcttcaacgtggatgcggtcgccaagtacaccgagaagcagatggcgtcgctgagcgccgactacgggctggatttgggcaccgtcagaggaaccgtcaacaacgcctgccggattatcgaggtgcggagggacttgggctcgctggacaggtacgtgtgggcgttcgtgaacaacaggccgctgtcgccgagctacaagtacagccggaagatcccggcgaagacgtccaagtcggagtgcatcagcaaggacatggtccggcgcaggttccgcttcgtcggccccaccgtcgtccactccttcatgcaggcggtcggcctcaccaacgaccacctcgtctcgtgcccgcgccaccgcgcctgctccgccgccgccgttaactgattctgctgaccaccgtccaccgatcgagagccagacgtaaggaagaagagagacctttatatataaggacacgtacaatacaaccgagaaaaaagagaaaggtagtagcctctagtagcactagaagtagtacgtagtatacggaagggagagtgctggtttgcaattgtgtgtacgtacgagtacgatgatcgagtgtgcttgtgtagattgattacgcccccacccctaattagtcaatgaatgagcttgcttgctgcgaaaaaaaaaaaaaaaaaacgcccgaaaaaaaaaaaaaaaaaaaaaaaaaaaaaaaaaaaaaaaaaaaaaaaaaaaaaaggataaaaaaataaaaaaaatcaaaatttaagaaacgcaagcatgcaaactttaaaaatattttaaatatagacaccttaaattgaattgactggccacaacttttacaacggggtaaactggtaaaaaccctgccctttactcaacttattgcgctttgcagcaataaccccttttggcccaattaggcgtaaaagccgaaaagccccccccctttccacctttcccaaaattttaaaaaggctaaaagtggaaaag

SEQ ID NO: 15621 - DNA, 2731 bp, Zea mays
ctatggcaagaccttctgacatcagggctgttcttgcatcctatcaaagtggtgatattgctgccgagtttattgagcgctctaaggagcaccagaggcgcatgcaagaacaaaagaaatcaggacgcatatggaggcggtgaggactaaaagttggaaggaaaacataccaatgattttgacgcttcaatccgaatgaagtgaatggatccatcaaggattacaattttgtcatcttttgccttggcggttaataaacataccaaacgttatttataatcattcagaagacgccataccggctgaagtatagcgcttgctgtttgtatttttaagggtaatgaaagtattaatgcggcggttgctgctttgttttaagagtcgcgatagtattaattaatgtggtgcttgcgttttttatggattttatgatggtactccatcaccatctctttcaaaatactatagcctgttctaaatcaaacatggctaagtttaacaagaaatatatcaagatttacaatgtcgaattagtttcattaatatatctcaatagcgtatttatttgaaatgttctatatattgttatattttccttaagtatcgagaagtctgacttagaaacaaagtttaaatgaactattatttagaacggaggaatcaacatttaatgatccttggacataggtcgatgtcatttgatttcgagcttacatctatagcaatctgttgcgaggactcacccctctggttccgttgaaaacccacccatgaggccatgacccatcaaacatgagttaggttaatttcgtttgcctagtattattcttagagctttgaacgaaatgtattctaaagttaaaccaagtttataaaaagacttgatttgttagaccacataggtgcactaataaaacgatctaaagtttagcagctaactatattttacactacgattatcttaatgaagtcttattagcactatgttaaggaaaaaccttagaattggatgaagaaattagcaatggggggtggtttattgtgcaacatagatgtgttgctatttgcaacgaaacaatttgtgaggtgaaaatcaaaaccgaagtacctttccgataacaatagatgcttccatggtttattatggtggacgtgcggcggccggtttcagcccaagtttccaccacataatcgcgtacgagtggacgttcacgcgaccacaaactgtcgtattactatcggagaactcgagcagcggtcgcggccggccgtgcagcacatcagcgctcagcgggcgggagcagctcagaccgcagcgatgcaggggagcggcgcactgccgggccttaccggcaccgggcgcggcggcggcttcctcccgtgcggcagcctcggcaggcgaactcccgctggccgacgcggcgccaccagcgttcgcgccgtcgacggggcttccgttgcggccgccgcctccgcggccgccgattccccgctcccgcccgtgcaggtcacctggcagattgccgtcggtgctctaggtcggtccgtgttcctgtaacctattacctcgctcgagtgaattgcctgctgtcagttccacgagttcaattgtctgacactgacagcatcggttggctcttgctcatcgttcgtgcagctggagtgacgcctttcgtcgttgcaggagtcgagttcggcaaaagaatcgtgagtgctactagaggctagagctgggcctgtttcttctcgctctttagcgtactgttttcttttttcaactaagttttccctatagctgaataaattgtcgtccttcggaagttgggaccaaccaagaggcagaaaatgttttttttaaagttgcataaccattgttagccgaaatttactacagtagcactgaatttctgtcagttccaaaaataatgccgttatgtccttcattcatggccgtcgtttctttcctgattgttcagatcgcacagaagaaatgccaagtctgcggaggctctggtcttgtaacgaagaacgactattacgttcgatgccaaaagtgtggtaagaagagccccacgatggcatacttgtggagaatcaaacgtgacaatggttttcttccgcaggtggttttcttccgtggcagtcttggcgaagattcttcacggggtgaacgtggtctctgatcagtggtcttcagtactcaactagcgctgtaactaaggccccgtttggtttgggctaactaaagtttagtgactaaagtttagtcacttttagccactaaagaagcaaacatattgactaaagtggagtgactaaactttagttctttagtcaccaaatgagtgactaaaaggggccaaagtagtatttttaccatatttgccctctacactttctttttatagcaaacatccattaattaataggggtaaaacagtcattattcacagcaattaatactctttagtccggtttagtcactggaaccaaacgggttactttagcgcctaaactttagtcactaaaatttagtttagtgactaaaggaaccaaacagggcctaaagatacaatagatggacatcaccgtgctttaaatgcctcctcactagaccataaatgaagcaatatgccgtagtccgtagacatgtagaattactcatgcatgttgtattttacaaaaggcatcttacataaactatattttgccccgtaaaaaaaaaaaaaaa

SEQ ID NO: 15622 - DNA, 3172 bp, Zea mays
gggtacctcgaggccggccgggaagacttcgtctgatagtcatctcatcccctcccggctggccgctgctacgccttcttctacatcgcaatcacgcgcccgtccggctctcccccttctccctcgccctcacgcgctcacgccctcacctcagtcctcatcgctctcggccgcctgcttaaaccctccgctcgaaccggaacccaaccaagaacagatccaaaacgcaagccgcaccatgtctcgtgtcgcgggctcgcgcctcctccctaggatctctgcgctctccttctgcaccgcctccccggcaaccgccgccgcttcctcctcctcatccacagcggcggtggcagcggcagccgccaccgcctccgaggcttcctccaccgccggagacccatcctcccagccgccccagactgcccgcaagccgtggggcgcgctcaagttcgccgccttcgccgccgtgtccaccgcggttggcggcacgggctacgtcagctacgcttattctctagaggaagtggatcagatgacgcgggagctccggaagaagtcgaagcagcccattcctgaggatgcttctggctttgagaggtttcaggctatggcttattcagcagctatgaaagttcctgttgccgctattgaggtatacatggatgtgaggagccaaattgaagatcaaattcggggatttagcgaaccagtatcagacaaacttcttccagatcttgctcctcaagagcagcatgtattgactctagttctggatctgaacgagactcttgtatactcagattggaagcgtgagagaggatggaggacctttaagaggccaggagtggatgcttttcttgaacatctcgggaggttttatgaaattgttgtgtattctgatcagcttagtatgtatgttgatccggttgttgataggctggatccaaagggcaatattcgacataggctatcaagagttgcaactaagtatgaaaatggaaaacattatcgggatttgtcgaagctgaacagaaatcctgctcaagttctttatatcagcgctcatgctaaagagtcaagtctgcagcctgaaaattctgtggaaattaaaccttggaagcttgaaaatgatgacactcaattgcttgatcttattccatttctagaatatgttgctatggcaagaccttctgacatcagggctgttcttgcatcctatcaaagtggtgatattgctgccgagtttattgagcgctctaaggagcaccagaggtctgtggatattttcctatgttctatcacctttttatacttaattgatggcaatctgaatgttgatgtacccaactccacttctgtgaaattataagttatcatcagtcatgattatgaacaccatgagttcatcagtgtctacaataatcaataatgtttctgttcatctttaatatggacagttggtgatttggcatgccttgggaaattaagtctcagctgagagaaatagtgtattggtcgtcgaactaaactggatatagtttatataatatactgatgtattagtgaatcccactgtattacaagacaataattgattacttggaacaaaaaacacgaacaatcttgctccatgtctggtgataacaatcttgctccatgtctggtgatttatcctttgtttctcccttttttgctataacaaaaagtagggtttcctgattcatattgctctcgtgacaaaaacagtaatagatttaactgggtaaaagtcattgctatttctataatctaataggagaataaactttgatctcgatatgatggggatatgcagttgtaactttgtatcttctttccttgttagcttacacagtataattggtgcacattaagataaggggttttccatttggccattaaatactccgaattaacaaagctgcccctcaaataaagtaatttgtggaaactatgccacttcatccagtctctcctgatgctttcttttgtgcaaatttttctacgttggcgtgtagaacaatctcattcatttaagtatcttgattattctattcagcaatctgttttgtgttgagtggggctaaaaactgttgtctcactcctcaaactgtgcttgatctaccaatttccgtacctctgggatcttgtcgcataaacttcataatctagcacattttagttgccagttattatgtttgatggcaacctttctgtcatctgcaaacatgatgggggcctatttctggttatatttatagccattttttttcggttcaaccattcattgcttgctactaagctgccctttcttaaacaatttgattggtgttagagcaagacattttttttgccttttgtgtgggctgtgttgatttctttaagtacttctgcttgcaatagctgtacgactatatgcttcctggccactatatgcgtaggaaaaaagtcaaacggtcttatttttgacaggaggtagtaacatactaacatgtgtaacctaggtggtagtatagaaatgctctagtgtaccacgattatggattgtcaattttgcttaacgcttattcacatggtatcacttgtcgatttagaacttcattaaagctttttagcaccaccaaggagcaccttttgcaggcgcatgcaagaacaaaagaaaccaggacgcatatggaggcggtgaggactaaaagttggaaggaaaacataccaatgattttgacgcttcaatccgaatgaagtgaatggatccatcaaggattacaattttgtcatcttttgccttggcggttaataaacagaccaaacgttatttataatcattcagaagacgccataccggctgaagtatagcgcttgctgtttgtatttttaagggtaatggaagtattaatgtggcggttgctgctttgttttaagagtcgcgaaagtattaatgtggtgcttgcgttttttatgggttttatgatggtactccatcaccatctctttcaaaatactatagcctgttctaaatcaaacatggctaagcaagaaatatatcaacatttacaatgtcgaattagtttcattaatatatctcaatagcgtatttttctaaaaaaaaaaaaaaaaaaaaaaaaaaaaagtactctgcgttgttaccactgct

SEQ ID NO: 15623 - DNA, 1690 bp, Zea mays
ttttttttttttttttgcattaaatattatattattatatgatattacaatattgtatcaaaactgcaaaaataccaccgttattaatagtgcgtgagttccagactccatagaccaaacatggcttgagttccggactccatagaccatagtcatctcatccctcccaactccgctgctacgccttcttctacatcgcaatcacgcgcccgtccggctctcccccttctccctcgccctcacgcgctcacgccctcacctcagtcctcatcgctctcggccgcctgcttaaaccctccgctcgaaccggaacccaaccaagaacagatccaaaacgcaagccgcaccatgtctcgtgtcgcgggctcgcgcctcctccctaggatctctgcgctctccttctgcaccgcctccccggcaaccgccgccgcttcctcctcctcatccacagcggcgggtggcagcggcagccgccaccgccggagacccatcctcccagccgccccagactgcccgcaacccgtggggcgcgctcaagttcgccgccttcgccgccgtgtccgccgcggttggcggcacgggctacgtcagctacgcttattctctagaggaagtggatcagatgacgcgggagctccggaagaagtcgaagcagcccattcctgaggatgcttctggctttgagaggtttcaggctatggcctattcagcagctatgaaagttcctgttgccgctattgaggtatacctggatgtgaggagccaaattgaagatcaaattcggggatttagcgaaccagtatcagacaaacttcttccagatcttgctcctcaagagcagcatgtattgactctagttctggatctgaacgagactcttgtatactcagattggaagcgtgagagaggatggaggacctttaagcggccaggagtggatgcttttcttgaacatctcgggaggttttatgaaattgttgtgtattctgatcagcttagtatgtatgttgatccggttgttgataggctggatccaaagggcaatattcgacataggctatcaagagttgcaactaagtatgaaaatggaaaacattatcgggatttgtcgaagctgaacagaaatcctgctcaagttctttatatcagcgctcatgctaaagagtcaagtctgcagcctgaaaattctgtggaaattaaaccttggaagcttgaaaatgatgacactcaactgcttgatcttattccatttctagaatatgttgctatggcaagaccttctgacatcagggctgttcttgcatcctatcaaagtggtgatattgctgccgagtttattgagcgctctaaggagcaccagaggcgcatgcaagaacaaaagaaatcaggacgcatatggaggcggtgaggactaaaaagttggaaggaaaacataccaatgattttgacgcttcagtccgaatgaagtgaatggatccatcaaggattacaattttgtcatcttttgccttggcggttaataaacataccaaacgttatttataatcattcagaagacgccataccggctgaagtatagcgcttgctgtttgtatttttaagggtaatggaagtattaatgtggcggttgctgctttgtttcaaaaaaaaaaaaaaaaaagcggccaaaaaaaaaaaaaaaaaaaaaaaa

SEQ ID NO: 15624 - DNA, 2798 bp, Zea mays
ctgcagttttatactcttaaaaccacagaaataatatacaagcacgagataggctgaatgcatgtaaaagcttacatagtgtattctttctttcctattttgaacttaaattaattcaaattaaagaacatggcgaactttagacttggcaccatggtttgtttacaaagtattattattagtatacaggcatcaccattgcccattgccacggcgatacatatagtctgaatatccctcccactagctaaattagtagtctcccatctgctgtggaaatacattagaattgtatgcaaggttcacagctggatttggatggctatatgcccaacgcttcggcggtgcagttgaatccaacctttcgttggggtaaccatccaacctatgcagagcattctgtgtattataggccctccggtaaccctcgccatagtaagggtcggtcatgtcaaaccggacagaactacttacggatggtatttctgagtcagccacattgcctcctgaagaaaatggcaaaccaaacgtatgatactcatgaagaggagagactgtcatatgggcactgttttggtcttcatcaagcaagtcatttataatatcaatgtgggggaattcttcgcccactgacccatactgctggcgtgaaacaaaggttgcagcaggtatctccctctggaggaactccctacactgtagtccacccaatctgtgctgttccgtcccaatgctgctcaattgctgataagaaatatctttcaagtggtgtaaatgagcatcacaattggtcatttgctggttaggaaaatcatgtttccacgtatttctgttaacatcagtgttacctttccatgaatgccagttatcaagggtttctgccctgctaggcccaaacatgaagccttgcttacctggtaactggccattcctttcgaatggaggggccatgaccgatgttgccatcgcatatgctgaccatggctgtgaagctgcagtattcggcgaaacagaagttgattgctcaagacttgctggggttgtatcaagatggcccttaccaagaattgcatttcgatatgtctgtgttacatacattggggcggtaggtgaaggctcattgttcggccgttcagacacagtccgcgaacgtgaaagcattggaggaacttgggctgacatagtccaagaacgtgaaagcattggagaaacttggactgacggtgtaggtagcatagttgattttggtacctgtagcagaggtgcacttgtaggccttgacattggtgtaggagttccaggtacagtaacgactgcagccctcttagaaaccgtatcttctcgaggcttggagatagatgtggacagaatctgtcccgatactgagttatgatgtgaggcaacttcatcaggctggggtgcaggtgatttgggggcagcttggatgttagcaactttatcaagctgtgaagtagaagattttgtaggagctgctgtagctttagcaattgtatcaatctgtagcattggtgatttgggtggagctggagtagctttagcaactgtatcagcctgtggcacgggtgattttgggggagttggattagcctcattatcaactagtggtgatcttgaaggcatcaggatagctttatttgtttgctggattgaacttgatacatgttcttcacacaaaactggctcaagtttacttggagtgggactgacaagcacaggtttggtgtttatggtgtatgttgccgttgctggaataactccattgttgtcgtcacttatggctacaggtacagcctttggaagtggtgcattaatttttgcatcaccaacaattaccgaggattgatctggccccttcagaacctggggagtcttttctaaggagttggatgaggatgctaaggatgaatccactgcagcctcagcagctgccttcttttccaaatgggccttgagcagttccctgccctcaatttctttctgaaacaaacataaatgcaaacaaattaatcaagtttttttactgtcagctaaataaagcagcaggatagctgatagatagaagtgctacagaatacgtataatctcagtataagattaaataagctttgaacccaggaaatggatcaccaaattcttttgaagtacatctaccaagtaatatgctacaaatataatcaccaaacataggttcagaagaaacaaaacagttataatacaatcttgatgtatccagctacaccatagtcacagagatggaggaatggttactctgccaattagaacatggtaatcaagtgatatgtgttatctcgccaaaacatatccacagtatcagagcaacagctctggtgtttgttcctacaattgaactatgtagcaatcgcaatcaaattacaaagcattctatttatagtatcacagatctgcatcttacattttgtagatttcctagaaaaatctttgcgttttttacaagtattgtaattcagtcaaatacaatgaaaaccttcaccagaaaccaagaagtagtgtttttaggggggtggggggtggatatctcaaaaagattatataaaattgcaaattgaaaatcgtcagctatatctttagtatatcagcaatgcaaagactcgggggtataaaattgtgacaaagctaaaataaacttaaacagtgagctcgagcaagacagatctgtcctaaattagagtgaacattcaataataattaaaccataattataaatagtgtccaatactttttgagaacagggtacc

SEQ ID NO: 15625 - DNA, 3611 bp, Zea mays
tcaaccctatcccaagtgttgccccgatgactggtgggacagctaagaagaagtcaactgttgggcctatcgtcggtggagtgatcggaggtttggtggttcttgcacttgggtattgctgcttctttgtgatctgcaagcggaagaggagtgctgggaaggatgcaggcatgagtgatggacattctggttggctgcccctgtctctttatggcaattcacacacttccagttcggccaagtcacacactactggtagctatgcttcatctttgccatccaacctgtgccgccatttctcttttgctgagatcaaggctgcaacaaacaactttgatgagtccctcatcctcggtgtgggtggatttggcaaagtttaccgtggtgaggttgatgggggaacgactaaggtggctatcaagcgtggcaatcccttgtctgagcagggtgtgcatgagttccagactgagattgaaatgctgtccaagctccgccaccgtcatttggtgtcactgattgggtactgcgaggagaagaatgaaatgatcctggtctatgattacatggctcatggtactctccgcgagcacctgtacaagacccagaagccacctcttacctggaggcagcgtttggatatctgcattggtgcagctcgtgggcttcactaccttcacactggtgcaaagcacaccatcatccaccgggatgtgaagacaacaaacatccttctggatgagaaatgggttgccaaggtttcagattttggtctgtccaagactggcccatctatggaccatactcatgtgagcacagttgtcaaaggcagtttcggataccttgatcctgaatactttcgcaggcagcagctcacagagaagtctgatgtatactcttttggtgttgtgctgtttgaggtcctctgtgcacggcctgccttgaaccctactcttccaaaagaggaagttagcttggcggagtgggcgttgcactgccagaagaagggcgttcttgatcagattgttgacccctacctgaagggaaagatagctccacaatgcttcaagaagtttgctgagacagccgagaagtgtgtttctgatcagagtattgaccgcccttcgatgggcgatgtgctctggaacttggagtttgcccttcagatgcaggagagcgcggaagagagcggaagcctcggttgtgggatgtcggacgagggcactccccttgtgatggtcgggaagaaggatccaaatgacccgtcgatcgaatcgagcaccaccaccacaaccaccacttctttgagcatgggcgatcagagcgtcgcgagtatggactcggatgggctgacgcctagcgccgtcttctcacagatcatgaaccccaaggggcggtgaggtaaagctggtcccattcgttaccttgcattcattcagcatgtttttttcacgagttcgtgctgttacggttctctcgaattaagaaccagacgtccgagaattgtttcatactagatattctgccttgccctgtacttcttccccagtattgcaacgactgtacatctgttggcttgtattgtaccgctgctattgacccaactagtattttactttatgagaaagtgatgtgcacgaactattgttatgagtggtcgtgtgacgtgctgttaggaaggagtctcgactctgaattcgacatgcacacttgataatcagttttcaatctgaatgggttgcgagagctgatagatcgttgtcagaactgagattgtgtcggtctttgccctccagatgaattccaactgtcaaacaatttttatagaccgtttctgacgactaatcgagctggcagctgagatattcttcctttagacaaagtgattcttagaaagctgtggacatttcacatcggattgtaggcggttcacgttaaggtgttatggacactaatatactactacctccatcctttttatttgtataaaaatgaactgcaaaacgtcaaataaaaaaatggagggagtagttttgtgtgtgtgtgtgtagtgggtgttcattggttgtgtgatggtgactaacaaaatatggcgggttatgcttcatatacctcttgtttcgtgctgtatttgggaaagatcatgtaaccaatgctgatgacgcactggatcgtgcccttttagttccactgtcttggcactcactggcagttggcacttctctttcgcaagctcggtccttggacccatctgagctgggaggttgttgagacggttgtttcggtgcagtcgagaaacgctgccgaggtgacgggagagaccccacagtttcggtctcgggcccggaacagaggcgacgaacagttttggtttcagaaccatatggctgtttctctagatagctcgatatgattgcgttgttgattcccgtgttcgcgtccgctcatgtatcagtcatgtgcccaatgatcgtgctctactcccatctctactcccatctgtgagctgtttcttcttccgccttctggccgcacccaagcggtacggcctggctatttcaaattccagcaagaagctccgccagctcccattatccttccgataagactgcgtcggcatcctgatatccagcttggaatcatgagtaataacaaacgacgtgtgtcagtgttactctgcaatctgcatcagttatgcgcctaacgttgtgatgagcaagtcgtcggactattcgctttagattagccgactactgcagctctaatatatagaaacaaaaaaaattataaaaacagtaaaaataggtacaaattaaagtcaagcgattaggccgcatctttaaaaaggaaaaaaaagattggtgatgatgaagtatgtccaaagattcggtgttaaataataataccggagcctgatcgacacgctccagtaacttatcttctggcccgacatcgtctacgccgtccagcagttgtgtttgtatatgcacaccccgcgagagcccatcttaccgtccaagtggattctacgctgcctccgtagctccctcgactatagcctccttattcgatcatccccgacggactgctatatgtttcttcaactccatattttttttttaaaaaaaaagcaggtgtccgcgaacttaaaatgaatggtaggttagaatttgtattagatagttgttactgcccttgttctttgtggagaatcaacaagaatggcttaccatttttaatatattttttctaagcttgctaaaaaagttcttttttatttgtgtgtgtgtgtaatttcacttgttagatgaatatgtcatatgcaatggctgcaagagtccggataccattctttctaaagagaacagactgttcttcctccgatgcgagcaggtaaattgtttcataatgttagcattcccaattctctctggtttcgtcatgtgattatttgtcgcgtaatatcattgtcctattatctgaagtgcttctagattaaacactgcctatgtgcgttcttgcctgatcggcatggcttagtgtccttggcaaaagcttgcttcaatgagaagttgaaaactggaacagtactgaacagtactctggaatggata

SEQ ID NO: 15626 - DNA, 2805 bp, Zea mays
tgaactacaatctcacacattgggaccctcgaggccggccgggcatgtaccttatcaggatgcatttctgtgagatccagtaccccatcacaaagatcaatcagcgggtcttcaatatttacattaacaaccagactgcagtcaagggtgctgatgtgaatgcctgggcggccgtaagtggtgctaccacccttattggcactccggtgtatcaggactatgtagtgagcacatcgggtttaggggccatggatttatgggtagctctccatcccaatcccgactcgaagccacaaatatatgatgctatcctcaatgggatggaggtgttcaagctacagcttaccaatggcagccttgcagggctgaatcctgtcccaagtgttgccccggtgcctgatgggacaactaagaagaagtcaagtgttgggcctattgtcggtggagtggttggaggtttggtggttcttgcacttggctattgctgctttgtgatctgcaagcgcaggaggaatgccgggaaggatgcaggcatgagtgatgggcattctggttggctgcccctgtctctttatggcaattcacacacttccagttcggccaagtcacacactactggtagctatgcttcatctttgccatccaacctgtgccgccatttctctttcgctgagatcaaggccgcaacgaacaactttgatgagtcccttattcttggtgtgggtggatttggtaaagtttatcgcggtgaggttgatgggggaacaactaaggtggctatcaagcgtggcaacccgttgtctgagcagggtgtgcatgagttccagactgagattgaaatgttgtccaagctccgccaccgccatctggtgtcactgattgggtactgcgaggagaagaatgaaatgatcctggtctacgattacatggcccatggtactctccgtgagcacctgtacaagacccagaagccacctcttacctggaggcagcgtttggatatctgtattggtgcagctcgtgggcttcactaccttcacactggtgcaaagcacaccatcatccaccgtgatgtgaagacaacaaacatcctgctggatgagaaatgggttgccaaggtttcagattttggtctgtccaagactggcccatctatggaccatactcatgtgagcacagttgtcaaaggcagttttggttaccttgaccccgaatacttccgcaggcagcagctcacagagaaatccgatgtctactcgtttggtgttgtgctgtttgaggtcctctgcgcacggcctgccttgaaccctactcttgcaaaagaagaagtcagcttggcggagtgggcgttgcactgccagaagaagggcattcttgaccagattgtcgacccctacctgaagggaaagatagccccacagtgcttcaagaagttcgccgagacagccgagaagtgtgtttctgatcagggcatcgaccgcccttcgatgggtgatgtgctctggaacctggagttcgcccttcagatgcaggaaggcgcagaagagagcggaagccttggctgcgggatgtcagacgagggcgccccattgatggtcgggaagaaggacccgaacgacccatcgatcgagtcaagcaccaccaccacaaccaccacttctataagcatgggcgaccaaagcgtcgcgagtatagactcggatgggctgacgcctagcgccgtcttctcgcagatcatgaaccccaaggggcggtgaggtaaagctggccccattcgttaccttgcaggcgtaatttattcattcagaatatatttttttcttcaatgttctctcaagttaaggcttaagaaccagaagtgtgaggattgtttcgtactagatattctgccttgccttgtactacttccttctccgagtattgtaatgactatacaatctgttggcttgtattgtaccgctgctattgacccagccagtattttactgcacgagaaagtggtgtgcacgaacttttcggggggggtggttgtgtgacgtgttcttttaggaaggagtctcacctctgaatccgacatctacacttgacaatcagttttcagtctgaatggatacaagaactggtagaccgtcgtctggttattagcagaactgagattgtgtcggttttgtcccttcagacaaattccaattgccaaacaatccatttcacattggattgtaggcgcagggcggctcacgagagctcttgaggtgttattacagaataattgtttgggtgtgtagtggatgctgattgattgtgagatggtgactaacagaatatggcgggttatgcttcgtggctcttgtttcgtactgtggttgggaaaggtcacgtaaccacagcgttggtctcgttcggtcgcgcctggtgcggttggaatagaggcgacgaaccaactcgacttggtggttgattgtacttgattcccatgttcacatcacctgttctgcccagtgagtcatagacacggattgtgctctactcccatttgtgacttgttttttcccccactgtcaagaacatcggtctacactacacccaagccaggtgccagaagcctggcttttccaggttccagcaagaggctctgccaacccccgttatcctttcgtttaaggctgcatcaatatcctgatatccagctacgaatcatgagtcatagggcctgtttggttcaacttttttctgaccaacttttctgaaaatctggctgtggagagaatctgactgtgagaagaatctgagtattattacgattac

SEQ ID NO: 15627 - DNA, 5173 bp, Zea mays
  misc_feature (2766)..(2766): n is a, c, g, or t
  misc_feature (3107)..(3107): n is a, c, g, or t
ctgtgattgattgcttgctcatgggtcacggccatgaccatggcatcccctcctctgcaaaagcccgtgcctttggtgtcttgtcacgggcaaaagtggcgcatgttcattattatcccccctgcctttttgctttcgcaagccctgtatgtgtcctggccataaagatgcaatctttatcctctatgcacatacttcacccgaaaaaaagctaaaggggtcactgattggtgctgcttccttaaatcttgcatgtgtgggaactaggaggccattggtcacgggtactgttccccctactgttcttgcttcccgtgtcctgaccatttcagtattcgttcttgttactgatggtgttcttgtgatgaagggttgggtctgtgctcaggtgccagcaagatgcagggtgtgttgtcgagggtgaggaggcccttcactccgacgcagtggatggagctggagcaccaggccctgatctacaagcacttcgctgtgaatgcccctgtgccgtccagcttgctcctccctatcaaaagaagcctcaatccatggagcagccttggctccagctcattgggatgggcaccatttcgttccggctctgctgatgcagaaccaggaagatgccgccgcacagatggcaagaagtggcggtgctctagagatgctgtcggggaccaaaaatactgtgagcgacacataaaacgtggttgccaccgttcaagaaagcatgtggaaggccgaaaggcaacaccgaccactgcagatccaaccatggctgtttctggtggttcattgttgcacagccatgctgttgcttggcagcagcagggcaaaagctcagctgctaatgtgactgatccattctcactagggtccaacaggtgaagtcacctgatcgtctgatcctgcattgttatactcatttctgccacttaagtttgtgaatttttattttctcaacatttttttctcgaacacgcaggagaactgtgcatcatatattaaaagaagtaaaaaagtctaaagaagaccaaaatctgccataagaggcagaaagagataggaagtgggaggggcaccagcacactatattttctcaacataaatgacaatctatggttgatacatgtgccagtctagcagtcagggttcaggacgtaccaaaacattgaaaatgttatatcctttagacattgaaattttgtccatagccattcatagttgaaaattttgttcttgatttctttcaactggtcagtgatttcttcatgtaacctgtcattgatgcattccatcttttgccccgtgcccattcctatatataagattttattattatgtttgtttgttcaaacaattatggtaagcatgtgcaaagaaaggcagtaggaagcactataaataactgaaatgatatggtacttatgtcagtacaaactttagagataggtgaattctgttcatgatgaccctttcaaattttgacgacttactatagtcagcagtgaaagaaaaacaggacagtgtttccttttccttccatgaacttgaaatgttgactctggtttgcaggaatttgctggataagcagaatctaggtgaccagttctctgtatccacttccatggactcctttgacttctcatcatcacattcttccccaaaccaagccaaagttgcattttcaccggtggccatgcagcacgaacatgatcagctgtatcttgtgcatggagccggcagctcagcagaaaacgttaacaagtctcaggatggtcagctgctagtctcgagggaaacaattgacgacggacctctgggcgaggtgttcaagggcaagagttgccagtcagcatccgcagacatcttaactgaccattggacttcgactcgtgacttgcgtcctccaaccggagtcctacaaatgtctagcagcaacacagtgccagcagagaatcacacgagtaacagtagctatctcatggcgaggatggcgaattctcagaccgtcccaacactccactgagtgttcatcaggctggtctttgttgggaccacaaaataactgaagccatgttgatgtcctgagtttgctgatactaggttttcagtcgagtcttgtaactcctgttttagagctgttatatgttcacgtcatgtcgcctttcattttcggttcattcagatgggtgttctaataatttctttccttcttacctgtgaaggatttgagttccaatctgagacgtgggtttgttctaacttggaggtatttatgaatattaggcacttctgatttccaaaaaaaaaaaaaaaaaaaaaaaaaaaaaggctgtatttttttcaggcttttcaagtgctatactcttgaatgcttgatactgcctccgttctcgaatatttgtcgcctgttagttcatttttgaactaaaccgcaatagataaataaaaaagaacggaggagggagtacaaatcgagggagcacaaatcttgcttgagctccattaaattgtgaatgcatactgaatcacgatacttgaagttcatctgagatatacatgtgtcctcatattgtccttagctgattctagagaagtgttgattcgactacgaaggtgatgcggagccagttcctgtatcccgcgggcgcggcacatcctgttctaattgcttccaacgtttagcttctttaagataaaataaaaaatctctgtattgcaggttacatataaaaaaatcttgtggtatgtctttattcatcnctgtgtttatttcgtttttagccataatgcaagggaattttgagtagtaccttagcacataacttgttttaacaaacgcgcatgagaactgcactgcacatcgatatattaagaagatatatagaactaagatctcaagcccaaggtgtgcccttgtaacaaggaggtgatcaggtaaatcagttcttattatcatcagttcattagattgatttggtccaattccttgagagtaacattaacattgcattccgcataacacaacggaacatggtaacgctgctctttcagtagtaggatgcgcggccgccgtcagcctgatgaagctcctggccgagatnttgtacgatgccgccgccatgccctgccggttttttggtcgggtaagacggctccatcgcgatgccgcacagccctcgggagtccggcacgcctcgctgcattctgatgtagcccctctcgccccagtcctcgccccacgagttcttcactgtccagtacttggtgccgtctccagtggtgccgtacccaacggcggcgaccccgtggtctaggtccgtgccgcagcttccggtgaagacgccctgagagcagagcagagcaggcacaccgagcatacaaaatttttattttgttaagtaaaagcagattattccatcaaattacgtacgtaacatatacctctgagtagaactggaaatcttggccgctagcctcgattgcaacggccactggctggctcgcgacggctttctggagagcgtcttcgttgttagcagggacgtcctcgtatccatctatggtcacgtcatgggaccgttcctgcacagcgatatgttacatagtagtttagattaatcttagacgtgtacgtgattttggttctagccgcgtgtactttggccttgttacagctcctctgctcggcaaggtacgggtagttggactcggtggtgacgcctccgttcctctggatgtactggaacgcgtagtccatgaggccgccgtcgcagccttggttgtccacgtcgtcgcagtccacgagctcctgctccgacagggacaccagcttcccggtcatgatcttgttgacgccctccacggccgcgatggccgagaacgcccagcagctcccttcaacaacgagtgtccatgcatacaaagataccatctgtaagttgtgaattgtgatgacacacacacgctcacacacacagacaagcagctagccttgctcaccgcactggccttggtccttgacgccggtgaccgcgccgcggagccgccagtcgaccgcgggcggcaggttcgtcgtcccgctcccgccccggccatgctgcgcgtgcgcgaagctcctcgcctcgcccagctgggcgcggtggtggcgcgtccgggagccagcgtacgtgcgccggaactcgtccgtggtcatgtccgcgaacttgttcagcgccagccggaacggccggccgtccttcctgttcgcctcgtggacgtaccgcgcgttctccttgaacacgttgaaccggcgcgcctgctgctgcttgtcgtccccgtcccgcggcgacaccctgtggtagtggctgcgccaccgctcgtacagcgctcgcaggctctcctccgacgccaggtcccgctcgctgaacgggatgccccgcgccgccggagccagtgcgagcgcggcgagcaacaccgcagccagcaccaggcacctcgacattgtgcggtgtgtgagtagctagctagtcagttcaggccaactgcgacatggatcatgtgcgtgcatgcaatctatctagccatgagcatgtgtgtgctgtatatataaacaggcgaccagtgtagtgagggaggctcgatctattacgcggccgtttgaggatgatgggcggcggtaggagatggcgggaaggaagagaagaactttctctgctatagggataagttcaggaatgaatttaatgcaaggaaaatggttgccgggtttctaacaggataaggcgtgcatatgctgatatgcctatgattggaaggaagatgtatgactgagcgccggccgggaaaaatctaccaaaatgtaaaacaaacaggagtatccggcttcatcctcatcaggtcatattaacttgttaaactatctgcagtagctttacccattctatctcccacctcatcttttatttttcaaactccactctacgagcagtctacaatatctatactacttattaaaactctaaggtagcatgccttttctcgttctgccttccaataatctcaaccgtccatccatgactctgttttcatcgtccgtcggatgcaacctacaacaaccaacgccgaaagatgcccacgcctcacgcgagcaccggctccccagatccatccctcctccccacgcccctct

SEQ ID NO: 15628 - DNA, 1645 bp, Zea mays
cattgggaccctcgaggccggccgggaaaggtgtggggccccgcgcgcccgccggcttttgctccctccgttcccccatctggccatctccccttcccctgctcccccgaagcagcaagccagcctgcccacccgcagccatcacctccgccgctctccaccatgaatcccatccaccagcacggcatcgtacccaatccttcgtgactgttgcctccgcgcatctccgggagcaatggaaggaggccgagatgtgttcttaggtgcggcggcaagggcgccgccgccgccgccgtcttgcccgtttcacggatccgctaccgccacccgctccggtggagcgcagatgctcagcttctcctccaatggcgtagcagggttgggtctgtgctcaggtgccagcaagatgcagggtgtgttgtcgagggtgaggaggcccttcactccgacgcagtggatggagctggagcaccaggccctgatctacaagcacttcgctgtgaatgcccctgtgccgtccagcttgctcctccctatcaaaagaagcctcaatccatggagcagccttggctccagctcattgggatgggcaccatttcgttccggctctgctgatgcagaaccaggaagatgccgccgcacagatggcaagaagtggcggtgctctagagatgctgtcggggaccaaaaatactgtgagcgacacataaaacgtggttgccaccgttcaagaaagcatgtggaaggccgaaaggcaacaccgaccactgcagatccaaccatggctgtttctggtggttcattgttgcacagccatgctgttgcttggcagcagcagggcaaaagctcagctgctaatgtgactgatccattctcactagggtccaacaggaatttgctggataagcagaatctaggtgaccagttctctgtatccacttccatggactcctttgacttctcatcatcacattcttccccaaaccaagccaaagttgcattttcaccggtggccatgcagcacgaacatgatcagctgtatcttgtgcatggagccggcagctcagcagaaaacgttaacaagtctcaggatggtcagctgctagtctcgagggaaacaattgacgacggacctctgggcgaggtgttcaagggcaagagttgccagtcagcatccgcagacatcttaactgaccattggacttcgactcgtgacttgcgtcctccaaccggagtcctacaaatgtctagcagcaacacagtgccagcagagaatcacacgagtaacagtagctatctcatggcgaggatggcgaattctcagaccgtcccaacactccactgagtgttcatcaggctggtctttgttgggaccacaaaataactgaagccatgttgatgtcctgagtttgctgatactaggttttcagtcgagtcttgtaactcctgttttagagctgttatatgttcacgtcatgtcgcctttcattttcggttcattcagatgggtgttctaataatttctttccttcttacctgtgaaggatttgagttccaatctgagacgtgggtttgttctaacttggaggtatttatgaatattaggcacttctgatttccattgaagcgagatttctttaaaaaa

SEQ ID NO: 15629 - DNA, 3642 bp, Zea mays
cgaagtaacttgaggaggcgcggttggagcctgtggaggtaggaagcaaggtcgacagtgacggcggacgcctcgacggcagcggccatggcgagcgcggccgctagctgcgcgcactggtcctgctcgtggaggagcgcgtccgtgaggggccgaagcacggcggacgtcgaggccgaggccaccgccgcggtgcggacggaggagtcctggtcccgaacgcggcagagagcggcggcgaggatgcgcgggacgagcggggccacaacatcgcgcgggtgggacgccgcgatgagcgccagggcgcacagcgcatggcagcggagcggactcttctgatcataacactattttgacgctgatactgcagatagagttatagaatggagtttaaaatatatagacaggggcatagatcatcagacaagatcgcattgcagctgttgtgaggctgttcctctatctacttgttcacagctaacgcaactcgattttttttagaaagagtgcaaaataatagtgatagtgggatgtgtgttttcagtatttcaaggtatctatagcaggtggtatgaataaaacctcaatgaaatggatctatttcgagtcttatcaagtcgggtagtccaagtaatttccttccaaacaaaaagtaatttcttcccaaacaaaagatgcaattactaacaacgtgcagtcgagtccaaaataaataggggcaattttcaagtatacaatacatttagccactcgcttgcctacacttcagaattacaatgtgtactattcaggataaattccgatgcacaacagaaattcaagatcaggattctgaatcgagactgaacctctgtccttaacttgcaatatgaataaaagtcactaattgtacgattttttccactgaactactcaccaggtccgggcaaacaaagcgaaaggcacctcaacagcgccggacgaattcggccacgagggcgagctccttcacggctttttcgctgccgtgtttaggcaagaagaagacgtgcgcctcacccttggtctcgtagaactcgagctccccctcccagccgcacttcttgattccctctgcgtaagcccttgccctctccacgaaccagcactggtccgccgtggtcaccagcacgcggcgggaaccaagctgcctccactcctccggcgatgccattgggttgacgtaggggtggtcgaggccgaactttccgccgcagatgaattcccaagtgggatcgaacattgcgcggtagccgggatccgtgggctccgcgcccagcggctccttcccccagaagtaagggtacctcgaggacgccgccgctgaccatgtcgccgtaaccctcgatgccgccctcccggcccagccttatcgccacgttgtgcgccatgttaccgccggcgctgtcccccgcaaggacgatgcggaagacgtcgccgtgagcggcgagcgagggctcagcctccgcctcggcgccatccgcgcggcacgcggcgatgaccaccttcagggctgcgaatgtgtcgtcgtaggcggcagggatgcagtgctcaggcgctaggcggtagtcaacggagacgacggcggcgggcaccgcggcagcaagggaggcgacatagatgtggtacagcggggaggcggtggggttgcggacacggacgcggacgcggacgagtcccgggggagtcgcggacggaggcgagccgtggtggacgctctcgttgcatccttatagagtagtagtagaagtagacacaatccctatgacgctgtagcatccccacctatttgtaaacttggaacactcgtgctcacgaatgtgaacaaacatcaccaaacttgatgcagggcacattgcctaaactagtataaatcctaggtccttgagtgctaaccacatgagactctaggcgtatgtgctacaaaaccagcttttttccaagtgatttttattttctaaagaaaaattatttttttataaaataagaattccacggaaaaatagagttgccaaagtattcgctttgttccaaacctgctctaatagtatgacaaaagaaaaaacgaaatgaatacacttttcatctccagagcagctaccgcggtcgtcgtcgtctttcgtcagcaagaaagcacacggttgcctacacacggtcggctggccactgccagcctggcgccgccgtcgacgtctcacggcttggatggaaacaaccctgcacattccggcccgttgactagagaaatttcacgtcaaccgccgcacaaactttgggctagagctagtatcgaagaagaaattggatttataccattaaaagattataactttaaatatatagcattgttaacttaattgtatatagtggcgttaacataattcaattacatatgaaatcaactatatatatatttaaagttacaatcttttaatggtatagatctagttattccaagaaagaatcttttttttttttttttgctgttctggatgaatcacaaggcccagcctaataacaagtgaataatggtactggtactgcgaacaacaagccaactgaacccaacaatcaatcaccggtacttgacccggcaccggtcgccggagccaagaacgcccaggccgccgggcaccggcgggaccgggatgctgagcgcgcaccagaccgccggcctctgccgtacctttacgatcccgaacacgtacctcacccgcgcttcgacgctgagctccaggcccagctccgccttggccctcacctcgccgtccagctgcgtcccggcgtcgcctggaacggcgacgcgctccccgtcgaacacgaggcgcaccgcccgcccggccttccggcgctggtggaactcggcgggggacgccgcgctggcggccgggctcagcacggcgccgcggtaccggagcgcggcgtccagggtgtcgtagtagatgccgacgcgcttgctggggttgtagaggctcaggttcacggccacgtggtaggacaccgtgacgggggagggggaggagccggatgaagcgttggagacgctgaggctggacagctccgcgtagtccaccctggcgcgtatctggtgcggctggaagatggcccagtacatgagcacgacgacgcccagggagatgagcggcgtgcagcagctgcagcagcagctcttctcgcggtcggcgtcgctgccggccatggtgggcgcaggaggagcgtgcgccggccggttggtgttggtcttcggattgttgagatggggagggagtactacttgagggagcactactctccctacacatgctttggacatggattgttataggtgtccgattttttatgacttcataaaacgttttcagaatcccatgggctcagatcgttcggtacctgaaaatccacttgaaattgtcactctagttgactcgtctacttggcaattgcagcaagcagagacatgtccatgaactagtgatgctccattgacgtcgcaacagagacagttcactgcaggaactaactccattgatgtcgcaacagggacatgtgtgctccacatgctcggtaaaatgctcacaagactgcaattgatggactacaaacaagggcattattgcctttgtg

SEQ ID NO: 15630 - DNA, 4074 bp, Zea mays
tggccggctccggcgccaacgacgatgaggtcatcttcgagatggcgcagttcatccgcgtctacaagagcggccgcgtggagcgctacttcggctccgaccccgtcccggcctccacagacaccgccacgggcgtcgcctctaaggaccgcgccgtctccccagacgtcgccgtccgcctctacctcccgccgcccgccaaggataccgaagacaacggcggaagcagtaagaagcttccaatcctcgtgtacttccacggcggcggcttctgcctccacaccgccttcaacttcgtcttccacgcctacctgacctccctcgccgcgcgtgcccgcgccatcgtcgtctccgtcgagtaccgcctcgcgcccgagcacccgctccccgccgcgtacgacgactcctggcgggcgctcctctgggtcgcatcccacgccactggatccggtgaggaactctggctcaccgaccacggcgacttctcccgcttgtgcgtcggcggcgatagcgcgggcgccaacatcgcgcaccacatggcgatgcgcgccggcgccgagcccctcccgcacggcgcccgcatcagcggcgccgcaatcgtgcacccctacttcctcggagccgaccgggtggcctccgaggagacggaccccgcgctggccgagaacgtggtgaccatgtggcgtgtggtgtgccccggtaccacaggcttggacgacccctggatcaacccgctcgcggccggcgcgcctgggctggaggggctcgcgtgcgcgcgcgtcctcgtgtgcctcgccgagaaggacgtggcccgcgaccggggacgcgcgtacgccgcggagcttagggccagcggatgggctggggaggtggaggtggtcgaggtgaacgggcagggtcactgcttccacctcgtcgacttcgcgtgctccgatgctgtcgcgcaggacgacgccattgcgagatttgttaacctgtactaggatcctgcgatctcgtgggcgtcgtactttgcatatggtctacgcctgcctgatatgtctgtaaacctaccggcgaattcatactcttttacgtttctgcggtccgaaaattattgtcgttgatatacatccggctgcggtcggtggaggattttggatcgccacttgatcaatccaaacttgatttaaaacttttctgtgttctaatcaaaacgaggcacacaaatctaatgccatggcttcgactccccccccccccccccttgtttggcgctgcgcctgcagctagagccatagaatggagtttaaaatatatagacaggggcataaatcatcagacaagatcgcattgcagctgttgtgaggatgttcctctgtttacatgtgtgcagagtctacttattcacagctaacgcaactcgatttgttttagaaagagtgcaaaatagtagtgacagtgcgaagctgctctgttttcagttcaatgtatatctgtagcaggtggtttgaataaaacctcaaatgaaatggatcaatttcaagtcttatcaagtcgggtagtccaagtaatttcttttcaaacaaaagatgcaattactaacaacgtacagtccgaaagaaacaggggcaattttcaagtatacaatacattggacagttttcaagtatacaatacatttagccactcgcttgcctgcacttcaaaattacagtgtgtactgttcaggataaatttcgatgcacaacagaaattcaagatcaggattctgaatcgagactgaacctctgtgcttaacttgcaatatgaataaaagtcactaattgtgcgattttttttctctcgctgaactactcaccaggtccgggcaaacaaagcgaaaggcacctcaacagcgccggacgaattcggccacgagggcgagctccttcacggctttttcgctgccgtgtttaggcaagaagaagacgtgcgcctcacccttggtctcgtagaactcgagctccccctcccagccgcacttcttgattccctctgcgtaagcccttgccctctccacgaaccagcactggtccgccgtggtcaccagcacgcggcgggaaccaagctgcctccactcctccggcgatgccattgggttgacgtaggggtggtcgaggccgaactttccgccgcagatgaattcccaagtgggatcgaacattgcgcggtagccgggatccgtgggctccgcgcccagcggctccttcccccagaaataagggtacaggaggacgacgccgctgaccatgtcgccgtaaccctcgatgccgccttccttgcgcagccttatcgccacgttgtgcgccatgttaccgccggcgctgtcccccgcaaggacgatgcgggaggcgtcgccgtgagcggcgagccagggctcagcttccgcctcggcgccatccgcgcggcacgcggcgatgaccgccttcaagggccgcgaatgcgtcgtcgtaggcggcggggatgcggtgctcgggcgctaggcggtagtcaacggagacgacgacggcgggcaccgcggcagcgagggaggcggcgtagatgtggtacagcggggaggcggcggtgtggaccatgaacgcaccgccgtggaagaacacaacgacggggagcttcttcccggcatccactcccgcgggtaggtagaggcgggcggagatgcctgcggcggggtccaggacgatgtccttggacgcgacgccgttggcgggatcgccatcggggcagggcgggacggtctcggtgccgtcgaagcgctcgacgcggccggtcttgtacacacgcaagacgccgggcatctcgaactcgagctcggagtcggggtccatggcggcgtgggggttgaggagcctgtggatcgggaaccggacgagcagagcggctagcgaagcgatgagaagagccgcaaagagcacccgacacgacagtttgggcattcttcctgttcttcgtggttggtatttggtagcgagaaggcgagagatctggattctcgaccagtggatgaacgatccggagatctggtggggagtgggacccgcgggtggctcccgccggcccctctagcaggttagacaaaaaaaagctcaattgcgataataatttttaagccaaacgtttaggctctgcaaaattcaaatttaaatgctcaggtcttggaagattcatgattttatgaactcacgacatgtacaaccatatataatacaatgtttcttaaagattttttaggcgattaactaaaaaggtatgagagatgtactcttcacgaatagtatgttcatgtttgatatagctcaggcttctcgaaaaatgactaatgtttctgacatctcttcaagagtagtttctctataggagttagtatttttaacaaattgttcggaccctcttggtgtgagagaaggggagcaaggaaaaaagctgctaagagccttttttttgctctcgcttcaacttcttaatgctttttgttgggagctctttttttagaccgtttgataaggctcctgtaggagccggagcggtttaggagccctttcaaacagaccatatttatctatatgactctctctctatatagggatggtataataaaaacacttggcttcgccccgctacaggaagctctggtcagtcacatgtaaccatcacccaactagcgcgcattaaataaatgtgtttgtaaatcttgtgataagtttccactgtcaaatcatatctattgcatgcgcgaaaatgcacgtaaatttgagaatgggcatggggcgtataatagatcattttgaaagaaattgacgtaaaacctaaaggttggtgtcctaatttatacattttaggtcttaatgtatataaactccataactatgtcatcaaatgatgatcccaatatcgtaagtacatgaacggagatgattttacgataacaacattgaagaaaatgatgtagcataaaaactgatatagatctgcatagatgcttatatttttatcatagatgttaacaatgtaatatgaaagtagatttctttacgataccgtatcagttatgca

SEQ ID NO: 15631 - DNA, 2017 bp, Zea mays
ccgggctcgagtttttttttttttttttttttttttttttttttttaaagaaacaggggcaattttcaagtatacaatacatcggacagttttcaagtatacaatacatttagccactcgcttgcctgcacttcggaattacagtgtgtactgttcaggataaatttcgatgcacaacagaaattcaagatcaggattctgaatcgagactgaacctctgtccttaacttgcaatatgaataaaagtcactaattgtgcgatttttttttctctcgctgaactactcaccaggtccgggcaaacaaagcgaaaggcacctcaacagcgccggacgaattcggccacgagggcgagctccttcacggctttttcgctgccgtgtttaggcaagaagaagacgtgcgcctcaccctcggtctcgtagaactcgagctccccctcccagccgcacttcttgattccctctgcgtaagcccttgccctctccacgaaccagcactggtccgccgtggtcaccagcacgcggcgggaaccgagctgcctccactcctccggcgatgccattgggttgacgtaggggtggtcgaggccgaactttccgccgcagatgaattcccaagtgggatcgaacattgcacggtagccgggatctgtgggctccgcgcccagcggctccttcccccagaaataagggtacaggaggacgacgccgctgaccatatcgccgtaaccctcgatgccgccttccttgcgcagccttatcgccacgttgtgcgccatgttaccgccggcgctgtcccccgcaaggacgatgcgggaggcgtcgccgtgagcgccgagccagggctcagcctcagcctccgtctcggccccatccgcgcggcacgcggcgatgaccgccttcagggccgcgaatgcgtcgtcgtaggcggcggggatgcggtgctcgggagctaggcggtagtcaacggagacgacgacggcaggcaccgcggcagcgagggaggcggcgtagatgtggtacagcggggaggcggcggtgtggaccatgaacgcaccgccgtggaagaacacaacgacggggagcttcttcccggcatccactcccgcgggtaggtagaggcgggcggagatgcctgcggcggggtccaggacgatgtccttggacgcgacgccgttggcgggatcgccgtcgggggagggcgggacggtctcggtgccgtcgaagcgctcgacgcggccggtcttgtacacacgcaagacgccgggcatctcgaactcgagctcggagtcagggtccatggcggcgtgggggttgaggagcctgtggatcgggaaccggacgagcagagcggctagcgaagcgatgagaagaagagccgcaaagagcacccgacacgacagtttgggcattcttcctgttcttcgtggttggtatttggtagcgagaaggcgagagatctggattctcgaccagtggatgaacgatccggagatctggtggggagtggggaccgtgggtgtgggaagtgggtctctctagactctagcagcttagacaaaaaaaagctcaattgcaataataattttaagccaaacgtttaggctctgcaaaattcaaatttaaaggctcaggtccttggaagattcatgattttatgaactcacgacatgtacaaccatatataatatgatgtttcttaaagattttttaggggattaactaaaaaagtatgagagatgtactcttcgcgaatagtatggacatgtttgatacagctcgggcttctcgaaaaatgactagtgtttctaacatctcttcaagagtagtttctctataggagctagtgttttttaacaaattgttcggaccctcttggtgtgagagaaggggagtggggaaaaagagctactaggagccagatttttttgctctggctccgactcattaatgctctttgttgggagctcttatttttataccgtttgggagggcttctgcaggtcgactctaga

SEQ ID NO: 15632 - DNA, 4111 bp, Zea mays
  misc_feature (2542)..(2542): n is a, c, g, or t
  misc_feature (2582)..(2582): n is a, c, g, or t
  misc_feature (2970)..(2970): n is a, c, g, or t
cctgagaaatgttactttgtgatcaggagaaagaatcggtttcaccacttgtgtttttgcatgacagttctggcatggatatttacctccccttgggctggaacgagctgcaccaaggcactatgaactgagcttcacagattgttggaggaaagctagtcgaaggattgaccagacaagcaagaagggatttaacagtgctgtattttatatgcttggaccttgtggattcgcaggaataaagtgtctttgatggcacctacctctctctcatggaaaactaattagtatttcacagaggaatcgagattatggcccctggctggagctagaaagtttcaggaattgtatagaccaggggctaagactaacttgattagtccagcgtgcggtatttgtatcaggtgaacgtgtttcttagtttcttgcattcaaaaatgtgtttttaagtttttatggcaagccctatttctctagtgagataagggggttgtgttgtacagaaccgttctttttctctttaatacaatgatacacatccctcctccgtgtttgagaaaaaaaaggttctgtggggaagaatgtcgagtaagagtgacagtcatttctgtcctagagagagactagaaatctagcagatagagcaattgtctccaaaaatctcagacttcacatcaaagggccaattatcagtatgaacctgtcaactccaagtgtaaacccctaatgtcccctgaacaaacatgagcagaaagacctcaactcacttgtgtggtgttgctaacatgatctccttcacctgtccaagatgcacccaatgtcatggctagggatgctttgccctcaccatcgtcttccacacctgcagagaatgtgcatgagttgaatcatgtaatttagcatttaccaaaattgtaggtaatgatagttcatgtatgaggcttgccattgttgaggtctggaattgatctacaattctttagcccttccacttcacgattgaggcttgcaatgctcctgtccatttctgtaatattctcgagaagcttcaaagaatttgaatcgcatgtttcctgaatcctagtcatctggcactgataacgcatttggcacacccaagtgagattctgcccaccagttaaaccaagattctccaaatacgagtcaacaccttccccacgtgttaccatattcatatactcctgaaatttagctaaagacttcttgagtaacttatcgtattgttgaacactgcggctcaattgatccttgtctgcttccaatgttcgcattacaacactcctttctaaaagttcctgtcgtatagcattgacagtagcttcaatttgttgatccttttccatcaccatattcttaatgcactccacctcatgttgagtgtccctgcaagtcttttccttatccaggtatttactctccatgtcagacacataaccttggatccgttgcatgagggcttggaaacgtgaaatagtttggtaactgcaattgccccccacctcctgcggttgagggaaaaaacttatgttttggctgccaaaaattggcatttcctctaagtcaccaaagttttgggtgccccaaaaaaccaaagaggtttcttcttcgtcctccaactggcattgctgcaatacctgacctttcaaccccttctcaagcgccaagctcccattaccctcaacgaaacgctccggcctttggcgcaccatcagatggaggaggtacggtgcgtatcgccgtgtcgtgccagctactacctccctcttcaccgttgcccaaatcaagccagcccagtcgacctcgtacgccttgccttcctctaccaaccttaacgcggcagcgacctccatcgacaccgtaaagccgctctctccccatcccagcagcacgcgatcgcagacaaaccttctcacggctccgatcgcctccgccgtggagaacacagccgcatcccatcccgcgaggaggccgaccgggcccagcggcagcccgagggcgaccgcgaggtcggcgggggaggcagagacagcgtcaccgcagatagaaaccataatgcggcctgaagcgtcgtcgtaggcggcggatagcccaagctcgtcgggcgggggctcagggagggacaaccgcgcgaactcccctagccccacgacgtcgagaaccaccgcgtcgccggggtcaaagccgccacggccgcgcttcagatgccgcatcgggtgttctggtgctagggttgggtggggaggccggggaagattggggttttgagctgccggagtggggttttttgcgcaaagaggttagaggcgagtgagagaggcagttgattgatttgaacaagagattgggtgggggaatggccgagtgggacgtgggaaggaaggggcgccactccggttcccggctcctcgctgaaaatgggcccgtatcttctaggtcgcactagtcaatgaaattgtacttcgggttgagccgttgagcagcgaggggtactggtttggagggttttttttcggctcttggnacatcgaaatgaagcgaaggtaggtgtacaggttatacgnatgagaggaaaatgtatttataccatagatttatttatagttgatttaaaataaaagatatgaatagaaaggcaggtgtgctgaacaataaatttgatagcactggaggacggtccatgggtaagtctgaaacgtccgagattagatcggttcgaaccggagtcctgatttgttgcaagatattccttatttctacgataagtctagacattctctcctataaatatgaaaggatacgaccgattgagaatatatataatccaattgaattaatctatctatattaattatcttcatgtcttagctctagttgtagttcatcaatcttaatcatcatctctcttcggctctatgtcgtatagtgatgctttgggtggacttctgatcntgaagcaaccttacgatctctccttcccgacggggtccctcccagaaggcgagatctagattctatacaaagccctctacgccatcgcggacagtccaccgcctacatgtagacggtccgcgcacctatagagaagagcggagttatttgtgccaccgtggatggtccggtaacctacctcggaccgtctggtgccctatcatggacaattcggtgcccaaccgtggatcgaccggtaccttgcatagccgacaccaaagtaccacatgacacatgaaggccctagggttcgttagtatttggcccaaaaggacgcctgcctaggagtttacgacatactttttgttgactccactggggacgaatgtgtttaagatatattagagcgaccacgatggtcggtcccaaagatcacaccacagtctctccagacaatatccttagaccatttatggagagtttgtcgaccaacgagcagcaggaatttgaagatctcataaaccaggatcgtgaagagaaggagagatttctatcacacttcacggtagatcaacactagaagatcaccaagcaagcagagatcagcctggagtccctcctaccttcgcctacaaccaccactataagtaaatgtgatgacatacgatctcttagacaatatgtagatttacaaaatgataagatggaacagtcactcaagagacttgcacgcgcattcgaaaaatccattgttcctaatttttcatctcacgatgtcatagttgaggcaatctcaccaaacacatcggcaacaaatgagccttctcaatcccaaccattgtatggtatatcgatgaactcgtaccaagggcaaccactgcccccacaacccctgtgctatatgacaacacccttgaccacggtcggatcgcccggtaacccatcgcggactgtctaacatctcaccgaaccatctggtgacctagactgtccaatgtacaacactcagattgatgcaatatgcacaacacttagccacattatataccacaacaccactatctttctccaccttcggaccaccaaagtcgaagcattcccacacctagggccaagtatcgcccgacacataaggagttagagggattcacaccaccacaca

SEQ ID NO: 15633 - DNA, 771 bp, Zea mays
cctcgaggccggccgggatactccccccgtctccggcccacaaggccacaatccaagccgaagaaccctaggcggtggcggcgcatcctgcataccccaccgtagtggcagcgagccagcgacctcgagtagcagcagaggctccgcaggggcgaaaaggtgtgaagcttccttcggagatcccagtagcagaagcaacgcaggcatcggcttgcgacaggagaggacggagatgacgcagaagcagaccctgttcaaggggcagagcaagaagaagactatccctcccaaccgccacggcaaggcgcctcatgttcgtaaaggaaagagagccgtcaagcccaccaagttcacaaaggacatggacgccgagaaggaactcaccaagttcatcaaccagtgcaacgaaataaaagctgcgaatcttgctagcaaagagggcggtgacctcaacatagtgaaggcggatggcgaggaatctaaatcaaagaaataggaagccagaaactgaaaacgagtgtgtgaaacgtgatgcgtggtaaactgttaatgcgatgtattctgctgaagaaaattcagttccgtatggctgggtagatgaacatgtttagcgcaaagtgacggtgtaactgcaaccggggtaatggcttgcaagttttgttctgtgccatctctatttctccaattattatattgatgaagtttgtgtgcaaaaaaaaaaaaaaaaaaggcccctagggcccccctgcctcccatttaattaaaaataaa

SEQ ID NO: 15634 - DNA, 985 bp, Zea mays
tcggtaccgtgggtgctctaccggcgacctgcaggctttgcggctcctgctgctgcattaactcactacacaagcgtaaccctgaacttggaaaatcaactgaagttccatgagtacaggctatctgcaagtttctgtcttttagcacaagaaatagaccggcatgtgaacgctacagagatctatccaatctagatggctgaaagaacaagcaaaggtgagaatatagcagcattgttcctaaggataaaacaaccaagtcctcgttagtatgaatataattggtcaaagaaaaaagtgggtgaaattttctgaaatttctagttacagcaaaccacaatggggcatttttttgtcctcttttcgaaccagtatatgcatacctgtaactcgtagcgtcctatggtagcattcttgaagtgattgaatttggttagaggccatcatgtgttgtttgtgtgattgtgattcttcgtagagtaagtaattcataaccgcccatgataagctggttattatgattagaaataggaatcactgatgcctcttaaattctgcaggctcgcaggcacgagggtgaccgtccacctggatggactggtcaacaccattatggagtgtttcagcgaccccaaacctaagaagaaagctgcacgggagaacgccgcacaaggggcattatggtgccttgagcgctctggttatgtcaagtcatcttcagatgttcctgacctgtgcggccatcagcccttctgctagccagatctacccttgtaggagtattaatgttggtagacggggtgcagcttgttgctgtggcacagtggttatccatgcactgatgccatgatactcttgagaagttgagtcccttatgaatcttgagccggctgtgttggctcgtgtacctagtctctagctcgtttggttacatgcccaacgcctgcacttgtactgtgtaaaatactgaactccggcgatcatg

SEQ ID NO: 15635 - DNA, 1020 bp, Zea mays
tacctcatcagtgtgggcagcgtaaaccctagcttccgtcacccacacagccggcgaggtggcttccatctcgctcgtgggccgatctcactgagcccccgccgttcttctctccacttcctgcgttctccagccgccgtcttcgctgataggctacgccgcccgctggcctgcgcgcgccgcagccttaccctgtgtgcaccctgttcctaaccctgcgtgtggccgccgccgactggcttgcgtgcgcccgcgcctccgcctaaccctgctagcttgcgcgcccaacgccagatgccctgagcccaccgccggctgtctgtgcacgcaagtgaacccatccggctacctgggcacgccatccgacctccctgcgaacctctgtatcggccgatattcctcaagaacacagtgcaaacagtaagttctggagacagcaaaaccttaaggtaacacatcagcaagttcgagactgccaaaaatatgcaaggcagctggctggaaagaaccatcatttgactttgaagaacaaggacctccgcataacagagtattcacatgcaaggtgaccgtccacctggatgaactggtcaacaccattatggagtgtttcagcgaccccaaacctaagaagaaagctgcacgggagaacgccgcacaaggggcattatggtgccttgagcgctctggttatgtcaagtcatcttcagatgttcctgacctgtgcggccatcagcccttctgctagccagatctacccttgtaggagtattaatgttggtagacgggtgcagcttgttgctgtggcacagtggttatccatgcactgatgccatgatactcttgagaagttgagtcccttatgaatcttgagccggctgtgttggctcgtgtacctagtctctagctcgtttggttacatgcccaacgcctgcacttgtactgtgtaaaatactgaactccggcgatcaatgcaatcaaactggaactcctagccgaaaaaaaaaaaacccggccaaa

SEQ ID NO: 15636 - DNA, 1319 bp, Zea mays
ttttgagctcactagtccccccccccccccgtcacccgcacagccgccgaggtggcttccatctcgctcgtgcgtcgatctcactgagcccccgccgttcttctctccacttcctgcgttctccagccgccgtcttcgctgataggctacgccgcctgctggcctgcgcgcgccgcagcctaaccctgtgtgcaccctgttcctaaccctgcgtgtggccgccgccgactggcttgcgtgcgcccgcgcctccgcctaaccctgctagcttgcgcgcccaacgccagaagccagatgccctgagcccaccgccggctgtctgtgcacgcaagtgaacccatccggctacctgggcacgccatccgacctccctgcgaacctctgtatcggccgtattcctcaagaacacagggcaaacaataagttctggagacagcaaaaccttaagggctactctccatttagtggttatggagtctcccaggaagcataaggccagtgccgtgccagtcaaggagaaagtgaagttagaagatggaaatgatttgttagtcaagcgcagaaagactgaattttcagggtccattgtccaaccagaacgggaaattgaagtctttgacccggagaacaaagtgcctgatggtctcccagttgaatattctactgacaaggatcccatggatgcgctcactagttgtgcagtacagaactttggtcaagcgaaaggtaacacatcagcaagttcgagactgccaaaaatatgcaaggcagctggctggaaagaaccatcatttgactttgaagaacaaggacctccgcataacagaatattcacatgcaaggtgaccgtccacttggatggactggtcaacaccattatggagtgtttcagcgaccccaaacctaagaagaaagctgcacgggagaacgccgcacaaggggcattatggtgccttgagcgctctggttatgtcaagtcatcttcagatgttcctgacctgtgcggccatcagcccttctgctagccagatctacccttgtaggagtattaatgttggtagacgggtgcagcttgttgctgtggcacagtggttatccatgcactgatgccatgatactcttgagaagttgagtcccttatgaatcttgagccggctgtgttggctcgtgtacctagtctctagctcgtttggttacatgcccaacgcctgcacttgtactgtgtaaatactgaactccggcgatcagtgcaatcaaactggagctcctagccgagctctgtcttgcaataaaaaaaaaaaacaaaaaaaaaaaaaaaa

SEQ ID NO: 15637 - DNA, 793 bp, Zea mays
cctcgaggccggccgggcacccgctcagccgccgaggtggcttccatctcgctcgtgggtcgatctcactgagcccccgccgttcttctctccacttcctgcgttctccagccgccgtcttcgctgataggctacgccgcctgctggcctgcgcgcgccgcagcctaaccctgtgtgcaccctgttcctaaccctgcgtgtggccgccgccgactggcttgcgtgcgcccccgcctccgcctaaccctgctagcttgcgcgcccaacgccagatgccctgagcccaccgccggctgtctgtgcacgcaagtgaacccatccggctacctgggcacgccatccgacctccctgcgaacctctgtatcggccgatattcctcaagaacacagggcaaacaataagttctggagacagcaaaaccttaagggctactctccatttagtggttatggagtctcccaggaagcataaggccagtgccgtgccagtcaaggagaaagtgaagttagaagatggaaatgatttgttagtcaagcgcagaaagactgaattttcagggtccattgtccaaccagaacgggaaattgaagtctttgacccggagaacaaagtgcctgatggtctcccagttgaatattctactgacaaggatcccatggattcgctcactagttgtgcagtacagaactttggtcaagcgaaaggtaacacatcagcaagttcgagactgccaaaaatatgcaaggcagctggctggaaagaacctccatttgactttgaagaacaaggacc

SEQ ID NO: 15638 - DNA, 777 bp, Zea mays
ggccgcaaatgctggtgctcgtgggccgcgcattttttttttttttttttgcaaattggcagcaacgtattataattctgaatatgtcatccagatcaaacagagttgaacgttttagtgcatagattgcattgcataacaataatacaaacatagtctcaatgcatagaaaaatcagattaatgtgcttattcagtttagcatcatcttctgaatgcatagcataatacatgacttcagtttaccatcatatcctcaatggtaaaacgtagaagcaaacaccatcttgatgtttcagttcttcttttggtgaccacttgttgatgaaaaacccttttgtaccacctggaattgctagatctgctgtgctggcggcacgatcagctctgcagccggcgttgttgccgccggcgacgacgagcagccagtcttctgccgccccaccagatccgactccagatcgctgagctcgccgtcgtgctcgtggtggctcgtggcggcgtggctcacggccgccttggctgtctccacggagaggtcgaccccgtcgtcgacctcggcccaacagctggccccaactgcacgagagaggatgcgacgtcgggtgcgcgagagaaaggaagtggcggcgggtgcacgagtggagagggtgagctcgaggaaacccttcccgaccttgtgaggccgggggcgaaagccctcccggccggcacggattgggccggggagttgggtcaccaaacataattttttttcgctctgggataatttagcgcg

SEQ ID NO: 15639 - DNA, 1068 bp, Zea mays
  misc_feature (733)..(740): n is a, c, g, or t
ggccgcgggttttttttttttttttttcgaattttgcaaattgccagcagcggagcttcgtgggcccccttttttttttttttttttgagttgaacgttttagtgcatagattgcattgcataacaataatacaaacatagtctcagtgcatagaaaaatcagattgatgtgcttattcagtttagcatcatcttctgaatgcatagcataatacatgacttcagtttagcatcatatcctcaatggtaaaatgtagaagcaaacaccatcttgatgtttcagttcttcttttggtgaccacttgttgatgaaaaacccttttgtaccacctggaattgctagatctgctgtgctggcggcacgatcagctctgcagccggcgttgttgccgccggcgacgacgagcagccagtcttctgccgccccaccagatccgactccagatcgctgagctcgccgccgtgctcgtggtggctcgtggcggcgtggctcacggccgccttggctgtctccacggagaggtcgaccccgtcgtcgacctcggcccaacagctggccccaactgcacgagagaggatgcgacgtcgggtgcgcgagagaaaggaagtggcggcgggtgcacgagtggagagggtgagctcgaggaaacccttcccgaccttgtgaggccgggggcgaaagccctcccggccggcacggattgggccggggagttgggtcaccggccggaannnnnnnncgctctgggataatttagcgcgtgggtttggaaggcagggaatgggtcggtattctcctgagatcctcggctaccaaaggtgccctcacggaggcgctgagccctagacccgcgaaccacgactgccggacgctctccctgtgcggcccgtcctgcgcctggccgaagaggcgtaggacgcggccctgggacgagaaggcggtgacggtgcggaggttggagaccgcgtcggcagctagcttgctggtttcggactgcgcctgtatcgacttcgtggacatgttcttcagcaggacacggcgagcataggagcaagcgatgatgaacg

SEQ ID NO: 15640 - DNA, 2231 bp, Zea mays
caataacgcaatcattcatagaacaatccaaacaaaaaatcaacacaaacaaattcaaaaggaaaaaaaaagaactaatgaactagccagaagtgttgctcctgcattcgctcggcttgctttgcttgcttcctgcacaaatagctagcgcaccattcctttttttttgtgcgtctatgattggatcccgcggttggtttcctccgtccaatcatcctaaccccagtccggcgacagctcagggcgatcctccagcgaacaagacacgccgaaattctttagcgctaccaggaaaatgcgatcatggtggcggaatccctgctcatcatcatcatcgtcaccccaagcttgtcgtcgcgggcttacagcttactgtgagctgttgttgccattgttctcttcagcgctgtcgtcaccatcttcgtctccgtcatcgttaaccccgccgtcgccgccgtgctgctgctccccctcggtctgctgctgctcctcgctaccgccacggttgtacgcgttcagcgcggcgagcatgccaaggttggtgtcggacatggctccgcctccgccgcctgcagcgccgccggggtagctggccctggacatgaactggagcggggcctgcacggtgcccgtgccgccgccgccgctgaaggaccacatgggctgctcggccggccgcgccgcggcggccgtgctcgcggacacgggcagcatccagaacccgccggacggggcggcggcggcccacattgtggcggaaggcggcggctgcggcggcggagtcgccgcctgctgctcgcgcgctttgggcgcgctcggatcctggcgctcgtcgtcctccttgaacaggtcctcccggtagcgcttccgcatgtaggcgtcgccggcgctggggtcctcctgcggctgcggctgcggcgggagaaggtggtgatggtacccagccatcatggcggacatgtcgtgcgcgggggccgcctggtggtggtggtgcgggtggagcgcgagcgccgggaacggcgcggcgcgggcggcgggggcggcggcgccggagcggatggagatgttaagcgaggagtagttggccgggatggtgccggtgccggtagccgccaggatggccggctccgcctgctgcagcagccactcgatggtctcgccgtcggacttgtggccgagctcgcgggtcagctggaacacccgcgccgcgcacagcgccggcatccgaatccgccgcccccgcccgtccaccttggtgtgccggtccttggacggccgcttggctactacgggccccgccgccgcgggggccgcaggcacgagcgccttcttgtcggcggacgacggctgcggctgctcgggcacgggcgcgatagcgagcgcgccagcgaacggcgacggctgctgctgggcctgtggcactccggagttggacgccgcgggcccggcgtagtagaacgggtggtgctcgctaccgcgaccgccgctcgcgccgccagcggtggcgccgccgccggcggcggcccctccggcgctgttgctgctcgacggcgccccaccccctcctcccccgccgccatggtccatgctcccgagatgcttccccttcctggggccggctgacaaaggaagcgccgaagaaccttccgttacagcgaggaagccggaaggaaaggcggcgcctttcgcttccaggggccgcgtgacccggtgtggcggcggccggaggtagggcggagaagggagcacgtgcagggcacgcacggtgggggaggggggaggggaggcggcgcggggttgggtggggcgcgggtggggttgggaacgaagagggaggagcgcagccagagccagccaaaggaggagcgggggcggggggaagagagagagagagagggacagacagcgcagggtgcccgggtggggctgcggcggccttttgctactctctcgtttatgctgccgccttttcggcaattctcaattctataaaaccctagagcagagcagatattgagtggcgtctcctctcgttttcacgttcccactttggttgtgttttgattggtggacagccgactccggatttccctgatcaaaagtggagcgtcatgatttctataataaagaataaaacgtgatacacacacgaaatgcactatggttttactaggtatagtatatagtaattatgattaactttagtattaagttagcatatacggtaacat

SEQ ID NO: 15641 - DNA, 1779 bp, Zea mays
tcgattcggcacgacaagaactgagccagcgggattggaaaaaagattcctcgcccaaccctaccccagtccccaggcgatctcgcatggccaccggaccgcggtctctccacgccctcctcggcggcggtgcagttgccgacttgctgctgtggcgacggaggaacgcctcggcggcagctgtggtgggcgccaccacggtctggttcgtcttcgagcgcgcggggtacagcttcccctccgtcctctccaacgccctgctcctcctcgtcgccatcctcttcttctgggccaagtctgcgtcgctgctcaacaggcctcttccacctcttcctaatcttgaggtctcagatgcgattgttgaaaaagctgcaaatcatgctcttgtatggatcaataggctgctggctgttggtcatgacatcgccatcaagagagataggaaagtttttataaaggtctgtgtctttctctgatattctcagtttctcagtctctactgtatatctgcttctaattatatgtgctcttatccctgttcttggtgcaaaaggtgatactgattttgtgggtggtttcattcattggaatgctcttcaattttcttacgcttatttacattggtgtaatgctttctctgttggttccaccactctatgagaagtaccaggaccaggttgatgagaaggttggtgtagcgtacagtgtactatcaaggcacatagataccatcattaccagggctgggcaatcagccaagcagaagaagactgagtaaaagaaacgttttgctgtattgtggtgagttttaatgactatgtgaaatctatggcttgatagtatggagcaaattaaattgaaccctacgtaaatcatagtattttaaaagtaacaacattcctgcctgttagattatttaaatgtaatattttacagaaccctttattttggctgtagacatgtcctgaatggtacggatatcactatgaactgctcaaaagtttgtgagtgacaccaaatttgaataatttgatttatgttctagcagcaacatgcactacctagttttcttgtcccaatttcctgtatctgactgtacaaactgttgtaggaacaaaatgaaaagaacttcagcagttctttgcttcactcacagttacaaactgtttgtgttttttttccataaagacaaactattgtgttgaacagctactgtttttttgccctatgtagttgaacagctactgcttcactcacagctactgtttcattcttatatacatcttgagcttagtaacttgtattatgtggtggttttttactctggaggttttctctggcaaaagtgcatttccctgagtttgagttgaaattacttatagttgctggttttcttgttaatgattcattttttcatgtcaggaacatccctggttgtccaatgaagttgacagtgggcctttcatctttgaccctctattccactaaaatgaaccctcgatatgctgatatgaggttttgatgtgcattacgggaaatgaggtggcttgtgtatttcctttttggacatggggtttactatgggcgcatatcttactcgaaatgatattttgagaaattgcaactcgtgcatacaagtgtgtgggctgcttgcgctgttagccatatgatctctctgtcactgattttaattttaggctgctctgacgaactctgtggagctcattcgatgcccatctgctggtagctcgttttctgaaatactaataagatgtattt

SEQ ID NO: 15642 - DNA, 1799 bp, Zea mays
caggcacaaaactccgccgggggctcgaggcccgccgcctcagctcgcccgtgctcaccactgacctaccccgcttcaaaacagccaaactggaaaaaaagattctccgtccacgcctcgtcccaaccctagccccgtcgatctcgcatggccaccggcccgcgatctctccacgccctcctcggcggcggcgcagtcgccgacttgctgctgtgtaggcggaggaacgcctcggcggcggccgtggtgggcgccaccgcggtctggttcgtcttcgagcgcgcgggctacagcttcccttccgtcctgtccaacgccctgctcctcctcgtcgccatcctcttcttctgggccaagtccgctttgctgcttaacaggcctcttccacctcttcctaaccttgaggtttcagatgcagttgttgaaaaggctgcagattatgctcttgtatggatcaataggctgctggctgtcggtcatgacatcgccatcaagagaaataggaaagtttttataaaggtgatattgattttgtggctggtttcatttgttggaatgctcttcaactttcttacactcatttacattggtgtaatgctttctctgttggttccaccactctatgagaagtatcaggatcaggttgatgaaaaggttggcgtagcgcacagtataatatcgaggcacataaataccattgttatcagggctgggcaatcagccaaggagaagaagactgaataaaagaattgttttgatgtattgtggaacatctctggttgtcaagtggagttgtgatagtgggcttttcatctttggactctccatatggccctccacttacattagttctcgatatgctgatctgaggttttgatgtgcgctgttgatttcaggaaatgagacggcttgtgtatttttttctttttgaacatgaggtttactatgggcgcatatcttactcgaaatgatattttgagaaattgcaactcgtgcatacaagtgtgtgggctgcttgcgctgttggccatatgatctctctgtcactgattttaattttaggctgctctgacgaactctgtggagctcattcgatgcccatctgctggtagctcgttttctgaaatactaataagatgtattttgcaaagacagatgtaccatgtgaatgaatgggttattttgtcgacaattctgtaaggtgtagagaagtctttatcagtggacttttaccgtctatttctgttccgatatatcaattgctacagcatcaattgcagattaaaagctttatttacgaaatggcatctattgacatagattttatgtactaaacatgcatgtaatttgatttatcgtttgtcggaatttatgaagtttgccgttttcaattcttcataccgacgatctcacgctcgcagtcccagcccctgcggcgttccgatcctcccgacgtcctgcggccggcgtctcctaccgccgacggggccagtgtgcagcccttgctgcgcccagccagccatgtccatggaccccatctcggtgtctcctactagtatcccccagagcctccttcgcgatactaatgtcgggggcagcattaatcttgcggctcccctgccttcagcgcttcggcctttctgtaaaggacctgacttttttttaccagcatgacaaaaaaacaggaacaaaaaacataacccattataaaataatatagactggatagcattagccgaaggcggggtttatatcgagtcttaaattttagtccattcaacctccgatacagcctgcag

SEQ ID NO: 15643 - DNA, 1323 bp, Zea mays
aggccggccgatagcctgatcaccggagtggcacagatctcacgtcctgtgtagtcgtctgtctcgcgcgtgcagtgtgctcaagcaccgaggcccgcgggattggaaaaaagattcctcgcccaaccctaccccaggcgatctcgcatcgcatggccaccggaccgcggtctctccacgccctcctcggcggcggtgcagttgccgacttgctgctgtggcgacggaggaatgcctcggcggcagccgtggtgggcgccaccacggtctggttcgtcttcgagcgcgcggggtacagcttcccctccgtcctctccaacgccctgctcctcctcgtcgccatcctcttcttctgggccaagtctgcgtcgctgctcaacaggcctcttccacctcttcctaatcttgaggtctcagatgcgattgttgaaaaagctgcaaatcatgctcttgtatggatcaataggctgctggctgttggtcatgacatcgccatcaagagagataggaaagtttttataaaggtgatactgattttgtgggtggtttcattcattggaatgctcttcaattttcttacgcttatttacattggtgtaatgctttctctgttggttccaccactctatgagaagtaccaggaccaggttgatgagaaggttggtgtagcgtacagtgtactatcaaggcacatagataccatcattaccagggctgggcaatcagccaagcagaagaagactgagtaaaagaaacgttttgctgtattgtggaacatctctggttgtcaagtgaagttgacagtgggcctttcatctttgaccctctattccactaatatgaaccctcgatatgctgatctgaggttctgatgtgcattatgggaaatgaggcggcttgtgtatttcctttttgaacatggggtttactatgggtgcatatcgcactcggaatgatatcgagaaattgcgactcgtacatgcaattatgcaggctgcttgctctgttagtcatatgatctttccgtcagtgattttaaattttaggctgctccgaggaactttgcaggctgctccgagcaattatgcaggctgcttgctcattcgatgcccatctactggtagctcgttttctgaaatactagtacctaataaggtgtattctacgtagacagttgcatatcatgtgaataaataggtattttctggcggcagttctgtttttgctttacctgtgtttatactcccaccgtttattttgacaatgcgtacaaggtctagataagtcttttttagtgcgcttctaccaaaaaaaaaaaaaaaa

SEQ ID NO: 15644 - DNA, 1423 bp, Zea mays
ggaccgggaccaggcacaccacgcacgcagaaccctagaggcattcccaagttcgagcaatcgagctcgagccccagaggaacgagtcctgccggacgccgccacaccatctgaaactgacggcggcgggcggccgctgcttcctctcccttctccgtccagatccggcgactggcgtccctcctccgccatcttccctaccctcgacgtggcgatgagctgtgagccgtgagctgttccaacattccggaaataaggggcaagcgagaagatgaggctggtgggtttgacgggtggcatcgcatctgggaagagcactgtctctaacctctttagggactctggtgtccccgttgtggatgccgatgtcattgctcgggatgtagtgcagaaaggcaccagaggttggaagaagattgtaaaagcctttgggaatgatattttgctggaaagtggagaaattaacagagctctattgggacaaatcgtattttctgacccatcaaaacgtcaacttctaaaccgtcttctggcaccacatatttcttatagcattgtctgggagatagcaaaactgtggatgaaaggctgcaaggttatcatccttgacatcccgctgctgtttgagacaaagatggatagatggacgaatccaatcattgttctctgggttgatccaaaagtccagattgagaggctcatttcaagagatggatgctctgaaggacaagctcagaataggatcaatgcacagcttgcactagactggaagaaatcagaagcagacatagtgattgacaattctggttccctggatgacaccaaacagcaattccaagaagtgttgatgaaagtctcggagcccttgacatggaaggaacgcttgagatctagagatggtctgatctctgttgtcgtctttactgcagtgggcgtattacttgcccagaagaatctgctatgatcatgaaggcttagggagttaaaaatgttgatacgatgttttaaaggactggcacaactaagtaagaacccttagtaagaaccactatttttagttgtccttactggataatgggtcaagtaatgaaagtctgcatttagggattgctgggcttagccaaaatcttgttgtaccaaattgtgttgatgggctgggaattacaactatattcggactacgggctatccatgttcatgtgattttttgtaccgagtataaagcatggccatgcatgcgaatccgcactgcctaattatggaagccacttgattagaagcttaaactttagtcacagaagtgttcttttcaggcttgtcaacatttcaattttgggtacacattactctttcaatcataagtttgggggtgtttggtttcaaaaaaaaaaaaaaaaaactcgagactagttctctctcgtgc

SEQ ID NO: 15645 - DNA, 2025 bp, Zea mays
gcccccccgtgccctcccccgtcccactgacggtggcccccaccgcccggccccgctcgtcggcgagcgccccttccccacgctgcaccgctgtcctgggcttcctgcccaagagatccgcccgactccggtcgctcggaggccggcgagccgcgcgtgctgggcgccgggatgcaggcggccggcgccagccggtggcccggatctcgctggcggcgcgtctcggcgaccgcaccccgctgtcctcgctgtcctcaagtcctcgattttgtcatagatcagacaaataatggaagagttacaagattgcaactcaagaagcctggttgcccttccgggctctttgcttctgcgtctctttaggctgtttggccagcagcaggatcagagttcatggcagaagtacatacttgcttactttctgttggtcaggaatgactacttctctggggagtcgaagaaacactcagatgtgttctgtgatatttcagaattagatttctttccatatgctacagatttggatagtgaagaacttgaactgaaggagcagaaacccattacgaaggctcaatcaggaggtgattcaagtggcaacagatcgaatgattgctacttccccggccttcatgatgatctgtctcaagactgccttgcttgggcaagcagatcagactacccttccctttcttgtctgaacaaaagattcaatttgttaattaacagtggatatttgtacagactgcgaaggaaatatggcattgttgagcactgggtgtatcttgcttgtagcttgatgccctgggaagcatttgatccttcgcgaaagcgctggatgaggctaccgagaatgccatgcgacgagtgcttctcctgtgcagacaaggaatcacttgccgtcggaacacagctgcttgtcttcggccgtgaatatactggccttgctatttggatgtacaacttactgactcgcagttggtccccatgcactccaatgaatctgccccgctgcctttttgcctcgggaagctcaggtgagattgctattgttgctggtggatgtgataagaatggacaggtgctgaggtctgctgaattgtacaattcagagattgggcactgggagactatcccagacatgaacctgcccaggcggctctcttcaggtttcttcatggatggcaagttttatgtcattgggggcgtgtccagtcagagggattcattaacttgtggagaggaatataaccttgaaacaaggacctggagaagaatacttgatatgtaccctggtggaaccagtgcatctcaatcgcctcctcttgttgctgttgtgaataaccagctctacgccgctgaccagtcgacaaatgtggtcaagaagtatgacaaggcaaacaatgcctggaacatactgaagccattgcctgttagagctgactcatccaatggttggggtctagctttcaaagcttgtggcgatcgattgctggtaatcgggggccatagaggacctcgtggcgaggtaatattgctgcattcctggtgccctgaaggtggggaagatggtgctgactgggaggttctctcggtgaaggaacgtgcaggcgtcttcgtttacaactgtgcaataatggggtgctgagttacctttgcttcagtacatgccactggtttagcaagccaaccatttcttgctgccatttagctgccctttataatgacttgtaattcagaaatgacaccccctcccctcatttcgcggagctctcaattgattgaatgttttgtagagagcaaagagcattcagttcagtttacctggaactacttttttttcttcttctgttaaactcgttcagaattctttgttcttgtccagtacgaattttatgcagtattcgttattcatcattttgccaaagcttgtctgccccattgctctgagacaaatctaaggcctcgattttcaatgcaccgtacttgcgtactgatgttcagagatcttgggccagctcaaacagt

SEQ ID NO: 15646 - DNA, 575 bp, Zea mays
catcccaatcgcctccccttgttgccgttgtgaatagccagctctacgccgccgaccagtcgacgaacgtggtcaagaagtaattcggctcgagcaacgcctgggacgtagtgaagccactgcccgtcagagctgactcgtccaatggctggggcctagctttcaaggcctgtggcgataggttgctggtgatcggaggccatagaggacctcgtggcgaggtaatactgctgcattcctggtgccccgaaggcggggaagactgggaggttctgtcggtgaaggaacgcgcaggcgtcttcgtttacaactgtgcaataatggggtgctgagttaccttttgctcctcggtacatgccgcagctggtttagcaaggcaacgaccatttcttgctgccatttagctaccttttatagtgacttgtaattcagaaatgacctcccctccccgaaatctcgcggcgctctcaaatgttgaatgttttgtagagagcatatatagagcattcagttaagtttacctggaactaccctctctctcttttttttctgttaaactcgttcacatttttttc

SEQ ID NO: 15647 - DNA, 1262 bp, Zea mays
ggtttttgcaaaaacaatgtttaaacagtactttacatttgactttttgaaatctgtcagtgtcagccgacaccgctcctgcgccctgtaaattttttttttttttttgtaagcagaagggtgtaatgtatttttttcatacgaagggtaacacatgattcaaaagacgagctccgactatgccattgcaacaacaaacttccccagcagtaaacaaaatgaaatctgaagttggtagtgagttaatttgcatttgttgattcctttggatcagcatctctgcaattagtccctttctcttccaacttctcacaaacataaatgaaatgtgaatctggatctttgagaacatagtcaggtggcagttggccaccctctgtgagtgtaacctcctccattataagatgtggagcacctttactcattctcagttggtatccagctgtgggcatgatgtagagtgcaatactccagctgcatccggactggttcagaagtgggacacgttcctttggagcaccatatgttatcaataagtagatcccatgaggcatcaaaagccttgccacttctgctagcattttgaaagcaccgtgaggagcatcatcagcacacatcatagcgtccagggtccctttatcaaggacacaatcaaatgactcatcaccgaaaaatcccatgtctctaatatccatctgcatatatgttagttgtgtaatctccttgtgtttctctctcatttgctcgatgaccacagatgaaatgtctatgtttacaatgtccttgtaaccatccttcgccatatcctccgacaaaagggagttgccgcagccgagcatcaggacgcgggaggaggtcgggacgcgggcgcggaggagcggccgcagcgccgggtacgtctggtaccagtcgaagaacccacagccggcggcggcggaagctggcgagccggaggagtagcgggcgtcccagtatgcggcggcgccgtagtcgttgctcttgcactcgcctacccccatcctaccctcggtgttgcttccttccttccccgctggctcacgaagatagagggagagggtactgatctgatgagagctttgaggccggcggctgggcagctgggctgcaactttgcaggccggacaaggcgtcgaggcgtgtttttcgattaggatgttctaggtaatggtctcgtgcgagaagcgagatgttcttgggacaggcagcgggaccgggactgcgggcggcgtgtttgaacgaat

SEQ ID NO: 15648 - DNA, 1732 bp, Zea mays
aagccccccccaaagagaacgcttgttggtagaacaaagtatatgcccccatgacaccgagtccaagcagcaggctcgagcatagctggagaagcccccacatccgcatgggctggatgcccatttcatgaggaggcttgtgagccggagctgggaggaatccaggctgctatggcgccttgccttcccggcgctcctgacggaggtgtttcagttctccatcggtttcgtcaccaccgccttcgttgggcacctcggagaggtggagctcgcggctgtcagcgtcgtggagaacatcttggattcctctgcctatggggtcctgtttggcatgggcagcgcgctggacacgctgagcgggcaggccgtcggcgccgggcagctggacaggctgggcacctacacgcagcagtcgtggatcatctgcggcgccaccgcgctggcgctggcgccggcgtacgccttcgccccgcggctcctgcactcgttcctccaccagcccgaccacgtgtcgcgcgccgccgggccgtacgcccgctgggcgatcccgaggctgttcgcgcacgccgtgaacataccgctcctcatgttcttccaggcccagagcaggatctgggccgtggcggccatctccggcgcggtcctcggcgtgcacgccgcgctcacctacgtcgccgtcacgaggctcgggtacggcctgcccggggccgccgtcgccggggacatctcccactggctcgtcgtcgccgctcagttcgcctacatgaccggcggccgcttccccgacgcgtggaagggcttcaccgtgcgtgcgttcgacaacctcggcgccttcgtcaagctgtcgctcgggtccgccgtcatgatctgcttggagttttggtactacaccacgcttctcgtcctcgtgggtctcctcaaacatggcaaactccaaatcgacatcatgtcagtctgcctcaacttcgagttcttgactgtaatggttgcgctgggcttcagcacagcaatcgggattagagtgtccaacgagctgggtgcaaacaggccgaaggaggcaaagtttgcagtgcttgtggcagtatcaacatccatgttcatgggagcagtctttatgtgcgtcgtcctcatctggaggacgagcctgccaaagctcttcagcgacagcgaagaggtgaaacgtggagcttccaagctggggcatctcctcgctctcaccgtatgcgtcagcagcatctggcctgtgctatcaggcgtggccgtaggagctgggtggcaagtgcgtgtggcgatcataaacgtcggttgctactacctagtgggcattccgatgggtatcctgcttgttcaagctaaaacacggcacaatgggcatatggatgggcatgttgtcaggcacgtttctccaaatgtcaatacttctcgccactatcttcacaacaaagtgggataaacaggccgcgctggcagaagtgagaatggcggagtggggaggaaagaacgagaacctaacactgacggaaacaacacatacagatgatctgatggctcctgtgcaagagaaaatgttggcgaatgatagccagaagaatgtagaattagtgcgcatagattgatcatagagtatattcatttcagctcgagacattatttcattgtttactaggatgatagtatgaatctatttttttataaataatctctccgttccaaaccaaaaaaaaaaaaaaaa

SEQ ID NO: 15649 - DNA, 1128 bp, Zea mays
ctctggtaaagttctcccttcccctctcgcttcgcttcgccaacgcctgcgagagctagggtttcgtgcgccactgccacttccggtcttccgcccgccatggccgaggcccccacgtatcagatcctggtgcgtctcctcgacgggcgcaccacatgtcttcgcttctccacgcccaccgtctccggcgccgtgctcctcgaagctgtcgcgtctatatctcgcgtccccgccgccgccctccgcatcgtcaccggccgcttcgacgtctcgccctccaacgtcctcacctcatcagctgatggccagttcccctccgcctccgcgctcctccgccttcgaggaggcaagggcgggttcggctccctcctcagaggggccgcctccaaggcggggcagaaaaagactagcaactttgacgcctgccgcgacatcaacggtcgccgcctccgccacgtcaacgctgagcgccgcctcgaggaatggaaggccgaggccggggaccgccatctagaaaagctcgccgagaacttcatcaagaagaaggccaaggaggcgggccgccgcggcggaccctcagctgctgaggtggacaagtacctggagaagtaccgcaaggatgctgagatctgcgtcaacgcggttgaggaatccgtacgtgcatctcttggaaagaggaagaccgcccctaagccgccctctggcgcagacgctaagaagcttaagatttggtgcttggtctggagaagctaaaaatagagctgcaatctcgtggattaaaatgtggtggaactttacaggagcgagctacccgactcttccttctgaagacaactccattggataagttaccaaagaagctgcttgctaaggccgctattggggggaagtgagaagctgtataaacaagtactgatggtgcaatgcttaagttttttctttgacgatgtatggaaatctgttgtggtgtaatcacgtgttacaagcccttggtgtggcattgacgattaatgatgtgtctgtatctacgtatatgataaaaaaaaaaaaaaaagcccctaaaaagaggaattttaaaaaaaaaaaaaaaaaaaaaaaaaggacgggcggccgcaaactagtgagctc

SEQ ID NO: 15650 - DNA, 1709 bp, Zea mays
attgggggccccgcggccccccccgataaagacgtctttggtaaagttctctctctctctctctctccgtatctcgcttcgccaccgccggcgagagctagggtttcgtgcgccaccgtcacttccgcccgccatggccgagacctccacgtatcagattctggtgcgtctcctcgacgggcgtaccagatgtctccgcttctccacgcccaccgtttccggcgccgtgctcctcgacgccgtcgcgtcgatctctcgcgttcccgccgccgctctccgcctcgtcaccggcggcatcgacgtatcgccctcttccgtcctcgcctcagcagctgatggccagttcccctatgcgtcagcgctcctccgccttcgaggaggcaagggtggattcggctccctcctcagaggggctgcctccaaagcgggtcagaagaagaccagcaactttgacgcctgccgcgacatcaacggccgccgcctccgccacgtcaacgctgagcgccgcctcgaggaatggaaggccgaagccgccgaccgccagctagaaaagctcgccgagaacttcatcaagaagaaggccaaggaagcgggccgcggtggcggaccctcaaccgctgaggtggacaaatatctagagaagtaccgcaaggatgctgagatctgcgtcaacgtggttgaggaatccgtgcgtgcatcacttggaaagaggaagaccgcacctaagctgccctctggcgcagacgctaagaagcttaagttttggttaggaaagaacaaagtagaagaagatgaaagtgatagtgacactgatgtggatgatgaggacattgaagatcttaagagcgcagatgcaaaatctgtagtagttgatgaaggcaattactcaaatggatgcagaaaaaatgaggagaagcttgatcttggttctgtttctgggtcatcacattcagaaggagagtcttcaggagaaaagtcccaactgacaacaagttcaggagctgaaggtggtgactttgaatctggtgatagtgcagagcttgaggtaggaatgttggatcatcccatttctgttgctgctgcttcagaagaagtgacagcagatgaggataacactgctttagctacttcaaaccaaaataatccagaggtaccacaagttgaagaagtgcggaaagcagacaaggataacactgcttcagctacttcaaaccaaaacaatcaagaggtgccacaagtagaacaacatgttggcatcagcaactcttattcagagccgttggaccttgcaaagtacagttcatctgcagaattggaggtgcttggtctggagaagctaaaaatagagctgcaatctcgcggattaaaatgtggtggaactttacaggagcgtgctgcccgactcttccttctgaagacaactccattggacaagttaccaaagaagctgcttgcaaagactaatgggcggaagtgagaagttgtaccaatatatataaagaagtaccaatgatgcaacgtttaagattttctttgtcaatatatggaaatctgttgtggtgtaatcatgtgttataagctcttggcttggtttgacaattaatgagatgtctgtacgtgctatatgttaaccgttacttggaaggcgctcagtttgggcaaaaaaaaaaaaaaaatttagttctaaaaaaaaaaaaaaaaaagcggcc

SEQ ID NO: 15651 - DNA, 1837 bp, Zea mays
  misc_feature (1714)..(1715): n is a, c, g, or t
  misc_feature (1720)..(1720): n is a, c, g, or t
  misc_feature (1745)..(1769): n is a, c, g, or t
cattgggtacctcgaggccggccgggaaaagttctctcttcccctctcgcttcgcttcgccaacgcctgcgagagctagggtttcgtgcgccactgccacttccggtcttccgcccgccatggccgaggcccccacgtatcagatcctggtgcgtctcctcgacgggcgcaccacatgtcttcgcttctccacgcccaccgtctccggcgccgtgctcctcgaagctgtcgcgtctatatctcgcgtccccgccgccgccctccgcatcgtcaccggccgcttcgacgtctcgccctccaacgtcctcacctcatcagctgatggccagttcccctccgcctccgcgctcctccgccttcgaggaggcaagggcgggttcggctccctcctcagaggggccgcctccaaggcggggcagaaaaagactagcaactttgacgcctgccgcgacatcaacggtcgccgcctccgccacgtcaacgctgagcgccgcctcgaggaatggaaggccgaggccggggaccgccatctagaaaagctcgccgagaacttcatcaagaagaaggccaaggaggcgggccgccgcggcggaccctcagctgctgaggtggacaagtacctggagaagtaccgcaaggatgctgagatctgcgtcaacgcggttgaggaatccgtacgtgcatctcttggaaagaggaagaccgcccctaagccgccctctggcgcagacgctaagaagcttaagatttggttgggaaagaacaaagtagaagaagatgaaagtgatagcgatagtgacagtgacatggatgatgaggacagtgaagatcaggagagcgcagatgcaaaatctctcgtagttgatgaaggcaattgctcaaatggatccataaaaaatgagaaacttgatctgggttctgtttctggatcacattcagaaggagagtcctcaggggaaaagtcccaaccgacaacaaaatcaggagctgaaggtggtgactttgaatctgatggcagtgcagagcctgaattaggaatggtggatcatcccattcctgtgaacaatgctgttgctgctgcttcagaagaagtgctgaaatcagatgaagtgacagcagatgaggataacactacttcagcaacttcaaaccaaaacaatccagtggtaccacaagttaaagaagcgctgaaagcagacgaggataacagtgcttcagctacttcgaaccaaaacaacccagaggtgcccaaagtagaagaatatgccgatgccagcaaatcttattcagagccattggaccttgcaaagtacagttcagctgtagaattggaggtgcttggtctggagaagctaaaaatagagctgcaatctcgtggattaaaatgtggtggaactttacaggagcgagctacccgactcttccttctgaagacaactccattggataagttaccaaagaagctgcttgctaaggccgctattggggggaagtgagaagctgtataaacaagtactgatggtgcaatgcttaagttttttctttgacgatgtatggaaatctgttgtggtgtaatcacgtgttacaagcccttggtgtggcattgacgattaatgatgtgtctgtatctacgtatatgctaatcgttacctttgaagccccaagtttgaactagggttccatttcgttgtgagggtggtgagacttttctgannctggngcttcacgccggcagcctccagcgnnnnnnnnnnnnnnnnnnnnnnnnnccaagacagcagatcaaggttcttctggttccccatctgcaactcgcccatatgatgtctattgtttt

SEQ ID NO: 15652 - DNA, 916 bp, Zea mays
  misc_feature (40)..(40): n is a, c, g, or t
  misc_feature (56)..(56): n is a, c, g, or t
  misc_feature (79)..(81): n is a, c, g, or t
  misc_feature (99)..(100): n is a, c, g, or t
  misc_feature (122)..(123): n is a, c, g, or t
  misc_feature (130)..(130): n is a, c, g, or t
  misc_feature (134)..(135): n is a, c, g, or t
  misc_feature (148)..(148): n is a, c, g, or t
  misc_feature (155)..(155): n is a, c, g, or t
  misc_feature (158)..(159): n is a, c, g, or t
  misc_feature (183)..(183): n is a, c, g, or t
  misc_feature (202)..(202): n is a, c, g, or t
  misc_feature (209)..(210): n is a, c, g, or t
  misc_feature (228)..(229): n is a, c, g, or t
cgcccacgcgtccgcccacgcgctccggcttgaaatcagnatgaagtgacagcagnatgaggggataacactacttcannncaacttcaaaccaaaacnnaatccagtggtaccccacaagnnttaaagnaagnncgctgaaagcagnacgaggnatnnaacagtgcttctatgctacttcgnacccccaaaacaacccagnaggtgcnnccaaagtagaagaatatnngccgatgccagcaaatccgcggggtccgagccgttggaccttgcaaagtacagttcagctgcagaattggaggtgcttggtctggagaagctaaaaatagagctgcaatctcgtggattaaaatgtggtggaactttacaggagcgagctacccgactcttccttctgaagacaactccattggataagttaccaaagaagctgcttgctaaggccgctattggggggaagtgagaagctgtataaacaagtaccgcggccgcgaccccgcagttttttctttgacgatgtatggaaatctgttgtggtgtaatcacgtgttacaagcccttggtgtggcattgacgattaatgatgtgtctgtatctacgtatatgctaatcgttacctttgaagccccaagtttggactagggttccatttcgttgtagtgggagaaaagttatgtgcccatctgttgggccaacacaagtggatagtgggagagaagtagagggccaacaaatttaggtggtaagtagcaagcctattggaacgagtttttttcttcactatctagaaataggatttgcggtctgtttagataatctgcttgagatgctctaaggagcctttggtctggccgtctggcttccaaactcttccagaaaaaaccaaagggatgaactttcaataacatatttacac

SEQ ID NO: 15653 - DNA, 1513 bp, Zea mays
  misc_feature (774)..(774): n is a, c, g, or t
aaagttctctctctccgtatctcgcttcgccaccgccggcgagaggtagggtttcgtgcgccaccgtcacttccgcccgccatggccgagacctccacgtatcagattctggtgcgtctcctcgacgggcgtaccagatgtctccgcttctccacgcccaccgtttccggcgccgtgctcctcgacgccgtcgcgtcgatctctcgcgttcccgccgccgctctccgcctcgtcaccggcggcatcgacgtatcgccctcttccgtcctcgccgcagcagctgatggccagttcccctactcgtcagcgctcctccgccttcgaggaagccgccgaccgccagctagaaaagctcgccgagaacttcatcaaaaagaaggccaaggaagcgggccgcggcggcggaccctcaaccgctgaggtggacaaatatctagagaagtaccgcaaggatgctgagatctgcgtcaacgcggttgaggaatccgtacgtgcatcccttggaaagaggaagaccgcacctaagctgccctctggcgcagacgctaagaagcttaagatttggttaggaaagaacaaagtagaagaagatgaaagtgatagtgacagtgacagtgatgtggatgatgaggacagtgaagatcttgagagcgcagatgcaaaatctgtagtagttgatgaagggaattactcaaatggatccagaaaaaatgaggagaagcttgatcttggttctgtttctgggtcatcacattcagaaggagagtcttcagngagaaaagtcccaactgacaacaagttcaggagctgaaggtggtgactttgaatctggtgatagtgcagagcttgaggtaggaatggtggatcatcccatttctgttgctgctgcttcagaagaagtgacagcagatgaggataacactgctttagctacttcaaaccaaaataatccagaggtaccacaagttgaagaagtgcggaaagcagacagggacaacactgcttcagctacttcaaaccaaaacaatcaagaggtgccacaagtagaacaacatgttgacgtcagcaactcttattcagagccgttggaccttgcaaagtacagttcatctgcagaattggaggtgcttggtctggagaagctaaaaatagagctgcaatctcgcggattaaaatgtggtggaactttacaggagcgtgctgcccgactcttccttctgaagacaactccattggacaagttaccaaagaagctgcttgcaaaggctaatggggggaagtgagaagttgtaccaattatataaagaagtaccaatggtgcaacgcttaagattttctttgtcaatatatggaaatctgttgtggtgtaatcatgtgttataagctcttggcttggtttgacaattaatgagatgtctgtacgtacgtatatgttaaccgttacttgcaaggcgctcagtttgggctagcgtttgaattcgctttagtttttgatgaacgcacactcaaacct

SEQ ID NO: 15654 - DNA, 891 bp, Zea mays
  misc_feature (812)..(812): n is a, c, g, or t
  misc_feature (846)..(846): n is a, c, g, or t
  misc_feature (884)..(885): n is a, c, g, or t
gcacgagcgtaaattaaattactgtggcgctctgacgctaactttgacatgtttttccctcagcaatagcaacaaatcaaacaacaggcatgtattctttttttttgaacggaaaaaaaggcatatatcttcggatgcttgtagatgtcaaatcacaaggagaaaagcaaggagcagctggaccaaggaaagaacagcggtgatctctcgggcaaaatgctcgactaaggaacctcgtgcgctgcggcagtggcggtgacgtagtaggcgacggtgatcccgccgtggacgaagcacatgatccctccgagggccaaggtgtgtccgtgagtgaacccgcacgacgtcttggacttggagttggacatggcgccggcgagcagcagcgagaatccggcaatcagggcgatccatgagagaattatggtggtggctgccagcttcctgttgatggacgccttgatgaactccagctgggagcagatgcaggcacagccgccgaggaagttggctaccgcgtgggcaactaccaggagcactgcagctgcgaggccaagctggtacgctctgtacactggtttctcgcactggatgaagaggatcgtcaccttcttagtcttgttctgagcagcctgcgcctcaattcctagtatgccagctgtgacgtccagggctaaaaccactacgcagaccagaatagcaactcccatcctcgccattgtagcgtgctctcggacttgtaccagctgagaaggttgctgaatggaagatcacctgcttacaaatggtgttgtgagctgccacctgttcgnatgaccaattggtgaataaatagaggcaaaagtnacagcaggggtatttgttataccaaccaggatgcagtnnccccgg

SEQ ID NO: 15655 - DNA, 1813 bp, Zea mays
  misc_feature (7)..(7): n is a, c, g, or t
cgggaancacgactctcggcaacggatatctcggctctcgcatcgatgaagagcgtacctcgaggcgagaccggacgagaaacgatccgtacggttaaagttgtggcaggaggagtgggggcgcgggagagatgataaggatggcggcagcgtctcagccgccatcgtcagccttgcggatgcacgggtgcggcggcgcggcttctgcgtcgtccgcgcccgtgcgcctcttcacggagtcgcggggtagagtcgtggcgtcgattgggaggggcaggaggcggaggcgcgccatctcgtgctgctcgtctccagacgcagatggccctcgccccgccgcgccaccgacctccgcagcgccttccgacgggtcgatacagctctattcccagatcgagagggtaatcacggaggcggcaaagcagtcccgggaaggctggggttcgactggagattggaccgaagtcgagggatcatgggtgttgagaccgaagtccttggagccatcatttgttgtccactttgttggaggaatttttgtcggagccgctccccagatcacataccgcttcttcctcgagtgtctcgcgaacaggggagctttggtgattgctacgccttatgcgagcggctttgaccatttcttcattgcagatgaagttcaatttaagtttgacaggtgtttgagaaacttggatgagcctgtaaatgatctcccaacgtttggtgttggacattcattgggatctgttatccacatgttgattggatcaagatatgctgtgcagcgaagtggaaatgtactgatgtcctttaacaacaaggaggcaagctctgcgatcccactattttcacctgtaattgttcctatggcacagagttttggccctatattctcccaattggcatcgtatccaacaatccgatttggggcagaagcagctattaagcagcttgagaatctaagcccacctgttgttaagcaacttctacctttacttcaacaacttcctccgttgtatatggacctaataaaagggcgggaggacttcattccaaaaccagaagagacacgccgcctgataaaatcctactatggaatttctcggaatctcttaataaagtttaaagatgatcaaattgatgaaacctctacccttgcacaagtactaagctctgaagcagctattagctcattgcttgatatgtcaattcgatcacttcctggggatcatgggttaccattacaacaggttcttcctgatgttccaccagcaatggctgatgcagtgaaccgcggaggtgaacttctgacaaatctgacaacaggcacaccatgggaggctgttgctaaggaggttggcaccactttgggtactgactcaggcattctacgagcacagatctcaaaagacgttgaaactcttgttgatgtaattgcttcatggacatcttcaaattctggtccaagactacttcgcccatgatcacccagctgtctgcgtacagaaatgttagtaacagtgaagagcaacatgatttaatgatgcattgtgagtaacaaaaagttagattgcacttcagtgcggctgtcttagtattttagatccatactatagttcagaaaaaagtgaagatatgtatttatatggtgtatttttgaaccaagatattttgatagaaggaaactttataaggaatagaaatagaatgatagattctggatacggtaaagctgctaagctgtatgaaaggagtcttggcaattcaataattggcaattcagcatttcgaatcaaaaaaaaaaaaaaaa

SEQ ID NO: 15656 - DNA, 1927 bp, Zea mays
  misc_feature (77)..(79): n is a, c, g, or t
  misc_feature (82)..(82): n is a, c, g, or t
  misc_feature (84)..(84): n is a, c, g, or t
gcgcgggagagatgataaggatggcggcagcgtctcaacccccatcgtcatgcgtgcgcctcttcacgtaggcgcgnnntanantcgtggcgtcgattgggaggggcaggaggcggaggcgcgccatctcgtgctgctcgtctccagacgcagatggccctcgccccgccgcgccaccgacctccgcagcgccttccgacgggtcgatacagctctattcccagatcgagagggtaatcacggaggcggcaaagcagtcccgggaaggctggggttcgactggagattggaccgaagtccgagggatcatgggtgttgagaccgaagtccttggagccatcatttgttgtccactttgttggaggaatttttgtcggagccgctccccagatcacataccgcttcttcctcgagtgtctcgcgaacaggggagctttggtgattgctacgccttatgcgagcggctttgaccatttcttcattgcagatgaagttcaatttaagtttgacaggtgtttgagaaacttggatgagcctgtaaatgatctcccaacgtttggtgttggacattcattgggatctgttatccacatgttgattggatcaagatatgctgtgcagcgaagtggaaatgtactgatgtcctttaacaacaaggaggcaagctctgcgatcccactattttcacctgtaattgttcctatggcacagagttttggccctatattctcccaattggcatcgtatccaacaatccgatttggggcagaagcagctattaagcagcttgagaatctaagcccacctgttgttaagcaacttctacctttacttcaacaacttcctccgttgtatatggacctaataaaagggcgggaggacttcattccaaaaccagaagagacacgccgcctgataaaatcctactatggaatttctcggaatctcttaataaagtttaaagatgatcaaattgatgaaacctctacccttgcacaagtactaagttctgaagcagctattagctcattgcttgatatgtcaattcgatcacttcctggggatcatgggttaccattacaacaggttcttcctgatgttccaccagcaatggctgatgcagtgaaccgtggaggtgaacttctgacaaatctgacaacaggcacaccatgggaggctgttgctaaggaggttggcaccactttgggtactgactcaggcattctacgagcacagatctcaaaagacgttgaaactcttgttgatgtaattgcttcatggacatcttcaaattctggtccaagactacttcgcccatgatcacccagctgtctgcgtacagaaatgttagtaacagtgaagagcaacaggatttaatgatgcattatgatacgagacgttggcaattagggagttatgttaccttggccggtggaggaaggatgcatggcactggcaataggagcttttgtggacaaactatcttaacccattggcaaaggcaagatctccttcctcagatattttagtctgtaatcaatttggattaaaggtaaacaatataggcttataaggtgaactaagtaagttaggatatttctccccactaaatgtattaagatcttatattcaagatgactgagtaagagatgctagtaaatggacaatgaaattacgtatcttatattccctaagtcttttacatgaaggcatagtgtgtttggtttagcttcctgaactagattcgctcataaaaatttagaatctcaccaataggtagattcctctagttcaattcataatcccctcctaccccagatttttcagattcttgttatccatgttacaaggggccatactcttatagaatctatagtttcgagttatttcccccaaaaaaaaaaaaaaaaaaaaaaaaaaaaaaaaa

SEQ ID NO: 15657 - DNA, 1730 bp, Zea mays
  misc_feature (9)..(9): n is a, c, g, or t
tcggccggnagttggtccggccattgtaattgctacgggcacacagcgaaacgcccggcctttgttactcaaagtcgagaagcgccgtcttccccctttccaacctcaagtctacagtctacaccgaatccatcccccatcgccgccgccgccgccgccgacgacgacgatggcaagcctactccggcgatctgccgtacccgcgcgccagctcctcctcctcccgcgccatttcgccgccgccggctccgcccccgccttgtcccgctcgttctcccgcttcaacccccgagacgacagctctatgttcgatccaccggagccgccggtgaactggggcgtgagcatagttccggagaagaaggcttacgttgtggagagattcgggaagtatctcaagaccctcggctccgggttccacctcctgatccccgccgtcgaccgtattgcctacgtgcactcgctcaaggaagagaccatccctatccctcaccagaacgccatcaccaaggacaacgtcaccatacagattgacagcgtcatctatgtcaagatcatggacccctaccttgcttcctatggtgtggagaatccaatctatgctgtcctacaacttgcacaaacaaccatgagaagtgaactcgggaagataaccttagataagacttttgaggagagagatgcattaaatgagaaaattgtgagtgccatcaatgaagcagccacagattggggcctgaagtgtatccgctatgagatcagggacataaatcctccagcagggattaggcaggctatggagatgcaggctgaggcagaaaggaaaaaacgcgctcaaatccttgagtcagaagggatgaaacaggcccaaatccttgaatcagaagggaaaaagactgcccagatccttgaatctgaaggagctatgttggatctagcaaaccgtgccaagggtgcggctgaagcaattcttgccaagtcagaagctactgctcgtggaatgagattggtttcagatgcgatgacaactgaaggcagtgccaaggctgctagcctgaaacttgcagagcaatacatcgaagcattctcaaatctggcacaaaagacaaatacaatgcttcttccaggtgatagtgccagcccagcatctttcgtggcccaggcaatgaagacgtatgagcaaatccattcccacagccaggcattaaagagccacccccagatagaagagctgaaggaatcaggagagaccagtcctgctccatcttctgaggcgagcaagacaccaccactcattgaggaagcagattctaaccagaccttctcactgcaacgccccaagaacaagcagtgagcttcgctcaagtgtttgaagtccttttttctatctgttgttctgaaacatgagtgccactgagaaacaccactagtaggttttagttttctttagtctgagagagctgatatgtggcggagaagggatagacccctaggcatttggtttctgggagctaaatgcgaccggagagacctagagagattttgattctcgtgaaggttatactttggttccttgttggaatgaagtttgtaaaaaggcaaggttgggttaacgttggttagacaaaatgcataaatgcttaagttatttctttcttgctgagcttgactacaaaaaaaaaaaaaaaaaaaaaaaaaaaaaaaaaaacataagaaaaaaaaaaaaaaaa

SEQ ID NO: 15658 - DNA, 1508 bp, Zea mays
agatttcgcaacggtccctaaaaagtcagaaacggccctgtcgccgacgatggcaagcctactcaggcgatccgcggtacccgcgcgccagctcctcctcctcctcccgcgccacctcgcagccgccggctccgcccccgcctcgtcccgttcgttctcccgcttccacccccgcgacgacgatgacagctctatgttcgatccaccggagccgccggtgaactggggcatgaacatagttccggagaagaaggctttcgtcgtggagaggttcgggaagtatctcaagaccctcgactccgggttccacctgctgatccccgccgtcgaccgtattgcctacgtgcactcgctcaaggaggagaccatccccattcccgatcagaacgcaatcaccaaggacaacgtcaccatacagatcgacagcgtcatatatatcaagatcatggacccctaccttgcttcctatggtgtggaggatccaatctatgctgtcctacaacttgcacaaacaaccatgagaagtgaacttgggaagataaccttagacaagacttttgaggagagagatgcattaaatgagaaaattgtgagtgccatcaatgaagcagccacagattggggcttgaagtgtattcgctatgagatcagggacataactcctccaacagggattaggcaggctatggagatgcaggctgaagcaaaaaggagaaaacgcgcccaaatccttgaatcagaagggaagaaacatgcccaaatccttgaatcagaagggaagaaaactgcccaggtccttgaatctgaaggagctatgttagatctagcaaaccgtgcgaagggtgcggccgaagcaattcttgccaagtcagaagctactgctcgtggaatgagattggtttcagatgcgatgacaactgaaggcagtgccaaggctgctagcctaaaacttgcagagcaatatatcgaagcattctcaaatctagcacaaaagacaaatacaatgctgctcccaggcaacagtgccagcccagcatctttcgtggcccaggcgatgaagacgtatcagcaaatccattcccatagtcaggcattgaagtaccaccctcaggtagaagggctggaggaatcaggagagaccacccctgctgctccatcttctgaggcaagcaagacaccaccatttgtcggggaagcagattctaaccataccttctcgctgcaacgcccaagaacaagaagtgagcttccctcaagtgcttgaagcccttttcttgtctactgttctgcaacataggagtgtcactgataaacaccagtaggtttagttttctttagtcagagaagctgatgtgcggcgaaggggatagacccgtagcccgtaggcatttggtttcgggaaagctaaatgcgaccggagagagattttgattctggtgaagtttatacgttggttccttcatatattttaaaatgaagtttgtaaaaagacaaaaaaaaaaaaaaaa

SEQ ID NO: 15659 - DNA, 684 bp, Zea mays
tcgaggccgtccgccgacaggcagcactgtccgtccgcttctctctccccatctccatctgcaatcctcgctcgcccacactcggcagccatggcgtcgtcgcgcaccggagccggagccggcggccgtgtggtggtcttcccgttcccattccagggccacttcaacccggtgatgcggctggcccgcgcgctgcacgcccggggcctcgcgattaccgtcttccacagcggcgccctggacccggccgactaccccgccgactaccgcttcgtgcccgtgaccgtggaggcggacccgaagctgctggcgtccgaggacatcgccgccatcgtcaccacgctgaacgccagctgcgacgcccccttcagggcccgcctctcggcgctgctggccgccgaggggagggacagcgtccggtgcgtcttcaccgacgtcagctggaacgccgtgctgacggcgtccagcgacctcggcgtgcccgcgctcggcatgatgacggccagcgccgcctcgttacgcgactacatggcgtaccgcaccttgatcgacaagggctacctgccggtgaaagaggagcgcaaggaggatcccgtacccgagctacccccgtacctcgtcaaagacctgctccgggtcgacacgtccgacctggaggagttcgccgaactgctggcccgacag

SEQ ID NO: 15660 - DNA, 2021 bp, Zea mays
cgcaattaaccctcactaaagggaacaaaagctggagctccaccgcggtggcggccgctctagaactagtggatcccccgggctgcaggaattcgcgcgtccccggtcccctggacggccaccgccacgcagcactgtccgtccgcttctctctccccatctccatctgcaatcctcgctcgcccacgctcggcagccatggcgtcgtcgcgcaccggagccggagccggagccggagcggcggccgtgtggtggtcttcccgttcccgttccagggccacttcaacccggtgatgcggctggcccgcgcgctgcacgcccggggcctcgcgattaccgtcttccacagcggcgccctggacccggccgactaccccgccgactaccgcttcgtgcccgtgaccgtggaggcggacccgaagctgctggcgtccgaggacatcgccgccatcgtcaccacgctgaacgccagctgcgacgcccccttcagggcccgcctctcggcgctgctggccgccgaggggagggacagcgtccggtgcgtcttcaccgacgtcagctggaacgccgtgctgacggcgtccagcgacctcggcgtgcccgcgctcggcatgatgacggccagcgccgcctcgttacgcgactacatggcgtaccgcaccttgatcgacaagggctacctgccggtgaaagaggagcgcaaggaggatctccgtactccgagctacccctcgtacgtcggcgaggttattagcagagggagactagattagatttgcttatcatcacatacctgcagaggagcgcaaggaggatcccgtacccgagctacccccgtacctcgtcaaagacctgctccgggtcgacacgtccgacctggaggagttcgccgaactgctggcccgcaccgtcacagcggcgcggcgcgcctcggggctcatcttcaacaccttcccgctgatcgagacagacacgctggccgagatccacaaggccttgtcggtgccggtgttcgccgtcgccccgctcaacaagctggtgccgacggccacggccagcctgcacggggtggtgcaggcggaccggggctgcctgcagtggctggacacgcagcagccgggctccgtgctgtacgtcagcttcgggagcatggccgccatggacccgcacgagttcgtggagctcgcgtgggggctcgccgacagcaagcgccccttcgtgtgggtggtcaggcccaatctcatccgcggcttcgagtccggcgcgctgcccgacggggtggaggacgaggtgcgcggccgcggcatcgtcgtcacctgggcgccgcaggaggaggtgctcgcgcacccggccgtcggcggcttcctcacccacaacggctggaactccaccgtcgaggccatctcggagggcgtgcccatggtctgctgcccgcggcacggggaccagttcggcaacatgaggtacgtgtgcgacgtgtggaaggtgggcacggagctcgtgggggaacagctggagagaggccaggtcaaggccgccatcgacaggctctttggcaccaaggaaggggaggagatcaaggagaggatgaaggaattcaagatcgctgcggccaaaggcatcggcatcggcgtcgacgtcgacgaaactgcgtcgccccgcacggatttaaccgatttggttgatctcataaaatccttctgagctcatgacgatcgatctgttgggtgatgcctactctgtccatcgtgctcgacttgtcttcctactactgtaccactgtctgtgctcacttccacgttcctgacggtgttgtgttctagtgtatcattgtgcgatcagttccatgttcttggccatgttttagaataaaacagaaaacttgtgttcttggtgtaccactgtgctcactttcatgttcttgacggcgagttggaataaaacaagacttgtgtcatggtgtaccattgccatcattttcatgttaatataaagatttgacgctaaaaaaaaaaaaaaaa

SEQ ID NO: 15661 - DNA, 1713 bp, Zea mays
  misc_feature (1702)..(1702): n is a, c, g, or t
cccatgcgtccgcgcacgcgagcgcgggccggccgggagcactgtccgtccgcttctctctccccatctccatctgcaatcctcgctcgcccacgctcggcagccatggcgtcgtcgcgcaccggagccggagccggagccggaccggcggccgtgtggtggtcttcccgttcccgttccagggccacttcaacccggtgatgcggctggcccgcgcgctgcacgcccggggcctcgcgattaccgtcttccacagcggcgccctggacccggccgactaccccgccgactaccgcttcgtgcccgtgaccgtggaggcggacccgaagctgctggcgtccgaggacatcgccgccatcgtcaccacgctgaacgccagctgcgacgcccccttcagggcccgcctctcggcgctgctggccgccgaggggagggacagcgtccggtgcgtcttcaccgacgtcagctggaacgccgtgctgacggcgtccagcgacctcggcgtgcccgcgctcggcatgatgacggccagcgccgcctcgttacgcgactacatggcgtaccgcaccttgatcgacaagggctacctgccggtgaaagaggagcgcaaggaggatcccgtacccgagctacccccgtaccgcgtcaaagacctgctccgggtcgacacgtccgacctggaggagttcgccgaactgctggcccgcaccgtcaccgcggcgcggcgcgcctcggggctcatcttcaacaccttcccgctgatcgagacagacacgctggccgagatccacaaggccttgtcggtgccggtgttcgccgtcgccccgctcaacaagctggtgccgacggccacggccagcctgcacggggtggtccaggcggaccggggctgcctgcagtggctggacacgcagcagccgggctccgtgctgtacgtcagcttcgggagcatggccgccatggacccgcacgagttcgtggagctcgcgtgggggctcgccgacagcaagcgccccttcgtgtgggtggtcaggcccaatctcatccgcggcttcgagtccggcgcgctgcccgacggggtggaggacgaggtgcgcggccgcggcatcgtcgtcgcctgggcgccgcaggaggaggtgctcgcgcacccggccgtcggcggcttcctcacccacaacggatggaactccaccgtcgaggccatctcggagggcgtgcccatggtctgctgcccgcggcacggggaccagttcggcaacatgaggtacgtgtgcgacgtgtggaaggtaggcacggagctcgtgggggaacagctggagagaggccaggtcaaggccgccatcgacaggctctttggcaccaaggaaggggaggagatcaaggagaggatgaaggaattcaagatcgctgcggccaaaggcatcggcatcggcgtcgacgtcgacgaaactgcgtcgccccgcacggatttaaccgatttggttgatctcataaaatccttctgagctcatgacgatcgatctgttgggtgatgcctactctgtccatcgtgatgtaccactgtctgtgctcacttccacgttcctgacggtgttgtgttctagtgtatcattgtgcgatcagttccatgttcttggccatgttttagaataaaacagaaaacttgtgttaaaaaaaaaaaaaaagggcggccgcccgcgtnctagaactagt

SEQ ID NO: 15662 - DNA, 2184 bp, Zea mays
  misc_feature (788)..(788): n is a, c, g, or t
ctcagttcaattatatgtacatgcatggttcacctcggctctcctaaaagttcaatcatatctacatgcatgatgttaaattactctacaaagtgtgggggactgcgagtttgcaatttgctaatgcttaatccataataaggcacgatagcaacggtaagagagtcaggaaaaagccgaagctgacataggaagaaacagcaaaagtagacttgatgtgatggaatataaacaaagatttagccttgaataggagtagaaaatagttctccatgtgcatgaaccttgacttgtggtttatgttgggttttaattcttagcctacccaacttgctttggactaaaagtctctattgttgttgttaatttttaattcataataagcagcattggcaccggtttaggatttaaaagcttcagcatgtccatgagaccagactactgtaacagaagtttttgcacatcctcgatcgtaaactgcccccctcttttcctgctgaattatatgaatcctgaacacataatgacataactggcacgtagttgtgttcgttacttgatgtggggccgttggtaaagcatgtcacaatcagaaattgcgtactatttgatgtttctcatggctagcatacaccatttattttattaatagaagggaatacaaatgcatggtaggcatttgttgatctcacctcacgtttcttctgtttaatgactattccatgaaatcattttcaacacattcactgctatcactgaaactatttttactgatctgcaggtggtanaataccccccaccgcaccgctggtttcatcatcctgtcatgccgtgtcatcgcactcctttgcccgctcttcgcgtgtaccaacacatgcaccctccttcgcccccgctgcatctcatgacgacatgcgcaagacaagaagctcctcaccgttgtaagttatcgggtacaacagttcctctacataactccgtctgccttgagaaactaccctattatttaactatgcaagacccatcccatcctactctatcaaacacgaatgttttatcgctccttgccctgtttaatcagggatgccactgtacatggtaaatttctctctctcgtggacagatgctacacgtgccctgtttataaattttggatatatcttgatgtatagctagcattgggcaatgtttcgtggttcaataaaacttcgtgacgtgaccagtgttacactgagctgatgttcttttgagacattccagccctcgaagatattgttttgctcgatggcattgtgactgcattcagtatttacatgaaaaatgccagctatttgttattggttgataactgtgatctcatcgccttcgttagatttccagtggtgagatgtcagagggttgttttgtttcaaaaagactacttcaatgttatttgtcttttgagatttgagatatgcttttgatgtgaaggcctcagttttctacagtttggcagaattcgaattgttttcagatcaaatcggtgcgcgatcgaagttggcagccagcaatatcttttttctaactggtcctggcgtcctgcggcgtatcagtaacctcatatatccaattttatgccagatcaggtctcccctctttccctccctctcgatgccctgtggccaggtgtgggtgtggcgctgaaccttatgcatgttacatgttagggtttgttcgttttagtgccaatccatatggattggatgagattatgggcgggataggtttaaatctatagcaattcaaaatgcttcttaaaatttctaaattccttccaatccatgtgggatagaaagggtacatttgaaccatcgccattgtgactgcattcagacccaagtgacaagagtggaaaatatcttgtcatttcattgatctcatggtacatatctatacaatgtgtccctccggtgtgaaagggtgtgacccctttgataggcaactgccaatggtggttatagtgttgatcaccgataaccgattttcaacactctaccttgatcaactctatcaacaagatcaatgtattgattaattcctccaaaaacctcgtgagaaaaagtgaggaatacataattggatatgccactaacactccttcaaacccagtggagaaataagaataaaatggtatggcatattgtg

SEQ ID NO: 15663 - DNA, 1019 bp, Zea mays
atcggatcgcggccgctggaaatctgcgtgactgcgtctatactgcgcagcccccggcccgtccggggcggcggggttttcgtgcggccgctgcggtgacaagcaggtcctccctcaagctcgcggcggatcagcgaccgatcgacccgtcatcctcggttcctcatccaaccgggcatccggattccggtgagcggaggaaggcgccatgaaagctgcggaggacgccactcgctgccctcagatcccccggcgttgccaccactgtgccgggccactctccaaggacatggaaacgagcagctggacagtacctccgttggttcgagatagcttctccatgattggttcggctcttgggggtatagcaggagcgttttatggtttcaaccatgttatgcctgttgttcgacgtcacattaagggcccaatgtggatgcatttttttgttggtgcaccaccagttattgtgttctcttctgcatgtgctggattagcaggtggtacaataccagccaccgcacagctggtttcatcatcctgtcatgccgtgtcatcgcactcctttgcccgctcttcgcgtgtaccaacacatgcaccctccttcgcccccgctgcatctcatgacgacatgcgcaagacaagaagctcctcaccgttgtaagttatcgggtacaacagttcctctacataactccgcctgccttgagaaactaccctattatttaactatgcaagactcatcccatcctactctatcaaacacgaatgttttatcgctccttgccctgtttaatcagggatgccactgtacatggtaaatttctctctctcgtggacagatgctacacgtgccctgtttataaattttggatatatcttgatgtatagctagcattgggcaatgtttcgtggtccaaaaaaaaaaaaaaatgtgaccagtgttacactgagttgatgttcttttgagatattccagccctcgaagatattgttttgctcgatggcattgttactcc

SEQ ID NO: 15664 - DNA, 3550 bp, Zea mays
caacgggactatagtgaagcacactgaagaacgacatgaacaatgaagaagccaggagcctaggagtacagactgcctcggtaagatgtcgggtatctcggtttaacccgaacccgaacccgaaatttcggggggtatcaagtaatatcgggttgagttcgggttcaactgctgaatacccgaatttttaaaaacccgaactacccgacccgaattttcgggtatacccgaacgcccagccctactccttgcctggcattggtacgtttacatacccacctgcactgcttctagcatggacttcttttatatgaagatctgcaagacatttcttgttatatgtgcatatggcatctgcgttgtttagatcctcatacacactagcatgttgtagtagaatttcgctttcacgcatgggatacgctcagatttacaaggctgcttgaatgaacattgaagttaattgacttgctttgtctagctcatcaggttcagaagctggtagacccctgacaaagaaaggcacagttaaccgatccctgaaggccacaaaagattcccacatgctggggtcaagacatcatcttgccagttgcattgatccagttcccactagagttgagctggagacttagaaggcatgtgatgcttgaacatcgccatggattgcacttagcatagcaagtagcaacttggatgccattcatgtctgcatggctgcatcgtttgtactggcggcagcggcttctttcaacaccgaatatgcacgtcagcatgtccatacatgctgaggttaccccattgggcctttgagatgtaaattatgtcgttcagtcgagtggtatgcttatcatgtgtttatcggtgtatgatgttggtatagttgtaacttggaaggctaagcgaagttgtactgttgtatttggtattgccgtattgatatatagattgcacatgcgtcttgcagttgaatttcgaccattttagacaaaatttgctaaaaaaacattgggtgcgcttttttttttttcgttgcggcaagaaactggtgtccttgtgagagtgaaggtgagcagaatcgctgatgttattacacgtatacatgctgggctagcaaaaggacatgggctgcccaggcccaacaagaagccggctcctttataggcagcccctttattccttgccctccacgacgcgtcttgtaaagttgtaattgtaaaacgaaccgaaccggaacgtaacctctgtctcgtgagagacctcgtccgtcgcgcccgaggcgaggaagcaacccgccccagtttcacgctatggcgacggcgacgtcatcgaggcgcgtgtcggtgccggccctggcggccgccgccgtgctcctgctcgcgtccgtagccgcggccgacgaccacaacggcgtctacgacccctgcgcggacgcgtcggtgcagcgcggcgacgggttcaccttcggggtggtcttctccgggcgcgactccttctcctccggcggcgtgcagctctccccctgcgacagccgcctcgggctcgccaaccgcgcgcaggtcgcgctgttccgcccccaggtcgacgagatttcgctcctcaccgtcaactcctcctccttcgacccggtgagcccatccatcgccatgttaaaccttactaactgcttgtggatttcgtataattgcccaaagtttgcgtttttcgattaggatgttctaggtaatggtctcgtgcttcgattccctctataattctcttataggataaataaatttgggaacggtattggctcgctaggaaaataaatttaggttgattattataattttccaaactgcgaaggaaaaccgagtaataagttagttatagaagaacttgtcagaaacgtaggtgaccacggccagcttggaggggttaagctgcctaaccgttgagctggacgttgtagttgtctcacgtcccatcggctatcgacatgttgaggtagcgccacttttggacgcatttgtgtagctgaactggggcaaggcaagctgtcctttgaagccgggacacgcctcgtgtagttctgtggtccgagtgttgggttgttagcattcacgatgcaatttattcggaagtttatgagcgtcttgtcttcacagatttggaagctcctgttctatacactcctacttaattgatttcgtcaaggaattggttggagctggtggggccgctctataacttttcgtgtaccaggagaaacacagcctctactgaagcaattggctttgcataaatctcaactcgtgatcctgggatattttttcctgtcttaattcaaaggcagagctcctgccgcttatgtaaaaaaaaatcatggaatatgatatgtcagcggaattgtgaactgcatgcggtcgattgctcttcttagatgatcgaaggtgtacaattgaaatcacatctagtgactaatgcacaacccttttcgccctgttccagtcttcttctggtgtgtacatggtggctttcgccgggaagaaatacgcagcgaggtcaccccctgtgttcgtcggcaacatctcgtacacggtgaccggcttcaccctggtacgtacgcccacacgcagctcctcaatcaaaaagggataaaaaattgacttggctaaccgagcctccgacgacccgtcttgcgtcgcgcttcaggtcctggagttccagaagggcacgctccagaacctgttctggaaggccggcgggtgctcgtcgtgctccgggcgctccgacttcgcgtgcgtggacggcagctgcgcggtcaggacggcgagctgcaggggcaagggcgggcaggtggagtgcagccccgggatccagctcgcgttctccggcacggacaggcacgaggccgtgctcaactcgtggtacgaggtgtccaagctccggcagtactccctgtatcgggctcttctccaacctcaaggccgcgctgaccaaccagttcagcagcttcttctagagctgcagtgctagctgccacgtctctctgtcctcctctgtcccgttgtatggttatcatgtagagtatgcttagcgaagagcacttctcctgtagttctgtttctggtgacagaagaaatatgtatgtgctcaacggctatcagattagtcctatatatatgtgcagtttataattcatatgagacggtgtaagttaccgtgattccactcgcaaagctgatcagggtcgttctggccgttttcttggcagagcccaaccgaccgtggctgcgcggggcaagcagggctgagccaacgcggcggcttcgacgcttgttggttggccgcgctctcggtgtccgtcaggtgtcagagactgcgtcggtgccggggaattctctgcatatgccaaggcgactgcgtcaagtctcaggcgcgcgcgcgagtatacttgtataaccaccgcaaaagcaggtttgacagctcgacgatccaagtccaaggtggtacgcacatcgatagcgaaaagaaaatggcgcagctccagaatccaacacaaaatatc

SEQ ID NO: 15665 - DNA, 2147 bp, Zea mays
actgctgcggcagtaatggccgcctggttccacttccaccacggtgtgcactagcgctacaccgaggccaccttttcttggttccttcaacacgcctactccggcctccggatcgggcaccacgtctgccccctgctcccggaatctttgccaagcggcgccgctactgtccggcaaggcgaccccgtctctcggccggcgttgatctggtgatgcgcttttcacggtgtttttttttttttgtttcactcccccctccgtcctgtgtgattgtgctgcagttttgtgccggtgctaacggaaaccggaaagtttgcgtctttatgttactgtggttgaggcgggcggagtggcggcgcgatgggcatctcggcgaggtggctcaagtcgttagttgggttgaggaaggtggggcggcagcagcagcagcggcgaaaggatgatgcagatgttggtcgaatgaaaaccgatgtcgccgaccagtttcattttcagattcagcactctcaagatgacaatagcattgctgcacaagaaattccagaggtttcttatggaaatgatccacctgaagatgattctaatgtaccttcatgcttcgagcctgctcgtagttcagctcatatgccattttgtcaaactgaagaagcccagaaagagatctgggctgctacaattattcagacagcatttagagctttcctggcaaggagagcccgccgagctttaaaagggttggttaggcttcaagcccttgtaagaggtcatatagtaagaaagcgagcagctacgacactccgttgtatgcaagctttggtcagggttcaggcccgtgttagagcaaggcgagttcgcatggctttggaaaaccagactgatcggcaaaatacttcaccagagcacacgatcgaggcacgtgtcagagaaatcgaggatggctggtgtgatagtatcggttctgtgggagatatccaagcaaaacttctaaagaggcaggaagcggcagctaaacgtgagcgagccatggcctatgctctagctcatcagtggcaagcaagttcaagacaacctacagcatttgaacctgacaagaacagctggggctggaattggttagagagatggatggctgttcggccttgggagagtcggttccttggcacttacgggacagatgggatttttgtagttaatgaaaacaggcaacctgacagaagtgcaaccaagaccccatacagaaaacctgttaaaaagcatgattcaacccttcaatcaaacatgttgaaccagaaggtcttcccatcaaactcagagggtggtggctcctcgacaaatcgatcaagtggtttggtatcaactaaatctagactgaaggttttacccagagaaggttctgaggaagcctcatcccatccttcagtaattgtgcggtccactagtaatccgaaggagaggatttccagtattaattcaaaggagaggactggggacttggattttcaagttcataaaagatcctccttgcctggcattggtcccgaagctggcaaacacctgacaaagaaaggcacggttaaccgatccctgaaggccacaaaagattcccaaatactggggtcaaggcatcatcttgccagttccattgatccagttcccaccagagttgaactggagacttgagaaggcatgttatgctcgaacatcgccatggattgcacctagcagcttggatgccgttcatgcctcaatggctgcatgaatgtgtcgcaacatctatgttatactggtggtggcggttttcgagtttcgacaccatatatgtaggctcatttcatgagataaaatcagatgcatgtgagcatgtccatatatgttaagaggattaccattggttttattgttgtatttgtaagttgccgttaggaggtgtaaatttgtgtcgtcgagtggtacttattatgtgttgtcgtatagttgtgactcgaaggttaaaggtggttttggttctactgcgaagtgtgaactgtagtgagctgtgttctgtaaaaaaataaagttgttgtgatttgtctactgtaaaaaaaatggaagtaacttggttcaagctgccgtgaaaatgtagattttatatgattttttttttttgc

SEQ ID NO: 15666 - DNA, 1706 bp, Zea mays
ctgcagttctgtgccgatgctgacggaaaccggggggaaaaatgcgttttcaggttgctgctgttgaggtgggcagagcggcggccgcgatgggcatctcggcgaggtggctcaagtcattagttgggctgaggaaggtggagcagcagccgcgtaaggagagtgcagatgttggacgaatgtttcattttcagaatcagcgctctcaagatgacagcagcattgctgcacaagaagaaattccagaggttccttatggaaatgatccacctgaagatgattctaatgcaccttcatgcttggaacccacttatagttcagctgatgtgccactgtttcaaactgaagaggaactgaaagagatctgggctgctacaattattcagacaacattcagagctttcctggctaggagagcccatcgagctttaaaagggttggttaggcttcaagcccttgtaagaggtcacatagtaagaaagcaagctgatacgacacttcgttgtatgcaagctttggtcagggttcaggcccgtgttagagcaaggcgagttcgcatggctttggaaaaccagactgatcagcaaaatacttcaccagagcacacgaccgtggcacgtgtcagagaaattgaggatggctggtgtgatagtattggttctgtggaagatatccaagcaaaacttctaaagaggcaggaagcagcagctaaacgtgagcgagccatggcctatgctctagctcatcagtggcaagcaagttcaagacaaattacagcatttgagcctgacaagaacagctggggctggaattggctggagagatggatggctgttcggccatgggagagtcggttccttggcacttacaccgcagatgggattttcgtagtcaatgaaaccaagcaacctgacagaagtgcaaccaagaccccctacagaaaacctgttaaaaagcatgattcaacccttcaatcaaacatgttgaaccagaagggcttcccatcaaactcagagggtgttggctcctcgacaaaccgacccagtggtttggtatctactaaatctagactcaaggttttacccagagaaggttctgaggaagccccgtctcgtccttcaccacttgtgcggtccgctagtaatccgaaggagaggacttccggtattaattctaaggagagaactggggacttggattgtcaagttcataaaaggttctccttgcctggcattggttcagaagctggtagacacctgacaaagaaaggcacagttaaccgatccctgaaggccacaaaagattcccacatgctggggtcaagacatcatcttgccagttgcattgatccagttcccactagagttgagctggagacttaacttggatgccattcatgtctgcatggctgcatcgctttactggcggcggcggcggctttcaacaccgaatatgcggtctagatgtgcgcttatctcatttcaaatcagatgcacgtcagcctgtccatacatgctgaggttaccccattgggcctttgagatgtaaattctgtcgttgagtcgagtggtatgcttatcatgtgtttatcggtgaatgatgttggtatagttgtaacttggaaggctaagcgaagttgtaccgttgtattgttgtatttggtattgccgtattgatatatagattgcacatgcgtcttgcagttg

SEQ ID NO: 15667 - DNA, 672 bp, Zea mays
tcgagttttttttttttggttcattcggtgaatatgggaaaatcattctcttttctctaaacataactgtccgacactccacctccaactcaacattttccccccttggttaccagaggccgaagcaacatcaacctcgagtcctcgacctgcaggtctcgtcatctcccgtctgtcacgctacaaggttgaagtagacggtgtagaactcgtccctcaaggtgaacaatggctccaggaggaagctcctcctcacgcccctggcagcgaagctcatggggtggtaccgccgcagcggctcgccccgcgcgaagctggccgcccgccggaaccaggcgccgccgccgtcgccgcgcttctgctgggcaccaccggcacagcccacctgcaccttctcgccgccgccgaccaagaagcaccccggcctggacgcgagctcgagcgacaccgagccgggcgcgccggcgagtcccggcacgacgttgaacgcggcgcccgagctcttctccgcggacaccgtgagcctgtccgtgaccaccatccccggcatgtccagcggctcgagcatcgcggcggcgcccgcgccggcgcctccctgcgggacgagcctgaacgtcgcgtggacggcggcgtcggtgccgccgctgttatgggccgctgcaggcatgcaag

SEQ ID NO: 15668 - DNA, 768 bp, Zea mays
cactcctaagggcgtttcccacccgcccggccggccgggaaagtcatccatcctttagttgccaatttaaaggaatagtagaagtaataccgatttgatggcccaaaacaagcagatcattgttgtggtggctctcctttttcttgtggtggcaacatcatcatcagtgtgggttgcagaaggagccgatgacttaaaagttgcttgcgttaaggagtgcacccaaaattttaacactcccgagggaaagaagatctgtgaaacgatgtgtgccaaccctaaaggaaggcctatcgacagagttagagctgattgatcaatgctcatctttatttgtagctagctatcatgcatgcaatgatggccttcttgattattattatttcattcctcatgttgtttgttcttgcatgttttttccaccactaatattgtcctaattgatgcatacatgttgtcactcaaagcattttctatgctttacttattggttaaataaatacaaaggcttccttttacctaaaaaaaaaaaaaaaaaaagcggacatgtatttcattggaagaggtgatgtggagtcaacaagatcctatatggtgggtaacacatgtcagttcaagtgatgagttacccaacaagttttatgagtactagacgagtgctatccctagtcaaccgtccttgggaagtacagagatccgaaagaaaagatatacaatagtttctgctatactttgtagtatatgtaagtcttgtggtaactatttttt

SEQ ID NO: 15669 - DNA, 788 bp, Zea mays
  misc_feature (14)..(14): n is a, c, g, or t
  misc_feature (787)..(787): n is a, c, g, or t
tttatcatcacgantggtcggaaaaatgaatagagaaaaatgaaatagaatggcagaaaacctaaacgtgaggttggcgaaaagagaaaagaactagagcatcccgtggagagaaggcggcggcagcgcctgtgggagatgtcaatcctgtgggagaagagcgcgggttggcgatggctggttcggcggacgcgtgactcgaagcccttctttttcacgttcgcggcgctgtgcggcgtcgtccccggcgtaatcggctacggcgtgatgcagctcaccggctcccgcaacgagcagctcgaggcccaccttcgctccacggcccgtcccgagaccacgatgatggggcaagtgaacagggagaggctggcggagtttctcggcgagctgcaacggaaagaggacacgaacgacaggtacgtggccgcgctgaggggggagaccctgaccaggaagcgctacgagcgcatccagcccgtgcctgccgccaacgcgcaagcgagccaggagactgccggagccagcgcggaggaggagaggcccaaggcaaagtgagtcatcagcgagacgtgcctcagtcaatttttacttgctggacatacgcatgcttcggcataatgtaagcagtcagcgcctgtgaaacgtcattgcgcttggggtatttgactcccttttgttttgaactctgctgatgtaaatctttggattcaatggatggatgctagtagagctctggacggttctgccgagactcttgctgagaaaaaaaaaaaaaaggccccccggnc

SEQ ID NO: 15670 - DNA, 854 bp, Zea mays
cactgggaccctcgaggccggccgggatagagaaaaatgaaatagaatggcagaaaacctaaacgtgaggttggcgaaaagagaaaagaactagagcatcccgtggagagaaggcggcggcagcgcctgtgggagatgtcaatcctgtgggagaagagcgcgggttggcgatggctggttcggcggacgcgtgactcgaagcccttctttttcacgttcgcggcgctgtgcggcgtcgtccccggcgtaatcggctacggcgtgatgcagctcaccggctcccgcaacgagcagctcgaggcccaccttcgctccacggcccgtcccgagaccacgatgatggggcaagtgaacagggagaggctggcggagtttctcggcgagctgcaacggaaagaggacacgaacgacaggtacgtggccgcgctgaggggggagaccctgaccaggaagcgctacgagcgcatccagcccttgcctgccgccaacgcgcaagcgagccaggagactgccggagccagcgcggaggaggagaggcccaaggcaaagtgagtcatcagcgagacgtgcctcagtcaatttttacttgctggacatacgcatgcttcggcataatgtaagcagtcagcgcctgtgaaacgtcattgcgcttggggtatttgactcccttttgttttaaacgctgctgatgtaaatcttttgtgcatttcccgtgagaaggcgtattccgacagaccgtacaaaaaaaaaaaaaaaaaatcagactcgtgggctcacccgtcgtgctccggcagcccggtgacagtggttatcaccgacctgtgccccgacgctacgtgccaggtggagcccgt

SEQ ID NO: 15671 - DNA, 1344 bp, Zea mays
cttgcatgcctgcagctacgcgtttgttctgtcattcatttgttcattccctcaggctcagcaacacaatttgacacatgcgccattcttgtacagaccaaaaataataataatactggtacggtacagtgcatagatcgacagatactcctactgtgcaggaacactaacaacaacaacaattgttgaattagttcacttcggtgccatcgacttgtgaattgtgatgaaagaagatgtataacaaatttcttgagcattgctgatttatcaaatcccgacttcccgagaggatcatgttttcttgacgcggggaaattagcttgggcttcacgtagttggcgtggggccggccttttatggacaacatatcgaatgccatgggccgatccataaagcccaatattgacaacccagcaactcgagcgagtggactcctgaaacactcacacagacacgacacgagcggacgacgggacgagccgtcgtgttccggcgcgggtgtgtggtggcaggaattcgcgggaggaatggctggccggcgggagcccagatcaccctcaatcatgcttcgacccggccaaagaagacggaattatctccgtcgccatccaccactcaccaccggaccgggggctgatgagatgaacgggaacgggtgcccctcgcctccgccgacgtggactcgctgcctgccccgcaaggccgcgacgaacgaggacgacgacgagacccgtctccgtcggtgtccgcgcccgaacgcacggtgcacagaacgtggcgctccacttgtcgcgctctccggactccggcgccgggcgggcgccgcctacttaaccggcccggccgcgtcaagaattaccggggcgacgcacgcggcagaagacggttcgagtccgttctagaatctagacacggcaatgaagcccaggcctctcggttgcggttgcggttgcgtcccggcggcggtagggtgcgtcggctgggcatggaggccgactccgaggccgcgcgggggagggagggcagcaggggtgtcgcccaagtgctcgcactcggcggcggcggcgggagcggtacagtcggaggaccgccgccgcgaggtgctgtaccgcccggtggagctgcccgggacggggtacgggtctgagctggaggcgcggatcgagaaggtcatctacgcctgccgcttcatgaccttcttcggcatttgtggcttgctcctcggctctgtcccatgcttcctcaagggatgcgttttcttgatggatgccttcgcgcgtccttccggcccgtcccccccactccccactaatttgtgaactggagctttggatcctgcag

SEQ ID NO: 15672 - DNA, 1110 bp, Zea mays
  misc_feature (1104)..(1104): n is a, c, g, or t
gcacgagaccattacctagaacatcctaatcaaagaaagacggttcgagtccgttctagaatctagacacggcaatgaagcccaggcctctcggttgcggttgcggttgcgtcccggcggcggtagggtgcgtcggctgggcatggaggccgactccgaggccgcgcgggggagggagggcagcaggggtgtcgcccaagtgctcgcactcggcggcggcggcgggagcggtacagtcggaggaccgccgccgcgaggtgctgtaccgcccggtggagctgcccgggacggggtacgggtcggagctggaggcgcggatcgagaaggtcatctacgcctgccgcttcatgaccttcttcggaatttgtggcttgctcctcggctctgtcccatgcttcctcaagggatgcgttttcgtgatggatgccttcgtcgagtactaccggcacggcggagggaaggtcatcctcctgctggtggaagccattgagatgtttctcattgcaacggtcacgtttgtcttggggacgggcttgtacgagctcttcatcagtaacatggactccttttacgggtccaacctcttcggcctgttcagccttccggaacggcccaagtgggttgaaatcaagtcggtgaatgatctcaagacaaagctgggccatgtcattgtcatggttctgctggttggcatcttcgagaagagcaagagggtgaccatcacatcctgtgctgacctcttgtgctttgctggatcgattttcctgtcttcagtttgcctctacctgctttccaagctccataccaccaagggaggcagccaggcctgaaatgagagtgtttgtatgtaagtgatatgtctgttctgttgctgtgcaacgcctgcctccggttctgttcgtgtagtaaataattaggcagtggggaggtaccgatttcccatgtactcatgttcatgtatggctagggagtttcagttaggcacaaccaaactacattgagtatcatcctgtatgtgtagctcgatgtaatgcaatcaataactgatattctctttgagtaagcttaaaaaaaaaaagggcggccgccaccgcggtggagatnccagtc

SEQ ID NO: 15673 - DNA, 1716 bp, Zea mays
tttttttttttttttttttttttttttgataagtagctagattgccatgcgcttacgcaagtacactagtagtggtgctatatagctgtcattattgaagcatgcatgcatcgagaatttgcatccatgcatgtgtagtagtgcaggggggagctgacacatgagatcagcaggaacagtgaggatcgtccgactccccggcgtggagctcgtcatcgatcgtcgctcagctagtatatatggcaagcaggacgacaggcggcgcatggtcgatggaggcggtgacgctgccggcgagcatggtgctggtgcaggtcttcaccatggtcgccgtgctcctctccaagctggcgctgaacgtggggatggagcccttcgtcctcctcgcctaccgcaacctcatcggcgccatcatcgtcgctcccttggccttctactttgacagggcgatggtgcgaaaggtgaccctcaaggcctttgggtggatgtccatcagcgcgctcctcgggatcgttctcgccatgggtctctactactacggcctccgcgccaccaacgccgccatctccatcaacttcctcaacctcatccccgtcgtcaccttcctcatggccgtgctgctccgcgtcgagaagctggcggcagggacgcgggcgggccgtgccaagctggccggcacggccgtgtgcgtggggggcaccatggtggccagcctctacaggggcccgctgctgcacccgtggccgacgcacctgctccaccacgccgccgccacggccccgcaccaccaccgcaacatgccgctcggcaccgtcttcctgtgcgccagctgcctggcctacgcgctctggttcatcgtgcaggcccgcgtcggcagggagttcccctgcaagtacatgtccacgctgctggcctgcgtctccggcaccgtccaggcgctcgccatcgcggccgtcatccgcgggggcgaccgggactcgtggctcctctcctgggacctgcgcctcctcaccgtcgtctactcgggggtcttcaacaccgccgccaccttctgcctcatctcctgggccatcgccaggcgagggcccatctacccctccatgttcaactccctctcgctcgtcgccaccaccgtgctcgactcgctgctgctcggcaccgacgtgtccgtcggcagcctgctaggcgccctgctcatcgtactcggactctacgccttcctctggggcaaaagcacagagatgaggcacctcaaacagcagcagcagcagcagcccaacgccaacgggacgacgaccacgacgaccaacgccgccgaagaccacgtctagcaactaaatgcatgcagtatgcatggtaaataaatcaaattgagcagctagctagaactagctagatcgaaggagtaaattcgatcgatcgatcggccgatctcatcatgcatgtactcctacgtagacagacacacacaaattaagagacacacagggatcggagagagagacgcaaatgtcaatctcgtaagccagaaaatgaaacactagtcacccctatcctatcctatcatatcaggtttcataggtcaagcatagactgtattaattactttattgtcttctagaaagaggtattcttgttgggaattgtattaagatatcatgtgttgtagacttatagtatactagtacttgttagtattcaaaaaaaaaaaaaaaa

SEQ ID NO: 15674 - DNA, 2835 bp, Zea mays
ccacgcgtccgaagcgccgaaccgcgttccaggtgatgggctactgcgtctgcgtcgccaagggtgccgctgagatcctcaagctcaacatggctctcatcctgctgcccgtctgccggaatacgctgacgacgctcaggtccaccgcgctcagccatgtcatacccttcgatgacaacatcaacttccacaaggtcatcgcgctgtccatcgcgatcgccacagcgatccacacgctcgcacacgtgacctgcgacttcccaaggctgatcagctgcccgacggacaagttcatggccaccttggggtccaacttccactacaagcagccgacttacctgggcttgctggagagcacacccggggttaccggaatcctcatgatcatcataatgtccttctccttcacgctggcaacacattccttcaggcggagtgtggtgaagctgccatcgccgctacaccaccttgccggtttcaatgccttctggtacgctcaccacctgctggtccttgcgtatgtcctgctggtggtgcactcctacttcatattcctcaccagggagtggtacaagaagacgacatggatgtacctgattgtccctgtcctcttctatgcctgtgaaagagtcatcaggaaatttcgtgagaacaactaccatgcgggaattgtgagggcagcaatttatccgggagatgtgctctctattcacatgaagaagccacagggtttcaagtacaagagtgggatgtatctgtttgttaaatgcccagaagtctcgcccttcgagtggcaccccttctctataacttcggcaccaggcgatgactacttgagtgtgcatatccgtacgctgggtgactggacatccgaactgcggatgctttttgggccggcttgccaggcacaagtaacttccaagaaggctacccttacaagacttgaaactactgttgtggcagacgcccagacagaggacactaggtttcccaaggtctacatagacgggccatacggtgcaccagcacaaaattacaggaaatatgacattcttctgcttattggccttggaataggagcaactcctttcatcagcatactgaaggatatgttgaacaacctaaaatccaacgaagaggtgggaagcatccacggctctgagataggcagcttcaagaacaatggtccaggaagggcttacttctactgggtcaccagagagcaaggatctttcgaatggttcaaaggagtcatgaatgaggttgcagggagcgatcacagcaatgttatagagatgcacaattacctgaccagcgtgtatgaagaaggtgacgcaaggtcagctctgattgccatggtacagtcacttcagcgtgctaaaaacggcgtggatatcgtctccggcagcaagattcgaacacattttgcaagaccaaactggaggaaggtattctgtgatttggccagcgcacacaagaactctcgcataggagttttctattgtggatctccgacgctcacaaaacaactgaaggatctttcgaaagaattcagccagacaaccacaacccggttccatttccacaaggaaaacttctgagacgacgtgtacccgaagatccgatggactggaaacataattgtatagggaaaaaatacgatagcattggcatagcagatttagttttacaagttttgatgtatgcggggttgtacaaaatatgtgtagaaagctagatgtcaccatcatacatagattctgaaatgcttgcagatatatatattgcattgcataagtgaaaccacttgcttcctaggataaccgagttctagatctcctgctttgaacacgcaaattttctcttttcagtctttctgcccgagctgtcattgcattgcgaataagggtgctattctgtttcctagaagattcttgtgtatcatcttgcactggcacaagtgccacagaacctggtgtgtcttcagcgccctgagaatttccaggtgcattcctgttctttggaggcctgcctctttttttaggctgcttatcagcagataaagatgtatcttttcgaggcctgcccctcttcctaggttgattactagcctgcaagccgtccactctaactatcgccatcttattgtttgtatcatttccctgggatagtgtaactatatgtgatgttttctccatactgtcatccactgtagcatatattttccttggtctacccacctttggtttggagtcagaaactgatcccttaagtttgcacttgtcgataacaagtgttttaagtggaacagttatgtccaatggcagtagaactttctcaagttcacgccattcaagatcttcctggtctccatcatcataaatgacggtgtaccagttgctttcaatgtcatacttggccactttcccgacgaaatatgtgtctccaaaaagcttacgcactttcctcccttctaaccattcaccaaaacgaggatcaacatgagattctgcgtcattttttactgcagattgagaaccagttgtgcaatcaaaaggaaaatctggaacgccattgataatgatggcaggctctttaggaactttgattatagatgtagtttctgactcttgcttgccatcagccccctccatggttttctggcgaacgcgacgaaggccagggaagaaccgtcgaaggcctggaaaactggcgtagggcctagggtttcggcgtcggcggttgtcctgttgtccagcggccgcacgccaggtgagcggcagacgaaacagcaaggcaggtcgagtgcgttagactaggaatactatcatattt

SEQ ID NO: 15675 - DNA, 642 bp, Zea mays
ttttttaatgtatcaagtatgatatctcaatgattacgctccaagggttcacataatacaaccatagaaagtaagcattaataaaaagacaatggaaaaactactacaacccttcacgacatgcagagatgtgttaaaaacaacacacaacacacttgagtccccaaagactatgaacttgctgatcggtcatgttcatgttattcatttggcggagcctctatgggcaaagtagttgaagtcgtagtggtggatgttatgctcctttagccatgattgtgatgcatcgaagagagaggaaatatgctcttggtcaccggagtttggacttgcccacactttggcatctaacttgtatgttgcaaggccgaacggcgcaagtgacatatgattgaaggcttgcatgctatctaaagcaacaatatctttgcatgttgaaaggctatggtaggtcaaaaagcaagtattcagatcttttctattcttcatagggacatgacttgttggataccaaaaaacggacatccaacttgatggcgagagctctgcactgcttaaagatgatagggaaggacaactatagcaaagctcatataccttgtctgcgaaaggtatcctctcgtaaggggagtcaggctcaaa

SEQ ID NO: 15676 - DNA, 813 bp, Zea mays
gttggggccttgggggagctggccaacggttccgttgtcgctccatcgctgccgtccgccacgccatccccgacggaaactgccctgccgcggctgcctcactgtctgccagactgcccacccggccccgtctatcccttggaaagtcagacgagaaagcgtgctgggcaccgcaaggaaagcgaccacgaaaccgcgcgcctcctgcctctccatcttctccatatatactacctatcgaccgtgtccggcgggccggacctcttgtcgtcttggtgcgcgcgctcggtttcccttcctttttccctcgcgcgcggccaacctagaaagcgacggcggagccggagagggaaggggaggcgggccggctggtcaagggcggacgatgtgctgcggcggcgacggggagtgccggccgctcgggtggctcctgggcctgcccttcgcgctgctcgccgtcctcgtctccttcgtcggcgccgtcatctggatcatcgggctgcccatctcgtgcatctgcccctgctgcctctgcgtgacggtgctgctggaggtggccgtggagctcgtcaaggcgccgctccatgtcatgacctggtttacctccaagatcccctgctagctgtcccctgctttctgctgtgcggatcatacatacatcttgctttagccggagaggttgctgtactgtactgtactgttgtttcgtttcgtcgtcgcttggtccgttcgtcctagtgctactttgggtttctgcgattgatttttcagaactagctagttcttgaattgaatgcatggacttgtgctgcc

SEQ ID NO: 15677 - DNA, 2207 bp, Zea mays
ttagtcaaagtgtgtcacatttagccataaacctaaatgacactaagtctcaagccaagttgcgcatgtgagccggtgtccggagttgcaggccgggccgggtagggtagtttcgctgatccatgtgacattagttggcgccactgttcctcttccaggtcttcctcgggattccttcctctctcttcccgcgccaattattagcctcgcgtacgtacgggattttaaagatccattcaaaaagtccggaccgccggccagatggcaccggggccccgagacgtgtaaccgaagcaatctgtacgcgccggagtaattggcatcgaccgtgaattttatcgagcagctgacattcctgtggcgtggtgccgatctcgtggttatgttatgtttcttcctcttggtgtgacgcagggaaccgcgcctccggccggacgccgctggactgggagacgcggtcggcggtcgcgctggcggcggctcgcggcgtggcgcacatccactccacggggcccacggcgtcgcacggcaacatcaagtcctccaacgtccttctcaccaagaactacgaggcgcgcgtgtcggaccacggcctccccacgctcgtcggcccctccttctcgcccaccagggtgtccggctaccgcgcaccggaggtcaccgacatccgccgcgtctcgcagaaggccgacgtctacagcttcggcgtcctcctgctggagctgctcacggggaaggcgcccacgcacgccgtcgtcaacgaggaggggctcgacctgccgcgctgggtgcagtccgtcgtgcgggaggagtggaccgccgaggtgttcgaccaggagctcctcaggtaccaaaacgtcgaggaggagatggtgcagctcctccagctcgccatcgactgctccgcgcagcaccccgacaggaggcccgccatgtccgaggtggccacgcggatcgacgagatccgccgctccagcctcggcgaccggcaggtggccgacagcgccgaaggcgacgagccatctctataaccgccgtagcagtagctcctcccctgatccaccaccacacgtactgtgtcaatctcagtgaatgaaaattgcttagttctttgcatggatcgatattgctcttgcttcacatcagcaacttgtgcatgtatgctttttctctttttcttctcttctttatctttttttttttggcctctttctcacgggctttgatgattctattctatagcacatgtcactgtactcttttattcttggaaagcaacatttggtgatgccttacttgtagcgatctaagaccagcaccattgccagctgcactagtgctgtattgtttgctcgtccaaaaaaatacgcgcgaaatgaaacgaatcgttcctggaccatggtagctcggctttcattgccaagtcttgcttcacatcaacaacctctgttgtcttggttgttagggggaggtgatggttgttggcctggccattctcgatctagcgtgattaacctatggggtagctccttttccggttgagaagattgctgcctgtgcctcccgatgaaagctctgctaatggcgtcgcgttcgtagcctgtgaaatctggttggttttatttacgagtgttgttgaagtaaaatggcagaaagagacctgtgattgcgtgtggagttgtgttaatctgcacttctgcagtcacttgtgaaaatgataggatgtcttgttgaactttgtgcgaatttcagacacaatttaatccacaaagtgtaataaaaatataacatatgtgatctgtattattgtatattttataacttagagttcatatatatcaaataagaactcgcatgcatgaagtagtagaagaaaaagaaatgaacaggagatgatggcattagagacgatgttctgctccgatcagtcaacatgatcgtattgcagctagctaatgtagccgattagcgttgatgcactacagtcccgaacatcgtgagaagtagatgaaacagtcgcgacatgatcgtattgcagctagctaatgtagccgattagcgttgatgcagtacagtcccgaacatcgtgagaagtagatgaaacagtcgcgaccagcagaaatgtgcctatttcgatcgtctatttcgtgcacgatgtctacgtgtcaatggttttggaggcctgcttactctgccctctgtctgtg

SEQ ID NO: 15678 - DNA, 1598 bp, Zea mays
  misc_feature (5)..(5): n is a, c, g, or t
  misc_feature (8)..(8): n is a, c, g, or t
ctctncgncggcgccatcgctggcattgccatcggctctgtgttcggcgtgctgctcttgctcgccctgcttttcttcctctgccggaagaggtccagcgcgccacggtcggcggcggcggcggcggagaaggggcgggaactcggcatggggccgatggatgtcgagccaaagggacagaacggctcagcaggcggccacaacggcgttgcggcggccgtccccccccccgccccccccgccgccgccgccgccgctacggcggcagcgaagaccggcgggtcgaccgggtccaagaagctcatcttcttcggccccatggcggcggccccgccgttcgacctggaggacctgctgcgcgcctcggcggaggtgctgggcaagggcgcgttcgggacggcgtacaaggcggtgatggagaacgggtccgccgtggcggtgaagcggctcaaggacgtggacctcccggagccggagttccgggagcgcatcgcggccatcggcgccgtgcagcacgagctggtggtgcccctccgcgcctactacttcagcaaggacgagaagctcctcgtctacgactacatgtccatgggcagcctctccgccctgctgcacgggaaccgcgcctccggccggacgccgctggactgggagacgcggtcggcggtcgcgctggcggcggctcgcggcgtggcgcacatccactccacggggcccacggcgtcgcacggcaacatcaagtcctccaacgtccttctcaccaagaactacgaggcgcgcgtgtcggaccacggcctccccacgctcgtcggcccctccttctcgcccaccagggtgtccggctaccgcgcaccggaggtcaccgacatccgccgcgtctcgcagaaggccgacgtctacagcttcggcgtcctcctgctggagctgctcacggggaaggcgcccacgcacgccgtcgtcaacgaggaggggctcgacctgccgcgctgggtgcagtccgtcgtgcgggaggagtggaccgccgaggtgttcgaccaggagctcctcaggtaccaaaacgtcgaggaggagatggtgcagctcctccagctcgccatcgactgctccgcgcagcaccccgacaggaggcccgccatgtccgaggtggccacgcggatcgacgagatccgccgctccagcctcggcgaccggcaggtggccgacagcgccgaaggcgacgagccatctctataaccgccgtagcagtagctcctcccctgatccaccaccacacgtactgtgtcaatctcagtgaatgaaaattgcttagttctttgcatggatcgatattgctcttgcttcacatcagcaacttgtgcatgtatgctttttctctttttcttctcttctttatcttttttttttttggcctctttctcacgggctttgatgattctattctatagcacatgtcactgtactcttttattcttggaaagcaacatttggtgatgccttacttgtatctaagaccagcaccattgccagctgcattagtgctgtattgtttgctatactaaaaaaaaacgcgcgaaatgactcgagtcgtgctcgggccc

SEQ ID NO: 15679 - DNA, 949 bp, Zea mays
caacaacaatgctgctcctcctcctcctgctcgtcgcctcctcctccctgtcccaggagggcgtcctcgccgacgtgccgccgtccaacaagctggtcttcatcctggccgggcggtccctcgaggccggccgcggcggggtggtggcgaaccgctgggacggcgtggtgccgggcgactgcgcgccgtcccccgcggtgctgcgtctctcgcccgacctgcgctgggaggaggcgcgggagccgctgcacgccggcatcgacgccgccaaccacgccgtcggggtgggccccgggatggcgttcgccaacgcgctgctgcgctcgggccgcgcggggggcgccgtggtagggctcgtcccctgcgccgtgggaggcacgcggatggcagagtggggcaggggcaccgagctctacgccgagatgctgcgccgggccagggtcgccgtcgagacggggggccgcatcggtgcgctgttgtggtaccagggggagagtgacaccgtccgctggtccgacgccaccgagtacggccgccggatggggatgctcgtccgtgatctccgcgccgatcttggcatcccgcacctcctcgtcatccaggtcgggttagcatcgggcctaggacagtatactcaagtcgtgagagacgctcagaaagggatcaaacttcgcaacgtcagattcgttgatgcgatggggttgccattgcaagacggccatctgcatctaagcacccaagctcaagtccagcttgggcgtatgttggctcagtcctatctaaattatggtacatcccaactctagctagtacttgtgagatagaaattcctgccctgtttggacgattcattgagaacccattcttataattattgttgtatggaatcaacttgttactgctcgatgcaatatcttcatcatcactcaaaaaaaaaaaaaaagcggcc

SEQ ID NO: 15680 - DNA, 5115 bp, Zea mays
tgcaccctataaagtttttacccgcgggcacgcaagtaatatgtgaccgttgccatccctagtcctattcacgcacttttttgtcagtgcaactgggtcttgttgacttgactcaccatgatagtgagactcatggtctatcctccatataggcctaatttgttgtagtgcttggggtacccgtatccagatgcgatgcgacatcacccaactagacttttgagatgtatgggagctaaggaacatggcaaaaatgtctcatctagatgcatatagtgtttggatggagggatgagaaaggatgaagagagatgagatggatcattctaacttgacccgcgtttggtttggaggtcagagtcagagtcaaggaatattcttcaaaaatggtgaatgaggtcatccctcaaaacataagggacggagtcagcccagagttgatctcgtcctatccctcgttgacaccgaaccaacttcgtgtcggcaccagccaaccagagacatgtggattcaaagtacgtacaaattctcagtatactcaaagtattggacgcccagcccagcccagcagaagaggacaaaccagattcgattcctcctcctgtcctccatctccccaattcgcacggccatcggaccatggattccggcgtgcctgcctctgcgcctgcccctcccaaacacaagacatgccggaagtgcaaggcgagctatgacccctcggccaacacgcgcctctcctgcaggttccacccttccttcttcgtctgccgccgccacgacgaccagaagaggtactacgagctccgcgacggcgatcctccctacgccgccaagttctacgactgctgcggcgccgaggaccccgacgctccgggctgcaccactgacttgcaccgttcctacgacgacgcccaagactagcaaacctttgctgcttccacaggcctcatcttaatctcaagtctcatctaccgtttcgcttttgcatcccctccttatcctctctagtcagctatcaaattaaaccatctatgtacacttaaataaattttgcttcagatatgttacctactggagctttttttttcctttttttttgcaattgatcaaacatatctctcttcatacaaaaaaaaaaaaaataggcggcccgcccctcaggatgctttaagtatcatacgagtctgactccacatctgcacgtaggtaaccaaacacacacctcgcacacgtaaagcctggaaccaaacacatgaatactaaactggaacataaggcgccccctatctgaactcccaaaaaaagccagcaattcataaaagtttatgtcatacaaactttgattcagtaattctgattcattgtaataacatcgatcttgtttggaataaacatttcactgggatatagaatatccaaatgtaaatagtttctgtccatgcatatcccacacctgtttttataaaaaaaaaatcaggccgtcagtattctctttcagttcttcattcaaatgataattcagggacttcaagggaaggtggtgcatcacttttaacagcaagggcacgtgggtatagatctgatcggcgcgatttttttctttctttctttccggacagcggcaccgcaccgggtactattttgacctcggtcgctcaaaatctctgtctgtcggcccgccagaccccagacctagaccctccaaaaacaactcaacaacaatgctcctcctcctcctcctgctcgtcgcctcctcctccctgtcccaggagggcgtcctcgccgacgtgccgccgtccaacaagctggtcttcatcctggcggggcagtccaacatggccggccgcggcggggtggtggcgaaccgctgggacggcgtggtgccgggcgactgcgcgccgtcccccgcggtgctgcgtctctcgcccgacctgcgctgggaggaggcgcgggagccgctgcacgccggcatcgacgccgccaaccacgccgtcggggtgggccccgggatggcgtttgccaacgcgctgctgcgctcgggccgcgcggggggcgccgtggtagggctcgtcccctgcgccgtgggaggcacgcggatggcagagtggggcaggggcaccgagctctacgccgagatgctgcgccgggccagggtcgccgtcgagacggggggccgcatcggtgcgctgttgtggtaccagggggagagtgacaccgtccgctggtccgacgccaccgagtacggccgccggatggggatgctcgtccgtgatctccgcgccgatcttggcatcccgcacctcctcgtcatccaggttggtgtgtgtgtgtgtgtgtggtaggagtagttagttctttcccgttctcacaagcaatcaagcaagcaagcaacctcaattcagtaccactgtactgtactggacggcttttattttgcattgtcaagcgagcggcacctggttcgggcatcttccgctaccatgaaggcatgaacaaaccaaccatattcaccaattcctttcttttgtctttctttcttcatccaggtcgggttagcatcgggcctaggacagtatactcaagtcgtgagagacgctcagaaagggatcaaacttcgcaacgtcagattcgttgatgcgatggggttgccattgcaagacggccatctgcatctaagcacccaagctcaagtccagcttgggcgtatgttggctcagtcctatctaaattatggtacatcccaactctagctagtacttgtgagatagaaattcctgccctgtttggacgattcattgagaacccattcttataattattgttgtatggaatcaacttgttactgctcgatgcaatatcttcatcacaactcagatccatcactgtcttggactttttttctttctctgtcttcctttattggttctttgataatgagcagaggcgacgtctgttaagccttttattctatgtccaatcatatttatttgcccttttttctttttgtggggtgataggacatgcacactctccaacccctaaaccatggtggctgcaaatcgttttggtattttgcttcatttttgtttgaaacggagcatgcaaatcgttcaggggtgccgaagaagaagaagaaacccaaatgagtttaacataggcatccaggacttattctgtcaatcaataagtctcattgtctgactagttgtaatgtaaaaggagaacacagagagtagtcgacagtcttgataagcatttgaaatttgcctaactttggagttggtcagaattcaatcagatagatatacatatggaatctcttttagaggggcattgctacccttttcttcgcaaaactcccttcgctcctatggtaccaaaatgcttcatctgagctctggttttaggtcacgaagatcccatagacgaagcttacataattaaccctaaaacagacttgctaacgaatagaactcattggtttgagtacctttgtttaggcacatcttcttctgtctcgtcgttcaatcgcacgtctgtatgatccatactacttacttatttttggaacaatctcgggcgcaacgctttccgacccagagttgggtgaagcagacctttttagagggcacttttacgtttcgacccctcaggagacacgggtcatgtgaagcgtggagtgggtctattctcgagttaccgtggtctttgttgtacctatgatattcattcctgacattatcctactcatgttttcttatcataaatcacattgttggattttttgtagagatcatttcttcataaaaaatatataggtattatactttgttattaccgaaaacaatcatttatagcgatctctgaccaaaatgtcggttgtatgcgcatcgatcgtatgcgagaggctcctattccttacccactcatgtttccttgccataaaacatgtttattggatttttttttgtggagaccgtttcttcgtaaaaatcaataggtgttagactttggtatcgctgaaaacagttgattattgtgttttggccaaaaataacggttgtatgtccatctatctttaatgagagtctcctattgcttaccacacacatttttttttgccataaattagtttcttgaatttttgggatgatatttcttcataaaaaatcaataggtgttttttttgctagaaatcgtattcttagaattttggtgcaaatcattcctttgtgaagaatccatatatgttagttttcggtattctcgaaaatgtttgttcatagcctttttcacccaaaaaatgtcggttgtatgcctatcgatcatcggcgagtggattttatccttacaccactcatgtttttatgacataaatcacattcttgtgaaaaaaatctataggtgttaacctttgacatttccaaaaaatctctcccatcaatcgtttatatattgcttgacctggtcataactcaaaggataacactctctactgtctaataggaaaaacgttccacccaataaaaccagaaatgggacaagccaaataaaatgatcgccacaagcgtgctgaagtccatgcctgctgattgatggatgatggattgtcgtgtcatgtcatccgtcagctaaggtatgaactaatcgatgcatcatctgtattacggtctaacagtagcggatgacaaaacaaaaattaggtataactgggaaaaaaagaaaaacacaggcaacaagaatcgttcactgcctactgcttaaaacatagtagcctatccattaccctacatttctgtttatggtcataatagaagatataaaggttttaaaattttgagtatagatgatgccatactaagccataatggctcctccgccactgggtctaaccgaactaattaaccagccagtctaccgtggggtgatgacaattggttatgctacccaggcaccacgatacttgtagattttgttagcaaattgattagtatttaccatatatgatataaaatatttatatattgttttattggtgcaccaccttaatttggttgctgacttcgcccttgctggccgacggaaccaacccaccaaaccacggaacagatc

SEQ ID NO: 15681 - DNA, 2793 bp, Zea mays
  misc_feature (2577)..(2577): n is a, c, g, or t
tgggaccccggatcctttccccaatcccatccctaatccatcggccacgagctgatgcgcaagcgccgccgacctccccacctcggcttctgtctatccctcgacaaaccgacctctcccgccgccgaccgccgtcgatctaccgatcggccggacgaaagacccacctctccccaaaataggcggctgagacatacgttcctatctccccttcgctgccggagaaaagcctcgcagcctgcccctccctcaccttcacctcgatttctctgggcctccgaaccccgccgacaggagcgttccagcatctcctatcccgtgccgcgtacgtctgcacggattagcgttccttctattggtaagtaggtcacataatgtcttctgaagataaagcaatggctaatcgtgtcacttcacactcgccaaaagctatggtgtcggaaccagatcccaacaggatgatgatgtttagatcaaatatggagtattcacaaacaaatggccagacaaatgctgttcttggtcctgtggctatcttttgggacattgagaactgtcctgttccatgtgatgtacggccagaagatgttgctggcaatgttaggatggctttgcgcatgcatcctgttgttaggggtgcggtgacaatgctgtctgcttatggagatttcaatgctttcccaaggagactccgggagggatgccagagaactggagtcaaacttgttgatgttcctaatggacggaaagatgctgctgataaggctatactggttgatatgttcctttttgcacttgacaatcacccaccatcatccattatgctcatatctggtgatgtggacttcgctccggcattgcatatacttggccagcgtggatacaccattgtcattgctattccgtcttcagttaccgtctcatcagctctgagcagtgctgggagtttcgtgtgggactggcctagccttgcccgtggtgaaggtgttgtgatccctaggtccttggtgcgccgtctggctgattatccatgttatgtcaacagtgggaatatgggacagttccctgataatcagaatgaagaggaggccattgtatataccggaacatcaaggaatgaatatggtggcagacctcccgtcaatcaaatgtattgttataacacttcccagacaactagagaaccaagcaaagctttgtatactgttgaagatgtgaactgtggtacatcatcaaggcctcataatttatcatgtcgtcagagtgaaagtcctgagacagaccaaggtttgacagatgagcagtcatggtgggttcgtcctggtgatcttcaaggattgaagggtcaactaatacgtctgtttgaattatctggaggatgtgtcccacttgttcgtattccctcagagtatctaaaactctttggcagacatttatatgtatcagaatatggagctgttaagcttgttcatcttttcgagaagctggccgactcttttgttgtcgttggtaagggtcataaaaagatgatctgtctctgcaattctggtgataggaacctgaagaattatccaagtacgccaatcattctgacgaagaaaaacagaggaaattctgctcttgaagaaagcacgataggagcatgtcagcaattaggcagctcatcagatgaattatcagaggatgaaccaattatcaacccagatataaatgttgcatgtgtgttcaatgagcatctagacagcttcagaagggagattcaggagctccttgtttgctactcctgccctgttccgcttggtaattttgagagtttatatgagcaacggtataagaagatcattgactatgagagcttaggagtcaccggtctggaggagctagttgagaaggtgaaagacgtggtagatttgcacgaggaccaaaccagcaaaagcaagttccttattgcaaactacacaaccggttaggctctttctgttgtcttgatgtcctagttcagctcctaaagtacttcagctcgtgtttccttaacatgtgtcacacagggtcggcatctttttttaccgtgccggtatgataagtgtgaatggcatagtaagtatttgtaatggcttccctcatgcctcagctaatctgtgcaaacagggagttgtttcttgtatgcaaaaagatgattatactaaagaacagtgaccatttatttggcaaatacatctaattccagttcaagtcaatgattgctttgttgcttcagaggttagactgtgaatagcgtttttgtttaaatggcttactggattgaaaggatgatcggtttattgccattgtcctactgtgagcatcgtcaccacgcttgcaccaatccattagttgcagatttctttttatgataacacgatttcagccaatgtttgttcgcttgtaaatacattcattggtggtttaggtggaggcaaccttagatttgatcagtgtagaatgtagtggagacaatggacatttgatactatacaatagcattggagaaaccctgttctcttcgttacgtgggctcacatgttgatctcattttcncttctcttcgttttccctccaactgctcgttcagcactaatctatgtctgtggtagcggttgggtataatttttatggacggtttttgtttatcaaacgaaaatggtcctttcaatcaaggatctgctagtccatttaactcaaggatctgctagtggaaacacatttttacatggcgttttctttagtaaccgtcagtagacatcatatattttt

SEQ ID NO: 15682 - DNA, 752 bp, Zea mays
ggccgggttttcgaataattataatcgcaggatggcatgttgcataaattgctccccaaaaaaaaaaaaaaaaaaaaaaaaacaaaaccaaaaaaaaaaaaaaaaaaaaaaaaaaaaaaaaaaaaaagtgcggcgcgcgacgcgaccggcccgggtaacgaccgactttccatcgacccgccgcctgtagcccttcccgtctctggagtctggaagcttcttcctcctcgcctccgactccgtcatggccggcggcaacctgttcgggcgggcgctgagctacgtagtcaacgagctcctcgtcgagggcctcgccaacaaccgtgcattccagaggttcgctgtgaagaccaacaggactcttgagagcctatcgtctaaagctaaggaagtgagggaggagttatcggaacaattgaaggaagctcgtggccagaaagatcacttcaagcagtgaagctggttcccacatcgattcagcaagatgatactgacaatcttgttacgagtttagtccttgtctgggtactatttatgaatgacattctggatgtcattcaatggaaattagtcttaagtttctctgcacttagattagtagacgcagagcagttggtctcatgtcctttgtcataaactattgtataatttttaataatgtgtgcctatgttgatattttttcttgaagtgtgaaatgtagatttgaagaaaaaaaaaaaaaaaaaagaaccgggggcccgctctagcggcc

SEQ ID NO: 15683 - DNA, 2342 bp, Zea mays
ctccgtggcgcgggcgcggcaaggccggccatggcgccatgctgcgcgtagaagatcccccctccgtgctgcgggggagacgctgggaattcaatgtgtagataagcgtacaagtacaagacaggagtaaagtaaaaattaaatgggtttgaagagacgatggatgagatattgagaacgttacttgaaataagatatgaaagaaaatattttagagaaaaatacataggaataccggatacagtgctcactgtcgtaccgtgcgtgacagtatttttgagaacgtttgttgtttggttaccgagggggcgcgcgagctgctgcacacggatgagagggtgaactgtggagcgggtggaaacgaagcggcttcgtcccattgattttttggagtgggagaagaatattctctaattgaagtcacttcgttttagttattttataactaaacaacaataaaattaggatacaacgactccgttttacttgtcttttcgaccaaacacaatctaatagaaaacgttcccccccccgctgtcccgggctggacggtatttgcatcgcgcattcgcgccggtctggccaatctctagttctctactgcacggtgaccgatcaacgacagtcgacagttgcagtgcagccggtgagcttagatgacgcgcgtcccctaaaagcaggatctggcataaggctacgtgctggtttacagttacagctcaggcttaccatttctttaaccaattcgcttcttgttctttaaaagttcagagttcaagagttcagtttagagagagagagggggagagtgatttgccgacttgccagttgccgcacaaagctcctctagcacctctgtgtggccgacttgtccccggtatcaccaagtctgcaggcctccccagtcgtcgccggcgagggaacgcgccgcccgtgacgccgcgggttgttggcgccggcgttgaggccacaagcgcgccagcatcaggacctcacaggtgattcaatcctgaaggcatcaactatgttcaattttcaagaaatgtcttgctgttttacgtgtgcgacgggcatggaacgaaataatgaaaacgaaggaggaagcaaggtgaggattttttcctacagtgagatgaggaaagctacgcatgattttagtggagcaaacaagattggcgagggcggtttcggctccgttttcagggggaagcttaaagatggaacgatcgtcgcggtgaaagtcctttctgctaattcaaggcagggtgttcgagagttcgtaaccgaacttacagcaatttcagatatcgtgcatgaaaacctaattacattggttggttgctgtgccgaagggtcccagaggattcttgtgtacaattatctcgagaacaatagtctttcatatacacttctaggttcgggccggagcaacattcggttcaactggagagcccgtgtcaagattgctgtaggcgttgctcgtgggcttgcttatcttcacgatggaattcggccccctataattcatcgagatataaaggcgagcaacattctccttgacaaggacctcaccccaaagatctctgatttcgggctggcaaggctcctccccccaaacgcaactcatgtgagcactagggttgcaggaacaataggatacctggctcctgaatacgctgtgagggggcaagtgacgaagaaatcggatatctatagtttcggcgttttgctactggaaattgttgctggtagatgtaactacaacagtagattgcctcagggagaccagtttctgcttgagaagacatgggcatactacgtgcagggaaagctagagaaggtcatagacgccgaagcaggggaggacctgaacgtcgaggaggcatgccgtttcttgaaggttggcctactatgcgcccaagacgcgatgaagctgcgtccgaacatggccagcgtcgtcctgatgctgataggagagaagggaatctccgtggacaggatcaccaagccagccgtgatcggtgacccgtacctcgaccggaggccaagcaacgcagactctaccacgatgaagtccttcgccacgaccgaagctttaacgtcatcagaggcaaacacggagtggtctctgtgatggggggaaaaaacgtcatcatcgatggagatttgtttttgtggatgctgcagttgccaaacaaataccgcatcgcttctgttgattatgtttgtttgttatttttgtgtgtgtgtatatatacttgaaatggaaccacgggagtgaaacgaggattgaatatgctttacccatctttggtacaagtagaatcgtttgtgtttctatc

SEQ ID NO: 15684 - DNA, 802 bp, Zea mays
  misc_feature (730)..(730): n is a, c, g, or t
ccggccggggacagttgcagtgcagccggtgagcttagatgacgcgcgtcccctaaaagcaggatctggcataaggctacgtgctggtttacagttacagctcaggcttaccatttctttaaccaattcgcttcttgttctttaaaagttcagagttcaagagttcagtttagagagagagagagggagagtgatttgccgacttgccagttgccgcacaaagctcctctagcacctctgtgtggccgacttgtccccggtatcaccaagtctgcaggcctccccagtcgtcgccggcgagggaacgcgccgcccgtgccgccgcgggttgttggcgccggcgttgaggccacaagcgcgccagcatcaggacctcacaggtgattcaatcctgaaggcatcaactatgttcaattttcaagaaatgtcttgctgttttacgtgtgcgacgggcatggaacgaaataatgaaaacgaaggtgaccagttttgaggaagcaaggtgaggattttttcctacagtgagatgaggaaagctacgcatgattttagtggagcaaacaagattggcgagggcggtttcggctccgttttcagggggaagcttaaagatggaacgatcgtcgcggtgaaagtcctttctgctaattcaaggcagggtgttcgagagttcgtaaccgaacttacagcaatttcagatatcgtgcatgaaaacctaattacattgggntgggttgctgtgccgaagggtcccagaggattcttgtgtaccattatctcgagaacaatagtctttcatata

SEQ ID NO: 15685 - DNA, 545 bp, Zea mays
tgtttaaaggggttcggccggggcggccttttaagtttttttttctgaaaggaacgagaagaattctattgataattcccattatgcattccctttccccctccacaagacagtgtatatgtatcccggttacagtggcccactccacccatcacgcccagcacgcacacacacttcacacctattctaggcctggtcacctctcacacgcgcgcacagaggacagggaggaggagagccgagcgctatggagatgagacgcgcgcacgggaaaacgaagctccacggcaggaaatccacggctggaggttgaagacaacccggcgtccggcgcgcgcaggaaggagccccacggcaaaggtcgcggacgcacggagggagctgagctggagctccgagcagaagcagggagaagacggggagggaagtcggctggagcagggcatcccggcgagctcgccatgggagccgctgggcgcgattgaggaaggggcggctggacgcagtcccggccggcctcgaggtacccaatcccccccggcagt

SEQ ID NO: 15686 - DNA, 3508 bp, Zea mays
taacgctatcctaacaggcacgaagccagaaaaaagtttaggatggactaaactaaaagtgatgcagtatagaagcctcttctacgttatatattatgtacattttagcttatggaaggctctagtgtggctccataggatcggaagcagtagggccgtaggggggctcgagccccgcccgtcccacagcaagatccgtctttgtagcgaacaacatttttgttcgcttggctttaatccgtactggtttctactgtttctataatatttttgtgtatatagatccggccccgccgccttagctggtacgagcatgaatgattatagcatatttaggcattgaactgcgcaatactactagtagtatgcgactacaatccaaaaccatccaaaccagcatatacatttgacgagtcttacagcgagtactaagaaaaagaaagaaaagagcacccaggaaaagagctaacagtacaagccaaagtatcacattcggcacctgatcgatacacatcaaagacagtaacatgaaaagcatatacccatgtcgaccgagtagtagcaacctgcaagcagaagcactttccatgtacagtagcgccagcccgccatgctattgctcacagtgagactgataccccaaccgacttctgaaccgcttgccggggcctcgccgtcacggccagcgccagcgggacggccatctcgcacgacagcttgagcacctccgacaggtcgacgggcgaggggagcagctcgaactcgtgcagcagcgtcgcgagccagaaggccacggtggccatggcgaggctcttcccggggcagctgcgccggcccgccccgaacggcgcgagcctgaggtccgaccccatgatcgggaactcggtggaccccatgaacctctccggctggaactccgtcggctcggcccacacgtctgggtcgtgcgtaatggcccacatgttcaccatcgcggtggtcccggcggggatgaggtgcccgtcgacgtgcacgtctgacgtggccaggcgcgcccacgacagcagcgggcccggcgggtgcatcctgagcacctccttgatcacggcgtgcaggtagaccagtgacgccgtgtcggactcggtgacggcccggtcgggcccgaccacgcggtccagctcgtcgtggacgcgggcctgcacgtcagggtgcagcacgagcctggccagcacccactccatcagcacggcgacggtgtcagttccacggaacaccatttcctgcaaacaaaacaaaaaaaagggacgtaacgacgttcgcgtgtcatccataagaaaccgaagcagccatgcggtgcgaagatgctggaagaggttacactgggaagaggaagaggctacgctgggttcagttacacacccagaggacggcgatcatgtcagcgtcggtgagcctgtcgtcggccggcagcgagagcaggacgtcggtgaagtccacgacggcaggcggagcagagcggaggtggttccgggcgcggtgctcgtcgacgatgccgccgacgaagcgggtcacgagcgggacgaggcggtcgcacctggccctggtgctctgcaggtcgaggcacgcgaggccggcctcgtggtccccccagttgatctggcccagcaggtcgtacccttcgtccacgagtcgcctcccctcccgcgtctcggggctctccctggccgggtccagctccaggtcgtaccgccggccgaacaccgaccacatgacgctgtgcagggagccgcggcgcaggacgcggcggacctcgacgccgccgcgccgccccggcgaggccgccgacagctccttcacggcgccgaccatctggcgcgcgatgacggcgcgctgcgcggccgacgcggcgacctgccgcggggagaagaggtgcgtggacgccacgcggcgcagcgcgcgccagtaggcgccgtagggcgcgaagccgatggcgcggtggaacaggagcccgtacgcggactccttgatgggccggtccgcgaacgccgggctgctgaggatctcgcgcgccacgtccgggtgcgaggccaccaccaccctcgtgcccccgagggagaaggccatcaggcgcctggcgccgaggctccccgccgccgccgcgagcttgcggtgcgccaggcccgtcatgagccacatgctcccgaccacgggcaggcccctcggccccggcagggccgccgccgccgccgtcgcgccgccaccggcaccggcaccgagccgccgcgtccaccaccacctcccccacgccgggcctcccgggaagcaccagtgcaggaggcaggtcacgacgaaggccacggcgcagacggcaaggaagcccgtgaggcggtaaggctggtcgccggcgcatttggcggctagggacaggtacagcaaccagctgccgcggtcatccggggtcgccatgcctcctcctcgtgtttcagtttcactcactcttcgatccctactcctattcttcgtgctggcaactggcgctcggtttgagtgaggtgaggtcccggccgggccggagggtcccaacccattgataggctcgaggcggtaagggccgtataaatatttgtatggactatggagtaaagcctgaacggttgttgatgctgccggaaatcgtgtggcgcccaaggccgatgcctatggtttctggttactgcgaggcgagaccgcgcgcgagatatttgtactccggcacgcgtaacgggacgggaggcggaggctgcgccggggcggggacacacgtacggctatggcggcggtagggagggggagggactcccgcgtggcgccgaggggtgtggttgggcacgtgatggccatgcatgcaagggggggaggagcgatgcgccgcgccggcggcgggtagcgcgagatgcgagacgtgtggtcgatgtactcggccccccctcgtgcctcgcgcgggatcggggcggcgagacggcggcgctactccgctagcgtcttgagggtccccggccggccgggaacctagtagcgaattcaagtgacggtgttgctcggctcggcggctgctcgtagtcatacaccagtggtccgccaggttcttccaaacctgacatgcacgcagaggttgtcggtcactggagtactatgggtcttcgttcttctacgattccaggcttcagggtggtcagtatgaactgtaaattcgaggtgatggttcagttttttttttttttgcatgcgtttgtttcatactgtacccaccgtatttttcaaataacgtatgagcagttacaaacaagggagatggctcctgggttctggaggaggaggataatctctagctagtctcacgcattattcggcctgtaatttcgtccggtgcatagcagctagcgcccttgatgcaggcggccggatcaggtgctacgatcgcagtgacatctacgctcccagacctcccaaacatgtggtagataaataatatacttactactagtataat

SEQ ID NO: 15687 - DNA, 2113 bp, Zea mays
ggccgcttttttttttttttttttgtttttttttttttttttttccttcctttcctgctttttcttttgacgtgtcttacagcgagttctaagaaaaagaaagaaaagagcacccaggaaaagagctaacagtacaagccaaagtatcacattcggcacctgatcgatacacatcaaagacagtaacatgaaaagcatatacccatgtcgaccgagtagtagcaacctgcaagcagaagcactttccatgtacagtagcgccagcccgccatgctattgctcacagggagactgataccccaaccgacttctgaaccgcttgccggggcctcgccgtcacggccagcgccagcgggacggccatctcgcacgacagcttgagcacctccgacaggtcgacgggcgaggggagcagctcgaactcgtgcagcagcgtcgcgagccagaaggccacggtggccatggcgaggctcttcccggggcagctgcgccggcccgccccgaacggcgcgagcctgaggtccgaccccatgatcgggaactcggtggaccccatgaacctctccggctggaactccgtcggctcggcccacacgtctgggtcgtgcgtaatggcccacatgttcaccatcgcggtggtcccggcggggatgaggtgcccgtcgacgtgcacgtctgacgtggccaggcgcgcccacgacagcagcgggcccggcgggtgcatcctgagcacctccttgatcacggcgtgcaggtagaccagtgacgccgtgtcggactcggtgacggcccggtcgggcccgaccacgcggtccagctcgtcgtggacgcgggcctgcacgtcagggtgcagcacgagcctggccagcacccactccatcagcacggcgacggtgtcagttccacggaacaccatttcccagaggacggcgatcatgtcagcgtcggtgagcctgtcgtcggccggcagcgagagcaggacgtcggtgaagtccacgacggcaggcggagcagagcggaggtggttccgggcgcggtgctcgtcgacgatgccgccgacgaagcgggtcacgagcgggacgaggcggtcgcacctggccctggtgctctgcaggtcgaggcacgcgaggccggggaggtggtcggaccagttgagctggcccagcaggtcgtacccttcgtccacgaggcgcctcagctcccgcgtctcggggctctccctggccgggtccagctccaggtcgtaccgccggccgaacaccgaccacatgacgctgtgcagggagccgcggcgcaggacgcggcggacctcgcccgccgccgcgccgcccccgcgaggccgccgacagctccttcacggcgccgaccatctggcgcgcgatgacggcgcgctgcgcggccgacgcggcgacctgccgcggggagaagaggtgcgtggacgccacgcggcgcagcgcgcgccagtaggcgccgtagggcgcgaagccgatggcgcggtggaacaggagcccgtacgcggactccttgatgggccggtccgcgaaccccccgcccccgaggttcccgcgcgccacgtccgggtgcgaggccaccaccaccctcgtgcccccgagggagaaggccatcaggcgcctggcgccgaggctccccgccgccgccgcgagcttgcggtgcgccaggcccgtcatgagccacatgctcccgaccacgggcaggcccctcggccccggcagggccgccgccgccgccgtcgcgccgccaccggcaccggcaccgagccgccgcgtccaccaccacctcccccacgccgggcctcccgggaagcaccagtgcaggaggcaggtcacgacgaaggccacggcgcagacggcaaggaagcccgtgaggcggtaaggctggtcgccggcgcatttggcggctagggacaggtacagcaaccagctgccgcggtcatccggggtcgccatgcctcctcctcgtgtttcagtttcactcactcttcgatccctactcctattcttcgtgcgtgcggccaactggcgctcggtttgagtgaggtgagtttttttttttttttttttttttttttttaagtgtcacctatcccggccgg

SEQ ID NO: 15688 - DNA, 941 bp, Zea mays
aattcggcacgaggcccaacccaaggaccgacccatccaaatcagttccgtcacgtctcttcctctcccgtctccgcagacgcctcccttttcttctcactccactccgccgcccggattcagagcgagaggaggcggagagggcggacatggcggcgatgttggtgggcgcgctgcggaggggaagtggatgccgcggcggcttgcgccttatcgctcattcgcttcgcagattcgtgagcacgctcgtcgtagcggagcacgaaggcgggttcgtcaagccgtcgtcgctgagcgcattggccgccgcggaggccattgccaaggacaacaaagtttctgtcctgctgggtggttccgggccggcgcttcacaaggccgccgaccatgccgcgtgcagccatccactggtgtctgaggtgctcgtggccgattcggaagccttggcgcatcctctggctgaaccctgggccgagctactccgttccgttcagcagaaaggaggctactctcatgtcatagcttcatccacatcattcgggaagaatttgcttccacgtgctgcggctctccttgatgtgtcccctgttactgatgtcaccgctgtaaaggagccacacgtctttgtgaggccaatttatgctggaaatgcactttgtactgtgaaatatactggagaggggccttgcatgatgagtattagatcaacttcattttccccagctactgaggctatgtctgaaacaaaggttgcacctatcacccaggttgatctctctttcctcagtgaagggaaatctacatgggtgaatctgacatcacaagacacggagcggcctgatcttgcaaatgcacccgtagtagtcaccgggagcagaggtttaaaaagtgctgaaaatttttaattggtggagcagcttgctgagaaacttggcgcagca

SEQ ID NO: 15689 - DNA, 2748 bp, Zea mays
ggtcgattgtgtatgcacaccctgctgaaggggagagatatttcttgagagtacttctaaatcatgttagaggtgcatactcatttgaggatttaagaacattgggtgacatcacatgctcaactttcagagaagcatgcgaaaaaagaggactcatagaggctgacatgtcacttgatgactgcttgagtgaggctgcaacctttcaaatgccaactgctctgcgaaggttatttgcaacaattcttgtattttgtgaggccactaatgtacgtggactgtgggacaaacacaatgactcaatgtctgaagattataaccgagacaatcctaaatcgacatgcgtacaacaaatggtccttaaagacattcgggagttggttcggtcgatggggaaggatatcaaatcttatgatcttcctgagattaatgatacaggtactttcctccattgtaagcaaatgattgtacttattgcaaattaaggggtatataaataactgtttctgaacttggtgcctttagcaaagttcaacttggtgtgctatatagatcaatattcatataattttttcaattaaccattaagttttattatgagtacctattcctttgtgataattaggtgaattttgcaatgatataatgagagagctcagagaggaacttgctgttggtgtggatcaagaacatttggatatatatacatgtcttaacaatggacagcgtgcaggatttgatgaaatcatagatcacgtacttaataaaaaaaaccagttgttttttctggatggtccaggaggaacgggtaagaccttcctatataaggcactacttgctagagtacgttcagagggattaatagcaattgctactgcaacttcgggtatagcagcgtccatattgcccggaggacgcacagcacactcaagattcaaaatccctattaaactcgctgacaatagcacatgcaacttcacaaagcaaagtggcactgcggagttacttcgcacagcgtccctaattatctgggatgaagttgcgatgacaaagcgtcaagcagttgagtgccttgataggtccctacaagatattatgacatgttctttgccatttggtggaaaggttatagtatttggtggagattttcgccaggtgcttcctgtagtgacacgtggtacaagagcacaaacaacggatgccacattgcagagatcttatttgtgggatagtataaggaagatacgtttgactatgaacatgagggctcaatccgataaatggttttcggaatacctccttagaattggtaatggaactgaggagactattggatctgattatgtgcgtcttccagaagaaattgtgattggctatacagacactgaagattcaataaacaagctcattgtagatgtcttcccgtcacttgaggaaaatgcaagatcaatagcttatatgagcacgcgtgccatcctttcaaccaaaaatcagcatgtggaccaactcaatgcaaagatgattgataaatttccgggcaatggaaaagtttatcatagctttgactgtgtcgatgatgattctagaaataactatcctattgagtttttgaactccatgactccaaatggtttgcccccgcatgtgctcaaagtaaaaatcaatagtccagtgattcttctccgcaatcttgatcctaataatggcttgtgcaatggaacaagactcatggttagagcattgcaagacaatgcaattgatgctgaaattgttggtggtcacaatgcgggtacaagggtgttcattcctcggattccaatgtgtccatcagatgatatttctcttccgtttaagttgaagaggaaacaattccctatccgcttgagttttgctatgaccataaataaagcacaggggcaaaccatcccaaatgttggcatctacctgccagagcctgtgttctcgcatggacaactttatgtggcgttgtcgaggggtgtgtcaagacaaactactagaattctggctaggccaaagaaggaattagatcccacagggaagagcaccaagaatattgtgtataaagatgtcctcaactgctgacaattggtaagtccatgcaaatagcacatatgtttcctatgtttgaataatccgcgtgttatatttttcgatgaatatttgtgtgttcctgccaatactgacaatattactttcatggtgtctccacgtgttagctgcatcatttttacatgttatttggccttttcttgtggagctccagctgcagagtctaattggtgctccttttcctctctatagtgcagattacgatgtccataccaagatcagctgggaatgctgaaagatgtgctttcattattgcactctgaaagttatgcatacatgactcatggtacaattatataggtatacctattaatctcatgctttgtaacctctatgattgatataataattttcacttcttttttactgttcatcgaatttcgttcatagctacagtttgagattgttgtttttcatgtatatgcaatttcttaaagaaattatattgcctcatgttgactgctaacttaataacctgcagctacttactttctttgaagcaaaatgaagtttgtgctacatattaatacatgtaaaagttagagctttgtactttctttaaagttggctggtataactttcagttcaaactctttactaaaatgttgtaaacttatg

SEQ ID NO: 15690 - DNA, 2696 bp, Zea mays
aattcggcacgaggagaattggaagagcgatttttctatctgaatatcatgatgagactgaagagcccttacaaccatatgaacctccaaaagtatttcaatggcgatcagaatttggaagtgaacttttaaagttgaggctggagggataccaatggagtacacctctttagtatcaatgctaatggagttatgtgtgtgctcatgaacagcacaacaggaaatgatcaggcttttgtcagggtaaatgtgagaagtggaacaaaaagttcacggcatgaagttgtatttcagcttgattgctggtccagcccatacagggtggagaatcgctccatgttcttgcctatacggtttcggcagtttggtggtgatgatcattcatggcgtaatctgcttccgaattcatcagcttccttctttttggaggacctgagcagaaggcatctattggaagttttggttgatggaactgaccctatgaactccatgacatatgacatcaatgtcgtaatggatcatcagccccttactaattcagatgcccttaagaaggccttacgtgtcactgtcttgaaggaggggaaattgaatgttattcaaattattgattggctgccagataatagaaatcgaggacagataactgaaaggatgttatcaccaatctttcagccatcagaggtcgactatgggcagtcatctcctgatctggatagtgaatttcatgttactttggaactaacggagcttggcatttctgtaattgaccatatgcctgaggaagttctttacctctcagtgcagcaactgttacttgcatactcatctggaattggctctggagtaaatcggctcaaaatgcggatgcattggattcaagttgataatcaattaccatttgttcctatgcctgtacttttctgtcctcaaaagattgaaaatcagtcagactatattttcaagttctctatgacagttcagaccaacaattctcttgatttttgtgtctatccttatgtcggtgtccaggttcctgagaattgtgtgttctttgttaacatccatgaaccaatcatttggcgcctccatgagatgattcaacacctaaaattcgataggatatatagcaatcaaccttcagctgtttcagtggaccccatactgaaaattgggcttctgaacatctccgagatccgatttagagtgtcaatggcaatgtccccaagccaaaggccaaggggagtatttgggttctggtcgtcgttgatgactgcattgggaaacatggagcatatgccggtccgtatagctcaaagataccgggaggaattgtgcatgcggcaaagtgcacttatgaactctgctatatctaacattcaaaaggatcttcttagccaacctcttcagctactttccggtgttgatattcttggtaatgcgagtagcgctctgagtaacatgagcaaggggatagctgcattgtctatggacaagaaattcattcagggccggatgagacaggatagcaaaggtgtggaagactttggggatgtcataagagatggaggtggtgctcttgcaaaaggcatcttcagaggtgtcacaggcatattgacaaagcccatcgagggtgcaaaatcttctggtgttgaaggttttgtgcaaggagttggaaagggtataattggcgcagctgcacaaccagttagcggagttcttgatcttttatcaaaaactactgaaggtgccaatgcggtaaaaatgaaaatatcatcagcgataatggctgaggagcagttgctgcgtaggcgtcttcctcgagctattggtgggaatagtttgctctatccttatgacggacacaaagctactggccaggctatcttgcatctagctgaatgtgctacattccttggtcaaattgatatttttaaaatccgaggaaagtttgcttctaccgatgcttatgaggatcattttttacttcctaaggggaagatttttttaatcactcacagaagagtactattgcttcagttaccaatgatgacccagcgtaagttcaatcctacgaaggatccttgttcagtaatatgggatgtattatgggatgatttggtaacagtggagatgacccatgggaaaaaagatcctccagattcctggccttctaagcttattttatacttgaaagctaaaccttcaaattcgaaggaaattgttcgtttggtcaagtgtaatcgaggttcagatcaagcatctatcatttactcggcaattgacaaagcttataaagcttacggtccaaactcgttgaaggaattcttgagatggaaggtaccaaggccatatgcccctcgcaatagtagtggccgaagtatccaagacttatcatttggttaaaaggtcaacacaaatgcacactttagtgttaaacacagtagaatcttaggatgaaggtattttaggttgacacttttggttaccaggcaaatgatatattctacatatacactataggtatcagaggataggtactttgccttcatgtaaatagatatattttaggaggcgccggtattcatgtaaatgtgaacatctctgttataaagaaaaaaataataatgcaaattatgcaagattcattgctgccaaaaaaaaaaaaaaaataatgtgttctcttgcgattgtct

SEQ ID NO: 15691 - DNA, 2522 bp, Zea mays
ctataacatccaacattagtaaattactatgaactgacattccgaagccagacatgagcacaacatctggaaggcaatccattcggagaacacgaaggaaataggacaacccacagtgcaaaataaactctaaaatatctagatcgaaagtactatgtatcaaagaaaaattcaagcaatagaactaataagtctagtggaagtatatctcatacatgtaaattcatctggttgaaacaagatgcagcccgtgtacgcttacagatccatgtaatatgcagggttgcaatatccttggtgctgtctagctatggtatgaccaggatcaaacatttggacagtatccatgaactaaaatgctgcccaaactcaaaattgtttccttttgctcctaaacaacttgtctctttttgagcacatataaaagaaaccaaaaacaaacaacccagacatggaaacagatacccacgggaatggtggatctttgaagcaaaccagtgaagcttcaagctcctgtgatgcctgatacaccaatgagtgaatttcatacagatcgtggtctgaagacctcaaatagtacattgccttgtcgtagtccaagcgtgacatggctgagatcaccttctccagtttatacgtgagcaggttccacctctgaatgaattcaacatgccttttctttctaagtattttctccccaccatgtgccaccatcgactccaaaacatctattgtgctggtgattgtgtagttcagggttgtgagaagaacattcctacgagctgcatctttctgcacaaaagacagtgatttggtctctgaaaaaggaccaaatggtgtatgtccagtgctccaagtgtaatcaacaactgtggcatgatgctcaggactccatgacagatgtgtgggtgaaaccccccacatgctctgcagaagtgagccaatgattgcgcgctcaagatttctagtcattgtaagcacatgtcgaccattacaggtgtagtcacttactgtttgtgagctccgcgtcctcacagccccccccggccccccaaatgccactgcctggtggtatctatccagaggcaaaagtttatcataatccaaatcgaaaacataaactggcaccaccttgtcatgctcataattttcatggaccccagccaaacgatgtatctcatccgacgagtctgacagcacctgcctcaaccgcttggagtccaagtactcattcactatcaatgtgtagttctcaaacaggaacctcgatgtaaacgagtttgtcgacctagcaactgcgaatgagcaaattgggcattcagagtacttgaccgtatgcagatcaaacttcaagctttgtccaccataaggtagatccccgtcacgaattgactgttctatcacacgaaaatcaagcccttcttcttccttccggtccccatggatgtgaatgaaccgaataagcaacgagttctcataatgcactggaattctgagcgaaggcactagcaaagacttgtatgcactaagaaccagcgacgcaagatccgcgaggagagctttctccgacttgggcctgccgtgaagggtggcaagagggtggaactcaccacgggggagcacgccatcgccagagagcgctggaccgtagttcactggaccggcacccaggtcgatccaaatgtaccgattcttaccagcccagacggggccgaggcagcgggagtacccaggcgaggaggcatcagtgccggaggaggccgcggtgtaggcatactggcgcgactgcttgccaaggtcgagcaagtagatgtagacggcctcagcggggccggagccggctagcgcgcggtagtcctcagcgacgagatcgtccacaagcgagtagggaacgcctgagagcgcgttattgtggaacggcgcgggggacttgtcgagatgcgcgcggacggcggcgccagctttagaggcgagcttggacgccgcgacggggccggtgacgtcaaggtgaagggtgtgggagaccgcgagacggtgtgggcggcggctggagaggaactgggctgaggagacggcggcgttgacgagggaaggaagggaccgcccggatgaggccgggaaggaggaaccggcgaggcggacgtggacggggaccgtggcagagaggttgagaaagaaggaagggaggagggaggtacgtgcggagagcgcgcgccggagggcggccggtagagcggcgaaggtgtcgttgccggcagacgggtcgcgcgcggctgccgacgcgaaaaaagcgtcgaggcccgagaacgccaccgcggtgaccgcgggggccagcgaggccaggaggaagaagagaattagggtttggggtgggggaagagccatggtcgcccgccggccggacggagatgcggaggtcacaagtgaagtcggggttcagaattcagatcgatctgggagaccagatgcccggtgcggcgatgccagaggagactagcaaacgctagggtatatgacgggat

SEQ ID NO: 15692 - DNA, 2492 bp, Zea mays
gccggccgggctagggtactcccctagcctgcctcggtgcgccgccgccacacctccaccatggctgcgaccacgccggccaccgacccgccggatgccttgcttgcagtaacagctgatgctcccactcctgctcgtcccaccccggcggagctggtagcccgcgccgtcgcccccgtcaagcccgccttcctctgcccgcctcccgtccgtgaggcacccaaggaggagggtaaagccgccggcggcggggccgtcgtaaaggtggagaagaagtccaagcgccagctcaagcgcgagcggcagcaggaacaaaaatctacttctcacctttgtatcgaagtagggaaaagtggaaatgtggactcatgcaaatatggtacttcttgtcgtttcagccatgacataaatgcttatttgtctcagaaaccagctgaccttgaaggcacatgcccatttactgcactgggacatttgtgtccatatggactaacttgtcgattccttagtacacataaggataaccttgctcctcaaaatcatccagagggaaattgtgagagaaatcctttgagcaaagaaattcaaaagctcttatggaagagcaaatataaatttcccaaggccagtgcccagatcaaacttcttggtcttaaggatggaaacaagaataaagcagaagcagtaaatgatgataatccagatgaaacatgtaacctaaatggtgatgacaaaacacttctttctagcattcctgaaaatgttgaacctgatcccacgttgtgcaaagaaatagataattcaggcgacagcaacgtagttgttgactcagttgaatctgtggagccaagggcatcaaagaaatcaaaggttgaagttgatgaaactcgggataatgaaatcaaaggtcctaccactggtattcatgacaatgaggctgaatctgaagttaattcaatcagtggagtaaaagtttcctcaaataaccaaagttcctgcaaagttgatctgatcacgatacctcatttacgtgaaaagaaaattatagattttcgagagaagctgtaccttgctcccttaaccactgttggtaatcttccttttcggaggctctgtaaaaccttgggagctgatgttacttgtggagaaatggctatgtgcacaaatcttttgcaggggcaagcttcagagtgggctttgctgcgacggcatccatcagaggatttgtttggggtgcaaatttgtggaccgtatccagatactgtagcacgaacagttgaacttgtggataacgaatgttcagttgatttcatagacataaatatgggctgcccaattgatatagttgtcaacaagggtgctggatcatcattgctcacaaagcctatgaggattaggagtattgttcaagcggcatcaactgttactgaaaaaccgttaactgttaaggtaaggacagctttctttgagggcaggaatcgtgctgattctttaccgtccgggatctacaactggggtgcttcagctataacaatacatggtcgatcacggcaacaacgctacagcaaacttgctgattgggactatatctaccagtgtgcacagaaggctcctgactatttgcatgttattggaaatggcgatgtattctcctttactgactggaacaagcatgtttcagactgctccaaaatttccacttgcatgattgctagaggtgcacttatcaagccttggttatttactgagataaaagaacaaaggcactgggatatcacatctggcgagagattaaatattcttaaagattttgtgcgttttggtctggaacattggggctccgatttcaaaggagttgagacaacacgccatttcctcctagaatggcttagttacacctgccgctacattccggtgggtctgctggatgtgattccacaacgattgaactggaggcctccaagctactatgggcgtgatgacctcgaaaccctgatggtctcagattcagcagctgactggataaggatctcagagatgttgcttggcaaagttccagaagggtttaccttcgcaccgaagcacaagtccaatgcctatgaccgagcagaaaacggttaaacctttgttccgttgttcgtcagggcaggaactcagcaacaccagtggtgggttctcttgaggatcagagacaactactgaggtccatgctgcttgaacccatcatgttgtgtaacatgattttatatttagccaaatggtgattgtaccaatagtttaagtatagactatagagcacctgataattgaattgctcaattctcctctattcatgctagctctagcatcttacttatccatatacctatatttaaacttactctatgaacaatgcagtttacagtgcaaaacattggtttgagtggctatatgggtgaactattggatacggtctccgaaacaatatctaatgtatgaacgtacgttttctc

SEQ ID NO: 15693 - DNA, 1172 bp, Zea mays
  misc_feature (38)..(38): n is a, c, g, or t
  misc_feature (808)..(808): n is a, c, g, or t
acgggcaaagagctgccacaaggaaggcgacgaccctnaatactatgccaacctgggcaacccagcgtcaggaagtatatacccagggccagacctgcccaacttgtctcacctgaaacatactacacaaatacctctggtttgtacaactacgaaggtgctcgccaaatagtagaagggcaccagacctgaataaatgcaagtccacaaccaggtctcttcagatgtagccatgttgtcgaggtgcatgcatgatgccggtgtagggcagggtacttcacgaaaacaacagggcagattatggcgccatagggtcgccagctgaaccagtgcgcatgtgtgtgtcggtcccgttagcttccatcgaggcgtccatgtctgctgtatcagatggggagccagcagagtgccttgtaaatgaggaacttctctgaagatctgcaaactgatgcaaacctttcacggcctcaaaattcttgtatgtataccccacaaagctaagatctttagaattaagcatcatcttccttgaagccccagaacttgctcttgctggagcagggtttaaatctggaaacttcatgaaattctgtgtatccagttcatcattaactaggggcttaaatgctgcctccatctcatacagcttgtcccattcaactcctcgaaaccaaggatgagcttttatttgatctgctcctccgctgccaattctgtgatcaacatcacataataaccgacaaatgagatcctttgcttcaagagacaatcttggattatctggaaaattcaaatagcttctccaatngcacatcttttggcatgtaactagtggatcatctgaatacaatggtggataaccagcaagcatttcatacatgattgcacctaatgtccaccagtctcactctagtcgatatcctgtcttaagtataacctatggagcgatataatcaggtgtcgtgagtgttgaaaatgtcagttttctcatgttgttctgtccatgctgaagctgttcatttggacttctccgcctcctaccatttgcagtatcagagagagaatgatcgatgtccatagactccctaaggttttcatcagtcattggttcatcttcattcagtgttgacaacttcgaacaatcaattggcttacacaatccaaaatctgac

SEQ ID NO: 15694 - DNA, 1189 bp, Zea mays
actcaaacggtgattccttctccgcggagggccacgggcacggcgacgcatccggcttccggccctcctgtccccggaggtcaccgccgccgtcttcgtgggcggccataccggccacgatgaatagcatcaagtcggctatcttctccggccatcggtcgcacccccacgtgggggcggcggcggtcccgcagcagcagcagctggggagcaccgcttcgttccactcgacacccattctgcagcggaagcacaagacccagtggcacaacagattcaactattatacgagacgtaggaggaacagagaaactaaaaggtcaatgctacggaacatgtcagaatatgcagagtctctctttcagagttggcgtgatgaagatgagaaaaatgctgcatctgctgggccttcatggtttagaggacatcgttgggtcagaaattcaagcaacaatggtttccgtacacacgatttttattacgggaatttcaaaagcaaaggaggatttgagttttgcacaagtgatgaggatgaaccagagaatctgtttcgtaatgtttttcgagaccagcacacatattattggtctttttcatctgataattttcagaggaactccaaacgtgctcgctcacaaaaatccagaaactggagttttgaaacagacgaggaggatgaagtatcagctccatcagaggtatctttggcacgacaagctcttgggttgagcacttctggtccgcttaaacttgaagatgttaaaagcgcataccgagcatgtgcacttagatggcatccagatcgccacaatggatcatctaagtctacagcggaggagaaattcaagcattgcagtgcagcatacaagaccttatgtgatagtttggccgctgcatagataattttgaatgaagatggactctggatgagccccttccaaactttctagctgcaaattctgaagagctgccacatgcttgtggtagctccgaccatcccaatcccaagaggcgggagtcgcatttcttggttattgaggcgattgagtcaattcaaaattgaccggataatatatgtactgtaccgtgtaaaattttttctcacagctcattgttgtattatttttatagatatgaagatattgttcacaccactcaataaattttcttggctgagttgtatcaaaaa

SEQ ID NO: 15695 - DNA, 5094 bp, Zea mays
cgattcaatatgcatatattaattagctgcttgttaccaagtttatgttagattttagaagattgctgatcgtggctttgtttggaggatatatttgtgtgaatggaaataaagcactcagcccttccattgaagagggtctagcaaactgttcgtaccttgctacgattttcatttatgaatataatatataaaacataaagacagatgtgttccgttggttaagtagatatgaatgtagatttgaagtcaacaaccatggtttaagtctcgatcgtgaaaaccgtggatctgggaaaaatgttgatttcatatagtagagatttgttatgataacttttgtatttaagacaaacttggtaacaaagtacataggatccaaaagttcaatccaaataccccaatatgcccttagttcacttcgtttttagtcctgtaagatcctgacatgctatacgctttgttttttcataacattgcaggaaatgaagcagcaatgcgacatgaaaaggttcaaatacaactcaagtcaacctttttttctcatttatgattaattgatactttgttttactaatatttctttttcctttcatcacagagagacatatgaagctatgagggcatcctatacacaaaaaggaaggtcaaggcattccaaaactgaatccttccctgcagaacaactgcaaagcgctctcgctgagtaccaagaagacgcagcgctgttcatatttcgcttaaagtcattgaggcaagggcaattccatagccttttaacacaggcttctcggcatcatgccgctcaggtaggttatttcttcctgcataacgctgtcagttggcctagcgattgggtgaattaatacataacctaactgtcacactgtcctttgaactgtagttaagctttttcaggagagggttgaactgtcttgaggcactcgaacctcatgtaaaggcaatagctgagaaacagcacatcgactaccagttcagtggtcttgaggatgatgcatctgacaacgatgattacagctcctaccaggatgattgcagtgacgatggagagctcagtttcgactatgaaataaacgacaaggatcaatattttgttgcttcaagtggttcaatggatgtaagttctatgattcatattttgccgtcctctttatgcagctagctgcctctcacctagatgtgaaccataggttaatgttgtcaaatatttttccctgatctgagtggagaatttaaggccataatctgtattgtctttcttttcatgcacagttagacaaaagagatgtgacgaattccccgcagccagtaaaagaaagcatgcaggtatggttccactcggtgcatagaacgaatttcagaatttcttaatgcttaactagttactcccatatacacggccataatcctaagataataacgttgctgccttctcatccacaggaaggggtcaaacaaaccaagggaaatgttataactccgcgagtgaagccagagatcaacacacactcagcacccattctggcaggcaacttaccggatccgtccgagagatcttggcaaacgaagccatcttcagccaaactttcgtacaagcttccaatgccagttgatgacaaggatcccagatctgcaggtgctcagagaccacatcattcacagcagctggagagtaagcctcgtgtctcagcgaatccgtggcattcgtctccactgacgaaagacttcaggccgggtggccacgtgaaaacgccaccaagtgcggagggggcctcggcgttctcccagccggtctctgatttcaagaagatgaagaggcagttctattctggtccaatggcaagcggaccagggttaagcatgccatcttcgctgaacgatcgcagatcatccgcggcacaagcacagcatcttgtgatgccaggaaatttgcaaggcctcttctggcagccgtcatctgcgtccccaaaagttccccccaagatgttggggcggcatccaacgaaatcaccaaggatcagcgagctgcacgagctgcctaggcctcctccagccagcgtggagtccctcaggccttctggtttggtcggctactctggtcctctggtatccaagcgtcagactcagatccctgcagccacagcccgtgtgtcgccgacagcgtcacgaaccccctcgccgcttccaccgccgcctgctaccctgactcgcagctactccataccatcaaatagccagaggataccgatcgtcaccgcggacagattgttggaggctagaaatagcagggacggcagcgatatttattcgccgccacttacccctttgtcactggctgatttgtcccagcagcaaggatcgtaaactactgcaggtggcacatggatgaagggtaagatgatgtattcccatcgccttctgtttctagctgtcttgctttcttaaatttagagttcagttccaattgctttgcagtttagactttttgcgtagatttgtactaggctttttgcgtagatttgtacatgtgcagtaagcagctcgttgcagatgatatattgacgattacgatggaccttctaacaatcttctcttttcctttcaggggccttatgacataaatcaaccaaatgcagactgatcttagttgattttgtaagtagtgatgtattttaggttcatattcatgatattcttttattcatcgtctgtattacaaatgaaaaggacggaaaagtaatatatacttttcttacacagtagtgatgtattgtaggttcatattcattatatattgtttcattcaccgtatgtattacaaatgaaaagggcggaaaagtgcaagaacattgaacctctggttcagatctctgatagcgtcaagatgaaagggctgtttcctcagttccgttttgtttcgtttttggatgaattttccatttcttgacactacatgatttcgttccagattgtatgggtggagagaaatgaaaccctgtacaaaattaatgatgcgggctcgtaatgtatgctgtccttgctattctgtctcgagaaaaatatgatgttccgtccctcttgaataaaaaaacaaaaatgcatctagacatatttcgtgttcatgttttctgttttgagaaagactggatgtggatggatttcagtaatccacagattaacatattccgtccacgaaatcaatggactttcttacacactaagatgaaaaagaaagcagagaaaaatgacagccatctcaaagatttacaatgcataacctaacagacattcattcagtcccagaagtcagactcaaaactcaacaggtatgaccgtataagcttatttccagcctagtgattgtctaatccctgagaaaatcagcccaagagaccttccaatcattgacacccagaagtaggacaccgcagagctcactttgctgatagcaacccttatgaagggcatggcaatatctgacaactctaagaataagctgaagtaatacctccatccaatcaaagctcttaattcctttgtccttcttgctggaagggaaaatggactgatgttaacataatcaagagtaagcacattaggcttgccagatgcaatcctccaccaatttgccctctcagcttgattgtcggctgttttttcacattttttgctgcatagaacatataactcgaacctgtcctcatacattgaaacaactgacttgaagtattggtgcaaccaccaattaattgccacctcattgcgcagcttttggagttctctggttgacagagaacatagaaccaagctggaaccaacaacttcagcagacatatcaccatcaactgacataagctccagataaatactagcaatcacatcagctaaggaaataacaaggtcctctaaaattctttctccatgttcagcaagaaatttgacatcaaaataactgtcacaccttgcagaaccaaatcttaggaaaaagagcatatccaaatagagttcagatttcccaaatctgttaaacctcctcaagatcttattgtcctcctttagtttgctgcttatcgtcttcataagtttttcgttgatttgtccattttccaaggcctgttcttcttcaatccatttcataaatactggttgaattaaactatctatcaaggtagtcgatacttgcaaccacctgattccatcgagttcagaacttccagagatatttcttacctccatttccagaagctggaatgtgatcagaagaagccgcaatctgggaccagcatgaatggcaagcatactcaaaggatagtttttcctatcactcatgagtccatcctctcggctatccaaaagggcatcttgaacatgtgcttgtaaggctttggaaagtttagcactcacttcactccacatatcgttggggtcaaatgcagcattcctttcaggcaagaactttagatccctaccagaatgagaggagcttggctctggaatatgttgagaaacattctgatttctgacacgaggagatgtctgcccagagggtacaactccagccaaatatgcaaaaaccatgctgattgtgagaagagcttcatccgaaatcagtattagatttggtgagaccatgccctccgaatccatgagtggctgcaaacagtaacatttaactgaagtttccaccctgtgatcccttccatgaaaaccaaaaggggtaaatgcaacacttgtccattctcttgctgctttggattggcatggaagatgaatcttgagggcgtagttcctctttggatccatgattggcatattcagcttgctgttggaccaggtccatctcccttgatactggcctctcactctcagcgttgccaatgaacattcggccattagaggattactagagctcctgactagtgttcagtgcatcacaaaggtgcgaagggagaaagaagcattgtttccttgccgctgctcctagtcaccggagctcgagcccacgaatcggagcactaggagagagagggggcggcttttctgagacggacactctggcgaagggtctcgtgc

SEQ ID NO: 15696 - DNA, 3039 bp, Zea mays
accaaaaactaaccgcctgctctttcaggggagcggacccggacgacgagccacgccgacgctagggtttggtttcgccggcctgcccggccatggacctgcccccgggcgccggccgtcgcaccacctactccctcctcccacagttccccgacgacgccgccgcacctgctcccgcccccgccaacatcctgcagcgccagtccagcggcagcagctacggcgccggcagctctatctccacctccagcgactacccattccacttacaaccccccgcctcggccgcgggggtcgcgccgcccggatcggcagcggcgcctcccggggcggctggctcgcctctgcaagagctgggcgcagcaggccgaggagacctaccagctgcagctcgcgctcgcgctccgcctctgcgccgatgctgcgtgcgctgccgacccgggcttcctcgacccaggcgattcaggaagcgggaggggcagcggtaacgggagagccttcccgctcgcgcagcccgcgccctctgcggagtcgctctcgcatcgcttctgggtaaatggttcgctatcatacaacagcacaataccagatggattttacttgattcatgggatggacccctttgtatggtcactatgcactgatgtacaggaagagaaccacataccctccatggaatcactcaagtctgtccgtcctgatgatccttccattcaagccattcttatcgatcgaagaactgattttgaattaggtatgttggagagttatgcttccagcattctttccagttctgctgatgccaaagatgtggtaatccaactggccaaactcatatcttcaagaatggggggtacaacttccaatgaagagaacttgcttcaacgatggaaagagtgcattgaggccatcaagtcaagtacaggatctgttgtgcttcatcttggaaagctccctatcggtctttgcaagcatcgctcgttgctatttaaagtgttagcagataaagtcaatattccttgtagagttgtcaagggttgtaaatattgtaaatctgatgatgcctcctcctgccttgtacgctttgggcttgaaagggagttcttggttgatttaattagggatccaggccaacttactgatcctgattcctttgtcaatggtccctactcactatcagtatcctcacctctccatcccccaaaatttaggtcattggagataacttcaaattttggttcagtagccaagcaatacttctcagattgccattccctgaatctcttgttcagtgattcttccacaggtgttgctaatagcacagtaatttctctggaccatccctattctaagaaacatgttgctggggatgatgttattaacagctgggtgccaggaaaagggcaaggaataatgaagccagatattatggtgccagaagctcctcgggtggttttgccacttgttacttcctccaatattaagcttgaacttgacaaaaagaaagaattggtgactacacagttgcggaatacagtcagtgatctgtcacttgctgcggatgatttgatcattccatggaatgagttgattttaaaggagaagattggtgcaggttctttcggaacagttcatcgtgctgattggcatggatctgatgttgcagtcaaaatacttatggagcaagattttcacccagagcgtttcagggaatttatgagagaggttgcaatcatgaaaagtctgagacatccaaatattgtcctattcatgggtgctgttactgaaccaccaaatctatctatagttacagaatacttgtctaggggcagtttgtataaacttttgcacaggagtggtgcaaaggaagttctagatgaaagacgccgattaaacatggcatttgatgtggccaaaggaatgaattaccttcatcgacgcagccctcctattgttcatcgtgatctgaagtctccaaatcttctagttgacaagaagtatactgtcaaagtatgtgactttggcctttcaagactgaaagctaacactttcctgtcttccaagtctttggctggaactcctgaatggatggcacctgaagtgcttcgagatgaaccatccaatgagaaatctgatgtctatagcttcggtgttatcctatgggaactaatgacactgcaacaaccatggtgtaacctgaatcctgcccaggtggttgctgctgtaggtttcaaaggaagaaggcttgaaatcccaaaagatctgaatcctctagtagccgtattaattgaatcttgctgggccaatgaaccatggcgaagaccctcgtttgcaaatattatggacactttgaaaccattaataaataaggttccggcacagttgatccgttcagattcgtagcctgttctatacgggtacgggaagatgtattttactgagtggtcctgataacatcaacatgagtgtcctaatactgatctgctataattgaataatccttggatggtattactcattatgataatacaattctcataatctttcaaatgaagtgtgcctggcaatttctttccatggcttaaggtcggcatggacatcaccaggaaatgtgtatgggttttgattgattactaattcagactttcgtttgggttcttatacgaacaggaattgtcctgtgtgatgtcgggcattgtattaaggctatttttgggttcaaactcatctagaggtccttttgtgtttgtacagtatattactgtaggcaaccatgaaaaccaaaggtttaggctgacctacgtttaggcctcatttctgatacggctccggagcgagcaaatgcagtgccgtagaaggtgatatcagtcgtatgcatgcctgtttcttcgtctcttgtactgtaacatgtcttaaatttacctagtgatggcgcatgtacttctgtcgatctgtaccattgttgctgttgaagacaaagtgcgccaaacaaacacgaaccaaaaaaaaaaaaaaaaaactcgagggggggcccggtac

SEQ ID NO: 15697 - DNA, 562 bp, Zea mays
  misc_feature (521)..(562): n is a, c, g, or t
acccgattcaaacggtttcaaaagcgcgaccccaccgcagcccgcagggtccacggctctcgtttccgcccgcgccacccgccatgtcgtccccgccgcgggggcagcccgccaccgccgccgtgccggcggtcgcggccgccacgtccccgcagttgcccgccgcgtcccacacgctcccccgcgcgttcctcgccacatcctctccccgtgccatagtggcagcaccggcgcccccgctattcaccggtcggccgctgaaccctaacccaccggcccacggctcctccgtgccccacggcatcctctaccccgtcctgaaatccgcctccacgtccaactccgcggccgcggccgcggccgtgacagcgcagctccgccgcgttcctcccatggccgtggggtaccctcggacccacgccgtcgccatccctattgcacagcagcagcagcccctggtgcacgcgcaaccccgatccttcgcggccgtgcctcgggcccttgtgactggcgtgtcgacnnnnnnnnnnnnnnnnnnnnnnnnnnnnnnnnnnnnnnnnnn

SEQ ID NO: 15698 - DNA, 1597 bp, Zea mays
cctcgaggcccgcccgcgtgggccacctcgccgccgcctgttgcgttcgcccctccttttaccttctcccattcacgccccgtctctttcgtggccttccttttccggcggccacaagtgggcgagcggcggcgcccttcaccaggtcttcgtcgggcccttcaccggcgacgagcatccaccagaaacgtggagctcagagcattggtgcctctttcctctttcaccaaggattccggtgccttatttcacaagacaaaaaaagtctcaagggtcttgattcttgtatgaactcaagatttatggtggatcttggagctgtgggatgctaagcctggtctagctactagattatgaactctctgctgatctaatagcatttctacaagaattcttttgctggaaggtttattagttatttgcaacaatgaaggaacatctaatgcttaatattgatgacctaagcattcttgagcctaacgaggtcattgggacagtcaagaataaatcatctggggaaaccattgcacatccaccctccatggctcatgccattttagcagtgggagaaagcatggtttctgaagcggaacctcttctgcaagtggtggagtgtcgcatttgtcaggaggaagatagtatcaaaaatttagagagtccatgtgcttgcactggcagtctaaagtatgctcataggacttgtgtacaacgatggtgcaatgagaaaggagatgtaacatgtgaaatatgtcatgagccttatgaacatgggtacactgcacctcccagaggccatcctgatgaaactaccattgatataagtggtgggtggacaattaccggtaccgcatttgacttgcgtgatcctaggatacttgcagtggcacaaaaccacatcatggaagctgaatatgatgattattctgccacaaatgcgagcactgctgccttctgccgctctgctgctcttgttttaatggctctcttattgttgagacacgcactgactctaactgatgaagatgacgacgacacttcagcgatgttttcactttttctgttgcgtgctgctggtttcctgcttccgttctacatcatggcttgggcaatcagtatcttgcagcgccgcagacagagacaggaggcagctgctctagctgcagcggaggtggcattcatcctgcagtcaggccaaggaaggggagtgcatttcaccatcgcaccggactccccggccacaccacagcatgaaccaccacaaccataattacatctatctaggagtggctgtggccgccgccgatcgattatttccatgggttacccaaggatttatggctgtctagtgcagaagcagataatttctgcccaagtttcctgtcattaatgtacttgcgtgttcgtgcgagttggctagtgcattttgcatgtcgtcccgggactaacgggatgtgtatataatatattttgtaacagagacatctgggttctatgatctccacaatgtcaaaaattgaactatcgcctgaattgtcagtcatcaacaacaaaaccttttagtccggaatatattagagttgaattctgcgccgaatct

SEQ ID NO: 15699 - DNA, 4548 bp, Zea mays
aagtttcggactgcgacagggagtttccgggtgcagaccttctccaccgtccgatcaaacttccaccgtgtaagtgcctttgtcctcttggttctctaactattatttgaaatgtgcaatgcaatcgtataagagatgtctactatttgtaggttcgacggccaaaagcggaagaaggttcacaaaatcacatggtcgtgacaagcaacagaaatgtcaaactgtcaaaagcacgaacaagcaacaactaacagaaaagattgagatgttacatgacttcagtgcacgaactagcaacatagcagtaggcaagtagcagccttgcaggcctgtggctgctgatacacgtctgaagtctgaaccggcttagaacctggaggccggagcaacagagcacaatacgctagagcctggagcggtgggatacacgtcactggtcggtggagcgccggctagggttggcgaatggacttggcatcggccgttgtcctgagttagcggtgcagcatactgcaggcagcgtcaagttgagtgatgtattgttgtgccaactgccaagtgcccaggcccaacagcagaagtgtgaaatagcccagcccaacagcggaagtgcgaagtgttggggcctggtttggctcctggttgtggacttgtggcatgtgggctgatcgagttggactgtaaaagtggcagctcgttaaaaaaccaagctggaaatgagcgctgggcacagctctcttaaaaattcaaacgatccgatctgaccagaccatgagctacaaacatttagtccagtcttactcatatacaccaattatatgttaatagtcttaatcttaattacataatttttttgtttaaattaaatatggcatggatggtttagttttattcgcaaaaatgttaggaacataaatataaaatcaattcggtgattatcttttaactagaagatataataaaaaaagtaactaaaaaggtatctccaaaaacgtgcgcgagcatagcacaggccgagcgcgcaagagcagcgttggtccaaaaaaaacgcttgtagattatgtttaggtactgtttggttattcctataccgtatggatgaaatgagattgaaaaaaaaaataaaagattttaacttatttatgatttaaactcacttaattcacttaatccatatagattgagagcaaaacgaaaattcttaagaccttgtccggttattcccatcttatatgtattggatgagattggaaaaaaattataaaagattttatcttgtttgaaattaaaacccacttaatcctaccaaatccacatggattaagagcaaaacgaacaagcctagagccaagtttggatgccacttttgcacagtttagtcaggctactgaagcaatacaggaaaccaaacacctagatttgcatatacttaactagcctggatagctggctgtgcatccaaccaatcagccccttatgcaccaagctcgcgtgagcctcgctgggcacacgcagccataccatatatagttggtaattgatattcatcttgagtttcggatgccccgggcaacatcgatgcaagaagccattgaacagttggtcttgattgtatttgcactaatatgagatctacaagcagaaaacccctcctgctcacacatattcaaatatattagcttttcaagtcatatataaaatttacaatgtagaactaaaataaacttgacacattattaacaaaaacacctaacgcttttatataacatggtcaggaaaaaaatgtgtaaatggttatgcaattgtgtcttaatatctaattttttcgttccctcaaatcactgtgatctattaacatgagtcgaacactaatacttgcatgtaatagtgatataccttccgcaatgaattgatgagggtgccgagtgggggagagttaacttttgctcgtctcgaaatctgaatttgattggaaaaaatagaatcggtgcatgattaaattttgctaagccagtaaatgaaccaagcagattgatgaatgagtgaatattgaactccaagacatacctcatcaagtcttatatatccaggaggcaacctcgggtcactctcttcaatcatcatgccaagaagtttttccaaagagacaccattttcaattgtgcatgcccatccccattcgttggccaagcctagcatttcggtaaggaaagaggcatcgtggagaggacctgtccaaagtgggcctacaacagtgattgaatcggcatcctgtgaaaaagggacaattatatactagcacagttccatggccaagtactccaaaaacaacgcaactcgatcaggtttcttgcatggcataggcatacaattatcatcgaagattattcattagtaaaccaacatcagggttagctacaaatgatatcgttccttaaatgacacttgagtacttgactcctatgttattttgtgttaattaatactgacaaagttaaatggttagggcctaagtttcctgaatcaaccaccagtaataaaacaacaatttagtcctgccacaatgatccattgtacctactgttgtgtctgtacatccacaagaaatctgccccagctcatcaaatccaaaagtttgagactgaccacaactcttgcaatgacaaatgaagccatagttactgtcgaaacagaaagggcatcagaggtaacattccataatcagctctgtagttattggatagaaaaccacaatgctttacctgatgccatcatcttttccgttgcatagttgtaccattactcgataaataggaccatgatacgcaaaatacgagaataggggtgttatgtgaaatcccaaaagagatgcttcccgtgcagcgccacctataaccattcgcaaaccgacctcatttggatatggcattggacgaacatacgctccatatgaagacaaagagctaaaagaaacccacatgttacataattgacaataatgacccatcttgtcaatcacagtgcaaagaaaatttgatttacataggcatgttgacagcaaagcatatactgggcaatacaggctcaccatacttaacagaggaagtaaccatagcaataataaggatgctccgtgcaatgtagttatactgttatactataatcagatacatagcaaatctagctaagcaatttaacttcagtacttcgtttctgcctttctggcttgcataagcactaagtcatgtaacttgtactgggaaatgaaaaagcttaagcattcacattaataaatagcacacgtttaaaacactacaacctaagggtatgtttaaataccatgggctaattgttagctagctaattttagctccaattagatccagtgcgtcaaaacaagatagctaataggcgggctaatctttttgccaagtctctaactagctagtcaaccatagctaatttgggctaattttatcccgaaattccctaatttgagctttagaaactatttcaatccgacacctctgtggctctgccagttcctatcgtataaatattgatgaacctaatataaaagttaaaagggaatgagcgaataagcaactgacccaacaaatattctagaagttatcacttgagcaatctacattctaataagaaaacccagagacttttagataagatgaaaataaaaatggatcaagaaaccaccttctcgacccatatcctctcgccgaccgccaatccgtggacgtcaggtagagcagccccccaattttgagcgccaagagcgctgccctcacgtaagcggcgtcgccgccgaacgagtcgacgtcgatgacatcgaagtactcgcgccggaggtagcgctctgcgagcagacgggtggcgtcgttgtgcgacaccacccacctcctgcaccccgccaccgcttccggcgagccccgctcaaagcgacagaggttggcaaggatgatggggcgaagagcctcggaggcgtcgttggcccagacgaagtcggcgccggcctgcgcgaggtagcggagcgcgcggacgccacagccgcacatagcatcgaggcagaggaatggggcggaagggtcggggcggccacggcggcgatggagagtggctgcgaggacggcgaggtcacgacccgcggcgctgtcgctgcggtagaaggcggagccggggtcgaaggagacgccgcgctcggactgcgtgcaggctggtggcgctgagcgccggcgcgtgggttgaaggagagagggagagtggggcaaagagatagcggcggcagccatgttagcggggaagagtgggggaaatggcttctccttaggattgggttcaggcgttcagctgaatgtctagtcttttcggtttcgggtccggtgacatgaaaaggtggcccggccggcccgggggtcccagcgatagtaaaaacatgggtaaattgcgccagcggtgtcatgtttgctggctgtctaatttatcaaattttacctaacttttctgtctaattttagtttttcaatttcgacg

SEQ ID NO: 15700 - DNA, 2448 bp, Zea mays
ttttttttttttttttttgctaacttccgtgaaattaaaatgctcacgaacgaatttgtgatttagaatttagaatacaagtgccacgttatttcatcagagagctcctaccctaagtttatctggacgccattcagaactacacgtacatattgtacctatacacgtcggatctctcaataaggatcctccaacttcacttcaaattcagcatccccagtagcttccaacatgtccagtattttcttcgggccaagagttgtgattgattggccctcagcataaccaaccattagaagtttccctatcttcgacctccaatcagaaacagatttctcagtccacctgtcatggaccacacgatcacggtagttgaccattgtgccaagcccagtgtttcttagccagccatatccttccaaaacatgtgcctcgccttctgttaaatctgtaccaaccagtaacggcctgttttcaataagagctgtccttccacagccactaagcttcattgcaacaaccagcctacggatctgccattctattggccttgattggaccacctcaaagaagtatgttgcataaccatattcaggacgctcaagaactatcctattatggcttctaaatataaaaataaaggattgcagatccctgcaccatccccattccacaggacagtcacggaatcgaaggtatcgtgactgctcaataagagaaattaaacaggataagcagtaaatagacttttcccccctttcgtatctagctgctgacagtaaatgacattttcccctcttcggaaatatatttgcaatcacgttttcaagatcttcaaagttactttctgtagaatctgcaatcatttcattatcttcttcagcaccgtaaagtttgatttcttcaactcctattcctctgtccaaaagaatctttagaagccctggagcatcttcatcaagtgccttttcaattgaatccgtggctgttttcttcctctttcgacgagaacggtatgcaacaccctcatcaacagtgtaagcatcttctttaagtgttttttcagttgaataacttgttttcctttttctgcgttgtcgggaactgaaagaaacattctcacataagccaggtaactcacagtcagttagttcatcttttattcctaaagatagtactgagccttcggcatgagtagaattttcttgaggtaattcggaaggaccaatctcataacctcctaatgcaggttccagttttacatcagccagatgagccccttgttttcttgcaaccagctcactgttttcacccatacaagttgcagtgccacctatctggttttcggaaccctccactggaagatcttcaccaagtattctcctgttgctgtcatcatccatgggattactctataatagaaggtgcagaagaaatttcctgcaacatgctgaatatatcttctttgcttatttttccctcatgatttcttttgggagatgctctgctagtttccacatgcattatagatttcccagctgatactgtagtaagccccagacttttgtctgctagaaggatcctgtagcgctctttcagagatatatgatcaagctcatcggtttcagtacagatttcaggattaaagccttggccccattccacgcttgaatctttatgtgtggaaacatcccattcggattcaatatgagttccctcggccaattcacacagcctgttccgtgatgcaaggaatatttttgacgccactatctctgactctgccttcactgtgttttgtaaatgatactgatgtaatctccaatcagtttcctgagatcttttatcactcggcatgtctgcatacagggcaaacacttccttgcaacccgtcagtgttccatccaggatgatggatctagggcttccaattttcctccagcagttatttacatcattctcactgcgcccgcgcgcaaaacttctatggaagaagtatgatgcacgaccatcttgcctaacacctggtatatgttgaggatgagtgcaaataaattctctaacatcatcaacaaatttaatgaactcgttgataaatggatggcgctcagctagagcgttcccaacttctgctgctagatgccacagaagatcactatcactgggattaaattctacaccccttggtagacctggccaactctcagaatacatcaatatggtaggatcaggagcggacccagcaaaggacatgagcatacagatgtacacccaataactggtgggtgctcgtcgccagtgaaggccccaacgaagacctggcgaagggactgacgttgctagacctgggcaccagagaaccaggagtacggcggcggcggtcgtcggccagttgcgccaggagtgagagagggcgcgcgcacgaacgcggcccggccggcctcgagg

SEQ ID NO: 15701 - DNA, 2369 bp, Zea mays
ggagaactagaaactgaagtactgaacttcgttcaaattccagtactcatgtaatagataatagtaacaggttctaccaatttatataaatttctttaagtgtagaccaaaggaatttgctcatggtgattttcttcgtttgtagacgtaaggcgatggtgcagaactaagatacaatgctgtaaaccccattacaaactgaaacaagcatgtatcacagttgtatcataacaccaacatttaaatatgatgtactggtatcttatcataagttttttgtgagggaaattttagcaaaagtttgtaggatttactctcactattgtattttattagtagtttagcttttcgacacaaataagaaagaacacatgatgaccaaattgttttgtttgtcttctctaccgtaatggttaaggcttccgagtagcacctccaggtcccgggttcgatccctctcagggggaggtgaatttctggcttggttaaaaaatcccctcgttgtgccccgtccgctccagggttacgtcatgcacgccaccctttggctatgccgttgcaaagtgggcggtcacggcccgctagtgatgaggggccagagttcggggattttctctgccgggactatgtttcggtcttttcttaatataataccgggaggacggtttttccctccccggccgagttttttatatcttcaatgttagtaacgtttgaacaaaaatatttagtcatgtgtattatactacagtctaggcagctaggggcattagaaagagttatctcttctctaggttatttgttattaaaagtaagcaaaatgagacacttttcactcctaatgcataaaataaaataaaaaactggagggagtctgttacttcatcagttcgttcctctatgccatctcattattatgtaggcctttacactaccgatatctaaaacctaaactgaatgtgataacgatctgggacaccgcaggccaggaaaggtaccgagcagtaacaagtgcctactacaggggtgcagttggagctatgttagtatatgacataaccaagcgccagtcctttgatcatgtggctaggtggcttgaggaactacgtggccatgctgataagaacattgttatcatgcttatgggtaacaaatctgatctgggcacacttcgtgccgtcccaattgaggatgcgaaggagtttgctgagcgcgagaacctcttcttcatggagacctctgcacttgaggctatcaacgttgaaaacgctttcatgactgtactgactgagatttaccggaccgtcagcaagaaaaaccttgttgccaatgaggagcctgattctagcggaaactcgagtttactgaaaggaacaaagattgttgtccctggtcaagagccaccctctacattgaaagcaacatgttgtatgtcctcttaagcatgatattgtaccataataccatgttctttctggtcgtcggggtttctgattacccctgacatatctgcgtgatgaatggctgtgaatcttggaggtaaagatgagaaggtctacaggaacagttaactcatatacgctaactatctggaaacagccttctttttgtatctgattttgtgatatagtacagtcattaagaagccttctcttcaaactcttaaaaaggtttgttccaagtattgtttgcaagaacatgaaccaccgaccttgtttggaccaaaacctaggaaacacacttagaccaggcaggtctcctattttaggccttgttcggttgcataggaattgaatgagattgagatcaaatcccttcctatttaattttgtataggaatggatttaatcctctccaatcccttcgcaaccgaacatacctgacagttgatttccagcgcctgaggctggatccgacgtgccttggcggcagcttgcaggtgagaccacagtccaaacgctgcctacatgcattctttactatgtgcttgatcctgtctacaaaaacagtgatggtggaaaatctggtgccaaaagactatctagaaacaaaaccgtttgttatatatttggccaaattcctctaagctttattatgcgtcaggaaagagcacgtcaatagattcaggatgtgtttttttttcctactcatttggtttgctttgaaagtcttaatacgctgtcttcctggcttcctgctctgtaagtcttaacacgcgctgtcttcctgctttgagacaaagtatgctgttccattattactattttctggaaatggtgaatctctttgaacaatcatgtcttattctacaagctgtgttgaacttcatccaaaacgtatcccagaaacttgcccttttcaaggcttgt

SEQ ID NO: 15702 - DNA, 1287 bp, Zea mays
gttaatgttccaccgttcgggtgtgctgattgttaaggcacagatctgggacaccgcaggccaggaaatatgacgagagacgggcgttgacagctaaacactccgtctgttgaatgttgatcccttcaacatttcccctatgggaccctcgaccccgattattaaccaatcgaatcaactgcacctcttgaccgcttctactccaccgcctgctgctccgctagtcttcttcaaccttgtgatgcttcagccccccgcccctggtattgatcgctcagcacaaagcgtcgtacttggataggagaaaacaattctagacagtcgacagagagagagaaaaaaaaaatagagaactgagagatcgaggacaaagggggagaggagatgtctcggggcggtagccacggggagctgggccagaggatcgattacgtcttcaaggtggtgctcatcggtgactccgctgtgggcaagtcgcagctgctcgcgcgcttcgcccgcaaccagttcaacctcgactccaaggccaccatcggagtcgagttccagacccgcaccctcaacatcgacgcccgcaacgtcaaggcacagatctgggacaccgcaggccaggaaaggtaccgagcagtaacaagtgcctactacaggggtgcagttggagctatgttagtatatgacataaccaagcgccagtcctttgatcatgtggctaggtggcttgaggaactacgtggccatgctgataagaacattgttatcatgcttatgggtaacaaatctgatctgggcacacttcgtgccgtcccaattgaggatgcgaaggagtttgctgagcgcgagaacctcttcttcatggagacctctgcacttgaggctatcaacgttgaaaacgctttcatgactgtactgactgagatttaccggaccgtcagcaagaaaaaccttgttgccaatgaggagcctgattctagcggaaactcgagtttactgaaaggaacaaagattgttgtccctggtcaagagccaccctctacattgaaagcaacatgttgtatgtcctcttaagcatgatattgtaccataataccatgttctttctggtcgtcggggtttctgattacccctgacatatctgcgtgatgaatggctgtgaatcttggaggtaaagatgagaaggtctacaggaacagttaactcatatacgctaactatctggaaacagccttctttttgtatctgattttgtgatatagtacagtcattaagaagccttctcttcaaactctt

SEQ ID NO: 15703 - DNA, 1454 bp, Zea mays
tttaaatctaaattaaataataaattccagaaaccgtactggactaagggttttcctatttttactccaaagcttaactcctacagaacctaacaaaatttgtttggttgaatttgcacaaatatttctcaagttatgtaccctttaaggtcgacctgcagaatttaaattaaattttctaaatgaattaggaaatgtccatttagtgctggggtccctgggttttcttcctttccttatttacaggacggtcctcggggcactattctccttagtcatgggtttaacagaaaacctcctagtttgctataatctaaacctgaggtccaagtttaacggaacagtaccggtggcaagaaatggagcggcggggcttaccgacggtgttagagctccggcgaggtggttggtaaggtcagggagtctttggtgaacacgtcggtggtcgaatggcggccggtggtggtcagagttgtttgtcctacgtttctcggcaatcggagttcgtcggtggcagtgttctggctagttggcgatgatagggttcaattccaccggtggggaagcttcacggggtgtcggggagatgattcctcgaaggaattggactggggttggctgtggaagcgggtccacgttcaccggcgaaaaccgtgttccggcgaatgtgattgtgcggttttggtgaggtagagttccggatggggccttgaagagtcctagggaactcaggggtcttggtggtggcgctggttgaggtggcacgtgaccggaggtggtggttcaccgtgaccagccttgggcaacaatggcgggcggcagtgttctcgtcctcggtggaattccagtgaaggttggttgggcaacggttgggaaggaatggcggaaggtggtgcgacctttataggcgcgagcacgcgcgcggcgctgtgttgcctgagcacagggtaggagctcgggccctatttggcacgctctgcgacttaggactgcagccgaacggttggttcatggtgtattgtcacattcaaacgcctataggtcgtgaatccaggcgaattttggacaaaattcccttatatgatcttctctcctctcttcactctgtcgataggtgcagaacaccaagggtttcgtgtcaggaacaccgcgttatctttggccaaagttgggtctgtcagagggggcagaaccgaggcatttcttgtgttttgtcttgtccaagtgtggagtcccgatgccatcttctgatatgggttaggttagttaatttggcacgattttgtcaattagagtgactggatttaaggtccaaatctgaatgaacatggggatgttctgattagaggctgaaatttcagaaatagagtgtggtgaatttggtctttatttctcctcttttgtagcttgtttcaggggtcttcagcctacctgtttggtgatattctgcagac

SEQ ID NO: 15704 - DNA, 478 bp, Zea mays
cgtaagctcggaattcggctcgagagtgacgtatctaaattgtctatcagtactgacttttcacactcgggtatagaaactgtcggcacttgaagatgaacaaagcgaaattaccctcaaaaaagcccctagaaaccaaacacccctaagacaactatcgattagctaggatcacgaggtgatgaatggtagaacggctcgatttatcgtgttgacgaggtggcttaccagctaggtaaacgagcagacgacccgggcggcctgttggccttatctggcttgtcatcgcgacaacgctgactttgttgttgaacgagagcggcgtgacacagacaatgctcgtgcgtgaggaggggtgagtagatgtgttggccggctgttaggtttttgtatgcggttattgggctttataagcgagcggcccaaatagtgggttttaaacaaaaaaacaaaagggcggcccgcgactagtgagctc

SEQ ID NO: 15705 - DNA, 4373 bp, Zea mays
  misc_feature (1609)..(1609): n is a, c, g, or t
tctcgtttttatctggattgaccctgtatttattcggtaattagaagagtctaatataaattagtatataaactaaatcctcgtgtctttagatgataaattatagtacaagtggtcattgtaaccattggtttttttcaatgacaagtggtctaaagtattaaacaatatcgaatgtagctatatgtacactattagcaaccaaacaccaatagaatgttgtttctctatatctatttgttttatgttattatcctaccaattaatcattagtcaatcaaaccatgaataccatttgtatttatattaaattacgagttttcgttagtatttttatttccgttagtatttttatttccgttcgttttttgtaattcggttcatcccatcctcttttcgtttctgactattccaaattcaatctaattttcaatgataaaaatgcggatacgaaaacgagattgaagttttttcgtctgttttagttcctaattgagttggttttctagactggcacccgccagtcggatccacacggcagtgattctgactacaaacctttctagaaaggagcacagggtccgcgcaccattgtccaaccttccatggagaaccacagggttcgcgccagtgtccatcgactcctgccactcaggcactcacgagaggtaaaaaaaacgttaacaagatgtctcgtcacacgtgtctcgcacgcattcctgcagtctcgctctcgcagcctgctcgtccattcaacgaccaaaccgctcacgtcacgtgcctgcccatcgcttcccaatcctaaccgcccgcagcgcagcggcgagatcgacatcgacctcgacctcaatcgctgacgagtgacgacctttccgtgtcgatcggtctccattactactagctcgcgggcgcggcatccctcaaccgaaactgatggaggctgcggtctccagcgccggcgagtcggcgggcgagctgcttctccgcgcggcggcgctggtgccgtggacgcgctacttcctcgcggcgctagccctggccgccgtactcctgtacaggttcctggagctccacttgctcggcgacctcctccgcggcctccgcggcggccgcgtctcgcttaccttccaccccgagtctcaagtgtaccaccgggtcgcctccaagtgccgctcgctgcacggcgggtcggcgggtgtgggatgctatcatgactcatgagacatctgctctgcctccctcttccgaagaaaaattgctttgtgattttccccccaatgttgcattgcgtaggtacctgacgacgccgtggttagcgagtcctcatttgcagacgctgttcctgagcatatctggcagaccaccttcattcacctatcggaggttggagtgaaatagtaaatcgttgtcatcattgatattattaagcatttgcgtgttgcgttcttcatggtgttgttgctcgcttgctttttagttcccctgtagtaaagtgattaagtgactacatagtggttgttacttatacattgttatgtttctgttgatgctttactaaaacttagctgatgcgttcaatttggctatgcaattctgtgtgtttatggcntggtgcacaaagtccaaaagaaaatagtactccatctggtccaaattatagttcacattaagttaaacttctttaatctctaccgattttttagaaaaaattattaacgcttcaagttcaaataaatgtcatatcaagacatattacattatgaatttaacgaaagtaatttcatggtttatgctaagttagtttgacttaagataaagttaaaggagtacaatttggaatggaaggggtatttcattattgtgaacatatgatgtatatagggaggcaaaagtagtttttcatatgtccaggaaatgtttggctcccattgtttcatttcagtattctgcaatttgtggccacacatatcagcttgatataccttagagatcctcatatttttaaattagggccttgtaatacaagataaaaactgcaatgttatagagttttatgactgtggttatctttctcagtgattggactattcatattgcaggcagttgtacactgttcgtgatggcggtaccattgccttagattggttactagcttctgatcttgaaggttctgcaaagtttagatagtttaagattgattagcaagcaaatggacgattaaccttttccttttggtgctaaattgcagatggagatattggcacttctgacggaaccatttctaaggatgattcaacaccccttcttgttgtgatacctggattaactagtgattctagtgctgctgtaagtcgatcagtttaaacaagaactggaagttgattgtataatccctgactctctgtttcattttagctacctttataatttaatctaaacaagatgtggggggctttgttgcagtatgtgaagcacttggtcttttctatggcaatcaaaggatggaatgttgttgtaagcaaccacaggggtcttggtggcatctccataacagtaagttcttccataggtcaaaacttatgataagacacaattttctattaaaaaaccaagattttttaagctagttaaccttgaatacacattataacaccagaagaattgtcaccaacattagttgctgataaaagatttagatgtctattgttacttttttctgtttgcagtctgattgcttttacaatgccgggtggacggcagatatgcgtgaagttgttagtttccttcatcaagagtatcctaaggctccactattcactgttgggacaagcataggtgccaatattgtggtgggtttagtttttctttcccgttcccaccctgtgaaaaaattacggcagctgttcttaatagtttaaggttagttctgaaactttcttatatattgcccatttaggtcaagtatcttggagaagaaggtgaaaacacacctgtagctggtgctgcatctatttgttctccctgggatctgctggttagttaattattaattaatttagtgggtttccaactttttctgattttaaaagtgtatgcagaaatactttggtttgcatatcaattgtaccacacctgtggtttcaaatactgtcacttcggtttctgtgcctactcatctttcctcagtaagggtctgggccccgtcgtgcagacccgggacggcggctacctggctgccacgaacccattcgacatcccggtggagcggaaggagctccccaagctcgccatgcaactgtccaagccgttcatcctccgcgaccagaagccccccggcggtggcgccgaggtgttccaacgcctgtgcgcgggcgggtctgaggcactgtgcgcgaagctgggcgcgctcatctccatggacgacgtcgttggcaagacagccgagcagatcgcgttcgagggcatggcctccgcgatcatcagcgcacgcagcaaggatctcgtcgcgagctccagcgcggccgagtccgtctcgttgctccggacaatgtccgcggcgacgaactacgggcgccaggaaaggatcgccaccggcatctggaacgcccaggaagcgccggtgactgccgacgagatcctggcgttctcgctgccgaagatcgagtcgatggcagtggaagcgctcaaggtccaggccgacatgagcgacgagcaggccccgttcgaggtatcgccaagcgctgcgcccagcgcggacgcggtcactctgctcgtggtggtccagctgagggatcccctgcgccggtacgaggccgtgggcgcaccgtcagtcgtgatcatccaggccgtgcgtgccggcggcggcagggacgacgagccgaagttcaaggtagcgaacctgcacctcggaggcctgcggctgaagtcgcccgaccggcgcaacatgtgggacggcgagaagcagcggcttacggcgatgcactggctcgtcgcctacgggctgggcaaggccgccggcaggaagaaccgagccgcggtgtccgggaaggccgggaatgaagtgctgtggagcatgtcgtcgagggtgatggctgacatgtggctcaagccgatgcgcaatccggacgtgaagatctaccagaagtagtgttactacagcgagtccggcttcctgccctgggactgtctagtggctaaggcatcacgtacaaataagcttttgcattttgtttgagaaaattgtacgaattcttgcaataaaccatgaatactactgttgcaataaatgagagaaagtttggcccgaaaatgtagaagtgccacccgcggcctatgcaatgagacagggggattctttaagagtcgacctgcag

SEQ ID NO: 15706 - DNA, 693 bp, Zea mays
  misc_feature (628)..(628): n is a, c, g, or t
ttttttttttttttgtttctcttcagatagttcattttcagtgcagtttccaatactacttcagtccaacgaaacaaatatggttgcaatcagttgccaagcgcccaacttccagttacaccattaatatctaaattacagcagccatctttacaataaaactggtggaagtgaccatgtcgatggaattgggcctaattcttgacgtggctaatgaatggcaagcaccactttcatcagaagcatggtgttacttagccacaggttaccacttacaagaaactagtgcccagtgaaaagtcactaaagttagaaagaatctgagagcgggtagttccaatctgctgcgcaatctcgagctgctcttctaaagacatcatctcatagtgagaaagaagctcaaagtcaatgatgttatctggtccaggacgatgtgccttgccatttgacttgaaatgcctgaacgatcttggatttaatccacagacatggggtatggcatctacgagcttcctttgcaagctctggagccgtcgaaatgtcaattcatcaacaggggcaatgcatccaattccaccatccaacgttccaaatacaagagcaaaacgatttgtcctcccaaaaggcnaatccttggggtaggcaacatccggtaatcccaagaaacttcgaaacatgggctccaacaatgaa

SEQ ID NO: 15707 - DNA, 1957 bp, Zea mays
gcatgcctgcagctgttctcttgatcctgctgaaatatgtcgtcgaccgtttctccttgtatttcctttcgacgcattcattgccttcctccggttgcgccgtgatcagtgactgaccaccattgttgtctgtactgtgcagatcgtagtggggaccttcgacgccgatggagagaagaagccgccgcagcagcagcagcagcttgctccgtcaccgccagacccgtcaccggcgccactaaagctcgcgccgacgggcgtggcggcagggccgagcagcccgccgtccagaggcacattgagcctgagcgagtcatccggcggcgccccgagcccgccgcacgcaggggccagtggcggcggcggcggcggctatgggcagcagcagcagcagccagtgggcttccccggcctgtcctggaaatgacgaccccggacaccgtctgaccatggtaaaactggtagaagcaacaaagatgcgtgaggaacagatgaaggccgaagctcactcagggagaagcagcgctgcagcagtagcttgtaggtggtgtcaagattgtagctcttgctatcagtgttaatcgttcattgtcaggtggttgcttattgtcgtctgcaactgatgccgtgtactccccgatgcagcatgtcggtatctgactactgaatttgagacggcttctctcggatgttttctcataatctgtgttgcactgcaaatatcaaacaccaaaggctatggataagtttctaataagattggaaagatgtaaaccaaatccagaaaaaatatttctctcccggaaaaaaaacacgatcctaagtgctagtttttgtaaaccctatttttaaaaaaaaatattttatcaaaaaaaaaataattatttttatttgggaaattgaaaatctcatgaaaaaatggggtttccgccctaaatgtttactttatgagcgcgcgtaacgtgtgctctcaccgtgagatgaccgcgcgtctcacctcacacatgacacatgtaattgcttgaaaatctatggctcacacatgacacatgtaattgcttgaaaatctatggtttagaaagagggaatcagggaagtgaactagcggtccacgatactccgacgcccactttgctacctcggaaccctagccgccgcccatggatatcgccggagaccggcgccggtagcgatacgcaaaaggagtggtacgttctttgaccttgtttattgctgcgcccgaggcgtgtggcgcggggggagcaggaaggagaggggaagaacagaaggggaaggcgggcggggccgcgatgtcggtgcggatcaaggcggttgtagaccggttcgtgaaggagctgcaggaggcgctggacgcggacatccaagaccgcgtcatgaaggagcgcgagatgcagagctacatcgaggagcgcgagcgcgaggtcgccgagcgggaggccgcctggaaggccgagctatcccgccgcgaggccgagatcgcacggcaagaagccaggctgaagatggaaaaggagaatttagagaaggaaaaaagcgtcctcatgggaacagcatcgagccaagacaaccaagatggagcccttgagatcactgtcagtggtgagaagtacaggtgcctccgcttctccaaggcgaagaaatgagaaatggactggcactgaactggaccaacacatgctctgtagtcagctaaatctagccacctagtcttgcaagacccttattttgattcaaattgcattctcttttcttgtacaggaaatcctggaatgccgttaatagaatagcggatacttatgccaggactgtcttgtttataaaaaaaccgggctgctagagcagctgcaatggggagttaatgatgacagaaggttgttgacagttgtgatgtcctgttcttgctgatatgtttacagatcagctcaatgctggctct

SEQ ID NO: 15708 - DNA, 845 bp, Zea mays
acgacgctcccagttttaccttctccagtcctctctgctggactctcggcagattccgctccagcgcccaccgtcgcccaccgtcgcctttcaaaaagctagagggttcctcgagagggagaagcgtacccggcagctccgctccgtcagtccgtccgcccccaagaatgtcagacgaggccaggcgcgggcccgcgggcgccgcgcaggtggtgcttcgggcctcctccgaggaccgcaagccggtgggctcggggtctccgccgccggcagcgaccgcgactgcggttgcgcacaagatccagctcaagagtgccgacatgaaggaggagatgcggcaggaggccttcgaaattgctcgcatcgcattcgagaagcacagtatggagaaggacatcgcggagtacataaagaaggagttcgacaagaaccacggcccaacctggcactgcatcgtcggccgcaacttcggttcttacgtgacgcacgagacaaactactttgtatatttctacatcgactctaaagctgtcttgctattcaagtctgggtgattgtcgcagccaatacagtcaaccttgcatgcctacatcttctttctctcatgtatgctccatcccctcccctttcccctcagagtcgtctgcagccaagcctggaagccggtaatcttatgagcctgcatgttgatgtatcagcaacggattattcttcgcatgccatagtgtgagatcaggttgcatcttatttatgtctgatatatcttggtgttgtgagtacattatcttgttgcattatgattgccggacaactggaaaaaaaaaaaaaaaaacggcccgcggccc

SEQ ID NO: 15709 - DNA, 1022 bp, Zea mays
aacggttggctaaaatagcggtcggtacctcgtggccggccgggtgcccacggccaccagaccaccacgacgctctcagcttcaccttctcttcagtcttgtctgctagactgtcgacagattccgctccaacgcgcacctgcagtcccgcacgccctcgcccaccgtcgcctttcaaaaagctggaggattctcgagagggagaagcgcgcctggcagctccgttccatccgcccccacgaatgtccgacgaggccaggcgcgggcccgcgggcgccgcgcaggcgatgctccgggcctcctccgaggaccgcaagccggtgggcgctgggtccccggcggcggttgcgcacaagatccagctcaagagcgccgatatgaaggaggagatgcggcaggacgccttcgaaattgcccgcatcgcgttcgataagcacagcatggagaaggacatcgctgagtacataaagaaggagttcgacaagaaccacggcccaacctggcactgcatcgtcggccgcaacttcggttcatacgtgacgcacgagacaaactactttgtatatttctacatcgactctaaagctgtcttgctattcaagtctgggtgattgctcgcagccgacgcaatcaaccttgcacgcctacgttccattgctcccatgtatgcaccgcacccttccccccaggcccagggtcgtctgcagccaagctggaagccggtaatcttaatgagcctgcatgttgatgtatatcagcaacggattattcttcgtatgcccactagtgtgagatcagattgcatcttacttatgtctgatatatctaggttaggtgttgtgagtacattgtcttgttgcaatatgattgccggacaactggacgaactgcctctcgtctgtttgtgattatctcaatagaagcgtccttgctcatgcgtaatactccaaaacgcacagacataattaaagagcaatggaaccctgctttgacaatctctaaagtaatgcataaatatctag

SEQ ID NO: 15710 - DNA, 1811 bp, Zea mays
ttttttttttttttttgtctctagataaatcatattctagacacatgtgatttagtttcaagaccatatatttaagcatgtcgttcaaattccattaacatagacatccaccaaatacatcatacaatctctgctggtaggacagacaacaagtacatgcaataaggaatggaaatagtaaatgaggcatttatttttcctcccttctgcagcaggcaggcccttgcattggacattctccccgcaccacggtccgcgggcgtcacccctcacccctgtcacgtctggacaagtgtcttgcactgggaggtcgccggatcccacaatgccgggagcaggtacttcctcccgcctagcccgacgacgttgtagctcgcgccggtggccgggtctgtgagcagcttcccggggtagccggggtaggacccggtcccgaagatcccggcgcacaccgtggcagcctccagcccggcgccggtgccagcgtcgccctggtagtacccgtccccgtacgggttggtgaccgtgccggcgaggagggcggcgaggctgatgaccatgccgtcgacgccgacgtcgccgttgggtggcaccagcggcggggtctggggaccgtacgtcggcaggtggaacggccacgcgcattggccggggcactgctgcgccggattccccgcccacaggtaggtgtaccgcgccctgccgtgcgtgccgccgcggtcgtggccgtgggcgccgcagcgcgacacgcagaaggacgccacggggacgtcggcggccgtgagcactgcggtgatggcgccccggtggtgccccgcggcccgcgccagcgccgtgacgttgcccggagagagagggccccggcccagcgacatgcgctcgtcgatgatctgcctgccgagccgcagccgcgcgccgccgccgcggtagagccggatggtgcaccaccacgccgccacggacggcggtgcccccggcggctccgggcgaggcgcgctcgcgtccgagagggaacggacgaagtcgacgacgatcgcgcgttgcgctgcggtgaagcgcccgtagaagagcaggttgacggtgtggttccccgtgagcagcgcgccgcggtggtcccgcagcacgatcgggtcgggcttcaccgtgaacagcacgcgtgggttgaacgccgcgcaccgccgcgccgcctcgtcgcccaggagggcgacggtgagcacgaggcggatcagcagtgtcgtcatggacgcccgcatcttgcgcccgcccatggatttcacgagccaatcaagatcgggaacgaggtgtgttgatcaagctttaatctgcgagtcgttaattgtgaggtgtgtgagttcacgcacttgtggtcttgggctatctagctcgtggtggcagtgtgggtttatatagcgagctggagcctgtggacgtaaaggcgaccacatagggaggcgtgccgtgcgcgcgtgtggcctcggcgcccgtggagttaaggggtgcatgacgcgcgcgtgcatcagctccgcggttttggacgccgttcgcgcttggggtagtacgagtagtggaatggaaatggaatgtgcccgcatgtttgaacgtcgccggattgcgatgcgtagcgcatctgccagcattgttaataatatagccatcggcaggctaatatgattttaccacatcctatgcagttaactataataacccacgcacgaacgcatataacggtttgactaaaaacatattaactcgttatgttttaggatttttaaaaccactactcagttttaccccctctcggtttttttact

SEQ ID NO: 15711 - DNA, 712 bp, Zea mays
ccggccgggcgcctcgcgggccttcgccgcatcgcagcgcagcgcacacgcacggacggccccgagggtttagagcccaacttctctcttcacatcgccgcgaagccagctccccgatgcgatctggccgagggaagatggcgactccgccgccgccaatccgccccgccgccgcgctcctcctcctcgtcctcgctggcgtcctcgcctccgccgcgagcgccgatctcgtcatctccaaggcagatcggagggttgatctgacctcgcatatcgttcgcgtcctcgcttccctcaaggctgaaaatgttggaccagaccctgtctctcaagttttactgccttttcccaatattcaagccaagaacttggcagctattagagcattcggcagtgaagggaaagtgaagggtcaaagtactgttctgccaattgaagttgttcaaccttctggagctcccccggagctgacattcttttcagcattgttgcccaaacctttggaaaaaggaaagactctgtacttggatgttctgactgtgttcacacactctcttcaaccattcccagaagaaatcactcaagccgaagcacaacttggtgtctatcaggatagtgctcactatctgtcaccttaccctgttaaggctcagacacttgctatcagattgcctggcgggaggggtgaatcataccccaggcatccaaacgc

SEQ ID NO: 15712 - DNA, 3762 bp, Zea mays
  misc_feature (1157)..(1157): n is a, c, g, or t
  misc_feature (2376)..(2376): n is a, c, g, or t
  misc_feature (2883)..(2883): n is a, c, g, or t
agtaaccctagttagggttatgtggccaaataccgactttgcccctgaggggtcccacatctctatataaggaacttgtacacgccttcatatgacagagaggagaaagaggccagagccccaagcccccaaccctatatcatgtgtctcgtgtgttcctttgtcgtgcttctgggaagggagacgggtcttctacaacttctcgcgcctctacggctgacgggaggaatgaaacgaatctggtgatccagggtaacgtagttctcaacaatttgcacacgtcgtcctcccaccaacagctagcgtacatacggaggcacatgctgcatacactcgctatatgtctcactgtcccttgtgctgctgctgctgccgccgccaagagtcaaatgcaggccgtctcttccacaggatcggagggcccctgtacggcacctcgtacatgtgcagttccttgggcttgcgcgtctccagcagccaccccagacgcggcttctgctcctcatccccggcggcctcatctgtatcgtcgatatgacggcggtatggcaagtcctggtagtaggtgcagtcccggtcgccggagtagggcgggccgaggacgtcgaggaccgcgcacgccgtggcggcggcgaacctgtgcatgttgccgccggactccgggaacagcaccagggcgtcgcacggcgcgctcaggtcggcgtccagcaccagcttcgccagcctcagcagtgctgcggaaagcacacagcacaacgaaacgtccaaaccaaactgctcatcaggcgcgcgaagcgtgtggtgaactggtcatcaaagcacagagaagaatttgaactcacggcgatcgccgccgacggcgacgggacgttggtcggcctcggcccagtcgtaggacgtgacgcggagcgagccgaggagaagcttgctgaacaccgtcatccccgggtggttgtgcagagggatggtcgcgcctgggggcagcaggaacaccacgacctgcagccagatcgtacgtacatcacacgctagcaacttaacgcatgcgtttcacagctggatcgtcgtcgtatcgtatccccgtaccgagaagttcttgcatttataaatggtggttcgtgtgatgataggaacagggtgcgttcgagggccgccgnaagcggcggcggccttggtgacggctctcaggtgcacatcctctggtcccatcttgtctgcagtgcaaaggaaaggacatggttaattagcagactgaacaaggcagtctagctcttgcaatgcgatggctttaacgatgaggaaaaaggggcggcgtacgtaccgaggatgtctctgatgaggacgacgtcgtggtgcgccggcacggtcccggggcctccgaacgcgcggcggcacgcggcaagcagacgctggagtggcgccggcgccggctctggcgcggtcgccgcgcccccctgcacgcgccgccgtacgctcacgccgccgctctggcgcctgccaggcgcgccactccgcctcctcttgaaccgcggccgggccggcgccgctcccttccacggtcaccttcatcaacgcgtacgtacacggccccagcaaccagcagctagcagcaggaacaggaacaggaacggatcaagatctgcctttccagcaagtccggtcttgcggtggggttaaatacttaaatccacggccgagtctcctttccgacctcggcggggcctggcgccgaggaaagcatgcaagaaccgcggcgcggctgggaatgagcaggagcatgcgaggggagcagagccagcacgttagaataaaggcagcgccagtgggtggtgtggtgaaaaaaccgcgggcgatggatatgatgggggcggggcgcggctggaggtccacgacgacgcggcgcggcgataccaccggtggattttcacggaaccgtggtccctggcctcgtgttcaaggacgacgaacggctgaaggacggtctggttggtcgctcacgctctgcccgcccgtgcggccgcccgcgttttcgcggggaaaccgctcaactcaagctgcctggcggagactggatcgacggccaggatacgctcagctggtgcgatgtggagactgtatagggggagtgagtgaccacggaccagacgagcggcgaagcaaaccaaggactcggttgcctgtccgggccgcttgccacttgccatgtgatgtgaatcgttcctagctttgttttttttctaacacagagacaggagctctggcaattaaacaataaaatagaaaatcatttatttacgatggaaattagttctaaaaactttgcagtcacataatcaaattaaaaaaaacgatgaaaaaaattaaacatgacaacanataggcgtcttcaatggttctagctgattgctcgagcctccatgacattcattatacaatataaaagctagcatttcaactaatctacaagagcaagtattgtaagagatgtgatagaagatttatggtgatgtggaagaaagagaaatatagagagaagtaaatcatattgctcacggactttaagatactttgtgagagaaataagtggacctaatattaagtgtatagcgtgtatcataaaagagttattatatgactaaacttttagttgactcaagatgatatgaccacttttaaagtcagcatccggctgtattactatccatgctttaaggacaatgttttgtgttacttgtacactggaaatgtaatgatacattgtgcatcatatttgtgctccttttatgtggatgttgtacactcatgtactactatataaggcgtccataggaccgtgcggactgtacgactacacgacccccaatatatatgtatagagaatgnaagacattagtttacataaatataagttaaaacatggtttagatcgtaaacaaatcagaacttctactaagtcatattcctgaccatttgtatatcaaatatgaaccggcggtcgtgacgatgagttttatggcaacaatggcatgatcatgctcgcagtcacaacgttgatgcaatcaagttaatgatatggcaagcacaatgctgatacaagaaaatagcactcaaatcatcttcattcctgctaggtggaagtaccaaatggccaatgtaaccagaatacataggttttagaacatccatagcagttttgttagatgagccattatcaagcacaataacaaagatcatatcagtaatgccataatcatttgcaacaattccaacacgctcaacaatattatgacatgtatgagcaacctttataggtcttaaaccaagcaacctctttttttctaaacaccaatcagagttcacaaaatgagcaacgacattaaggtagtcctctttagccttaccagatcaaatatcagttgtaagagcaatagatgaaacaaatttaggacatcaataagttgttcgacatgatcattaaaaagtcagatcaagtctctagtagtagtttgcctagaggatttaacaaacatatgattatgagcaagggtaatatattcttgaaaagcaacatattcaccaaagcaaagaggcaagtctagtctagcaatcaaatggcaaagctctgtttctagtaacagaaagagagtactcatagtgcacaatagaaccaccagcattaaaattaaacattagattgagttctgtctgatctaggtgatgggtcaagtgtccagttctagaagaagatttagtagacatgta

SEQ ID NO: 15713 - DNA, 1387 bp, Zea mays
caaagtgaaaacggagttcttcggagtcctatatttgtaaataactgtactattgcaaagagcgaacggggcgacctccaggaaaatcgcagagaatgagggggatcctcttcgggccccggcggcagccgccgccgctcccgctcttccccgccgccaagcgctcctcggcacccgcgaaccttcttttcgctcgcctctatcgcttcctcccggccagccccatcctccggctccttctcctcctcgcactcctctccctcatcccgccggccttcttccacctccgtctccgccgcttccaccaaatgcgcgagaggaagtgcgggtggatcgcgaggccacccatggtgtgcgcgcacggcggtgactccaccaacgccttccccaattcgatggacgcatttcggatggctctcgacgcgcgggtcgactgtgtggaggtggatgtttcgaggtcctatgacggtgtgctctttgctctgcatgacagggatctacaaaagatgtctggtaattctacagcaaaagttggccactggaccacagatgagataaaagcactaaggacgaggtttcagttgtcaaaaagagtccaaaatgaggaagttcccatggcagaggaagctctggcgatgatatcacaatcatttaggcaggtcgttcttgatgtgaaagttggacccccttcatttgagaaaggtttagctgaggatattttgtctcttctcaggagaacaaattgcaagaattgtcttgtctgggcaaaaagtgatgatataggaagagagataattaaattgtctaaagatgttattgttggctatgttgtcatggtggataaatttaccaatagaagaacggagttagtgaggattgaaggggctaaagttgctggcatatatcatcctttgatccatgagaaggttatgaaggtcatgcgcaggcatgacaggagagtttttgcatggactgttgatgatagcagctccatgaagaagatgctgtatgagcatgttgatgccattgtgaccagtaacccttctcttctgcagcagcttatgcaggagaccagagctgagtgtatggaagatggttttgccttaccataggaatttctagctgtcagaacataagggtttaacttctcagcagagaggaccaactagcgagttgagtttgagggattattcataaattagatgataattactttagtttttggcacattccgcacttctgtcatataattgaaataagaaaatatggttagcttgtcatgaaatatgttgtttccttttacagcttgatcagatcaggtcactgagaagatcgcaacaataatatcattgattaacagaatcatgctttaaaaaaaaaaaaaaaa

SEQ ID NO: 15714 - DNA, 2259 bp, Zea mays
tttcattttctcggaatttccgtggatccatcatttggatttgagtccactattggtttttcatcaaacgcaaattttttgtccgccgatttttgaaaccacagcgcaatgccttcgacagtatttgttatataagagcggaaacaaatctaaacaggtgatttttattcgacctgaacagtgtgaagaagaacccttcgtgggccgctgcctccttttaaccagtggagagcgcgtcgtatacgggagaccgtccgtgcctggctggccgcccgctcatcttggtggtccgaccggcctgactctcttctccttcctgcgcgctgggtccatattgtcggtgtccgaggccggcccgggctcggttcggccacgccccaccagccagccagccagggacccgtcgctgccctctggcgatgagggatattacgggtctgccctgaccaccgcccacgcgcagccaggggtagaaacgaccgcgtcaccgtatttgacccctcaccgtcccacaccagtgtcggcgagtccctcctgtgcctcgtcctccccctttcccctccgagtccagcccggcgccacccactcagccgcggatccgaggcgcagatccgatccggcgatggcgtccacggcggcgaggcggctgcgggagctgcaggcgcagacggggaacaagacctgcgtggactgcgcgcagcggaacccgcagtgggcgagcgtctcctatggggtgttcatgtgcctcgagtgctcgggcaagcaccggggcctcggcgtgcacatcagcttcgtgcgctcggtcaccatggactcctggaccgaggcgcagctccgcaagatggaggccggtggcaacgaccgactcaacgccttcctcacagctcgcggcgttcctaaggagacgccccacgtcgccaagtacaactccaacgccgcagccgcctaccgcgaccgcatcgccgcgctcgctgagggaaagccgtggactgacccgcccgtggtcaaggagacgcccggatctggcgcccccgcccccgctaggaagccgcccgtgcacacatctgccgcctccggcggcggcgggtgggacgactgggacgacgattttcggccggacatgaggcggaatcagtcggttggatcgttcgccgccgcgggtgcgcagtcagggaggcagccgccgaggtccaaatcaacacaggacatgtacacgaggcagcaactggaggcgtcggcggctaataaggaggactttttcgccaggaggatggcggagaacgagtccaagcctgacgggatcccgccatcccagggcggcaagtacgttgggttcggatccagcccaccgccgtcggctaacaggaacggcggtgctgcccagggcgatgtcatgcaggttgtctctcagggatttggacgcctttcattagttgcagcatctgctgcccagtctgctgccagtgctgtccaagttggcacaaaagaaatccaatcaaagatgagggatgggggctatgaccagaaggtgaatgaaactgtcagtgttgttgccaataaaactgcagagattggaagcaggacttgggggatcatgagaggagttatggcgctggcctcacaaaaggtagaggaatatgccaaggaaggaggagtgggtggctggggagaggattggcaacacagcgagcagaaaagtgagccttaccaaaggtttgagcatgagaccaacggcaacagttggaattcctcccaaaattcttcatcgaagaacaattccagttcttgggacgactgggacgacccaggcaagaaagatgagcctgcgaaaccgcaccagagcagtgactcctgggctggctgggatgatgggaaggatgatggttttgatagccctagttacaacaatcacagcacctccaacaaggggagcaaccaaaacgggacatccggtggcacattttggacagaaggcggcttccgctgaaaccagtctcttttccatagagctatactttcagagttgttacatgccaggaaacgtgagggtccagtggttggtattatttgggatacttaaacagtcgggtgaaagggtttgtgtgttttgtaccatgtctacaactgttattatatctagtgagatatatttctgtggtcagatgccattcaacactgcccaaatgactaagaaatgtcgatttgaaactgtaatttactcgactttgtcgcaaaaaatccgcccaccccgccggaggg

SEQ ID NO: 15715 - DNA, 2632 bp, Zea mays
tgcagatccctagtgcatcacattagttcttgcatctatgtactaattgaatgaattgtgttggtatactcttttactctggtcgttgtcacctagtcgaccgagaggttcgtagggttattaagtggcttggtgattgttgttggcttccatcatcggagattcacaaaactaactttagtatagttttgttttgttttataaggtgtttggtttctttagtcactctcttaagctttagagactaaattttagtctataaaaaacctatttgaaagacttataataatcaccccgtttttagagactaatgtttaaaaatttggaactaaacaccccttagttggagtgtctctctagtttagttgttctaatgctcaattattcaacttatgtatcttacgatgctcaactattgaacttgatgtatgatgtcaattgatatattaaccacttttttttaactcactacaacaaagatatatgttgttggcgattaatcgaatagagatagactagtcatatgtccgtgtatttctacgattttatataatataggataaattttattttaaaaaacataaaatatatgatttttatttattaggtaggtgtgaatgtggagtcaacaaccaacgttcaaacactcacttatacataatttcatcttattttttatataaacttttatattataatattatagaagagattatatgagttcgggttgatttaaaaaaaatgtagggatttttttaaaaaaaatttgacgtggtataccgttaaaattagtgctttaatatagaaaagattattgtatttatttaattgttttaaaaaatatttatataagagggatataccctagtgtcggtgtcggcgttggcgagtggcgactggcgacttctctgcctcgtcctccccgttttcccctccgcgtccagcccggcgcgacgccaccacgcacctagccgcggatccgaggcgcagatccaatccagcgatggcgtccacggcggcgaggcggttgcgggagctgcaggcccagacggggaacaagacctgcgtggactgcgcgcagcggaacccgcagtgggcgagcgtctcctacggcgtgttcatgtgcctcgagtgctccggcaagcaccggggcctcggcgtgcacatcagtttcgtgcgctcggtcaccatggactcctggaccgaggcgcagctccgcaagatggaggccggcggcaacgaccgcctcaacgccttcctcacagcgcggggcgttcccaaggagacgtcccacgtcgcgaagtacaactccaacgccgcggccgcctaccgcgaccgcatcgccgcgctcgctgagggcaagccttggaccgacccgcccgtagtcaaggagacgcccggatctggcgcgcccgccccggctaggaagccacccttgcacgcctccggaggcggcggcgggtgggacgactgggacgatgattttcggtcggacatgaggcggaatcagtcggttggatcattcgccgccgcgggggcgcagtcagggaggcagccgccgaggtccaaatcaacacaggacatctacactaggcagcagctggaggcgtcggcggctaataaggatgatttcttcgccaggaggatggcggagaacgagtccaagcctgagggtatcccgccatcccagggcggcaagtacgttgggttcggatccagcccagcgccatcggctaataggaacggcggtgctgctcagggcgatgtcttgcaggtcgtctctcagggatttggacgcctttcattagttgcagcctctgctgcccagtctgctgccagtgttgtccaagtcggcacaaaagaaatccaatcaaagatgagggatgggggctatgaccagaaggtgaatgaaactgtcagtgttgttgccaataaaactgcagagattggaagcaagacctgggggatcatgagaggagttatggcaatggcctcacaaaaggtcgaggaatatgccaaggaaggaggaatgagtggctggggagaggattggcaacgcagcgagcagaacggtgagccttaccaaaggtttgagcacgcgaccaacagcaacagttggaattcctcccaaaattcttcatcgaagaacaacaattccagttcttgggacgattgggacgaccaaggcaagaagggtgaacctgcgaaaccgcaccaaagcagtgactcctgggctggctgggatgatgggaaggacgatggttttgatagtcctggttacaacaaccacaacagctctaacaaggggagcaaccacaacgggacttccggtggctcattttggagggaaggcggcttccgctgaaaccgttctcttctccatagagttatactttcagagttgttacattggcaggtaaccagggtccagtggttggtattatccgggatactgaaaccgtcgagtgaaaggggttgtgttttgtaccacatctgttattatatctactgagatatattcctatggtcaatgcccattcaaaagtgcccaaattgactaggaaatgtcgagttgaaactgtaatttacccaactttgtcgcctattctttaaaaaaaaccgttggttttgt

SEQ ID NO: 15716 - DNA, 732 bp, Zea mays
  misc_feature (1)..(1): n is a, c, g, or t
ncctagaacatcctaatcgaaaacaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccccgcaggaacgcgccgaggtctctctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaatatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagccaaaaaaaaaaaaaaaaaatccgcccctaattttgaattactatacaataaagtc

SEQ ID NO: 15717 - DNA, 2784 bp, Zea mays
ttttttttttttttttttttctttgttgctgcgttgatttttttcactcacaagttcgtatataagataagccaacacaaatacaaactcagaaaatcattttttatagacaagcacagcctaccaaccgaactcacccaagttaaaatttctaggtcaaagaagtttgacgcaaagcacaaggatagatcccatatgatccggagccctacttagcctcatgtactggatctaccacctaaaaatatcaacaggtggtagcagcagcagcagcataagagaatccccgaccatggacgccgaccagggctgtcagaatcagcagctcaaacgggccaccgaccaaaagaatgaaagaatcatcgcatcacaaggtccagaagagcaacctcctcctgcaaacccaccgtcgtaacgggtcgtcgtcagctgtgtccatcgcagaagagctgcgcttacgggctgccgacccgtcgtccaccaccatctgtttctctcctctttgatcaagaaagagtacaaaatcaggctctctctcgcaatgcgtcatctgacgttgcagcaccgggcactcccggactgcagcttccgccacaggcagatcatgtgctgcggggactggtagtgcgccgtgaagtagccgttgtagcagcccgactggtagaaccgcacgtcgtgccggatctccaccgcccgccgcgtcctgttgaacttctccacccacatgcccatgctcacatcctccatcttaaacagccgaagcgtctggttgtcgaattcggacacgatgtagcgagcaatatcggatgaaattacgtagccaggtccattagcataattcggatacagtgcttcaggccattcctcgtacgttactgcccacttgccagatcttagtggtcgatggaagtagtttatactccctacgtaaacgcttttatcgtttccaacattcttcacttgatccagtaccgaatcgatcctcacgaatgtgtcgtcgtcgcatttcattacgtactttgcagggacgacgcgcaccccatactcggcaatggcaacggtcttcaacacaacgaggtcatagctatcgataaaaggcactatgacaatgtcctggaagaactctgcctccttcttgagctctgcgttaacctccttctttccattcagtaattaccagagccacaaagaaccgagctacaacattggatgatttccttgtatacatcatccacgatttccttacagccatacgctcagcaaaatggctggctgcagaaagaatgccgatgaaaagctcaacaggttcagtgggcagaggtggagctctccactgttcagacatctcaaggtatcgctcgggagcgaagcttggatgcgaattgggtagagaactagcaaaaatcgactcaatatcgatgtctccattcagggataatgcagttgcatcctcaagagagtaaccctgaagagagagagagagagagaataactggcaacaattagcaatacatacctcaggactacacaccaagatttatgaggctctaactgacaacttacagtgcggtaaggaaacgaagcaacatgccgcccatcaacattaacatggtaaccttccaaaccagctgttaaagtcataacaaatagcttgccttccgtgaatgggtatggccaaatgatgcggacatccttaggcctgccaatcaaacgcttgacccaccatttcatctttgattcctctgacttgctgtcatcgtcacggatccatttctcacacttgagttgcccctctgctgaaacagcaaagtgagacatgtcacatgaatcatgtgccaatgttgcaaagcaaagtcagggttgtattcttgaagtaaaagaaatcctggttttagcagcattgaatcatccgtaacttataagtagctggaactcattggacacatgaactcctaaaaacacaacacatgttgtggcagtagaaattgtttatgttccaataagaggaaaaaaaaacaaagacaagaagggtcaggttcccacgtcagttgcctcgtcaaaactgaacagctctgaacgcggttgcaggtcaatatgtgccttgtaagattccattcgattttaaaaatgggacgcgtcggcatcagacccctcgctcacatttctccgcaaacaggaaagaaaaaacaaatctggaaatgaattctaaccgtttctagaaatttcctgcgccaagtttgtaccttctatgcccaattccaccaagctaagctattccacaccctgaagttgactggcttcaatttccgtaactaacaagtcacccattaatagtcgtactcgtaccgacctcgatctttgtagttaattgaaaactaaaccagaaaaacggcagctagaacataggacgattaatcgaagaatcaaagtaataatcaaaatagcaaatcaaaatgaaccccgacaaatccggaggtcgctggagaggttgacgacaactcaccggtgtcctcgacggggcgggaggcgaagccctcgcagcgctgcgactgtccccactgcatccggtagcagctgttcatctcgacgacgggcttccggctgtagtccccgcggatcctggggttcaagtgcaggatcctgggcggcgcctccccgtcgacggccttggtgccgaccagctcgaccatgaactgcgacaccatgaccgcggcctccccgtccttgcgctcggcgatcttggggtcgtactcgggccgggcgggccggggccgggccaccacg

SEQ ID NO: 15718 - DNA, 1468 bp, Zea mays
ttttttttttttttttttttttttttttttttttttttttttaatcagaaggaacacaatctttagctaggtaagcacaaccgtcacagtttacactggaatcagttgaccagatgatgcaatatacatatttttcactcttcagtatgaagcaagctcgaatcaaaacttacagagcacacttccaagtaggccatgtgattttacacagttaacacttaacagaccacaccacatgatttgaacgtgtccagaacaccgatacaaccatagtatgcaaccgccatttttttcctgagaagcagaaatcgacatacgtacacacacataacatctaccatccagaaaaatctttgaactctacactagatgcagtcgcttttctcttcttgctcgaatcatcagctacaccagcacttccagtcacatcaatagaaccagcagcccgagcttttaaatacttgccaaccccaccaccagtacttgttgaaccagcaacaccagttcctgggttgctataccatgatcccaccttatcataatcctcatcctttttcttttcctcctttgccttttcttcttcctcatctggctctgtgtaaggattcacgaatatgctgacttttagaatctttatttcctccattggccggtcatcatcatcgacaggaaccctttccatcgttgaaagtgtggtcaaaccacccaccaccatgccaaataccgtgtgcttgtaatttaagtgtggtgcagacttgtacaagataaaaaattgggatccgttggtatgagggcctgaatttgccatgctgactacacctcttccagaatgtagcagctttgagtttggctcgtccttgaacggtttaccccatatggactctcctccacttcctgtgccagttggatcgccgccttggatcatgaagtttttgatgctccgatggaagataagaccattgtagtaaccattttcacaatgtgtgaggaaattttcacaagttcgaggagttatatcacaatgaagctctaaattcaaatcaccatgcgttgtatgcagctgaacgtaacctttcttttttggattcccttcttcttgatcgcgctcatattcatttttggtaacaggatcataagaagtcgatgtgaaagaacgcgacgctgctccagtagtgtaacgacttttgaccagtttagcatttacaggagctcgttcccctgccatatgcagagcgattctagcagcggttttttcagcagaagttgcttttgctgctgctgcactcctgccatgaacagaagcagaagcagcatctacaatactgaaactttggttaggtttaggctcttttcctgcttttgagtcatccgtctccttccttgctaaaattgcagcaagagccgcagctctttccttttgagctttcagccctccacctccccccgcgtacctcggccgcgaccacgc

SEQ ID NO: 15719 - DNA, 569 bp, Zea mays
ggccgcttttttttttttttttttgtttccaagcgcataacattatactattgccagaggcagagggggctttaatctaccacaaaagaacaacattttccatccgactccatccctataatcggtgttttttaaaattatatcgtacgaccacggggcttttattacatgatttgtttatttcgagatgactgttcgtgagaatcagtcgcagaagtggcagtgacagatgcctctcctggagccttcgcaccagctgttcttgtacttggtatggtactgcttggcgtcgatcaggcagccgaacttgcacgcccagtccacgcaccaggtcgccacccggtcagtggtgtaaaagcacttctggtcgtctgcagaggaggaagaaggattctgcgccagaagaagcagcaggaagatgcagacactcgccggttttgcgtccattgtcagtctctctttgcagggtagggatctctctctctctctctctctgtattttttttgcaattgcaactgagagatgacagtcctgagtacttttggtgtccggccggcccagggtcccc

SEQ ID NO: 15720 - DNA, 1805 bp, Zea mays
gcacgagaccattacctagaacatcctaatcgaaaacataaatagcaagggccttggattgtttggccagggatagcacgccgaggaaggtcgacatgtcgtctccgccgccgccggtgaagctgatcggcttcttcggcagcccgtacgcgttccgcgcggaggcggcgctgtgcctgaaaggcgtgccgtacgagctgatcctggaggacctgttcggcagcaagagcgagctcctgctccaccacaaccccgtgcacaagaaggtgcccgtgctcctccacggcgacggcagggccatctccgagtccctcgtcatcgccgagtacgtcgacgaggccttcgacgggccgccgctgctccccgccgacccctacgcgcgcgccgccgcccgcttctgggccgacttcatcgagaccaggctcaccaagcccttcttcatggcgatctgggtggaggagcgcgacgcgcgcctgcggcattgggtacctcgaggccggccgggagcgcacctcatctcgctccaagcacaccaccactccacagtgcacttcactctacagcaacgacagaaaagtgagcagcagacagcagcagctgctgccatggaggcgtggagatctctcctcgcgagcttcgtgctcgccgtgctggccgcgcaggccttggtggccgtggtcgagtccaggaccggccccgtggagcaggcgagccaaggtgacgacgtgaagaagccggactgcgtgccggggatggacccgcgctcgttcccagggaccggcggcggccacggcatcacgcccgtgacgccatcgcacggaggctccagctccccgacgccgtcccacggcggcggcggcgggtacgttccaacgccgtcgcatggcgggacgctgcctttcccgtcccacggcggctccggctccggctcctctccgacgtcgccctccaccggtggcggctcgtacggtggatccccgtctactcccggaggcggcgcgtacggtgggtctcctccgtccacccccagcggcggcggcgcgtacggtgggtctccgtctacccccagcggtggcggcgcctacggaggcgggtccccctcgcctgctcatggtgctggtggcgcctatgggagctctccgacgcccgcgtacggcgattcccccttgcacggcggcatcgggacctcgtcaccgacgacatttgtccccatggacccccacagcttcggcacctgcgactactggaggtcgcacccgatggagatctggtcggcggtcggcggccggttcccgagcacgtcatcgtcgatgggccacttcttcggcgcggcggcgggcagcgtgggcggggctgacgtgatgagcatccaggacgcggtgggcaacacgcgggcggacggcacgggcgcgctgctgcgcgagggcgccgccgcgctgctcaactccatgacccgcgccgggttcccctacaccacggagcaggtccgcgacgctttcgcggcggcggcggcggccgggtccgacggcgcggccgcggcgcaggcggcggccttccggaaggccaacgagggcaaggcgtagctgcctgtgctgtgctatatgcatgcatggttaattagttggagtgctccggtcgcttaatctgttggatttggtggtttgttggttgtgtgcgcgtgtgtttcagtgatttgctcctttttttttctttctcgtggatctatcgatggatgaacatgaatgaatgaaccgaactgcacagctccgttgtgagctgatgcatgcatgcatgcacatgcacta

SEQ ID NO: 15721 - DNA, 856 bp, Zea mays
  misc_feature (24)..(24): n is a, c, g, or t
ttgggtacctcgaggccggccggnaaaaaaaatacaaaaaaaaaaaaaaaaaaaaaaaaaaaaaaaaaaaaaaaaaaaagagcgcacctcatctcgctccaaacacaccaccactccacagtgcacttcactctacagcaacgacagaaaagtgagcagcagacagcagcagctgctgccatggaggcgtggagatctctcctcgcgagcttcgtgctcgccgtgctggccgcgcaggccttggtggccgtggtcgagtccaggaccggccccgtggagcaggcgagccaaggtgacgacgtgaagaagccggactgcgtgccggggatagacccgcgctcgttcccgggcaccggcggcggccacggcatcacgcccgtgacgccatcgcacggaggctccagctccccgacgccgtcccacggcggcggcggcgggtacgttccaacgccgtcgcatggcgggacgctgcctttcccgtcccacggcggctccggctccggctcctctccgacgtcgccctccaccggtggcggctcgcacggtgggtctccgtccacccccggcggcggcgcgtacggtgggtctcctccgtccacccccagcggccggcggcgcgtacggtgggtctccgtctacccccagcggtggcggcgcctacggaggcgggcccccctcgcctgctcatggtgctggtggcgcctacgggagctctccgacgcccgcgtacggcgattccccccttgcacgggggcatcgggacctcgtcaccagacaaattttgtccccttggaccccccacagtttcggcccctgcgactactgaaggcccccacccgatggaaatctggtcggc

SEQ ID NO: 15722 - DNA, 821 bp, Zea mays
gccggccgggcctgccacaggccaacaaaggagcaaagctaccgtcgccgaagccgagcgacgttccaagaaacgaaacagccatgatgatgatgggagagggagcgcacgcgccgccttggcagcagtcaccggcggccagcggcatcatggacgcggacgaggtgtcgccgtacgccctcctggcggagctgaagcattacctgccgtcaaacgaggtgatggcgtacgacgaggacgacgaggaggccctggcggcggcggccgccgtcgacgcgtacgcatgcgacgagttccggatgtacgagttcaaggtgcggcggtgctcgcgcgggcggagccacgactggacggactgcccctacgcgcacccgggggagaaggcccggcggcgcgaccccaggcggtaccactactccggcgcggcgtgcccggacttccgcaagggcgggtgcaagcgcggcgacgcgtgcgagctggcgcacggggtgttcgagtgctggctccacccgtcgcgctaccggacgcagccctgcaaggacggcaccgggtgccgccgccgcgtctgcttcttcgcgcacacgcccgaccagctccgcgtgccgcaggcgcagcagtccagcccgaggggcgcgtccgcggcgtcgccgctggccgagccgtcgtacgacggctcgccgctccgccgccaggcgttcgagagctacggctacctcaccaagagcggcgtcatgtcgtcgtccccgaccagcacgctggtctcgcccccgaggtcgccgccgtcggagtccccgccaatgtcgccggacgccgacgacgcg

SEQ ID NO: 15723 - DNA, 4700 bp, Zea mays
agcaccataccctgcactaggcccacggtcatagaccgaaaagcgaagccatggtgccgcttagggcctagcctgcgtgtcttcagaagcgtgctacgattttttcacttcacacaggtccctccatttttctttttaacttgacacggtcttggaagtatattgcgtggtgcgtgctataattcctcttatactatactatataagccatgtaacactagatttgttattaaagtacttcaaggtaatcatactttgctacctgcatagaggagtaaaatgtgtgcccgtgtatttggaggtacgtaaatgcgtatgtttattatatgtgactgttactgtctacaccatgatttcttcaaaaatattatgttcgaaactacaaataaacacagctattatataaatacggagggaagagtgcagtcttcatatctgacgtgtgatgtttaaatcgttttcgtgaattaaaatactacaacaatacatgcagtactcctttataggactgtttggttttcatgggattgttagaatctaagataaaaatatctcataataaaccaaacatggatgacaacagatcgaattctattgaatattgtaaatatcaacgcgcaactatatacatggttgtaatcaatatctgtccacaaccacactcacatgtagaaatttatatatttatactcgtacccatcaggttacagacgggttttagatatcaagtcaaatacgatagacacaatcattttgaacaaggctagaagggccagaggtactggagcttgggttggccagatgccaacggtgctcgacctataggacttgataggcgcatcgagtacagcgtaggaagcgagcaaggctagaatgaccgtcaactatagaaattaggagcgttagggtggggtttatgaagttaaggtttacactttactgtgtaaaatgggttaggcacaaaaaaatctatggatcaatttggaatatccaacggcaggtggaaggtaatatcgtaatccatatccatatgaggttgattcacaggtatatccatactcggctcccgcatgtgagatatcggaagtatatctgaatccgtggatcaaattgacatccttagaaccaaacacattggatattatgtgtaaggtagtgtccttgtatataaaatctgtgagataatatattggatcatgtgcaaaatcagatatttgcatcgttgggtagtgggaatgtgggggtgcacatagcaatttggtcttcggtctctagtagactagtactacagtacgtcttgcgaatccgcaggcagcgcagcccgccagaagccacaacgtgtcctgacccggtagcggccgcggaccacctcagtcctcagtccacctccgccaagcgcttgccgcgcgcagccgctcgttacactccacgtgtctcgcttgttcgtcgccaccccgaacctacacgtataggtggcctcatgtgtcagtgacgctcctcgcatgaactgcctaccctaggataaggccaccagagccagacggcgtcagttggccgctccctccggacacgtacacctccttcccgccagttaattcaaccacggttagatagaacagcccccagagtaaccacagttagatcacctgggggtaaacccaggggctccgtgccccgccgtccacgcccacgcctccacggccaagcgcctcgaaggcaaagcttccactagccacaggccaacgaaatcgcaaagcgaagctacggccaccgaccgacgttccaagaagcgaaacgaaacgaaaatgatgatgatgatgggagagagagcgcacgcgcctccgtggcagcgctcgccggcggccagcggcgtcacggacgcggacgacgcgtctccgtacgccctcctagcggcgctgcagcattacctgccgtcgaacgaggtggcggcgtacgacgaagacgacgaggaggcggccctggcggcggcgaccgccgccgtcgacgcgtacgcctgcgacgagttccggatgtacgagttcaaggtgcggcggtgctcgcgcgggcggaaccacgactggacggcctgcccctacgcgcacccgggggagaaggcccggcggcgcgaccccaggcggtaccactactccggcgccgcgtgcccggacttccgcaagggcgggtgcaagcgcggcgacgcgtgcgagctcgcgcacggggtgttcgagtgctggctccacccgtcgcgctaccggacgcagccctgcaaggacggcaccggctgccgccgccgcgtctgcttcttcgcgcacacgccggaccagctccgcgtgccgccgccgcggcagtccagccctaggggcgcggcggcggcggcgtcgccgctggccgagtcgtacgacggctcgccgctccgccgccaggcgttcgagagctacctcaccaagagcggcatcgtgtcgtcgccgccgccgaccagcacgctcgtctcgccgccgaggtcgccgccgtcggagtccccgccaatgtcgccagacgccgccgccgcgctccgccgcggctcgtggccgggcgtagggtcgcccgtcaacgaggtcctcgcgtcgatgcgccagctgcggctcggcggcggctcgccgaggtcggcgccttccggcgggtcgttcttgggcggaggctacccgttcgggtccccaaagtcaccggccgggctgtacagcctcccgtccacgccaaccaggccgtccccggtgaccgtgaccaccgcctccggcgccaccgtcctcaccgtggaacgcctcaacctcggactcatcggggacgaggagccggtgatggagagggtcgagtccgggagagccctccgcgagaaggtgttcgagcggctcagcaaagaagccgccgttcccagcgacaccgccgcatccgccaacgttgagggagcggcccccgccccggatgttggatgggtctccgacctcatcaactgagggaactcgtggaactaccagctcagaagttcaggggggaataacaaaaaaaaagtaggaagatttttaattttttagttctttacaaatattttcctggtccttgtacagatgttcctgctttgtgaatagtcttggatggttgtcgaagggaggggaggcagggaatggttgatttgttatgaggtttcagatgatggcatgtcggtgaaggagacaaggtgcccagcaaaccatggtggaaaatggatcaagaagacatgtgcaggcgaccatgtatacgggttgtctagatgcacatggtgtcttccctgcctgtgaggtgggagcatgggaggcgatcatggcggcgatccaagaccgaacccataatttccgcgagcgattccagaacgaacggcgtcttgagttgatgttcattctgctatttgccttttaagattcgacgagttattactgctctgtgatttttctcaaagtatttccatattgatctatgcatgcatgtacaatgtcagtactgctactttcgctgatactccgtaacaaaattaattaaaaccggcgttgctaattactgtaccatctaaaaacatagcgatgctgatgccattgtcatgtgacggatgaatcaaatgtgctggatctgtgaatctggataaccataaaccacgccgagcccggctcatcgatcttgaggaactaattgtgctatcctcgtgcttgaccggtggatgaatgttacatgacgaggatgggcagcgaggtggactgcttccttcggtcgtttttggctcttgttttcggatcgtgttttttcccagcactagttgtcggcgaatcgctgtccaaagcagaggcccggggctgttggcgccttcggccgaggcgacgtcaatcgattacctgcctgtgttacgcgtgccattgggtcgtcccggactgggtgagtgcacaaatcatggatccaattgaattcaacaacaaaaaaatggctagctgcatagtatgtaccctcgtctctgttcttggcggaccacagagcttctgaaactgaaagcaccccgaccggcgcgagcaagatgtttggctttggcaattcaacatgtttagcttcgttccccacctgattgccctttgcccgctttgtcttgcctaccggggtttttttttttggatatttgtagtgtagtgtcctgtgaaattttagtttgatttgctcataattatcttatcctctgcatgatatatttataactactactatattgtgcgcgtgtatataatctgccaaaacatgcggtgccacgaattatctagtttcttcacatcttagtttccaatttgggttttaaacatacatgctgctcatgttgatgacgattatgcttagctcatgcatgaccataacttgatggtgcctctcgcggacacataggacgtgattggttggtacgttcaaccgcgcctggctcacgccggcctggtcagctagcgaacctccccgtctccacttccccacgcatgtaggtgaaactgtgaaaaagcacctactatgcaacacgtgtgcatgcccactttcactcgtgcaggcaacaaatcagtcgctcatgcgcagccaacacacgtagctagcctgggcgcggaggacatggcaaccaatcacgtccatactaaagtcgtgagagatccaagccaaggggcccaaaa

SEQ ID NO: 15724 - DNA, 3837 bp, Zea mays
cacgggtcttcagcccttgctgtagctatatagtgtttttactctgtgtcggggatccggtgagcccttgcggaggtctgagacccacccgtaggggtccagacctatgattgaaattgtcaagcaattcaaccgacgagacatctggagacactgacctagcggctggtggccccatcggactaattaactagccagtcgatcggacggtgaaaccagtccagcggagcatagaatggatccgattaacccgcttattgggtccatgcacgtcaatcatacctaatgttttttttatgttagtgggttacttgtttttctattattataaaactttagacatttttcttggcagcattattttgcaattatgttctcttagtgatttgtctatgagtcagtaataatgatataaatcaatgaagttatagacattttgcatttaaatgaaagtattaatactttttattaacagtggtaattcatttgatatcaaatattattattttgatagttatgtgtgcaatgcatactgtgtaatgtgatatatttattaagaccagtaatatttttgagtgttatttgatttgattatcaaaagtctatacgttttgacatcatttttagcaattttgtcggaacagtaagttttcaatcaatcagtaataatgatataaatcaatgaagtcgcagacagtttacatttaatgaatgttatatgtatttttattaacagcggtaaattatactaaaactagatatgatttttttacagtaattttgcaacgcatatcaaaccatcagaccagaccacctgcaccttgttcagacttcagatatcaaatccaaagttggagctaaatcagaaacagagcttacgccactaatcccagttatccttgtttaaaatgaatataacacccatgtcaattagaaatttaaccagaaaatttccgacagtaatgaacgcagcgcaaagttgcattgttacaattagggcagcaaacatttcgcttttcagaggtaaaggaaaatcatgagccctgaaataagcatacagctctacttctgattataacaggaatatcttagaaaggaaaacaataatattcaggaatcctataattctatgtacacacatggaagctactgcaagcaacaacaatcaccgtaacacataacagatgaccttcaagttgaagagaagcatcagaggtttctcttctttggctaagcaatccataatgaatattccacctaagggcttcttcggtttgtaagggattgaaggggatcggagcagattaaatctctttctagtcaaaattaaacaagaatggatttaattcccctcaatcccattcgatccttgtgcaaccaaacaaggcctaatgggttttacttctacgacgatgattcacatgtatgtttgtttggagagcttgtaaccagaaaccactgccgacaaggcaagagctgcaaatgcaaagaaggtcatgctgattgctgcagcggttgcatctgtgaagttattgacaactgcagatctcatgcggttcgtgatcggggcagcagccgacagcgcagacatcagcaagtacgcaactacctgcaagttgcaaacgatgtcacagatgtctgtcagctaagttgtatcatttaaaagttgcaatagaaatcgtctaaagaagattctgataactatcagtttcagtacaaagaatgccttgaaagaactaagttgcagccaaccaaaaaaatcttgttaccttgctgcactagaaatggtatcatgacatgaaataaataacctcttgagtcctgatcaaagaatctaaggagggataagcatgaacttcgatacaaaaccctcttagccagtttaactgttataagaatacaccacatggcatgaaaggttacttcatgtaatgccacatacgttgtttgaactttattattttgactccatttgactaacaaaatctaggtatgcactagaaagtaaattcaagttgcagaaaatctaattctaacttttatgtgtccttagaataagtgaggccgctgattcaaatattagatgtattcccaatcaaccaaacaaaccctaagggtacatagtccctcagacgtttcaaacttcattgtttcacacgagagcatttcaatgcattcaagcataatctaatgggcatcatgaacatttttgttgacatgcagtacttatctccaaccaactgaagaactgaagattcaaaacatactcccaacttcgagctcatttggaagtttggtccaaccactccaatctcccaatactgggaccacattaccatgattgctgctggtggcctgtcatgtgctggtactagcatatagattgcccacattattagaccatttttgagagcttctagcccactatccttttgcctagtttcttccaaaaagaaactgaaggggtattaggttgttgagttgaaggtgtgcctggaaaaggagcatcacagaccaatccgactgatccaacagtaaaaggtgttgtgcctcttctcacaagtcacaaagttactcgcaccattgttatgctgctaatcagatgggggaaaagctacgggagagaattctcctacacagtactactgaattgatgtgtttcttcaccacggaagtagaatgtctgtactggaacctttactcttgctcatcagtttataaattgcactcatattgttctctcgttctcgtcactgagcaggaatctcgaccaaatcgaaaaacacgtcggacttttgctgactgagcgaaatacctgtgtcggcacaacatttatagctgcagactaaaagttggaagcaatgactcgcctgatcaccaacgaaatcaagaagcctcccagatgctgaggagacggggtcgacgccgccgcgcatccggtgcgcgtgccgcgccgcctgcgccagcgagtagagtagcgccagcgacgcgatggaaagcaggtacctagggagagagaagatgcagcaataatccataaacaaataaacacgggtcgaagtgcacgccgaggtcgaacccccaacaaccgtcgtccgctcacgcacttgtactcctggtaccggtcgaactgcatccagtcgccgtgctggttggacgcgacaagcacgagagcgacgaaggcgaagaccgcggccgcggcatgcagcgcgagggggctcttgtcgagcatgtcctcccgccgccaccgcgccaccaccgaatccaccacgccgccgccgcggcggacgcgggcgcccgtgccgccatctgcggtggaagcgccgttgtagggggcgtagtccggcttctcggcgtgcttcggcttctctgcggcggtggcggtgacggagtcggcgtcgacggtggcggtggcggcgtcggcggtggcggtggcggtggcggtggcggcgtcggcggtggcagtggcggtggcggcgtcggcgtcagtcatgaccatcgccatcgcttagcggcgcaaagcgtcgaggtggtggatgagagagaaggagtgaggaaggaaggggaacaatttttgctagcggggggttaaaaaaaacaaaagtgcttttgtgtgtgagcccggcaaggcacttgtgcatttacagacagatcagcggttgctcacttgcactagagtggaaataattacccaaacgaaacaaataatgaaagaatcatccctgagtgagctcgggcccacttgtcaataaacttgaaatttgatttggatcgagcggccaccttgtcctacaggcgacatatgagtatactaggtagatgcccgtgcgtgcaacg

SEQ ID NO: 15725 - DNA, 1107 bp, Zea mays
ttttttttttttttttattttttttaagcatacaactcaacttctgcttatgttcatagaagttaaatgttctcatcatgacaacaatatctaagaaaggaaaacaatcatattcaggaatgccacgcataattctatgtacacacatagaacctactgcaagcaacaacaatcaccttagcacataacagatgacatccaagttgaagagaggcatcagaggcttctcttctttggattagcaatccataatgaatattccacctaatgggttttacttctagaacgatgattcacatgtatgtttgtttggagagcttgtaaccagaaaccactgctgacaaggcaagagctacaaatgcaaagaaggccatgctgattgctgcagcggttgcgtctgtaaagttattgacaactgcagatctcatgcggttagtgatggggacggcagccgacagcgcggacatcagcaagtatgcaactacctggtcaccgacgaaatcgagaagcctcccagatgctgaggagacggggccggcgccgccgcgcatccggtacgcgcgccgcaccgcctgcgccagcgagtagagtaaccccagcgacacgattgcaagcaggtacctgtactcctcgtagcggtcgaactgcatccagccgccgtgctggttggacgcgacgagcacgagagcgactaaggcgaagacggcggccgcgccatgcagcgcgagggggctcttgtcgagcatgtcctcccgccgccaccgcgccaccaccgagtccacgacgcggccgccaccgccgccgccgcggacgccggcgcccgtgccgccatctgcggcggtggaagcgccgttatagggagcgtagtccggcttctcggcgtcctgcggcttctcgacgtcctgcggcttctctgcggcggctatggtggcggcggcgttgtcaatggtgaccatcgccatcgcttagcggttgatgagtgaggaagtgaggggaacaatattttcggggcttgtgactttgtgagattattaaaaaaaacaagcaaaagtgctttgtgtgtgaagcggaagcaaagcgaggccactactcactagtacagactac

SEQ ID NO: 15726 - DNA, 798 bp, Zea mays
ggcacgtccatgtcgtgcccgcacgtctccggcgtcgctggcctgatcaagaccctccacccggactggagccccgccgcgatcaagtcggcgatcatgacaagcgcgacggtgctggacgcggagatgaagccgatcctgaactcgtcctacgccccggcgacgccgttcagctacggcgccggccacgtgttcccgagccgcgcgctggacccagggctcgtgtacgacatgaccgtcgtggactacctcgacttcctctgcgcgctcgggtacaacgcgacggccatgaggacgatgaacaggggatcgttcgtgtgcccggccacccccatgagcctccacgacctcaactacccatcaatcactgcgcacggtcttcccgccggcacgaccacgatggtccggcgcaggctcaagaacgtcgggctgccggggacgtacacggccgccgtcgtcgagcccgaggggatgcacgtgtcggtgataccggcgatgctggtgttcagggaaaccggtgaggagaaggagttcgacgtgattgtcacggtcagcgaccgcgccccggccgcgagctacgtatttggcaccatcgtctggtctgatgggagccatcaggtgaggagtccgctggtagtgaagacgacgcaggggtgaagaacttgaacaatttgtctattgctggactgaactaggaatctagctagtcgagagagagaaagagatatgcagcttcgatcattatggaggataattgtggtatggattttttaagataatggaacaagtaatacctcc

SEQ ID NO: 15727 - DNA, 1146 bp, Zea mays
tccttgaaacatacatacatacatacatacattatatatatctgcatacacaatacataaaaggggaaaaaaatcgatagaattttggtacaagcttgttaacatgacaaccccaagcaaattagtgatgattgccaagcaacaaactcaggacatccatcagctgttgacatgttttttttttggagaggtaaggtagtacgtgagcttcgtacagttgcggcgtcaacatccatcctctgcttctgctagagctcgtgctgtaatctctggatcctcctattatgtgcttgttctctgatggagacaaggttgttcttgatctcgctacatatccttccttcaaggagtctcactggaacccagagcttgggctccagctcaaccacgtaagacagtgttgtctccaattcctgctcctcagaattctccccaccagcctcttcaacagaccatttcccctggaagagcttgaaatcgccgtcgatcatgttgaaggcgatctccctcctgcgcgccccggcggcgggcagcagctcaatgtccccctcgtagcagtctacggtgcccttggcgttgaacttgaagcccagcgcgaggtcctgctccccgacctggtacagccgcgcgaagccatcgtgccggtccaggagtcggcactcggagagcccagggatgaagtcagcgaggccctcgtagtcggtgagcgtggcccacacggcctcgagcggcgcgtggacgcgaacccgagcccgcacgaggcgccggttccgcttcccgaccttggacacctggatccggaagccgatgccctcgtcgcgatcctcctggtcgtcgttaggcgcgggccagtcgacctcgccggtcgcgtctccggcggcgacgtcgagcggcgggtcgggcggggcggggattcggcgggaagagagcctcggggaaggggtggaggggaatactaggtggaggtggaggctggcgatgcggagccgagcggggccggcgcgggagaggccgtggccgtgggaggagacgcagtagcaggaggaggtcgccatgttcgtcgtccggtccggttccgccgaccgccttcaacttcaaccctgtccggtatagatttttccccggccggcctcgaggtacccaatg

SEQ ID NO: 15728 - DNA, 1195 bp, Zea mays
aaacgtgggaaaaatatcagttttgcatgcgatggaatatatgcggcctttccaggattggattgccataaaagaacgcaaccaatcaggatataaccacacaactattttagaataccatgtggcgtccgagccattatacaaagaggaacagagtcttccttcagaattggtaatggacgcatttaataaaaaaaaaatcatctaaaatgtcaggtattgcccgctcgatagatttgagttcagacagttaacggtttggtcttcaactaccactagtatcagaaactctagtccaaaacacagttgttcatcaccattcaaaattcatcttctcagaacaggaagtaaaaaacaacataagtaaactactaataaaaagggtttgatcgtcaaatactaccatggtagcatctgaaactctagttcacaaaagttgctcttcatcgctctcgtctaactgaaccacaaaaaatcagtttatgataccgcctgcaccaaagagaaaatatagcagacccaggacaagacagtgagctacgacttggtgccacagctggacaacgtacttataatcctagacaagaaaaaaattaaggggtgtacatgtaagttatttaatacccttggggtttctatgcattattatgctacatagcatgcattttggattttgcccaatccagaatagattacaacgcacaaatgtagatcaacaaactttaacagtcttgacttttgacaaataatttagccaacaattttaaccaataaataatacagacttaatgtatccttcagtaaccacaagtttataataaccataaacaatataatttaaactaaataaatagtgaacgtgtgagaattgaggtggcaagtgtaactgcaccttataaattctacaaaaggtaacagtagtcaggccaacctaggaaataattccagtgattactataaagactcaaagcaaaattgccagtcctgttataagcacaatagtcaacacagggcgtgagcatcagctacatgcaaagggagacaaaactactggttgaactccttgttctaaagccttaaaaataattatgttgcataaaaaaggcaaaaaaatgtggtttaaactcacagatgttaacaatctcgtgctgttatttaactcccaactcacagtacctcggccgcgaccacgcta

SEQ ID NO: 15729 - DNA, 1263 bp, Zea mays
tatttatctttctccgcacgtaatcacagcgatactcagattctctttacaacgtaatcacagacagattctcgtaaaagccagtaaaaaaaactgaatcaaataggaccatagtggcatagtctgctcgagacagtcagcagcttgcatcgcgcatgggcccacctaacgacgcattcatttgttcctcgcgcatgggaccactctagcggtcgcttgcagccacgccgtgtcccgtccgcggcagcccaccccaacaggcgcagcgcgggccgctcccgtctcctcgtccccttttaagccatccgccacctccccgccgcccccaactccaactccaaggctccaacgcatctgcacttccttctcctacaaaatcgcagcagcacttcttcctccacttcccaaatcaaagcaggaccagcgcgcgcgcagtgatctagggcgaagcaaagcgaggaacagggaccgtctcgttgggcccggaaaactggcgagatcgatggacgctgccgcggaggcctcaacgccgtcgtccccgtcgaagctgcgcgacaagctgcggaccacggtgtgctgctgcttcggcgtggagagggctcggtggcggcggcggcggggggcggcgacggccgcgggcgagttccgctacgacccgctgagctacgcgctcaacttcgacgagggcgaggacgacgacgcctacgcggaccccgccgcggccttccggtacaggaacttcaacgcgcgcctcccgccctcgccggccgccgctgccgcggtgaggacccagcggccgcagcgggccacggccaccgcctgaccgcccatcgcttagagttaagatcgtgctccgcgatgtctctctctttttggtttgtttgtttgtttggccctcctctcttgcaattgtacgatctactgagcgagcgacatacagctacttacttttagtgaattattatcgtgttatagatacagtgtactcttgtaacatgtaggaatgttccgatgtgttcagtacgaagcgggagtgatgaaccctagaaattggggctttgattccagaaacaaatctcctcttgttctgtctctctatcttttgccctctcttttgtctgagaagaagcaaaaacaatctcccccctggaaaatagtaatctatagaatgaaacaacatcccgagaaatacatttctctcgtctcttgaatagtcattcgattttagtttttttttgttttagtaaaattgcataatctatg

SEQ ID NO: 15730 - DNA, 950 bp, Zea mays
  misc_feature (878)..(925): n is a, c, g, or t
cgggcgcgtgggctcgagccgattctaatggcatcttcagcttgtaccaaaacaaggtcagtttgaagatatactcctggaaatggacagaatcttacgcccggagggtgcagtcataattcgtgacaaggttgatgttcttgtaaaagtggagaaaatagccaatgccatgaggtggaagacaagattggctgatcatgagggtggccctctttgtacctgagaagatactcttcgcggtcaagcaatactggaccgttgcaaaaacaagcagctaacattattcgtattttatttttttctccagtcacaggtaacttggtccctggatgtgtttattggggggaaaatctgccggtttgaaaatcatcatcccatgtttgttactgaaaatagaaaacaagcttacaatcaccctggaggatggtaagttatgcgggacctagttgtgaacttgtgatttgcttattccactgttgcagagatgcagaagacatgccaaaaggatcaattgaccttgcactagtgactcatatctgatcggacagatgcagctgcttataattggaaccctgcagcagtccaggaagttatgaactagcagtggacttacagttttgtataggatactcatttacctctacacgcacctcttttttttgttgttgtatctcagaatctcatcaaatggattgcatgtggacctataaggtctttttcggtgttacccattacaaaattcaaacaaaaaacataggtcgattcgtgtggtaggtttatttgtaataaactcgaaggaataattgtgatggtgtatagaacaaaggacacaagatttaaatatatccatgcagccaaatcgttgtactcaaaaaaannnnnnnnnnnnnnnnnnnnnnnnnnnnnnnnnnnnnnnnnnnnnnnngaaaaaaaaaaaaaaaaaagcggcc

SEQ ID NO: 15731 - DNA, 1899 bp, Zea mays
gcacgaggcacgcccttgactgtgaagttgcaccgtccgcctctgcgagtcgggtggtcgccgcacgaggacggaacggaatgctcagtctcgccccccgcagcccgccgctgtcctactccacacaccgcgctcacctactccaatccagacccctctctccctcacccacagtccccgccgccgccggcgccgcgtccgcgtcctgtgcgcctcgctcactctgcttccgccgccgccgcagcagtcgtctcgcagcggagcggacccggaggcctaccatggcagcggcaatctcgctggaggccggcggggccctggcccatgacctagggtctgcagtcgtcacaggtggtgtcgccctcgcgctcctcaaattctttgaggagctcgccaagcgcggcgtcttcgagcagaaactcagcaggaagcttgttcatataagcgttgggctggtattcatgctcttttggcctctttttagctctggatggtatactcctttccttgctgcgctagcaccaggggttaacattataaggatgcttctactggggctgggacttatgaaaaacgaggctatggttaaatcaatgagccgctctggagattacagggaacttctcaagggcccactgtattatgctgctactataacttttgccacgtctcttttatggagaacctcaccagttgctatagcacttatatgcaacttatgtgctggggatggtatagccgatgttgttgggagacgcctaggtaaagaaaagcttccatacaatcccaacaaatcatatgctggaagcatagcaatggcggtggctggttttctggcctcagttgggtatatgcattacttccacactttcggttttattgaggaaacatggtacatggctttaagcttcctcgtggtctctgtagctgcagcactcgttgaatcgcaccccatcagcacagaacttgatgacaatttgactgttcctttgacatcattcctagttggtagcctcatcttttgatgtttaggcgcaaggacgtatgagatgtttctccgtcatgctgtaatcttctgatgtttaggctcaaggacatatgagatgtttctccgtcatgctgtattttatgtaaaacgtttctaaaatactactataattgtgagaatctgtacctagagtttggagaatatgttcggtttgtttatcataatacaagagtgtgtttggttagggagttgactggaatgaagcagttccattccggttcctggtatcggagtcattctattctatatttgacaacaatatttgacaactgaacatctatatttgacaacagaacggagtcgctctcttttttgtttgattgaagagtagaatagaatagagccgctccgttctttgtttgattgcagagccatataagtgtggaggggaagagattgaaggaaatgctcgctctggtcattttagtagagcaggagcatcctaactatttatggtatattcctatatggagattacaagaaccgcttcgcttctcttttattggaaaccaaacatccagaaaatagaaatgaaatcgattcattctccttcactcaaccaaacacatcataagtcagttttaggatgcgtttggttgaggagccaactaggatgaagcgactctattctagttttgataattgagacatttcattctgtgtttggcaagtagaacagaactgctccatgttttatttggtttaagagtagaatagagcgaagccgctccgttcattgtttggttggagagccatttaagtgtggagtggaggagagagaggagaggcgagagcgctcgctatgtcgttttggtggagcaagaacatcccaaatgtttgtcatatatata

SEQ ID NO: 15732 - DNA, 995 bp, Zea mays
cattgggtacctcgaggccggcccgggttgttgtctcgttgaggaatattccacatcccctcgtttccggcaaaccgcaatgaagtctctgacccccaccgccgctggctccgccgcagatttttccgactctctgccctccccgatctcccctgcggcggtgccatgccattccagccccggccgccactactacctcgccgtcgaccgcacccagttcaaaatgaggacactcttggagctcctgggggttgtcgcggatcgccgtggtgggctgccgattgcaacatgtgtttcctcccgtgatgagcttgatgccgtctgtgctgccgtcgcaaacctcccctttgtgtcagcgtcacctctgtatagtgatcaagctgaagcagagcgtgcatctattcttgagaactttcgtcaagaaacaactcagtggaataaaactgctaaagctaccaatattgccgaaagttctaagcttgaaagtactggctctaaaataagcattatagttgcaacagatgcttgcttgcctcaggcagcgatggcagaggcaccccttatggctcgagtgctgataaactatgagcttcccacaaagaaggaagcttacttaagacgcatgtcaacatgtttggcggcagacggaattgtgattaacatggtcgttggtggtgaggtggttacactcaaggctttagaagagaacagtggtctgcttattgctgagatgccaatacatgtttcagaaatattatgaccgttccagttgtacaacatttcagaagttactgttctgattgcacactaactactcatggtttacttctactttaatttttgaattgcttttcatgtttcagaatgttctcaaattatatctctaaagcattagaataatgctcattgcttcttttttcctctgtataagaaatgatagaatatagtcatggttcaacatccaaaaaaaaaaaaaattaaaaaaaaaaaaaaaa

SEQ ID NO: 15733 - DNA, 3327 bp, Zea mays
ttacagaccattacatagataggtataggtactagaaactataaagctaatattaagatggtatagtgataaacaaaaggctagggaattatataatcagctcatttgcctagaataagtaagttgagtgaataaaaatcaagcaccttgattcatgatgatcgactttatttgcaacaacagcctgctgattcatcatgacaatttcaaaatctttgatagatttaacaagattttccatgaattctctcatatcattgtctttggaaacagcagatgttagcatcttctctttttcttccatggcataatgtagagcttgattctgtttctctaggtctctcagagagtttcccatggttctcagtccatcattcagctcaaccaaggtaacatcattgtgttgcccatgctgctgagcttgctccaacctgcacataatggcatcaaattccctgttcttttcagataggtaggaatcttgctttgccactttgtcccttagcaaatcaagttcacaacacattgactccacgcgagtctgcatcgcttccaatccaatctgtgatacaaatttctccttttcactcaatacttcagtgaaggaatccacaattagtttcagtttttcaatcttttgcttatgtagagattcctcttcagcatgaccctttttctcctcgtacttcaacaacaaagaatcaatgtttgacattgctctagcaatagcctcattgtgaattattgagcaaacttcctgcttcataccaccctcaatctcataaccatgcaattctatgtttatttcactaatgaactcttttatgataatcctttctatttcttctctaaaggtggctgcaattctggcatcttcaacgtcaaattgaggccttacaatattcagttcatgatctgcctctctggatgcaaaatgcgaagagtgagttggaatagagcaatggtagtcttcattattacttgcaccactttctagttgctcggtttcagaacctaatacattgttcttatcttgttgaccaggaattgcatttgacttgactcgaacagaggttcttttattctccaggaggagcacatccaacttggagatgacttcctctattttcttccttgtttgctcaagttctttgttatttcgtaaatgaaaagggtttgatccatccttcttcaggatttcacgcttcagtttgaatatctcttccgtcctctggtacagaactgaatcatgctgccttttcatctcattcattgatttattgaaatgggctatcaaagcaaccttatccatgtgatccaagagtttcggatcaccaaaaacttcttctttagagtctccaggatgaatggtctttgctacaccatttctagaggaattttctttgtcctgctgcttgctggcattttctgaatcttcaaagttatgctgtgatcccgatagcccccattcagaattcaacagtgacttggaaatggagtcaagctgctggcggagactataaaactcatcatgtcttttatcccgtccctcagataaactcaagctgccatttactggctgctgcagcttctggttcagtgatgatatctctgcatccttgagagcaatttggctagcagcttcttgccgcacatcacttaggatccccttgatgatagcaccagtcacaattcctgaaacatgaaccctgtcgtttacttcatccaagaaagattccatgtcctcaatggcgtcttcatggcaataaggctcagtctgaactgcagcacttccattggcatcatcgggcaatacatgcaaggtctctgccatctccatctgtatgtgagtttggtgtgatcgccactgtaaccaaaaaaaagggaaggcacaaaaaggaatgttaaactcggggattataatcaaaccagcatgctatttccctcaggaaatccgtctgaacatttattgcccagcagcaaacgcgcatgtatcattcaataaaccacgtcaaacatgacgtgcagtcacatcaccccaagcttgtgacagcataatggtctctgagcaaaaccctacctcagcaagacgacgaaaatcttacaaattaaattaccagtataaactgccttgaatgctcggataataatgagtttatgacatcaaatctaaagagacagaacatccatcccagtaatggtaactcgattggggaaagtgacatggacggaaatacatagcccaaaaaaaggagatagcagaaacaaatcaacatctagctaaactagccgaatcagataagccaaaaaaaataaaacaggcaacaaattgaacactaaccaaccgtctaggttaaagagctcaagtggaggaggccgtctaagcgaagctagcccaagctcaaaccaagaggggaggggcgagacgaaacaatccggaaaaccaccagcgcctcctaggacggagagctccgccaccaccaccaccaccagtgaatccgtagagcaagaaacagcagcgaggcaaggaatgccgccccccgaaatacaacggcggtaaaggggaaaagaaagaagctgcgctggtgactgatgctctacctttcctttcctgccaccgtcagcgccgccactgtgcgcgggtggtggggagacagcgaaagcagccgcctttcacctccagtcccccctcccccgccttttctcaccgccgccgccgttaacgtgctaaggttatctcttgaaggttgactgcaggcgcgcctcaagtgccaccgccgtgaggccggcccgtaatgcttgcctctccttgaagcccagcccatggctcatgggtttggcccaaactctagtttcactctgacagcccgataagagagtaacacatttcatttcaaaattaaacgccggcgagagccgccccggcggagggagctctctggacgcgaagcgctccacgccggtgaccactgacctcctccctggaggcgccccggcgaagggagcgatcctggtaccggctgcggaagtgcggagccaagggcggggccgctccgcggagcgccggtggcagccacggtctgacgtcaggtattgtcattttcgagtcctccgaacccaactgcaaacaacaggaacccattaccaaataaatgatgctagaaatggtttcatcttaaaaaatgggtcggatccatctagagcgtggtaatgtatcacgatctaaaggtttttttataatttgttaggacactaaactaattttagttcaaaataaataaaaatagagtttcatcctatctaattttattcttaaattttatagcg

SEQ ID NO: 15734 - DNA, 1349 bp, Zea mays
gcccaggctatcgtgtagatttatctaccattgtgccaggaaaaaataaaggtccacatgaaaactcggcttctctaacatcctctcggctaccaatgttacaagagttcacctttgcaacccagcatagcaggtggcgaagcccatggcatcaaaagccaagcacaagaactaatagctacggttgggtcatttacaaagtgctcaaaagctaccaagaccactactctgcctgcaaaagggagcaacccactctgcatcacctagtccttgagtcggaaacaaaagcttgctgccacctacacttctacaaacttatctcaaaccactggaagcctgctgtcaagcctacggttctataatgtcaagccgaccagaagcattttacttcgccatgctaatgtgcttcttaatcatgttcaaggtctccataacgccagtgtagtgtcgaaggaccggagaatagtgatcaagtgcagtatagatttttgcaagaagatccgttaaggcctcaacctcatcaccaagcaaatccacctcaagttcagctttctgaagattagagtctcttgtctcagatatctctttgtatcgtaaggccttctttcttaaaagattgccttcttttgcaaggtgtttacattgttcttttaataaacagaaccttgattcatgatgatcgactttatttgcaacaacagcctgctgattcatcatgacaatttcaaaatatttgatagatttaacgagattttccatgaattctctcatatcattgtctttggaaacagcagatgttagcatcttctctttttcttccatggcataatgtagagcttgattctgtttctctaggtcttttagagagtttgaaatggttctaagtctatcattcagctcaaccaaggtaacatcattgtgttgaacatgctgctgagcttgctccaacctgcacataatggcatcaaattccctgttcttttcagataggtaggaatcttgctttgccactttgtcccttaacaaatcaagttcacaacacattgactccacgcgagtctgcatcgcttccaatccaatctgtgatacaaatttctccttttcactcaatacttcagtgaaggaatccacaactagtttcagtttttcaatcttttgcttatgtagagattcctcttcagcatgtccttttttctcctcgtacttcaacaacaaagaatcaatgtttgacattgctctagcaatagcctcattgtgaattattgagcaaacttcctgcttcataccaccctcaatctcataaccatgcaatctatgtttatttcactaagaacactttatgatatgcc

SEQ ID NO: 15735 - DNA, 1299 bp, Zea mays
cctcctccttcccgtccatcgccgtcgccggggcttcctacaacttcaaaatggcggctaccgccaccgccatggctatagcaactatctcccccgccgctccgattccatccgcgcccttcccatcccttcccctccccctcggcctccgcctccgctctcaacccctcctcttcgctgcttcccgccgccgcttcctccatgttcccaaagccgcctcctgggacgaatccgtccccgaggatggtggagatgcggaggaatccgttgccgctggggacgacgaggacgaggacgagaagccgcggcccgagccggtgtcctcctccgagttccagttcgcggcgccacccgagggctacgtcgagcccgcggcgtttgacgagctaccgccggagtccccagaagacgtggcggcggcgtcattgggtacctcgaggccggccttcagcggcgagacattgctggggaacaatgtctttgaggtcaaggtggtcgaccccatcgacatggaccgggagcagcgcccgaacgacgatttcaccgagcgcgtcgtgcaggtcaaccgcgtcaccaaggttgtcaagggagggaggcagctctcctaccgcgcaatcgtcgtcgttggcgacatgaagggccacgttggtgtcggcgtgggaaaggccaaggaggtcacggaggccatcaccaaggccgccatgaacggccggcgcaaccttgtcacagtgccgctaactaagtactccacattcccgcacagagctgatgcggactatggagcagccaaggtgatgctgaggcctgcttgccctggatctggtgtcattgctggtggagccgtgagggttgtgctggagatggctggtgttgaaaatgctctgggcaagcagctgcgcagcaagaaccccctgaacaacgctcgagccactatcaaggcgacgcagatgatgaagcagttcaaggatgtcgctgaggagcgtggtattccaatggaggagctgtggaaatgataaaaacaattcgaaaccaagaccccccccccctttgtagcattctttctcctgtcgctgtatttttcttaaggtcttcatttttctgctgtatctatgggatgaatcccgcctcacggtttcttttttgcatctctcttctgagattctgtgtgtgagaattgagtccatgagatctgaccctatatgcttgctcttcacttctgtacactgctactggtggaaattcagaccaaagaatgaacagatttagcgcgaaaaaaaaaaaaaaaaatgcggcccgact

SEQ ID NO: 15736 - DNA, 1388 bp, Zea mays
gccggccggttccggacacactggataacgaagggataatctgggcagcggccccccccatccccgaacttcaccggcctcctcctccttcccgtccatcgccgtcgccggggcgccctacaacttcaaaatggcggctaccgccaccgccatggctatagcaactatctcccccgccgctccgatcccatccgcgcccttcccatccctccccctcggcctccgcctccgccctcaacccctccttttcgctgcttcccgccgccgcctcctccatgttcccaaagccgcctcctgggacgaatccgtccccgaggatggtggagatgcggaggaatccgttgccgctggggacgacgaggacgaggacgagaagccgcggcccgagccggtgtcctcctccgagttccagttcgcggcgccacccgagggctacgtcgagcccgcggcgtttgacgagctaccgccggagtccccagaagacgtggcggcggcgtacgaatctctctacgggccggccttcagcggcgagacattgctggggaacaatgtcttcgaggtcaaggtggtcgaccccatcgacatggaccgggagcagcgtccgaacgacgatttcaccgagcgcgtcgtgcaggtcaaccgcgtcaccaaggtcgtcaagggagggaggcagctctcctaccgcgcaatcgtcgtcgttggcgacatgaagggccacgttggtgtcggcgtgggaaaggccaaggaggtcacggaggccatcaccaaggccgccatgaacggccggcgcaaccttgtcacagtgccgctaactaagtactccacattcccgcacagagctgatgcggactatggagcagccaaggtgatgttgaggcctgcttgccctggatctggtgttattgctggtggagctgtgagggttgtgttggagatggctggtgttgaaaatgctctgggcaagcagctgcgcagcaagaaccccctgaacaacgcccgagccactatcaaggcgacgcagatgatgaagcagttcaaggatgtcgctgaggagcgtggtattccaatggaggagctgtggaaatgataaaaacaattcgaaaccaaggcccccccttttgtagcattatttctcctgtcgctgtatttttcttaaggtcttcatttttctgctgtatctatcatcacggtttctttttttgcatctcttctgagattctgtgtgtgggaattgagtccatgagatctgaccctatatttgtactcttcacatatgtacactactcgtggaaggaaattcagaccaaagaatgaacagattcagcacaaaaaaaaaaaaaaaaaaaaaaaaaaaaaaaaaaaaaaaaaaaggaaaaaaaaaaaaaaaa

SEQ ID NO: 15737 - DNA, 1684 bp, Zea mays
gggtacctcgaggccggccgggccgggcatccccgcacttcaccggcctcctcctccttcccgtccatcgccgtcgccggggcttcctacaacttcaaaatggcggctaccgccaccgccatggctatagcaactatctcccccgccgctccgattccatccgcgcccttcccatcccttcccctccccctcggcctccgcctccgctctcaacccctcctcttcgctgcttcccgccgccgcttcctccatgttcccaaagccgcctcctgggacgaatccgtccccgaggatggtggagatgcggaggaatccgttgccgctggggacgacgaggacgaggacgagaagccgcggcccgagccggtgtcctcctccgagttccagttcgcggcgccacccgagggctacgtcgagcccgcggcgtttgacgagctaccgccggagtccccagaagacgtggcggcggcgtacgaatctctctacgggccggccttcagcggcgagacattgctggggaacaatgtctttgaggtcaaggtggtcgaccccatcgacatggaccgggagcagcgcccgaacgacgatttcaccgagcgcgtcgtgcaggtcaaccgcgtcaccaaggtcgtcaagggagggaggcagctctcctaccgcgcaatcgtcgtcgttggcgacatgaagggccacgttggtgtcggcgtgggaaaggccaaggaggtcacggaggccatcaccaaggccgccatgaacggccggcgcaaccttgtcacagtgccgctaactaagtactccacattcccgcacagagctgatgcggactatggagcagccaaggtgatgctgaggcctgcttgcttccaagatgattagtctacatcgaaatcttgtgttaggttgaatttagtgagatgctcttggtattgaccagtcaaggttaattgtgcttgccaaatgattgaaataaagttggttttagacttgctttcaatatattacattattcttctaccttgactgaggcctaagaaaaacatatagtgagctgttttaagaatgaggctagtggctgcaaaatcaagtctcgtccttgtggtactattcttgacctagtgttattttgaagctaacatgacttttgaaattgtccctactagcacgatcctatttgacagaggcactgaagtgtcatggtcttttatcttttgtttgatcaagtttgatggtaaactcaatccgaattttccttcacgaatttgtaattctctacattgacagcaaactccatgttagaaggtagacccaatactgtagctatgtctcctttcttgtggtatgaatttcctgttgtgtggataagcctatggtaattcacttaggccccgtttgtttcccttcattttggaggaattggaatctaactaatggagtagactattttcattagaatgtgacattacacaactttccaaagtttatatataagcctatctcaaataatgaggtgagtgatggaaattgattctatagatttacatgttttttttttctaatgtacaacttatagcacactcttctacttgcttctctatagcataaatgtagtgtataactatctctctcatgatttagaataatatacaaatatattacatatatcaatatattaacttaattagtt

SEQ ID NO: 15738 - DNA, 343 bp, Zea mays
acagcaaaatgagaagagcagaagaagaatagtggcggcgaacaagaaaaggcggctgcccaggcaagatggtggcctagactctgaaagtgctgctgcttcgttggacggtcagattatcaagtatcagcctctgatcaacgaagcagccaaagcaatgctaaggaagatattaaagctagattcttcgtgggcaattcagagaatggtaattttctgctggagaattatatgccaggcgctcaagcctttgagagctcttcgtcaacaagaaactctggggtcaccctttcagaggtttcagctaacccaggtttgccgtacctcggccgcgaccacgcta

SEQ ID NO: 15739 - DNA, 1945 bp, Zea mays
gtcgacggtgaccacggcggtggcgcccccagtcacggcgcacgcggtggcggtggcgcccccggccgcggcgcccgaccccgccgcggcgggcaacggcagcgccaccgccgcgccgccgccaccgttcctcatgaagacctacgagctggtggacgacccggccacggacgacgtcatatcctggggccccgggaacaacagcttcatcgtctggaacacgcccgagttcgcccgggacctcctgcccaagtacttcaagcacagcaacttctcctccttcgtcaggcagctcaacacctacgggtttagaaaggttgatccagacagatgggaatttgcaaatgagggttttctgagaggacagaagcatctgctgaagactatcaacagaaggaaaccatccttgcaggggaacagccaaccacagcaacctcagtcgcagaacgctcctgtgccttcctgtgtagaggttggtaagtttgggttggaggaagagattgaacggctgaagagggataagaatgttcttatgcaagagcttgtcaggctgagacagcaacagcaaacaactgaccatcagctgcagactttgggcaagcgtcttcaagggatggagtcacggcagcaacagatgatgtctttcctggctaaagcaatgcaaagtcctggtttcctagcgcagtttgtacagcaaaatgagaagagcagaagaagaatagtagcggcgaacaagaaaaggcggctgcccaggcaagatggtggcctagactccgaaagtgctgctgcttcgttggacggtcaaatcatcaagtatcagcctctgatcaacgaagcagccaaagcaatgctaaggaagatactaaagctagattcttcgcataggttggaatctatgggcaattcagagaatggcaattttctgctggagaattatatgccaggcgctcaagcctttgagagctcttcgtcaacaagaaactctggggtcaccctttcagaggtttcagctaacccaggtttgccgtatggcggcggcggcggcacgagctctgggctgtcagccatctgccctcctgaaatccagtgcccagttgtgatggacaacatgtcgtctaaccaagtgcccagcatgagtgctgtgcctcctgtttcgaaggctacaattgacatgggtattcctgaattctcagctctggcagacttggtgaatgaaggctccgtcgatatccctggaggggcctttgagatgcctggtcctgagtttcctctgccagaaggcgatgacagtgtccccatcgagaccgatgagaccatgtacaacaacaacgacgagactcagagccttccaggcatcatcgactccttctgggagcagttcctggtaggcagccctctctctgccgataacgatgaagttgattcggggtcgccacaggagaacggatggagcaaagtggggaacatcggtgatcttacagaacagatgggccttctgtcatcaacaaatcaccgcgactcagggaatgggctgtagtgtatcttaattaatatacggtagactgggattatcggtaataagcgtcgcctgcagtttttgttatttttccttttggccaaaaaatgatatgccggtatatcaaccactcgctcgacctatatgcgcgggaggggcagtcttccagctgagctctgaatgccacagccacctgcttgtatcaatctatgatgttggcagtcttgagaacaccactgtgacttgttaaatctgtatgcttattcccactctagttgctgatattgtttagtttgttatattggtgcggaaacacgggggttgtttagcaacaaagtacaacacgttgcttcattacaattcgattctgtacaattccatactccaaccaatatttttccagcaaggggatcaaaaaaaaaaaaaaaa

SEQ ID NO: 15740 - DNA, 1753 bp, Zea mays
  misc_feature (28)..(28): n is a, c, g, or t
cctctccccgcgcaccacggccaacagnaaccactccgctcctcgccgtaccgggccgggccgggctcccctacatgacgccaccgttcctcatgaagacctacgaggtggtggacgacccggccacggacgacgtcatatcctggggccccgggaacaacagcttcatcgtctggaacacgcccgagttcgcccgggacctcctgcccaagtacttcaagcacagcaacttctcctccttcgtcaggcagctcaacacctacgggtttagaaaggttgatccagacagatgggaatttgcgaatgagggttttctgagaggacagaagcatctgctgaagactatcaacagaaggaaaccatctttgcaggggaacagccaaccacagcaacctcagtcgcagaacgctcctgtgccttcctgtgtagaggttggtaagtttgggtcggtgcaagagattgaacggctgaaaagggacaagaatgttcttatgcaagagcttgtaaggctgagacagcaacagcaaacaactgaccatcagctccagactttgggcaagcgtcttcaagggatggagtcacggcagcaacagatgatgtctttcctggccaaagcaatgcaaagtcctggtttcctagcacagtttgtacagcgaaatgagaacagcaggaggagaatagtagctgcgaacaagaaaaggcggctgcccaagcaagatggtggactcgagtccgaaagttctgctgcttcgttagacggtcaaatcatcaagtatcagccttcgatcaacgaagcagccaaagcaatgctaaggaagatcctaaacgtagattcttcgcataggtttgaatctatgggcaattcagataatagtaataataataatattctgctggaggattatatgccggccggccaagcttttgagagctcttcgtcgacaagaaattctggggtcacccttgcagaggttccagcaaactcaggcttggcgtatgtcggcacgagctcggctatctgttctcctccagcggcccctgaaatgcagtgcccagtggtgctggataacaaggcgtacaagcaagtggccagcatgagtgctgtgcctcctgtttcaagtgacatgggtattattccggaattctcagatctggcagacttggtctctgtggatattcttggaggggcctttgagatgatgcctggtcctgagttccccctgccagaagaaggtgatgatgggaccaccatgtacaacaacaacgacgaggaggctcagagccttccaggcatcatcaactccatctgggagcagttcctggtaggcagccctctatctaccgataatgaggaagttgattcagcaggcggactatatgcgcaggaggatggatggagcaaagtggggaacatcgctaatcttacagaacagatgggacttgtatcatcaacaaatcaccgggactcagggaatgggctgtactagtatcttaattaatacagtagactgaggattctggtaataagtgttgcatgctcttttcttatttaattattttcccccttttcgccaactcaatatgggaggtgggggctgaggcgattcaaaggcatgtttggctcgttacctaagttgacacactttgccaaacttacttttatgactaaggttagttatttaatttggacgactaactttagacaagtgtgacacatttagccacaacccaacagaccctctgtctttcagac

SEQ ID NO: 15741 - DNA, 850 bp, Zea mays
  misc_feature (9)..(9): n is a, c, g, or t
  misc_feature (681)..(681): n is a, c, g, or t
  misc_feature (740)..(740): n is a, c, g, or t
  misc_feature (742)..(742): n is a, c, g, or t
  misc_feature (773)..(773): n is a, c, g, or t
  misc_feature (785)..(785): n is a, c, g, or t
cggccgggnaaaaaaaaaaaaaaaaaaaaaaaaaaaaaaaaaaaaaaaaaaattcgaggcttgctccggcagccacacagtattgctcatggctactgcttgtgttccgacggtggatgcggaggaagcatgcgccctcctcagctcttccacacaccactatctggatgtcaggatgtgggaggattttgacaagggccatgtcgccggtgctcggaatgttccctactacctctccgtcactccgcatgggaaggagaagaatccccagtttgtggaacaggtttccgcgctctacgccaaggaccaaaacttgattgtgggttgccgctctggcatccggtccaaactcgccactgcagacctcgtcaacgcgggcttcaccaacgtgaggaacctacaaggcggatacctttccttgctccgaagcgcaaactagctagcttcctgcttatttgttcgcatgcttgtaataagtgagtcaacatatgcttgaaagatctgttcatgaagaagcagcatcaactccatcatgaaaaatgattaatgacactgcaaatgtgcatacccaaaaactttactatctaaaaaaaaaaaaaagaagtctgccgccggaagctagcgtcaactcacagccgcaagcccctttggttcgacgctccagtagttcatccatgattntaacatgcccaccctgagcagccagatggagtgggggtagggtagcaccagagaaacananagaggaccatttaaggtaatatatatcctangacatatcattnctaagcccagtatgaatatcattctggaatctgggagcataatggggtggtttggttttagctat

SEQ ID NO: 15742 - DNA, 1497 bp, Zea mays
aatgcaggaagagagagaaggtgcagtcagtcagtcaggcagagaaacgtgcggaggtggaagccacaacgggagcgcctaccctcgcagtccgcccctcgacctcggagccgcagcccgcgaggagcgttcacaatcacaccggccaccgcggaccctagcgctttagccttatccgtccgagcgcgcgcccgatgcagacggaggcgcgcgtgggcgtcgtcgtcgacggcggcgccgccgtgggccggtgccaggagcagcgccacatcggcacggcggcgcacctcgccgccggaggcttcgcgggcgccgtcagcaagacgtgcaccgcccccctcgcgcggctcaccatcctcttccaggtagctggtatgcattcagatgttgcgactctaaggaagtgtagcatatggcatgaggcttcacgaatttttcgagaagaagggattgaagccttttggaaaggaaatctagtgacaattgtacatcgcttgccttattctgccatcagcttctattcgtatgagcgctacaaaaatcttctccaaacggttcctggcctggatagagactcaaataatgttggtgttgtacgtttgcttggtggtggtttggcgggaataactgctgcatctttaacttacccgttggatgttgttcgtactcgcttggcgacgcagaaaaccactaggtattacaagggcatcttccatgcggtgtccacaatttgtagagacgagggtgtcaaaggattgtataaaggccttggggccacgttattgggagttggacctagtatagcaatcagcttttctgtctatgaatcactaaggtcttattggcaaatggaaaggccccatgattcaactgcagttgttagcttgttttctgggagtctatctggtattgcatcatctacagccacatttccccttgatcttgtaaagcgacggatgcaacttcaaggagcagctgggacagcgtccgtccagaaatcaaccatatctggaactgtccgtgatatcttgcagagagaaggtctccgtggcttctacagaggtatcgcccctgagtacctcaaggtcgttcctagtgttggaatcgccttcatgacatacgagacactgaagggcttgctctccagcattgacatagacgatgagagctgaggtttcccattatacgaagaggttaaacttcaccggattttttggccataggttaccatcagaatgtatgtaagtgcatcagagtggttacacgaacggcattgtggcagttttgtagttgacggtaggtcaaagcttacctgaggtgtacaactagtcttgtgttgtaccataggctaaacagagcaaataagcgcttcatgatggagtcttcatcttgtgttcctttgtacattatgctccatcaaggaagagcaaaaaaaaaaaaaaaagaagaagaagaaggtgaaagtcaatgattttataggtaaaaaaaaaaaaaaaa

SEQ ID NO: 15743 - DNA, 938 bp, Zea mays
  misc_feature (32)..(32): n is a, c, g, or t
tctcaaagtggggtatttgagatatggcagangcaacattgagcggacttgccgcagggccctgcgactagtccgctcaatgttgcctctgccatatctcaaagtggggtatttgactgctcctccagctaacaattccatcgcaccacacggggattgggaggtatcacagttcattttgaatcatgagggcctccagcaggctgatgcttctgaccagcctccatcgcaatcccctgggcatttggacaggggcagaaagcctgtcagaataaacgttgcagatattgtttcagtgtcagcatgtgccgatttaactttaccaagtggtgctggcctctgtatagaaactattcatggtcctacgttcttggttgcccatagttgggaggctcttgacggctggctagatgccatacgccttgtctacactatttttgcgagagggaagagcgatgtgcttgccggtattattactggttaaatggcttgctgcaggagggaagagcgatgaactagccgggtgttgttactgccactggagaggcgcgaagttttggtgattcagcgtcagccttatcagttaaatgcccccttcgatttgttagtatgcctcccatctgtgatgtcagtcttcctagatatagggtatatcaatcatatattcggttgtaactcgtactttccagtgattggcgataggtccgttttttctttgtaaaagtggccgtgttactgtattatgcattcacagcatatgtatcggacattctttaagtttgattatatttctctgtaacaatgaatcgaggcaagatgggctctggccctgctgggctccacctccaatatgtagagccgaggaacaggagggaaagaacaatgatatactccctcattccaaattataatgtgtttttgtttgcttttctaaaaaa

SEQ ID NO: 15744 - DNA, 721 bp, Zea mays
tttttttttttttttttttcctttttttttttttttttaaattaaaattcttgaactcgttagattgctcatatggatatacattaaatttgaagtactcaaatgtgcttcggcgtgggctttgaagaggagccttacaagaattcaaaacactacgtcgtcacgaacctttggggcacataatcctgtaaatcagaaccaacactattgagaagagaacactcgtcttctcggcctgttcctggtgcgtggaccgacaacggcgggctcctcctccaccaccaccggcaggtcgaccccctcttcctcctccccatcgtcgtcttcctcaccggcaccgtcctcgtcggacgcctcgttctcttccagtatcgctcggtttatctccatctccctcaggaagcggtcgtcgaggtcgtcggcgacgcgggcggcggtgacgagcgtgccgacgaagagggagagcggaagcacgaaggcgaggatgagcgcgttggtgctgggcggcccaccggcccgcaccaccatgagccggccccgccgccgccgccgcgaggctcccggcaccggcctggcgcagctgctggctcggacaaaacgaggtggctgggagagtgctcggacgacgtgggcgccccgcgccatgggctgctctcagaatcggaggctccccgtccccagacgtgagcgggcagcacgagcctgcctagacgcgtgggac

SEQ ID NO: 15745 - DNA, 1998 bp, Zea mays
tgctggacaaagctagtttggaaacggatacttgtccttttacagagcaaataaaatctggaactatttcactacaggaggcacacatgaagactgaggtatcctggacttcggccattatggccgggcctgaaggccataaaagctcactaagcttgccagttccttctggccactcactttcttccaattttgcgacaaggtctttaagtactgcaggagaatctgtgaaaaacacatatgacttggtagtatttaaagggagtagagaatcttcgcgggctggagactgtatctcttcgcctggtgtgcatcataacataccgccaataatgattgatcaaggaagcaacatgaatcctagtatggagagctcaaacaattcacataggctgatggcatctaacactaatgcaactcagttttactcttacaaggaccaaatgcatgtaacaccagagactagggcctcagtgatgacagaaaaagatagcagtcaagcttctgctgcatcaagtcagccctttgcgggaactgttttaagagcacaaagtgtatctcaggaagcttcacctagcgtctttacttcaaagcctctcatagattcttcacttgtgaaaaatacatatgttggtttaagttcaggcggtgcccatattggacatccaaattttggtaaccagcaaccaagtgacgaatgccttaaaagaaaatctgaatctctatctggttcagaagcaaggggtcattcagctgcattggtgcaacctgctctaggaaatcataatgggagtggaggtgcacacaagggccttcggatggctaacgttgtacatcgattcaagagcttagttgaatctttggaaattggtgttgtgctatctgggaggttgtggtcctcaagccaagcaatcttcccaaaagggttcaggagcagagtaaaatacttcagcatcgtggatccaacacaaatggcatactacatatctgaaatattagacgccggaccacagggacctctgtttatggtgactctggaaaactgtccaggcgaactttttatcaacgtctctcctgccaagtgctggagcatggtccgtgagaggctgaatatggaaatacggaggcaactcagtacgggaagagctaatcttcctgcactacagccaccgggatcagttgatggttttgaaatgttcgggttgctgtcaccggcaatagttcaggcaatcgaggcacgggatagagatcgcatctgcacagagtactggagatccaggcctcatgttgtcactgaagatcgtgcgacggcgccacctcaggctcagggtcctctgcatgcgctgaggggtctattccagcgagccaaccgcaatgagctgctagccctacggagtctactggtgagcaacatcagcccggacgacttctccaggcggcaggctacccaaatcctcgacgaggagatcgccaagcagtggcgctgacaggcgtaaatacaactctgtaatctcttgatggcatgacgggaccaagcagttttcgaccctgacgagagagcggctccttccgttgccccccgtgcccattctttgtattgttgtgtccatgctccatgccataagatcttgtccccatttggatgcgatcgaatgaccgacgacggctcatcaactgaccagcgtacataccgtctgtctggaaactcttgtggtgttgtaggtttagttatttttcttttaaacgaaatatttaaccttcttttttagtgaggctgaaacgcaggctcatgagacctgagttttttacatgaaaggttgtgtacatcagaaatgtgcagggcctgttgacactactagcagataggcgtgatttttgtgccgagttggtcagagtcgaacagtccatgtgcttcaggtactcatcctgcatggttgactgggagttggtacttgcaagctgctgttacagaccagtaaaaaaaaaaaaaaaaaaaaa

SEQ ID NO: 15746 - DNA, 3544 bp, Zea mays
  misc_feature (3206)..(3206): n is a, c, g, or t
aattcggcacgaggataaatctcccagcgccgcccccccccgccgcccggtatctcccggctcccgtccccatcgagcgctcccctcgctgcccgggtctcccccaccctttcgcttcgccgcctccggggttctccgcgccgtgcattgattctaatgggaaagttcgcataactgaaactttgccgtggatcttgtgaattttagtgggaatttgatcgtggaaagtttatgaagttttgttgggattatggatgcataagatagtggtgtatgtgatttgcccatagtttctgcagcctcattgttttccatttgggatcaataaaacttcatgctcatggatagggctgatacatcaggttttgtcagtggtggtatacattacatgaacatccatgtgtattttcattttgtgtatactatgtgcttcctcagtggtgaagttgtaaagctggagttctgatctctgttggttggattaagtatctggtctctggataacatataaatttcttcctatcataatcctaccttatttataataagcaggatggaccttaataggacaaatctttggtttcatggaaaggaacatatagctactgcttcattctcccaggcccaaccatctgccataaattgcaggaatgaagaactatctatgtcagccgtgaacttgggttacattaggagctcagaaatagcacagaactctagaaaatcatttcagcatggcgatcaaagtttgaccgctccagatgatagctgcaggctggcccttggacttgggccaacaccaaatctatattctgctgatagtcactcatttggtggaaacaaagcttatcaatcagcaactttgctcagtcaacattgtgccacaaccgatcctggtttaatgttgggtctttcaagatgtagctcaagaaatttgcaatctacaagggcgagtggcagcaagaattattcacctgcaaggaagactggtatcatcttaccacttattgatgagggatcaacttcagcaaaaaggaaaaaaggtggctatttgctaccacttctgtttgtgccaagatcagaagatctttgtcttaatggaacatctacagacaccgatgcccaacaacatattggaactgaatgtgatactgaaagcggtcataatagatctctgaatcttcacgagattcagcctagcgctgatctatccattacagctggttgttcttttgctgcaacttctgatgtagtagccgatacaagtgatgagcagaggagtcatcagcgccatccaaagaaatgcaggttcaatggttgctcgaaaggtgcaagggatgcatcaggactttgcatttctcatggcggtggccagaggtgccagaagcctggttgcaacaaaggtgctgagagtcgaacggctttctgcaaagctcatggaggagggagacgctgccaggagctaggctgcaccaaaagcgccgaagggaagacagagttctgtattgctcatggtggtgggcgccggtgtgggattgaggaatgcccaagagcggcaagggggaagtctggattctgcataaaacatggtggagggaaaaggtgcaggatagagggctgcactcgtagtgctgaaggccatcctgggttgtgcatctcacatggaggtggtcgccggtgccagtacccaaactgtgataagggggcccaaggaagcaccatcttttgcaagtcccatggtggaggcaagaggtgcatgtttgatggctgtaccagaggagcagagggcagcacgtccttctgcaaagggcatggtggcggtaagaggtgcctctttgagggaggtgggatgtgcccaaagagcgtccatggtggaaccagcttctgtgttgcgcatggagggggcaaacgctgctctgttcccgggtgcaccaagagtgcccgcggtcgctctgattgctgtgtgaagcacggtggtggcaagcgttgcaggttcgatgggtgtgacaagagcgcacaggggagcactgacttctgcaaggctcatggagggggcaagcgatgcgcttggagcaccggctgcgacaagttcgctaggggaaggagtggcctatgcgcagcgcatacgaccctgatggcttccaaggtagtgcaccatcctggacatgcacgaagcatggtcgggccttgccacttcagcggcggcgtctctggttcgtcagcagctgatagcaacatggatcatgccatctcgtcatccggccatggcgcatggtcagactgcgtcgactcgtcgagagacatgcagagcgccggcaggctcctaataccacgtcaggtgcttgtccctggttcactgaaggacgctccttcgtgtggtctagcaggcaacggccaggacgacggagggagccggaaccagagctgtgggctcgtggtgcctgagggaagggttcacggtggagggctgatgtccatgcttggagttggaggcaacctgggaagcaatcctgatggttcgaaagcctgaaataccaaggatgagacgtagaagcacataatttaggttattttgcatgcctctgttatgattcttgcaatggaacatatacatgaatcttcaaatggccattgtgtaactatagtgcttgccaattggccattgtagtatttgctatgtacaagagtggttttggcatctagtcaatgttgtgcatagagctgagaactgcatagttacttgggttcagaaattatgcggaagcttgtaagttgtttcactccgaatttttgcaaacctgtttgctgaaatatttagtccatcccgcccgcggcgggccccggctcccaaatcagtgggactgtgggattcactgtgatctacttttaaaccggtaatggagatttattcaaaatgcagaaaaaggggtaatgtgaaattttggaagtttgaacacatacgaagtattccctcctttctgggtatagaaaaaattatatatgtagaaaatcatacatgtcttatagctaaataaagagaataatttgttttcaaaattttcacaaattatgttgtttccaaaggcttcatattaaatttgtgtcattattggtccctttggacttgctttggccatcattcctcaccaaacactgctggtagaaaaaccttttgcttggccaacttgcctcatgttgccgttttncacgatcagcattattggctttctaagagcatctccaagagctctccataaaacgactcctcaaaatcagttttaagggacatctaaataataagtgggggtaaattttaatcctttctccaacagatcccttaaagcagcagtttgtttctggggagcccaaaaaaaccctcatttgtagctacaaatgagggagttttaagggctatgaaaaagttgggggcgctttaggggaactgttggagacatgtttttgtgtttttccccaaaaaatagatttaggggagacttctggggagcttttggagatgctattaggtatttggccagccaggtaa

SEQ ID NO: 15747 - DNA, 2559 bp, Zea mays
gtgtggaacgacgttggggtagaattttgttggacatgtatcgggatttttttaaccaagtcagaaattcgtccctaggggatcgaacctggaagttggatgtgctactcagaagcctttaaccacggctagaggccctttcacatttttttattcttaagagtgatggtgtttgaggtcttagactttctatttactgaagttctttcttaacagaaatgatacaggaattgctgcagtggaaccccactcttgtgaaagaagttgatgactcgggcagtactccttttcactacatcgcttctgttggaaatatttccgcaatgaagctcttattgcgccgtgacagttctccagcatatagctcagattcaaacggtttatttcctgtacatattgctgctaagatgggctacggtcaattcatctacgagctctgtagattttgcccagattgtgacgaattgcttgacagtagaggaagaaatttccttcatactgctattgagcataagaaatggaaagttgtctggcgtttctctggtactgcagatcttggaaggatggcaaatgtcatggattcagaaggcaacacacctctgcatcttgcaatcaagaatgcagaccagatgatagtgagccttcttatggcaacaaatagtgtgctgccgaatatagtgaacaaccagggcctcaccgccttagatcttgctgtactggcaactgacaaaggcataagttatacactggtaagcttcaccgaatcacctaggactgcattcttctttgcatcttttaattcatgttctcgttcgatttgaattgtatttcagttcagtttttaacttgtatagtttgatttcctgaaatgttgattttcttctggtagaatcctcaggtcatcatactccgctgtttggcatggactggagctgtccttagtcctcgtcgccttgatcatttcatcgatgattttggcattggcaaaccttcaggaaacgagctcaagaaattcacccaacattgcacagaacttaattgttggtttccgtccttgtttcaacggtcacgtttgcagcagttttcactcttcctggcggctacatatcggaggggcatccacacgccggtgcaccaattctgtcacacaggtacaccttcaaggcgttcgtgatggcaaacaccctcgcatttgtcggctccaccttgtccaccatctggctcacctatgctgggtcggaacacgtccacccactgcttcgtgcaatctacatgttcctctccgtaatttcgatggagcaggcaacaagaagtatggttataggattcgcattgggtgcgtatgtcgttctgagcccagtcagcgagcggattgccattgtggtctgcatgtccaccttcatgacgctcttgcttcgcaacccttctagctggcagctgtggttcctgttcatgccgattaagaggcgattgggatggaaaggagcttttaagacccacttgcctccggaaacaaggagccgccttacaattggtgttggctccaattttgcttgccagttccttcggaggatgctcggtatgttatttacgtacagctttatctttctgttagcattgctatgatgagaaacaatatagtgtgcctcggtgtaatattcatgttccttggagctgtatgttttgtacttttgtatataaatagttcaagttccacgaatggttgctttattcctgaactcagatattttaatcatctaatgcgatggtggaattaaaaaattcaaaattctgcgagtggttgccttttggttgtaaagattaggtaatggttgggagagctttaacagctcaagatccacgaaaacagctttaggtttgcatttttcaagtcatgtctcacctctatgaaatctaagtcatgtcctcacctctatgaaattcaaatttaccaaaaattcagatctgaatgactatggatttcaatatatgctctagagttaacaaaaaatctttgccaatgccacttattatacaaagtaacggttcgttctattttcttctcgcttctttatgatccaaaaattcagatctggaggcccatagatttcgttacacagaagtaacgatctgttctttcttttctcgcttatttcccatcgctatgagcccatctccactagctatactgccccgatctcgctacgacgtgccgtcctcccttctatttctatggatgtggcgctgtcgtgcgaacatcgccactccccagcgtccctcccttattaccgaccgctctgtcgtgcaggctcacgctcttcccctgtcatgaatctaggaatctggcaagcggaagcagaatgtggcaaaaatataactaaaaacaagacacggaagttctgttttgtggatgttctaggcaattaaagaaagttttcctttttcttatttattttactctagttgtttttttatgttttcctttttttgttttatattcatttttttactttcacttatttacattggacatacgaaacacaagaatgccatcggaat

SEQ ID NO: 15748 - DNA, 2177 bp, Zea mays
cattgggtacctcgaccgccggccgggccggaccgaaaaaccccccacttgagccatcatcccaagtccaacctacccccatcagcatcacgcattcacgcgcccgccccagcgccgtcatcggtcgccatccctgcatcgaccgcaccgcatcgcaccgtctccgccgccatgcgccgcttcgcagccgacagggcgcgccgcgcggtggccgcgtctctgcacggtgcagcgtccagatcagcagcgccgtcgcctcacgctccggcgccacgtcatccagcctccccggtgggggcggcggcgatggcggccgccatggtgaggaccatgtccacgacggccgcgggcacgcccccagtgtcggtcgccaccatcaaccccaaggtcttgaagtgtgaatatgcagttcgaggagagattgttacacatgctcagaacttacaacaagaattgcagaaaaatccagaatcacttcctttcgacgagatactctactgtaatattggaaatccccaatcacttggacaacaaccagttacctatttcagagaagttctctctctatgtgatcatccagctctcctggacaaaagtgaaactcatgctttgtacagttcagatgctatagagagagcatggcaaattctagagaagataccaggtagagcgacaggagcatatagccatagtcagggtataaaaggtttacgtgatgaaattgctgctggaattgctgcccgtgatgggtttcatgcaagcggagataacatctttctaacagatggagcaagcccagcagtgcacatgatgatgcagttgttgataagttctgagagcgatggcattctctgccctattccacagtacccactgtactctgcatcgattgctcttcacggtggttcccttgttccttatttccttaatgaagagacagggtggggactcgatgttgatgagctgaagaaacaactggaggaggctcgatctaagggcatcactgtcagggcgcttgtggtcataaatccaggaaatccaacaggacaggttcttgttgaggaaaaccaaaagaaaattgtcgaattctgcaagaatgaaggacttgttcttctcgcagatgaggtttaccaggaaaatatatatgttgaagataagccattccactcattcaaaaaaattgcacggtcactgggatacactgatgatgatcttcctttggtatcattccagtcagtttctaaaggctactacggagaatgtggaaaacgaggcggttatatggagataactggattcagtcctgaagtacgggaacaaatttacaaggtggcatcagtaaacctgtgctccaatgtttcggggcaaattcttgctagccttgtaatgaacccaccaaaggctggggatgaatcctttgaatccttcatgtcagagagggatggtatcctttcatcgttggctcggcgtgcaaaggctttggaagaagcattcaacagtttagaaggaattacatgcaacaaagccgaaggtgcaatgtatctgttcccacgccttcatttaccccagaaggcaattggagctgcccaagcagtcggcactgcgccagatgcatactacgcaaaacgcctactggaagccactggaatcgtcgtcgtccccggttctgggtttggacaggtccctggaacgtggcacttcaggtgcacgatactgccgcaggaggacaagatacctgcgatagtatccaggctcaaggagttccacgagaagttcatggatgaattccgtgattgagctgagtatccatcgccctggcgtgatttttatctgttcaaaataataatgctgccaattggttgcccccgctccctcgtcgtcccatggatgctacagccaaacaccatcccaaattgtgttacaggcagatccctatcgaaaaacctacagaatctcgggcactgcaatgccatggttctgtttgccttgtgagaagtgtatcaggctaggctctgagccctgatgtgtacaaacatacccgaactttgaggccaagttgagttgtctcggcgcatgctgaaactctgctcgccttgtgttgcggagaatctttgctgtccaggttgataaaaaaaaaaacccccccccctgctctgcttctgctcgtttgacatcgc

SEQ ID NO: 15749 - DNA, 823 bp, Zea mays
cctgtgctccaatgtttcggggcaaattcttgctagccttgtaatgaacccaccaaaggctggggatgaatcctttgaatccttcatgtcagagaaggatggtatcctttcatcgttggctcggcgtgcaaaggctttggaagaagcattcaacagtttagaaggaattacatgcaacaaagccgaaggtgcaatgtatctgttcccacgccttcatttaccccagaaggcaattggagcagcccaagcagtcggcactgcgccagatgcatactacgcaaaacgcctactggaagccactggaatcgtcgtcgtccccggttctgggtttggacaggtccctggaacgtggcacttcaggtgcacgatactgccgcaggaggacaagatacctgcgatagtatccaggctcaaggagttccacgagaagttcatggatgaattccgtgattgagctgagtatccatcgccctggcgtgatttttatctgttcgaaataataaggctgccaattggttggccccccctccctccctcgtcgtcctatggatgctacagccaaacaccctcccaaattgtgttacaggcagattcctatcgaaaaacctacagaatctcgggcactgcagtctgcaatgccatgcttctgtttgccttgtgagaagtgtatcaggctaggctctgagccctgatgtgtacaaacatacccgaactttgaggccaagttgagttgtctcggcgcatgctgaaactctgctcgccttgtgttgcggagaatccctgctgcccaggttgatatgttcgctgactgggctgaatgctc

SEQ ID NO: 15750 - DNA, 999 bp, Zea mays
aacgaatgcgtagtcgtggaactcctcccggcctcctgggtatggaagcgacggcgcgacgcgcgattcagagtagcgacgacggcgacgcatggtccctcccgccacccgccaccatcgtcgacagcgaccttttccccgattgtacctgcaccggttagagttggagaagaccaacccccgccgtcttgggacccggtaccatccccgagagttaacatgtttggaaggggttctccaagaatcaacatgctcttatcaaaaagtgcaacaaagaagccttctcctaaagctggtgatccaaaaaagcatggaggttctccaaaagagaaattaagagccgcttggaactcaactctagagaaaactcttgtggacctcttgcatgagcacaaaacagctgattataggggtcaaaatggatggacaacagaagcatggaacaaaattgtcaaggaatttcatcagagggaacaatatgtctatttcacaaagacacaaatacaagataaggaaagagagttgaaaagggactataggttgctaaaggatgcaaagaatcaaagtggagctcattttgatgagaagacagggaggattacggctgacccagctttatggaaaaatatactgacttctcatcctaaggctaaaaagttccgcaacaagtcttttcctctatatgaggccttgggggagctttatgatggttagtctcgttacaatgtccttgctttccaatatgttatgttgtctacccttttttagtaaaactttattgtgcagggcaaacagctgaagggacctacaactacacctccacccaacttccagatcttactcaagtaggaaatggagatgagtttgtcaacatagaacatgaacaagatgaagtgaaagaaaccttgccggcgcatgaagaagatgatgtccacgtagttgaggcaggagatgcaaacagtgaaaggcatgatctggtgccgcagaaaaagactactg

SEQ ID NO: 15751 - DNA, 2877 bp, Zea mays
  misc_feature (252)..(252): n is a, c, g, or t
gtattgttgcttctgcaaggctctaaatttttctacagtatattctccctatttttatctagccacaggttgtctgtttatgcacgtcaagtcatgctatgttgtttatttgtgacgtgcatttctcttttaatatgaaaatagtacttcagttccacttattcaaaaatattactaatttgaatattctaccttttctttgtagattgtacctgcgccggttagagttggagaagaccaacccccaccgtnttgggacccggtaccatccccgagaggtactttttgggacctggtacccccattttttgcaatgattatggggttaatggagcgcattaggaagaggagacaggaggatgatgatgatatgatgatgttattccttcctgcattacatttgctgcattctagttctcttaaagggaggagagttaagaaacgacgacacacatccaagctaagtggcgaggagcatgttttagagttgcttgaagggcatgtcaagaactgccgagtagcattcagaatggaacctggaatttttagagccctagccagctatcttaggaaggaaaggttggtacgtgacacaaggataaaagttgaggagaagctcgccttctttctatacatgataagccataacgcttcatttgaggatctgcaagaagagttcgggcatagtagtgacacattccaccatcatataaaacatttttttgacatagttgtcccttccctcgccaaacgatttttgaagcctccttctccaattcaagtacattcaaaaattgaaaggaatcctaggttctatccttacttcaaggtgatggcatttctatccttgcccaatatctattcattttcttccagattttaaaaattcacatatagttttcttgtgcagaactgcatcggtgcaattgatgggactcatgtgcccattacaatttcacctgaccaagctgctccttttagaaacaggaaggggactctcagccaaaacgtgatggtagcttgtgattttcgacctaaatatcactttcatgtctactgggtgggagggatccgctacagatgctagagttcttcgatctgcaatgaacaatggattccatgtacctccaggaaagttctatttggttgatggtgggtatgctaacaccacgtcattccttgcgccttatcgtggagttagataccatctaaaggagtatgggcaaggtcaccgtagacctcagaactacaaggagttatttaaccatcgccatgccatactgaggaatcatgttgaaaggactttgggggttgtgaagaagcgctttcccatcctaaaagctgccacatttcacaaaataaggaatcaagtgaagataccagtagcagctgttgtacttcacaatattatccgatcactcaaaggggatgggaatggttagataatcaaccagataatatctcgccacaaaactttgttgatctaccggatggcgatcaaggcaacgatcaagtaactgtcaaggcaataatcttagagatgcaatagcacaagaaatgtggaatgattaccaagagcatagaaattagtggcacatttgtctaaaaaattggcacatctattagccctcatgtattctggtttagtttggaatagaccatatgttgctctgtttgctacattttatttactgtcacattgttacctctcttagctctcattaatatcagctaactgttttcataataaaaattttctttgttcctttagttccaatttcagaatagaaatttcagctaactgttttcagcatagaaatttggtttaatattgtgttatataatatcagttaacatgtttggaaggggctctccaagaatcaacatgctcttatcaaaaagtgcaacaaagatgccttctcctaaagctggtgatccaagaaaacatggagcttctccaaaaggtatgcaagtagacaaattaagagaaattaagagcctcttggaattctacagctaatgtttcttccttgtcttgtgtagagaaattaagagccgcttggaactcaactctagagaagactcttgtggacctcttgcatgagcacaaaacagctgattataggggtcaaaatggatggacaacataagcatggaacaaaattgtcaaagaatttcatcagagggaacaatatgtctatttcacaaagacacaaatacaagataaagaaagagaactgaaagggactataagttgctaaaagatagcaaataatcaaagtggagctcatgttgatgagaagatagggaggattatggctaacccagatttatgagaaaaaatatactgacttctcatcctaaagctacaaagttccgcaacaagtcttttcctttatatgaggccttggggagcttttatgatggttagtctcattatagtgtacatgctgccggccgataaatgattagtctcattacaatcagctatgacttgagcgccgatcaactaaaaatgcctcaccgcaggtgtgtgtgatgtcggcatggattaaccgaacagtaaaaatgggccatgtattaaatcctagttgtaattgaaacatacatggtttaggtaacatgagatggattcactcaatcccgccctgtattagatcccattgtgtaataaatacagcctaccgaacaagacctcagtgatcgcggttttacttaacgtgcatgctgacggccggtaaccatccaaaccaagaggaaaccagaacacacatataaatatgcattaaaccaaacaaacaaagctacatgtgtctgtgcaactttggtactgaatcctatcagccagagatcagacaatgaagtgtacgcatgcag

SEQ ID NO: 15752 - DNA, 1245 bp, Zea mays
ttttttttttttttttttcctcggtaaggacctgtcctgttggatttcctggatttatgacaacaagacaggtccttaccgaggaaaaccagaagaaaattgttgaattctgcaagaatgaaaggctcgttcttctcgcggatgagcgtttaccaagaaaacatatatgtcgaagacaagcaattccactcgttcattttaatcgcacggtcgctgggatacactgatgacgaccttcctttggtatcgttccagtcgatttctaaaggctactatggagaatgtggaaagcgaggtggctacatggagataactgggttcagtcctcaagtacgggaccaaatctacaagatggcatcgataaatctgtgctccaatatcaccggccaaattcttgctagccttgtcatgaacccaccaaaggctggggatgaatccttcgaatccttcaggttagagagggatggtatcctttcatcgttgggtcgccgtgcacaggctttggaagaagcattcaacagtttagaaggtattacatgcaataaagccgaaggcgcgatgtatctgttcccacgccttcacttaccccggaaggcgattggagctgcccaagcagccggcactgccccagatgcttactacgctaaacgcctgctagaggccactgggatcgtcttcgtccctggttctggttttggacaggtccccggaacatggcacatcagatccacgatactgccgcaggaggacaaaatacctgggatagtatctaggttcaaggagtttcacgacaagttcatggatgaattccgtgattattgagtgtccatctcagttcagtcattgcatgaattctgccaagagggcatcctgtcattttgtcgcgatcggcaccgtctgcccgagttccagccacggtcggtcggtcggtaccgactagctagctagcggtggatccgtggatgaccaccgatgaaccgttcggtatagaccatctctgctgccacgtgtgtcgtcttttcattagtccacattatttcgatgtccaaaatattttaagaacctaaggaaatatttatgaatcatgtaacatttatatttacatattatattttttatgtttgtgtcaattttatttatgatgtacaaactatgtaatttgtatttctatttatgaactatataattttatttgttcaattaaaaaaaaaaaaaaagaaactcgagggggggcccggtaaaact

SEQ ID NO: 15753 - DNA, 2190 bp, Zea mays
cctcgaggccggccgggccgggaatacctacggggtactgctacctcaacgagcgtatctgcttttttttttggtaaaagaatttgtttttgcaaagctagctcctacgctgccgccgccatgcaccgcttcgccgccgacagggcgcgccgcgcggtggccgcgtccctgcgcggcgcagcttccagagcagcagcagcgccgtcgcgtcacgctccggcgcctcgccatccaacctccccagtcggggcggcggcgccggttgctgccgccgccatggcgagggccgccatgtccacggcggtcgcgggcgtgccaccaccggtgtcgctcgacaccatcagccccaaggtgccgccagtgtcgctcgacaccatcaaccccaaggtcttgaagtgtcaatttgcagtccggggagagattgtcacacgtgctcagaaactgcaacaagaactgcagagaaatccagagtcgcttccttttgatgagatactctactgtaacattggaaatccccattccattggccaacagccagttacctatttcagagaagttctatctttatgtgagaatccagctctcctggacaaaagtgaaacgcatgctttatacaggtcagatgctatagagagagcacggaaaattctagacaagataccaggaagagctacaggagcatatagccacagtcagggtataaaaggtttacgtgatgaaattgctgccggaattgctgcccgtgatgggtttcatgcaagcgcagataacatcttcctaacggatggagcaagcccagcggtacacatgattctgcagttattgataaggtccgagaaggatggcattctttgtcctattccacagtacccattgtactctgcatcaattgctcttcatggtggttcccttgttccttatttccttgatgaagagacagggtgggcacttgaggttgatgagctcaagaaacaacttgaggaggctcgatctaagggcatcagtgtcagggcgcttgttgtcataaatccaggaaatccaacaggacaggtccttaccgaggaaaaccagaagaaaattgttgagttctgcaagaatgaaaggctcgttcttctcgcggatgaggtttaccaagaagccggccgggtcccggacaagcaattccactcgttcaaaaaaatcgcacggtcgctgggatacactgatgacgaccttcctttggtatcgttccagtcgatttctaaaggctactatggagaatgtggaaagcgaggtggttacatggagataactgggttcagtcctcaagtacgggaccaaatctacaagatggcatcgataaatctgtgctccaatatcaccggccaaattcttgctagccttgtcatgaacccaccaaaggctggggatgaatccttcgaatccttcaggttagagagggatggtatcctttcatcgttgggtcgccgtgcaaaggctttggaagaagcattcaacagtttagaaggtattacatgcaataaagccgaaggcgcgatgtatctgttcccacgccttcacttaccccagaaggcgattggagctgcccaagcagccggcactgccccagatgcttactacgctaaacgcctactagaggccactgggatcgtcttcgtccctggttctggttttggacaggtccccggaacatggcacatcagatccacgatactgccgcaggaggacaaaatacctgggatagtatctaggttcaaggagtttcacgacaagttcatggatgaattccgtgattattgagtgtccatctcagttcagtcattgcatgaattctgccaagataaaaaaggcatccggcccctttgtcgcgatcggcaccgtctgcccgagttccagccacggtcggtcggtcggtcggtactcggtaccgactagctagctagccggggggataaccccccgatgaaccgttcgggtatagaccatctctgctgccacgatgtgtcgtcttttcattagtccccattatttcaatgtccaaaatattttaagaacctaagaaaatatttatgaatcatgtaacatttatatttacatattatattttttaatgtttatgtcaattttatttatgatgtacaaactatgtaatttgtatttcttttatgaactatataattttgtttgttc

SEQ ID NO: 15754 - DNA, 1279 bp, Zea mays
ccggccgggatccaacgggcccgccgcgaagaatcttctctcttgacaaggagcaagcctaatcccagaaccccacggtcgtgagaccctagctgccgtcgccgccgccgccgccgccggtgaccggcgacggcgatctagatgggggcgtcggcctccgtgctctcgttcccaacggccgccgcgttcccagcagccgccaccgccgtcgccggggccgccggctgcttcgcgctcggctacctcctggccttcacccgcctcccgcgccacgccgccggcccaggttcgggagggacctccgatgacgattccgaggatgactcggaagaagatgatgacgaaaactccggccgcagtcgcgcggcgaagcgggcgggagggcagaagagggccgggctccggctgctctactgggcacggaacgtggtgaccaagtccgactctgccagggaggcggaaaggtcccggtctcaggccgcggccagtcccctggagatcgagaaccttgctgagataatagaagatttcaaaatggtgttggttgtgaggaatgatctgaagatggggaaggggaagattgccgcacagtgcagtcatgcaactcttgggctattcaaaaaactccaacagagagctccaaaatcactaagaaggtgggagcggtgtgggcaagttaaagtggttgtgaaaatagaaagcgaggaagacatgctagttttacaagggagagcaaagtctttaaatctgccaactcacataaccatagacgctggaagaacacagattgctccaaattcaaggacagtcatggctattctggggccagctgatatggttgatgatgttactggcggtctgaagcttttgtagaaaaccaccttgtcagcattttcaacttgggtcttcatagagcagtgctgggactttgcaggccacagtggtctctgcacttgtactgatgtgcggcagaagaatgaaccttggccccgttggttgacctgagtttcttgtccatgaatttatttggaaggagagcttgcattcttttttcacttgtaccgaccgttatctttggagttgtgatgttagcagttcgaattctggtgttgacaacttatagaccatcatttcttctgtaacatagataagaaaatactatttgactattgtccatttccccttttttattttctttttaataattcgtgcagtagtggacacaatactgagttgctttggagaagtcatcttgattgcggcagtgcaccgggaatca

SEQ ID NO: 15755 - DNA, 2033 bp, Zea mays
cattgggacctcgcgccggccggcgcccctcagcccgaacccaaacactctccgtccgtccctcctctcctgttccctccccgagtcgatatctcaccgtcgtgcgagtaaaacaaagcctcgccgccacggcgccacgcgagcaaagacctagcgcgagcaagcaagggaggcagagaccttagtgcgtcgcgcaacgcggctcggcccgacggcatggagagcctcgtcctcgcctcctcctgctccccgtccccacggctgccgctactctccccctccgcccgcttccgccggctgcccggctccatgccacaggcgccggcgtccaccagcggtgccacgcggaaaggtcccaggaggcacatgctcttcgtcgccgccgccaccgcggctccttccggatccaggaacgttttcaaggaattgagagcaaaaggctttgcaagcatgtcatcttcgactggcaatgagaatatgtctactgaaactggcaccctgcctcccatgcctcccccatcatcatacattggttcgcctgttttctggattggagttggtgtagcattgtctgtggcgtttaccacggtttcttccatgctaaagaaatatgccatggaacaagcatttaagtcaatgatgacccaagcaccaccaaactcatttggctccaactcgcctttcccatttggcatgccaccacaggcatctcctactgcaccaagcagtttttcgtacttggaaccaaggaaaggtacctccccacaggtgtcaactgttgatgtctcagctaccgaagtggatgccgctggaacatcgaaagaggtggatgtgactgagacaccaaaaccttctaagaaatttgcatttgttgatgtttctcccgaagatttgcagcaaaaggacctccaatcttcactggagatggtagatgtaaaacatgatagtatagaaagtgaaagtaaggaggatactgaggaaaaggctcccacaaatggagcgacttttaagctgaatgaggatgctgctcgtgggccaactgaatccagtcaatcaggacctatgctatctgttgagacaattgagaagatgatggaagatccagctgtgcagaagatggtttatccctacttgcctgaagagatgaggaacccagattcgttcaagtggatgctgcagaatccaatgtaccggcaacaactacaggatatgctaaagaacatgggtggatctcctgatcaatgggataaccgtatgctcgatcacctgaagaactttgaccttagcagtccagaagtgcggcagcagtttgcgcaagttggcatgactcccgaggaagtggtatcgaaaataatggcaaacccagatgtagctgtcgcattccagaacccaaaaatacagacagccatcatggactgctcgcagaaccctcttaacattgtaaagtaccaaaacgacaaggaggtcatggatgttttcatgaagatatcacagatctttccccaaatcaacggctagctggtcttcactgcgggattgcagtcttgattttttttgtcggcctatcatcccctgtgtctggagggcctgctgcggtaaccatctttgaaggaaaagggaacacctgttgctgttgggccgtgacgctctggataaaccctccctgtgtcgagctttttgagtttcatatgtagtagtacatcgtgtgatgtagcggccttggtctagctatgagtatgattgacccaccctcttcccgcttcataaagtcaggctagtgagcgtagcaggggcaaatatttgttatttacattgcatgggcagccagccggtctgcgctctgacgttgcatggtttatctcgtaggatgtgaaaggcgcagcagacagacatggttcgtatcagatcaattttgatatatactaattgctattgttagtgtgtaatacgtcagtgacacaatggcaatgcaagtaatctgtttcgagactgaaaaaaaaaaaaaaaagcggcccccgggccccactgagaaa

SEQ ID NO: 15756 - DNA, 1968 bp, Zea mays
gtaccactcgcggcctgccgggattcgtcaattgtcatcccatgatcccatccaaaaactccccgtctctactccctactggcctcctcccacgagtcggataccgaacctcggcggcgtcggcgccacgcgagcaaaaaccctagtgcgagcaagcgagaggcagagacctcagtgcctcgagcaacgcgcgcccggcccgacggcatggagagcctcatcctcgcctcctcctgctccgcgtccccacggctcccgctactctcctccgccgcccgcttccgcgggctgcccgtttccgtgccgccgccgtcttcggcgtccatcagcggtgccgcgaggaaagggccgatgaggcccaggctcttcgttgccgcggcggcggctcctcgcggctccggaaacgttttcgagggattgagagcaaaaggctttgcaagcatgtcatcttcgactggcaatgagaatatgtctactggaactggtacactacctcccatgccacccacatcatcatatattggttcacctgttttctggattggagttggtgtagcattgtctgtggcgtttaccacggtctcttccatgttaaagagatatgccatgcaacaagcatttaagtcaatgatgacccagtcagcaccaaactcatttggctccaactcgcctttcccatttagcatgccgccacaggcatctcctactgctccaagcacttacccgtacttggaaccaaagaaagatacttccccgcatgtgtcaactgttgatgtctcagctaatgaagtggaagccactggaacatcgaaagaggtggatgttactgaaacgccaaaaccttcaaagaagtttgcatttgttgatgtttctcccgaagagttgcagcaaaagaacctccaatcttcaccggagatggtagatgtaaaacatgatagtacatacagtgaaagtaaggaggatactgaggaacaagttcccacaattagtacaaacactgaaagtaaggaggatactgaggaaaaagttcccacaaatggagcatcttttaagctgaacgaaggtgctgctcatgggccaactgaatctaataactcggcatctatgctatccgttgagacaattgagaaaatgatggaaggatccagctgtgcagaagatggtgtatccctacttgcctgaagagatgcggaacccaaattcattcaagtggatgctgcagaatccaatgtaccgccaacaactacaggatatgctaaataacatgggcgcaactcctgatcaatgggataaccgcatgcttgatcaccttaagaacttcgaccttagcagtccagaagtgcggcagcagtttgcgcaagttggcatgactcctgaggaagtagtatcgaaaataatggcaaacccagatgtagctgttgcattccagaatccaaaaatacagacagccatcatggactgctcgcagaaccctcttaacattgtaaaataccaaaatgacaaggaggtcatggatgttttcatgaagatatcacaaatcttcccccaaattaacggctagctgatcttcgtcgtgggatagcacttctgatttttgtcggcccgtcatctccagtctggagggctgctgcggtagcatctatcaagaaaagggtcgtgacgctccgatataccctccccgtgtcaaggtttttgagtttcttatgtacatcatgtgatgtagcggccttggtttagctatgagtaattgagtatgacccttgccagttcattaagtcaggctattgacatagcagggtccaagtttttattaagccagccaatcagtggaaaggtgcagcagagacggttcgtatcagatcaattttgatatataattgttattattaatctgtaatatattagagacacaatggcaatgcaagtaatctgttacgacatttcctgaccataaaaaaaaaaaaaaaa

SEQ ID NO: 15757 - DNA, 2105 bp, Zea mays
ctgacctgaggaaggagatgctaggggtgggaagtcttggctgtacgcggtttgggctttgagatggcaaagctgataataggcatttacattctctttaatataaaatgtatactgattttatatttctatccgccttataaaaaattcttcataaaaaaatatagtacgtagtaaacaataaatatggctttgaaatcggagaacatttcggttctgtactacggccgttggaatcctctccgcccgtagatccgtccatgcgaatcagtattcacgccaccgacatggtggtggcagcagaccaaccaaaatggtcctgcagatgttttatgcattttcaccccaggattcatgcccagttgcacttgcacactgcagctagctagctagctgctgctcgtcgaccatggatatggaacctctgctctctacacacccattgcagctagaagaatgaactgctcgctctctctgagtcagcataaccaaacctggccacgcccttacgaatcaacaagatttgagttttgatgtacaccaccaggtcacatatcgaccttgttcatacttcatactaacaacggcagtaatcgatgaagtaataagcaaccgagcatgaccaagaaccaaaaaggcatggcgtctccatccaaagacaacagctgggtggccgagcaatctttaaaccaccccgccctaagcagccaaggcggcggccacggcgatagcggcggcggcggtcgcgagccaccgcgtgcggcacggggccgccgcgttcttcttgtagtccttcctctggtcggccggcgaggcgtcggcggcggccgggccaggcgcgtccgctccgcgccgccgctggtgccgcgtccgcttggcggacctaggcgccagcgccggcgccggcgcgggcgcaggggtcggcgcgtccgccacggggtcgaacagctccacgggctccagcaccgcgtccacggcgtagatggcgacggggtccctgtcgtagacggtggagcgcacgcgggccggcgcgtcggccgccggcgtccgcagcgtcacctggtcgcccgcgttctgcaccgtcaggttgtagttgctggcggcgccgtcggtggccagcgtgttcatgggcccgttgctggatttcaggccccgcagcgtgtagtacacgggcaccgcgtggaacagcagcagcgacgccttgccgtccgcgctcaggttccggtagctgggcatgaacccgcgcacggcctcgtccgtcgggcagaacgccgtcacgccgccgctcaccgccgactcgaacgccgacagagcgtcgggggacttgtccagcagcgacgcgaacgccttgcacccgcccttggacatgagcgccgtgatgttgggcgtcgccttcgccgcggtgccgccgccggcggcggcggccgaggctagcggcaggaggaagaggagcgctagcgcccccgcggtggtggtggcggcgccgagtggggagtggcacattgcggcgcgtgggagtgagcggcaggcagatggcagcggccgacactccagcagccgagagtgaaatgtcagtgtgaggactgaggtgatgggctggctttgtgattttacagaaagaaataccttcacacaaaccagacttgttgctcagctcatcgccacaaagaaaccaggctagaggaaggagacaaagaaatgaaagaggacgacaaaagacaggctgggagtacggccggagaagggagggaccagccagcagcacaggatacagctattgtatgaatattttgaatttcatgagcacaaacagataaccatttcctgatttctagcattgcttaagatctgcaggaatgttaccagagttcaaccactttgccaccgctccccaaattactctagagatagaacatttgagaaacatatgatccacagattccatatgatcacaaaaaacattaggaagcatctccattccggtttcttttgatcaagttatttttggttcaaagcacattattttctaagaaccacataaaattttttatcttaggaggtatcatggtttcgaaaaccagagaacaatgagatttgttcggctg

SEQ ID NO: 15758 - DNA, 3381 bp, Zea mays
tgagagtagtaagtagtatgcgcgcatgccatatgcgcgtcctgtgagggttgccattgcgtcttgctgaagcagaggtatccgcatttctttacgatctgtgatgtaatgtggtaataaactccaactggaggtggttgtgtttatgtgattgtgagcaaccgccatgcgccgctggtgagatttgccgtgtttggagcacgaggggagataaattgaaaattgagttttttaagctggtgtcttcggttttgctggtgtgctcatttttatcattagtcgtgttttttgttcagttttgttttgtccttctgttctatagcactaaaagggtaaaattgagtaaaaaaacacaactaaggataaaaataagcacatcagcgaaattgagggcaccctcttaaaaaaacctttcaagtggtttgagtcgtgcagccatcactctgtcacgtacctttctgaaatggaacgtgtaaaattgcaaataaccaagttcattatgttttagcgtaattgggcttttcctctgtagtatttttttcttcaagaggcttcatcagtacgcaacactcccagtaggctcactctgatgtccttgtctcccgattatactagtaaacaacacgggttcccgtggtctcctcagaaggcaactatgacccggaacccctacagttgacttgtcatggcttcgcgatctgtgactgtgatctatactataaggtgtacaagatctctttgtctactgtagttgcagcaccagcagcagcagcagaagagcagcgcctgagctccagcaataatggccgagaagggcgtgaaggtgttggggatgtgggcgagccccatggtgatcagggtggagtgggcgctgcggctgaagggcgtcgagtacgagtacgtcgacgaggacctcgccaacaagagcgccgacctgctccgccacaacccggtgaccaagaaggtgcccgtgctcgtccacgacggcaagccggtcgcggagtccaccatcatcgtggagtacatcgacgaggtctggaagggcggctaccccatcatgccgggcgacccctacgagcgcgcccaggcgaggttctgggccaggttcgcggaagacaaggtacgacgcgcgaactgcggtgcagccacatgatctacttactgacgcagggcagccggacgagccccgcgacgactgacttctctgtactctactctagtgcaacgctgctctgtacccgatcttcaccgcgaccggcgaggcgcagcgcaaggcggtgcacgaggcccagcagtgcctcaagaccctggagacggccttggaggggaagaagttcttcggcggcgacgccgtgggctacctcgacatcgtcgtcgggtggttcgcgcactggctccccgtcatcgaggaggtgaccggcgccagcgtcgtcacccacgaggagctgccgctgatgaaggcctggttcggtcggttcctcgcccttgacgtggtgaaggcggccctgcccgacagggacaggctcctcgccgccaacaaggcccgccgtgagcagctcctctccgcgtagatatggctagtaattctggagcagctagtttcaccgccgacgctcatatattgctgaataaggactggttgcacttttgcacgttgtgcagtgcagccgaggtttggatgacctctgcccctctgttccatttcagaatggtagtcccataataatgcatatacatcatgcataaccttcgtggcaccgcacggtgcgtcaaactgttggcctgttgcccaatcccagtagctgattttcttcaggcgtgcaaggtagcaacagaaagtaacacatagaaacagacatttcttcttttttttatattcgttcagattagatcagtcctgtactgggatcggcccacaaagtgcgccggtccagacttactgtccgaaccgaacgtggtactgccaaggtacatctacacaccatgcagcacagtattggccaacgtccaccgccgaacagaagagcacccacaccagaagcgacagctgcaggtgacgacgattcaggacgctatccacgtagcacacagcagcgatcacaatcacaacatatactgatatacacacaacggggaagatcgaagaggccaggccaaagtccgcagcagcatcacgggttcgcctgctgcagggcctccgcggctgcggcgccctcctccgtcctggtcttcctcttcttggccctggcctcgctccactcgccgtaggagtaggacgcgaggccccagagcgagagcaccagcgccacgcctttctcgctactgaacctctcgcgcaggaagatgacggccgccacctccgtcaccgggatgaacaccgcgatgaggatgcccgccagcagcgtgtgcacgcagaagatgacgcccaccgcgcccaggaagaagcactgccacagcaccgccgaccacgccagcaccgcgtagtaccgcgcctccccaagcttgtaccgcctcgcctcccgcgggatcgcctgcatgcatactttttttcatttatatttctccagcgtttccctttactgtgtgcacagtgcagtttgtgcatcatgcatgcggccatgaccttctttatccttgaaaaatatgtcatgtcatgcgccatacttttccaaatccaaaaaaaagaacacgtgttggtcgtgaacctgcattcttgttactatccctatcagagactatcagtagcgtgtgcgtatgtaaatcaatcagttttgtcccatgaagacgcaaagtttgaactgcaaagtgcgatactcggtgaaaaacgcttgcatctcccctgacttctcatctcacctcctattttaaacacactttataagcaataaacaatacagtttataatacaaaaccatgttttacacggctatatacatgttttatcggagacaacctaagtatttgaccagagcacaaccactcctcatcgagtcattgtccatgctttctaggggtggaaacggatcgagtatacttgccgggtaccgaatacggatagtataaatacatgttttttcagatacaaatttaggtatttttatattcgaggctgatatgggtaataaccggatagtgcagcttcggattcgaattggataagaaacaaagactaaattcacttccacttattgcgtgagttacacgtgaattcactctaagtatctaaattttaacataatcaatactccactttaacaattttatgtggggacttgaggttgtcttcttataaaatatttattagtcttaatactttatttgcaattttttgattgaacaagaaatattttatgaatatttatgataagtaaataatgcatt

SEQ ID NO: 15759 - DNA, 1060 bp, Zea mays
gtgactgtgatctatactatgaggtgggcatgtgggccccggcggcggtagttgtagttgcagcaccagcagcagaagagcagcgccagagctccagcaataatggccgagaagggcgtgaaggtgttggggatgtgggcgagccctatggtgatcagggtggagtgggcgctgcggctgaagggcgtcgagtacgagtacgtcgacgaggacctcgccaacaagagcgccgacctgctccgccacaacccggtgaccaagaaggtgcccgtgctcgtccacgacggcaagccggtcgcggagtccaccatcatcgtggagtacatcgacgaggtctggaagggcggctaccccatcatgccgggcgacccctacgagcgcgcccaggcgaggttctgggccaggttcgcggaagacaagtgcaacgctgctctgtacccgatcttcaccgcgaccggcgaggcgcagcgcaaggcggtgcacgaggcccagcagtgcctcaagaccctggagacggccttggaggggaagaagttcttcggcggcgacgccgtgggctacctcgacatcgtcgtcgggtggttcgcgcactggctccccgtcatcgaggaggtgaccggcgccagcgtcgtcacccacgaggagctgccgctgatgaaggcctggttcggtcggttcctcgcccttgacgtggtgaaggcggccctgcccgacagggacaggctcctcgccgccaacaaggcccgccgtgagcagctcctctccgcgtagatatggctagtaattctggagcagctagtttcaccgccgacgctcatatattgctgaataaggactggttgcacttttgcacgttgtgcagtgcagccgaggtttggatgacctctgcccctctgttccatttcagaatggtagtcccataataatgcatatacatcatgcataaaaaaaaaaaaaaaaaaaaaaacgtcaaactgttggcctgttgcccaatcccagtagctgattttcttcaaaaaaaaaaaaaaaaaaaaataaaaaaaaaaaaaaaaaagcggcc

SEQ ID NO: 15760 - DNA, 3922 bp, Zea mays
  misc_feature (367)..(367): n is a, c, g, or t
  misc_feature (410)..(410): n is a, c, g, or t
  misc_feature (1763)..(1763): n is a, c, g, or t
tgatgtcacaagtgtaatatatcaaaatataatgctcacatcgtaaatgaagagtataaaaccttattacaactcaaatggacaatagtgtcgtaaatagtatcttaacaaaacatagtggaatcacgggtaatctcccacatgaagatgaccgagacacgctagaactagaaaccatcaatgtcctcatcaattcttcatcttcacatccatctgatcaacaatattagcaagggtgagtacacttatggctggtattcagcaagtagggtgaaagtacatagctcgtaaggataggcttaggtttattgcggtcaatatttatttggtcaaattttattaacaacacctatttactaactataantataaccaaatccaattaagcataagcaatactcatatctcanaattgtttttaattaatagatttgagatgttacaatatattttgtgtacttcctccgtaaaaaatatagctataagttacgtattaattgatataatttatgtttaattaaattttggttaatagtatttatatttaagactctcaaatttattataaaatatatgtcataaataatctaataatatttataatatcataaattttgatatttttatttatatctagataaacttaacatactaaaacatattagaattgtattatactctctccatctctaaataaatatacttttacagttatgttaatttaatttttttaaactttgatcgaatttctaaaagaatgtgttaagatttacgacattaaattagtatcattagatatactataaaatatatttactttatagtacatatgttgtttcttttttgtatagagttagttaaaattgaaattgtttgacttgcatgaattatagaaattggcgatgatagagtatgttagaacgaaggaagtaaatctataaaccaagcagccatttgcccattttaagatgtcaactgaccgaatatatatatacttcctccgtcaaatagttgtcgtgtggtacttttatttaaatatctcaagatttaattagatttgtaaaaaaacatattagctatatttgtatctttaaataaacttattataaaaatatattcaaaattcattagtaacaacaaatgtatactataactgttaatatttttatatatctgataaacgattaaacccagtttattcaaatacatgtgtatggaattgttaatcatttcttacattgtcaaacatattattgtataaaaataaaattttgcataaatatttttatacagtatttgctgctacaataaaaaggtaaaaatatcataatatatatatatataatttaagagttatttttaattagattaatactgaaaaataaaaatacagtagaatctatatcatgttagtttgcaattaaagaaaaaggattaaaaaaatttattcgttttgcatccctgttcgcgagcacgggaatcacaggagcttggatggacctcgagaactgcaagttggtcagcagaatactccaatgtccaatcccaaaagccggtgggcggtggcgcccaaactagaaccatcctgtcctttcggattggccagctcgtgcggtgggcaagctgcactcctgcgctttgcgcgcgcggggtgctcgcagctcccggggcacgccacgtacgcgccctccatccaccacctgtgcgcgcggccgacgacgcttgggcgcgtgcgctgcgctggcggtgcgcgcacacgcgtngacgcctcacgcgcctccgcgcatgcaaagtcgaaggcgacctgctctgctgctcctctgcgccgcttcggcctcacgctagctcctcccccctgcgtcggcaggcaacggatagatacgcatcgaggcagagggcttggccgagatctccccactaccccgcagcgtctttaaaaccaggacctgcttgtttgattgtttcatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggtacgtaagaaaggccagtagtaatcacgcatcatgcatatactcatgcatcgatatgcatggcgcgcctctgatgcgcattgcgttgcattgcacgcaggcgtggccggcaacggcgcgacgttctacttcctggtgttcgccatcctggccggcgtggtgggcgcggcgtccaagctggcgggcgtgcaccacgtgcgcgcctggcgccacgacagcctggccaccaacgccgcgtcgtcgctcatcgcctgggccatcacggcgctcgccttcgggctggcctgcaaggagatccacatcggcggacaccgcggctggcgcctgcgcgtgctggaggccttcgtcatcatcctcgccttcacgcagctcctctacgtgctcatgctccacacgggcctcttcggcggcagcggtggctaccgggaccacgactacggcgtcggcggcgcggccggcgagcccaagggggtcaccagggtctgaggattctgatcgatgcagctcgtacatgtgtcatcatatcaggcgctgctggagtgtgatgacgtaataagtagtacccatatatatatatatggtgtgtgttgacgtaccacgtatactacgtacgtgtgtacctagtagctagctagtcagtccatcgtctgctcatctcgtcaggtcatcagatctctcggttctggtttgtacatcagtacgtgcatgcatgtatcccgtgtcaaatgtatttcgtcacccgtcagtttcagccggtcagtgaccaagtttatttcgtcacccctcagttcagtgacattggtgacatgaggtcgtggtgtcaacttttggctcaatgtattatgtacctgatcttttttacaggatttctatcggctcgtcacacttgatcgtacgtacaaatattcagttagtaacaccactgtttttaggatcgagccaataatatcagtacatccatcatccaagaacgtttgtcaggcggatccatagggcctaaaagtgaagcaatttagctccttaacgcaccagctaaatctccttaattaaggtgtgctagctagctaaactttagcaccctcttgaagtttaaatacatggtgactaaatgctaaatgtgaatgctaaactataacaccctatgtgcctaaatgtctaaatgccaatgctagtttagctttactaaactttagcaccctctaactttacaccctcctaaagtttactaaagtttagtacggaatccaaacccatacaagtgtgtacattaatgtctcgataaaatagatatacactagatagctatacacttcatctgtctcgtctcagaatataaggcatctgtctcgtaatcattttttttttgtttttgttctataatgtactctgtacatctcttaattagtggtacagagagaattaaactatagtgagagagaattaaactatagtggtatagagagaattaaataaaccagaggtggttacgccatagtatagagagaattaaatgtattactttagttttgaacatttttgaactagagtattactttatttttgaacatttttaacatttttgaagcaga

SEQ ID NO: 15761 - DNA, 1463 bp, Zea mays
ctctgccccccttccgccccacgctagctcctcccccctgcgtcggcaggcaacggatagatacgcatcgaggcagagggcttggccgagatctccccactaccccgcagcgtctttaaaaccaggacctgcttgtttgattgtttcatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctacttcctggtgttcgccatcctggccggcgtggtgggcgcggcgtccaagctggcgggcgtgcaccacgtgcgcgcctggcgccacgacagcctggccaccaacgccgcgtcgtcgctcatcgcctgggccatcacggcgctcgccttcgggctggcctgcaaggagatccacatcggcggacaccgcggctggcgcctgcgcgtgctggaggccttcgtcatcatcctcgccttcacgcagctcctctacgtgctcatgctccacacgggcctcttcggcggcagcggtggctaccgggaccacgactacggcgtcggcggcgcggccggcgagcccaagggggtcaccagggtctgaggattctgatcgatgcagctcgtacatgtgtcatcatatcaggcgctgctggagtgtgatgacgtaataagtagtacccatatatatatatggtgtgtgttgacgtaccacgtacactacgtacgtgtgtacctagtagctagctagtcagtccatcgtctgctcatctcgtcaggtcatcagatctctcggttctggtttgtacatcagtacgtgcatgcatgtatcccgtgtcaaatgtatttcgtcacccgtcagtttcagccggtcagtgaccaagtttatttcgtcacccctcagttcagtgacattggtggcaggggcccggaaaaaaaaaaaaaaaaaaaaaaaaaaaaaaaaaaagggcggccgcccttttttttttttttttttggaccaaacgagttgcatttcatggtagtacatcccatcccagggagaagatacagatcacacatgttccaagtttatgcataagaacacagcacggtttggcctagtatctagatcgcgggcggccgctcgcgatctagaactagcccacgagaccgcggacgcgtgg

SEQ ID NO: 15762 - DNA, 868 bp, Zea mays
ctggttggtcaccggttgcggtgagctaactggctccggattataaaatcggtaccgctcgaggccggcccgccgcgcagagcgcgattgcactgcaagcgcagatctcaattaggactacacaacaagtggagttcgacggatgtgaagtgaattgcggcctttcttggttgccgtcttgctgctatggttgacttgcggtccctactcgccgccggcgttgtcctcctcgccggcctggccgtcctcgtccacggcgccggggacgagcagttcgtctactcgggcttcaccggcgcgccgctcgcgctggacggcacggccgccatcacgccgtcggggctgctggagctcaccaacggcacggcgcagctcaagggccacgccgtgcacccggcgccgatgcggttccagcggacacccggcgggcccgtgcgctccttctcggcgtccttcgtgttcggcatcatcccgccctactccgacctcagcggccacggcatcgtcttcttcgtcggcagggacagcttcgccaccgcgctgcccagccagtacctgggcttcctcaactccagcaacaacggcaacttcaccaaccacgtcttcggcgtcgagctcgacaccatccggagcaccgagttcaatgaccccaacgacaaccacgtcggcatcgacgtcaacagcctcacgtccgccaacgccagcaccgccggctactacgacgacggcaccggcgcgttccacgacctgaccctgatcagcgccaagcccatgcaggtctgggtggactacgacggcgagacggcgcaggtcaacgtgttcctggctcccctcaggacacccaagcctaccaggccctctggtgtcg

SEQ ID NO: 15763 - DNA, 2525 bp, Zea mays
  misc_feature (28)..(28): n is a, c, g, or t
ctttggttttccgttttttattcccaanctagccctaagacgatttataccttcctctgaaaaaataatcgaaagacgtttaaactaaactttgttcatgcgttgtagcatctcaacactccagcaatggccctacatggacgtctcatgaagatttcagtgtctcccttgttttttccaatccttaaatagttaaaaacttgtgctccaacttgagcattaggtttccatttcacgaccaagtttttttttcaatttttaatggcaagccatacccttctgtcagcggaattcattttcttttctctcgtcttccatcatcgtaggaggagctcggcgataacctaactgctagagattgagaggacagatgaggcgagtgttttttttttttttttcggaccaaaagagttgcatttcatggtagtacatcccatcccagggagaagatacagatcacacatgttccaagtttatgcataagaacacagcacggtttggcctagtatctacatccgcacgacaggaccaccgcccaaccaacccaagaaaccgaagaagaacccgccacctcgcccaggcctccaaaccgaagatttttatcatcagagggaggagaggctcgtcgtcgtcacacacggtggtgctgcaactgcagcagccgcgagtacgcgccctccggccgggccaggaggtcggagtggctgccgtgctccacgacccgcccgtcctgcacgaccgcgatgcggtccacccctcggatcgtcgacagccggtgcgccaccaggacggtggtccgccccttcatcagccgctccagcgcctcctgcagcacgcactccgactccgcgtccagcgcgctcgtcgcctcgtccagcagcaggatggccgggtccttgagcaccgccctggcgatggcgatccgctgcttctgcccgcccgacagctgcatgccccgctcgccgaccgcggtcctgtacccatcgggcagctggctcacgaagccgtgcacgttcgccgtcttcgccgcctcgaccacctcctcctcgctcgcgccttccttgccgtacgcgatgttttccaggatgctcgacgcgaagaggactggctcctgctgcaccaggccgatcttgcgccgcagggacttcaagttcagcgtccggatgtccttgccatcgatggccactttccctccgcacgggtcgtagaaccgctcgatgagagcaatgatggtgctcttccctgagccgctggctccgactagcgcctggctgcgcccagcttggattttcaggttgaagtccttgaagatttggatgtccgggcgtgctggatacgaaaagtcgacatgccgcaactcaatgtcacctcggatggtggtgaccctctctgactctggatcgtcaggctcgattcttgttgctctgttgaggatgccaaagatggatcggatggattcacctccacggatgatctccggggccaggcttaccgtctcggctacggagttggcggtcaccacaaggacaacaaaaaccttgatgaccttggagaaggtggacccatgtgaccgcacaagatgagaaccataccagagaatgagcgcttccgaggagtataagcagagctgtgacaggccaaacagaagacctgatgtctggctgcggcggaggatttgctgctctgggacacgcagttcatggctgaagagtgacaagatcttgctttgagcgttgaaggccgccacggtgcggatattgctcactccttcaccagcaaccatactgctcttggcatgtgcctttgcagtgtcaccagcgaagcccttcattgaaagttgctgagaacacaaaatgaaacaagccatcagtacatatgttctacacagccagtataaagaactaagagctgttctgattttgacaagcaattaaattagcaagacgcgtttccttaaagatggacttgtacggtaggttaagtctcaagatgacaaaaataaaagtaggcccggaattacctgagcaaagttggcaagcacaagcagagggaaagtggccagaataagtattgccactctccattcaatgataaatccaacgacgaaagaagtcataagggaagtcatgttctgcaggatgaccgatattctctcagctatggccgacttcacatcagcggcaccaacagctagatgcgcagccacgagacttgaattgttttcttcttcgtcaaaccaaccaacttcattcctaagtattgctgcagtgaacattgtagagattcacagcttattcaaatggcacctcaaaaactgatttcggaatggagaaaatacataccagacaacatcatccgcctgaccctggttgtaagattctctcccatgatgctgaagaagtaatgctgcacaagataagcaacgacggcgtatatgcctgtgccaatatagatgaacacatatagcttggttttcttctccatctcattggggtccctgtagtagaacacgtcgagcatttcac

SEQ ID NO: 15764 - DNA, 2121 bp, Zea mays
  misc_feature (2031)..(2031): n is a, c, g, or t
ggtgacctcctgggaagtcctcgtgttgcattcctttttttggttttatttttgtttgtttttcgaacaccaaaccatagtaaaaatgggtgaccgttctcgtgttaaattaccttttatttgttttaaggggcgtttttcgggtactttgtgcggaggaaggatgtccagtgccgtgggcgagccgagcacggaggtgtgggcataagaggaaggaggacgcaggatatgacggatgcgatcataccagcactaaagcaccggatcccatcagaactccgaagttaagcgtgcttgggcgagagtagtactaggatgggtgacctcctgggaagtcctcgtgttgcattccttttttttggttttatttttgtttgtttttcgaacaccaaaccatagtaaaaatgggtgaccgttctcgtgttaaattaccttttatttgttttaaggggcgtttttcgggtactttgtgcggaggaaggatgtccagtgccgtgggcgagccgagcacggaggtgtgggcataagaggaaggaggacgcaggatatgacggatgcgatcataccagcactaaagcaccggatcccatcagaactccgaagttaagcgtgcttgggcgagagtagtactaggatgggtgacctcctgggaagtcctcgtgttgcattccttttttttggttttatttttgtttgtttttcgaacaccaaaccatagtaaaaatgggtgaccgttctcgtgttaaattaccttttatttgttttaaggggcgtttttcgggtactttgtgcggaggaaggatgtccagtgccgtgggcgagccgagcacggaggtgtgggcataagaggaaggaggacgcaggatatgacggatgcgatcataccagcactaaagcaccggatcccatcagaactccgaagttaagcgtgcttgggcgagagtagtactaggatgggtgacctcctgggaagtcctcgtgttgcattccttttttttggtttttttttgtttgtttttcgacaacaccaaaccatagtgcaaatgggtgaccgttctcgtggttttattattgtttgtttttcgaacaccgaaccatagtaaaaatgggtgaccgttctcgtgttaaattaccttttatttgttttaaggggcgtttttcgggtactttgtgcggaggaaggatgtccagtgccgtgggcgagccgagcacggaggtgtgggcataagaggaaggaggacgcaggatatgacggtatgcgatcataccagcactaaagcaccggatcccatcagaactccgaagttaagcgtgcttgggcgagagtagtactaggatgggtgacctcctgggaagtccttgtgttgcattcctgataaacaatcagcccaatcaatcaccggcggctccgccccacgatccctagattacttcgccttcgccaccagaagccaggaacctcgaagcggacagcgagaggagccccgccggtcgatccagaggagatgggctcctgcgagatgacggccacggaggtagcggcgctgctggatctgaagccgcacccggagggcggcttctacgccgagaccttccgcgactcctccgtctccctcagcaccgcccagctcccgccgcagtacaaggtcggtcgtgctgtgagcactgctatctatttcttgcttccttcagggagtgtttcacatctgcatcgtattccttgcgctgaaacctggcatttctacaagggggagcctctcacggtatttgagctacacgacgatggccacattgacctcaccgtaattggtccgcacctagatgctgggcagcgcccccagtacaccgtgccaccaaatgtgtggtttggatctttccctacgttggatgttgagtcgtttgcatccgatggcagccatcttgtgaactctcggaagcgagaccccgagaagcactactcccttgctggctgcacctgtgcccctggctttgagtatgaagattttgaaatgggcctcttttgatgatgtngaaatctattgccccgaaggcagaacccttccctcaattaccttattccttcccagaaagtaagaacgatcagagatggtcatattgctt

SEQ ID NO: 15765 - DNA, 1551 bp, Zea mays
ccggccggggtttttttttctcttggcgcaatcgatcgcagcttaatttcccgctgaaaacattaatcgcgagagctggctgactgagcttcacgtttcaaagccggtgtagttttagatgctaataatttgttttttttttttacagagcaagaggcgtcccaagctgttctggatctccgcggcggcgccgttgacgtccgtcgtgctcgggagcgttctggtgtacctcacgcacgctgaaaaccacggcagcggcccgatcggttacctgaagaaaggcctgaatccaccgtcggtgacaagcctgcaattctcaccgccctacatgatgctcgcgctcaagactgggatcatcaccggcgtcattgccctcgccgaaggcatcgccgtggggaggagcttcgccatgttcaagaactaccacatcgacggcaacaaggagatgatcgcgatcgggacgatgaacgtcctgggctcgctcacgtcgtgctacctgaccacggggcccttctcgcgctccgccgtgaactacaacgccgggtgcaggacggccatgtcgaacgtggtcatgtcgctggcggtgatggtcacgctgctgttcctgacgccgctgttccactacacgccgctggtggtgctgtcggcgatcatcgtctccgcgatgctgggcctggtcgacttcggggccgcgctgcacctgtggcgcgtcgacaaggtcgacttctgcgtctgcgccggcgcgtacctgggcgtcgtcttcggcagcgtcgaggtcggcctggtcgtcgccgtcgccgtctccctgctccgcgtcctccggcccggcgcccggcccaggaccacggtgctcggcaacatccccggcaccatggtgtaccggaggatggaccagtacgccgccgcgcagacggtgcccggcgtgctcgtgctgcgcgtcgacgcgcccgtctacttcgccaacgccagctacctgcgagagaggatctcgcggtggatcgacgacgaggaggagcgcaccaagagccagggcgagatgggcgtgcggtacgttgtcctcgacatgggtgccatcggtagcatcgacacgagcgggacgagcatgctggacgagctcaacaagtccttggacaggaggggaatgcagatcgtgctggcgaacccgggcagcgagatcatgaagaagctggacagctccaaggtgctggagcagatcggccacgagtgggtgttcccgacggtgggcgaggcggtggcgtcgtgcgactacgtgctgcactcgcacaagccgggaatggccaaggacagcgccgccgcccacgagagcatggtgtgacgagcaccgccacgccaaccgtatgtgtagtgtgctccggttccggtctgacgtaaccagtcgtcacgcggaccgagatgaattatgtatacacgtgtctcgagtattgtacacctgcaccgtcgcgggaaaaacgaattcagagaagaaaggatcccacccggtttttttggtgaagaaaaaaaaaaaaaaagcggccaaaaaaaaaactcttc

SEQ ID NO: 15766 - DNA, 1413 bp, Zea mays
gcacgagaccattacctagaacatcctaatcgaaaaactgcgcgtgtgcgccactacaccaaccgtttggtccgccgttcggggattccttccgcactactacatagtagcacccgtgtggccgtgtccgagctacccacgcccccaacgccaagaacgtcgacgggcacgacggcatggcggcggcggacccggacaccgaagtgcaggcggagttcccacccctcgtccgccagtacaaaagcggccgcgtcgagcggttcttcaacctggccccgctcccggccggcaccgacccggccacgggcgtcgtgtccaaggacgtcgtcgtcgacccggccaccggcctctgggcgcgcctcttcctccccgccggcagccacgggaagaagctccccgtcgtcgtctactaccatggcggcgcctacgtgatcggctcggcggccgacccgatgacgcacggctacctcaacgcgctcgtcgccaaggccggcgtcctcgcggtcgcgctcgagtaccgcctcgcgccggagcacccgctcccggccgcctacgaggactcatgggagggactcaagtgggtggccacccacgcctccgcctccgccgccgcgggaggaggaccggccgccgagccgtggctaaccgagcacggcgacttctcccgcgtgttcctggccggggccagcgcgggggccaccatcgctcacttcgtagcagtccgtgccggtgagcagcacaagagcggcggcctcgggatgcggatcagggggctgctgatagtgcacccctacttcagcggcgcggcggacatcggcgacgaggggacgacggggaaggcgcgcaaggcgcgggccgacgcgttctggcggttcctgtgccctggcacccccgggctcgacgaccctctctccaacccgttctcggaggccgccggcgggagcgcggcgcgcgtcgccgccgagcgcgtgctcgtctgcgtcgccgagaaggacgacctcagggacaggggcgtctggtactacgagagcctcaaggccagcggctaccctggcgaggtggagctgctcgagtccatgggcgagggccacgtcttctactgcatgaacccgcgctgcgacagggcgcgggagatggaggagcgcgtcctcggcttcctgcgcaagtgagcgagcgacggagcgcgcgccttgctacgcgattgagatggaataatttcaccgtttccagatgtggaggcgtttgagcatgaggccatgagggtcttatttgtttgcttaagatcaattgattgaagtttcgaaatcaaaaaaaaaaaaaaaacccggccgctaaatttaaaagaaatgaaaacgaacccataccgtcaaaaaaaaaaaaaaaaaaaaaaaaaaaaaaaaaaaaaaaaaaaaa

SEQ ID NO: 15767 - DNA, 2889 bp, Zea mays
gataaacaattttcccgttcgagcgtctcgcttctcccgttcccgatcccgatccctgagtcctttcgcttatcccgttgatccggcgtgcgttcgtgcgatctcctgtggcgacaactgggcgatcgacgccgccgctgctgtcgccgccgtatacgagaggtgcgcaggcgttcgttggtcccttcgccaggcttttgtctacccttcgccgacgacgagcacaatttatttgcaggccagatttctttgtctgacttgtggaagcctcttacaactattgtacaaggctgctgtattgaagatgtctgagttccttgacctagagctacaagatgggataaggatgccctggaatgttattccaggcacaaaacaggagactgtgaactgtgtgattcctgtttccgctatctacacacctttgaaaccaatttctgatatccctggtctcccatattcacctcttcgctgtcgcatgtgtcggtccatcctcaaccctttctccattggtgactatgttgctaagatttgggtctggtcattctgctttcaacgcaaccagttccctcaacactactcgtcgatctcagaaaataatctccctgcggaactcttccctcagtataccaccgtcgagtacatatcttcaactgaaactggtcctatagttccaccagttttcatttttgttgtagatacttgcatgattgaagaagaaattggttatttgaagtctgcactggcacaagctgttgagctattgccagataattctcttgttggattcattacgttcgggacgtatgtgcaggttcatgaattgggttttggcttattgccaaaatcatatgtattcaaaggaacaaagggggtcaccaaggagcaaatattggaacaaatgtgcttttttgcagggaagaaaatgcctaccacaggcgtgattgctggtaccagagatggcctttcatctgagagcatctctagatttctgctgcctgcttctgaatgcgagtttgtattgaactcagttatagaagaaatacaaaaggacccttggcctgttccagctgatcagcgtgcgtctaggtgcactggagctgccttaagtgttgcagccaatctccttggggtttgtgttcctggatcaggtgctaggataatggcatttgttggtggtccatctacggagggccctggtcctattgtatccaaatccttatcagagcccattcgctcacacaaagaccttgataaagactcggcaccactctatgataaagctgttaagttttatgatcaaattgcaaagcagcttgtgcaccaagggcatgtgctggatttgtttgcttgtgcagttgaccaggttggagtcgctgaaatgaaggttgcgattgagaagactggaggaattgttgtgcttgctgaaagttttggtcattctgttttcaaagactcacttctccgcatctttcagtcaacagatgacaaccttggtttatcattcaatggtattcttgagattaactgttcaaaggatgtaaaggttcaaggcatcattggaccctgttcttccctggagaagaaaagtcctttgtcttccgacactgttattggtcaaggaaacactagcgcttggaagatgtgcggccttgacaggaagacatcactttgcttggtatatgatattgcaaaaaaagatggcccagattcaattgctcaatcagcaaacaatcagttttacttccagttcttaacctactatcagcataatgagggtcagatgagattaagatcgaccacaatctccagaagatgggtctctggtgacaaccatgtggaggagctagtagctggctttgatcaagaagctgcagctgcagtcatggcacgcttggtgtcatttaagatggaaactgaggttgattttgacccagtaaggtggcttgatcgagctttgatacgtttatgctcaaaatttggagattatcagaaggagacaccctcatcgttcagtttatccccacgactatcaatatttccccaatttatatttaatttgaggcgttctcagtttgttcaggtttttaataacagtcctgatgaaactgcgtattttaggatgatgttggacagagagaatgtaaccaatacagttgtgatgattcaaccttcacttatatcctattcatttcaatcagggccagagccagttctcttggatgcaactgcaattgcttctgacaagatccttttattggactcttattttactgttgtcatattccatggggtaaccattgcgcagtggcgaaatgctggctaccaagatcaagaaggtcacgaggtgtttgctcagttgttaaaagctccacatgaggaagctaatttaataataaaggagcgatttcctgtaccccgtttggtagtctgtgatcaatatggatctcaggctcgatttttactggcgaagctaaatccatcggtgacatataactcggacaacccctcccctggtggagacgtcatattcacagatgatgtgagcttccaggttttcatggaccatcttcagcgactagcagtccaataggatatgaatctgtagatcagtgcatagagcaattttatactaccaatgatatcttctgtagagtgataatatttttgttttgtatgtcttacaaattcgttgtagctggttttaaattatataagtttcttttagaggcaatcaaattttgcaacttgataaattatgataataaatgacctgtagaatgaagaattgcattttctttcacaagggcgataaattgatttgtatttaccgaagaggcatctttcaaatgattaagatgccgatttgctgaggccctctttccccat

SEQ ID NO: 15768 - DNA, 2368 bp, Zea mays
ccggccgcctcgtggcccgccgggcaaacgcattgtcggctgtaaagggtagaacgtctccactctcccgtacgccgatacccactgacgccaccgcccgaagcctccccgagaaacaggagccggcgcggggatgtcgtccatctcgcggaatctccggcgatccctcgccccggaccgcctgcgccgcctctcccagcacccgcgagagtatgtgacgtcggagtgccaccgccccgtcgtcctccacaagcgcggccccgacatcctccacgacccctggttcaaccggggcacggcgttctcgatgaccgagagggaccgcctcggcctccgcggcctgctcccgcccaacgtcgtctcctcgcagcagcagatcgacagattcatgcttgatctgaaacggctgcagagatatgcaagagatggcccgtctgatacttatccattggcaaaatggcgcatccttaacagattgcatgacagaaatgaaacgatgtactacaaggtactaatagataacattgaggagtatgcacctatcgtttacacaccaaccgttggacttgtttgccaaaactacagtggtctgtttcgacgccctaggggaatgtactttagtgcagaagatcgtggggagatgatgtccatggtgtacaattggccagctgatcaggttgacatgatagtggtgactgatggaagcaggatattgggtcttggtgatcttggggtgcatggtattggcattgctattggaaaattggatttatatgttgctgctgctggaataaatcctcaaggggttcttcctgttatgattgatgtcggaacgaacaacgagaagctcctttaggatcctctttatcttgggctacaagagcaccgtcttgagggagatgaatttgtttcagttattgatgaattcatggaagctgtttttactcgctggcctaatgttattgtacagtttgaagatttccaaagtaaatgggcctttaggttgttgcagcgttacagaaagacttatcgcatgtttaatgatgatgttcagggaactgctggtgtcgcaatagcaggccttttaggagctgtacgggcacaagggaggccaatgatagattttccaaagcaaaggattgttgttgctggcgctggcagtgctggtattggagtggtgaatgctgcaagcagaaccatggcaagaatgttgggaaacaatgacgttgcttttgagagtgcgaggagtcaattctggatagtggatgcccatggcctaataacagaagaccgagaagatatcgatccagatgcacggccttttgctagaagaaagagtgagcttggtcaccagggcctaagtgagggggcaagcttagttgaagtggttaaaaaggtgaagcctgatgtcatacttggattatctgctgttggtggtttgttctcgaaggaggttctagaggcactaaaagattcgtcctcgtcaaggccagcaatttttgcaatgtccaatccaactaagaatgctgagtgtacacctggggaagcattttcaattctaggtgaaaaggtcatctttgctagtgggagcccatttcatgatgtggatcttggtgatgggaagattggccattccaatcaagggaacaacatgtacctctttcctggaatagggcttggaacccttctgtctggtgctcgggttatctctgatggaatgctgcaggctgcagctgaacgtttggcttcatacatgaaagaggaggaggttctcgaagggataatttatcctccaatttccagaatacgtgacatcactaaggaggtggcagcagcagttgtgagggaggcagtagcagaggatctagctgagggataccgtgacatggatgcacgtgagcttgcacgactcagtgaggaagaaactaatgaatatgtcaagacgaacatgtggagtcctgtctatccaacaataatatacaagaaggactagatagctctatttgctattttgcatatgttcaatgatcatgtatgatatactttaggctgcgttctggaaggcactccagaagtgtaggcacgttagttataagaaaacagccttcattgttcattgaccttacttttaattgaatttagtacacgagacaccttaggccacagttcctgacgtactccatggtgctgaaacatttcccatctcaaatatcatcaactgtaccactactggaactgtagtccaatccctctcagatgttaaaatcctgtgtgtaactttgaacacagaccaaataacaaagccagaaatttgccagaggaaatctgttctggcaacttgtttgcctgaaaaaaaaaaaaaaaaaaa

SEQ ID NO: 15769 - DNA, 3211 bp, Zea mays
cttcatcctaattccaactttcttgaaagacaaactatcttaggtttgatcaaatctatataataaaatagcaacatcaaatatatattattagattctttattaattatatttttatactacaacttatttgtatatcaaaacttttgtaattttccctataattccgtcaaacttgagatgttttagttctttttaaaattggaatgacttatgatttggaattaagatcatattgatgttggaatgtttttaaaatctgtgggtctgtctcttcgttctctcctaacacctacggtgagtggttgtcaccttcatgagtacgatgttttttttcttttatatttttttattatatttggtttcttctctgtcagtatacgcttgatatgctcttgtcgttggcgctttttttatataaaaataaaaaagcacatctcgtgggaatggagatggatagctgaagaaaactgaacatggtctaaagccagacatgcattggcagtatgaatggcgagtgacctctgaaagtagaacaaaagatatgcacgagtccaaatcctttttatgtccacagcatccatatcctacacctggctggaggccacatctgtgtcaggtgagatacatacgctccattgtcctccaaagtcaaagggaggaggagattcagatatgcgcccatagcagcgtcggaaccgtggtcccttttcccaacggcaccagaagatagcttgggttgggtcggggtcgggcccgttcagatggggccatggggatgtgggtggggcatttgcatgcgcccgcgcgcggcggcaaaagcggcgaacagaagaaagagtgtaacggcaggcacgaccgagaaaaacgcgtcttccagttccagccagtgcccacccgtcgtgccgtgctccctctgtccaccggtgaacacgcggcgaaacggccgcttgccctggcgcctgcctatacacgaccgtcacacaccaagcccacgcgacttcttccacttgcacaccacgccccgacaaagcgagcgagagcagccacggcaaaaccctcgcgggcgtctctctctcgatcggcgggcagcagcgacgcgcgcgcacaacacagcaggtgaattcaaggcaagtgagtcagtggttggggtcctcgtcctggctatgagaggtttaagtcggtatctgccgttctgcggcggcgggtgctgctgcggtgacggcgccggcagggcagggggcgtggcggatgggctggtgtgggacgtggccctcaaggcgcacgcgtccggtgactactccatcgccgtggcgcaggcgaacgaggcgctcgaggaccaggcgcaggtggtcgcggctccggccgccacgctcgtcggcgtcttcgacgggcacggcgggcccgaggccgcgcgcttcgtcaacaggcgcctcttctcgcatatccaaggtgagctctgttggagatactagacggtctcgatatgctgcgcctgtacgtgacatgtcgacaccttgcacttgcagcctttgcggctgagaacggtggcctgtcggcggaggtgttccagaaggccttcggcgcgacggaggaggagttcataggcctggtgcagaaatcatggccgtcgcagccgaggatcgtgtccgtgggctcctgctgcctggtgggcgccgtcgacatcgagaacgggacgctgtacgtggccaacctgggcgactcgcgcgccgtgctgggccgccgccggggcaaggggaggcgcgtggtggccgagcggctgtcgcaggaccacaacgtggccgacgagggcgtgcggcgggaggtggccgagatgcacccggacgactcgcacatcgtgctcaacagccacggcgtgtggcggatcaaggggatcatccaggtgtccaggtccatcggcgatgtgtacctcaagaagcctgacatctgcaggggcaacccggtgctgcagcagtccatctgcccgttcccgctgcgccgccccgtcatgaccgccgtgccgtccatcaccacgcgggagctgcgccccggcgaccgcttcatcatcttcgcgtcggacgggctgtgggagcagctcagcgacgacgccgcggtggacgtcgtggcgagcagcccgaggaagggcgtggccatgcgcctggtgcgggccgcccagctggaggcggcgcgcaagaaggaggtcaagtacgacaagatccggaccatcgagaagggccagcgccggcacttccacgacgacatcaccgtcgtcgtgctcttcctcgacaagtgcaggggagctgccaggtccggccccgaggacatcgacggcacctacgcgccggtggacgtgttctcctgcagccccgccgccggcggcgatcacgaggacccgacgaagcccgtcctgcgtcgttgatacggatcgcttggtgttccgcgtgctgtcagatactgaacaaacatatactcttctctttcagtcttctttcagtgctctgcttcgctctctaaacaagagaaggtacatacttgagctgcttcgtttggaacgcaggaatatttgccggttcttgcgtgaattgagttgtttatcgtccaagacaattcgcttgtaaagaaatgatagtttcaggtcatgtgtcatagattgtaaatcttcatccatctcttctcacttctatcctatctactactatctgtccttccgatgttcttcatcgtcgtctatttcgatgttcttcatagctgtcaaccgaaagctaagatgaatatactcagcatctgctggttagcagccggcccccggccgccggcgacctcctatcagcgaggcagcaagtgaactgcatgcgaagcaggcaagccggtcgtccctcgtcagcggtcatgatctcggagacggtctgctctggaatatggctatgtggaaagacggccacgatcgtggatcggttcaacaggcactataattcttgacctctgagtcaacagagtgatggcatcgatgcccggatggccaggatcgcgagaaatggtggacgaactatcatgacagaaaaaagaactgccggcaaaattctgtccaacttgagcttgttcggttacttttattatatatggatgggatgaaattgaaaaaaaaatcaagtagaagttggaattgcttagtatttaaattcatctaatttcattcaatccacatggatga

SEQ ID NO: 15770 - DNA, 1806 bp, Zea mays
ttgggaccctcgaggccggccggggcacgtatgctctccactccaactcacgccccggccgggttcgttttgtttcgtttcgtttcggatcgtgccgctgccgctcttcccttctcgtctagtcttgtttttctttcctcctctgttactccacctacagacctactactgccatcgggagggtaagctcttcggagccggagccgggtccacgttaacgccatcgagtgctgcgatgggcagcttaggagggagcgccggtgctggggacggcggcaaggtcgggctgccggcgcttgacgtgacgctcgcgttcccgcaggccacgcccgcatcgctcttcccgccagccgtttcggactactaccaatttgatgatttgctgactgatgaagagaaggcactcaggaagaaggtccgaggtatcatggaaaaggaaatcgcgcccattatgactgagtactgggagaaggctgaattcccattccatgccattcccagccttgccagtcttggtttagctggtggtacaataaaggggtatgggtgccctggactctcgcttacagctagtgctatttcgatagcagaggttgcacgggtcgatgcgagctgctccacatttattctagtgcactcctcgttggctatgtccactattgccctttgtggatctgaggctcaaaagcagaaatacttaccatctcttacccagttcaaaactattggttgctgggcattgacagagccagattatggaagtgatgcaagctccctaaggactgcagcaaccaaggtacctggtggttggcatttagatggacaaaaacgctggataggtaacagcacttttgcagatgtcctcatcattttggctaggaatgcagatacaaaccaactaaatggatttattgtaaagaaaggagctcctggtctaaaagccacaaaaattgaaaataaaattggactcagaatggttcaaaatggagacataattctaaataaagtatttgtccctgaggaagacagattaacaggcatcaattcatttcaggatataaacaaggtcctcgctatgtctcgaattatggtggcatggcaaccaataggcatatcaatgggagtttatgacatctgccatcggtatttgaaagaaagaaagcaatttggagctccactggcagcttttcagctcaatcaagaaaagcttgtccgcatgcttggcaacattcaggctatgcttctcgttggatggcgactgtgcaagctgtatgagtcaggcaaaatgacaccaggccggtctagtttaggcaaggcatggacgtccaagaaggccagggaggtggtttctcttgggcgagagctactgggtggcaatggcattttggttgattttcttgtcgccaaggcattttgtgacgtggagcccattttctcgtacgagggcacctatgacattaatagcctggtggctggcagagagatcaccgggatcgcgagcttcaagcctgctgtgtcagcaaaatcacgcctgtgaaagttgtttttttctttgttccccaatgaagacagtagaaatcaaccttatacattcagatgattgggaataagaacggtaggaaagctgtaaaactcgacgtgcttcctcgtatgtactgttctgtttcaaattattcgacgttttgtcggaacggaacggaagacctgtatggctgtatatgatactcatatcctatatatcactgctccaggtaatttgaagattttgtaaaaaaaaaaaaaaaaaaaaaaaaaaaaaaaaaaaaa

SEQ ID NO: 15771 - DNA, 2443 bp, Zea mays
  misc_feature (1084)..(1084): n is a, c, g, or t
ccctttcgttctcctccccttctttttatcgtagcgttagcatggactatatgctaataactaaaaatcctagatctatttttacctcagatggagaccagtacaagtagtgttaacgtcacaagacctgctcaagtccagataccattctagaggtacacctgctgcgtacgtggataccacacgtccacacatgacacacactactacgtacgtacatacccgacacacatgtcacagactcacagcccgcccgggcaaagcacccttttccttcccgctggctctaggtacgtacactagctccctctcatcccatcactccatggccgacaagcaagaacaccagcagcagccccacggccaccatttcctggtggtggcctacggcatgcagagccacgtgaacccagggcgcgccctagcccaccgtctcgctcggctcagccgcatcgacggccgccccatcctcgccacgctctccgtgccggtcgccgcccaacgccgcctgttcccgtcgcccacgacgatggtggacaaggaggcctgcagcgacggcgtcatctcctacgtcccccactcggacggcttcgacgacggcgccagcgcgcccaagaccgccgaggactgggcccgccggcgccgcgcgaccgccgccagcctctccgccgtcgtcgcgcgcttcgccgccgccgggacgccggtcacgtgcatcgtgctcacgatggtggggcccgcgatggtggacgtggcgagggaccacggcatccccttcgccgtctactggatccagccggccgccgtcctcgccgccgagtaccactacttccacggctacgacgacgacgaccccgcccgcgcgcgcgaggtgagccctgcccgggctgcgccgtcctctcccggtccgggacttcccgtccttcctggtcgacacgacgggcagcgtgctggccaaggtcatcaccgaaatgttccgggaactgttcgagagcatggaccggtggcggcccaaggtgctcgtgaacacgctcgaggagctggaggcgggcgtgctcgcggggatgaggcgccacctggacctggntcgccgtcggccccatgctcggggcctcggcggacgacgcgcggatccatctggtcgagcacgacgacgacgtcgacaagaagaggtacatggactggctccgggcccgcccggacagctcggtggtgtacgcgtcgttcgggagcgtgacgaaggtcaccaggcaccagatgggcgaggtcgccgcggggctgcggcagtgtgggcggccgtacttgctggtcgtacgcagggacgggctccaggacgacgacgacgagagcagcagcagcctccatgtcccgctgggctcggagagctgccagcaggggatggtcgtgggctggtgcgaccagctggaggtcctgtcgcacccagcggttggctgcttcgtctcgcactgcggctggaactccaccatagaggccatggcgtccggcggcgtgcccatagtcggcgtgccggactcgtttgaccagcccacgaacgcgtacttggtggaggaagagtggggggttgccatcagaacggggcgaaacagcgacggcgtgttgtcagggacagagttggcaagatgcattgagctcgtcatgggcgacggtgcaagagcagtggcgataagggagaggatgaagggcttgaaaacgatggcgcaagcagcagccgacacaggcgggtctgtggagacaaaccttcgccactttgtcaaaacattccaagctcttgagctgtgacacattttgaagaagacggagtgtgtcaaaatcagtataatgaaatcctcttaaaaaggtgtttggacttcgaaaaaaaatacagctgaacttcttttggcccccaatctgtttggcttagcattcgactccagttccataaatgacagattttagggaaaatatccttctcttaaagaacccacatgtagatgaaccaactccattatttctctctcccatctcactcacccagtcatctctctccatggaacgacatgaggcatgaggtgacactgtgacagtcgactgtcaatttcctccaccttagcttaaatcatggagtcattggcatgctaccttcacttttcatccccaagtccatcttgtattgtatcatatcaataagaaaacacccttgttcaactttctttttattgaatgataataatctatataactaactaagcaatcttcacaatctctcattagcccattgctattgatcatctctttaatatttttttctagcttgaagaatattgatgcatttaaaaaaacatttgttctatgtgctcaatgcatctctaaaccaaatgcatttcatattgttttcatttatcacttgtatttgcttgcattgtcatttctcccattatgcactatc

SEQ ID NO: 15772 - DNA, 886 bp, Zea mays
ggtctcccccgcgtccgcccacgcgtccgggttaagaagcctcaaaggtaggtaaggagatgaggatggatgttcttctgatggaaaatcttttgtttgagcgcgatgtgacaacattgtatgatttaaagggctctgccagatcaagatataacccagactcaaatggtagcgataaagtacttcttgatcagaacttaattgaagcgatgcctacatcacctatatttgtcggaaacaaggcaaagaggctgctggagagagctgtttggaatgacacgtcctttcttgcttccatcgatgtaatggattactctttacttgttggtgttgatgagaaaaggcatgaacttgtaatgggtattatagatttcataaggcaatatacgtgggacaaacacctagagacatgggtgaaagcttcagggatactaggtggaccaaagaatgtgtcgccaacagtaatttcaccaaagcaatacaagaagcggtttaggaaagccatgtcggcctactttcttgtcgtcccagaccagtggtcgcctccagtggtcatccccagcaagcaagctgagagtggtcaagacagggacgaacaggttgtcttgacagaattgtgagatgcatgcattacttttaggaacattcagggaataactcctcttttttgcaacatctatagattttgattttatttaaattttgttcattgttttttcttgtagctgtattttctgggtattcctaccctttcctttttttggggaggatctatagaaagttttagcccaagtctttgaaactggtcattgtaaataccatccttcttctaatgaaatgatacacagctctcctgcgtgtttaagaaaaaaaaaaaaaagcggcc

SEQ ID NO: 15773 - DNA, 2349 bp, Zea mays
ggccgggccggaaccttcctccacggctccaccatcccctctcccctgccctgcccccaccgccccgcttccttccgccttgctccgttgcttcctcccaccacagtccactccactcgccggccctgcagctcagtatttgactgagactggtggtggagctgctagcagcgagcctgctacttcctggtccctgacggtgccgttcagacctcagaccagtgccgacgacgagctgtgaggagagggcaaggaaacaagcctgtgaggaaggcggcgatggagaggtacgaggtgatcaaggacataggatcgggcaacttcggggtggccaagctggtccgggacgtcaggaccaaggagctcttcgccgtcaagttcatcgagcgggggatgaagattgatgagaatgtccaaagggagatcatgaaccacaggtcactgaggcatccaaacatagttaaatttaaggaggactacttggtggcaacttgtttctatgggtgttggatacttggatgtctatcagcattcagcagctatgggtagcatgcactagtgccatgccccttgagtcggggaagtgcttatggcatttgggcctcggagttttttttgccaataactctccgcggccgcgggcccgtggggcaatgactgagtgacagttccttagcagttagcagtctgctttgtcctcttgttcttctgttatatattcttgtttgcacggaatgcatgccactgttttttgtgctacctgatttgccgtcgataaaagaggtatcaactaggtagagtgaaggagaattatcgctggatggtaatatcaaccaaaaatatcgaacttcggtccatagactgaattccttttaacttgtttttttctctcgccaggatttcatagcagcacacctttaagaaatgtttctcgcaactaagttctttggaatgtaattagctacaacaagcatgggtcaattatgattctggcagtaacttgtattcctttcaactagtttggctgcagtaccggagaaatacttagtgtactggtcattgacgacagtaaatttcgtggatttaattggagacctctttataatgctaacaacatagttatctcatgaagcttattactgcagaaaatagcaggagagggtccaaccgtgattattacatttttgtttcagaatttaaatttattaccatttccaaactacaaattaaaagacgggcggggtttttcaggttgtgctaactcccacacatttggccatagttatggaatatgctgctggtggtgagctatttgaaaggatctgtaatgctggaagatttagtgaggatgaggcgagatttttcttccaacaactgatttcaggagttagttattgccactcaatgcaaatatgccatagagatttgaaactagaaaacactctcctggatgatagtatagcacctcggctaaagatatgtgattttggttactccaagtcctctgtgctgcactctcaaccaaaatcaactgtcgggacaccagcttacattgctcctgaggtccttgctagaaaggaatatgatggaaaggtcgccgatgtttggtcatgtggagttactctgtatgtgatgcttgttggtgcctatccctttgaggaccccgacgaaccgaagaatttccgcaagacgcttactcggattatcagcgtccagtacgcggttcctgattttgtccgagtttcaatggagtgcaggcatctgctgtctcggatctttgtggcgaaacctgagcaacggataaccatcccagagatcaagaaccacccatggttcctgaagaacctgcccatcgagatgaccgacgagtaccagatgaacctacagctagtcgacatgaatgtcccctcgcaaagcctggaggagatcatgtccatcatactggaggcccggaagcccggcgacgggctgaagcatgcgggacagctccccggccttgggagcatggagctggatgacattgatgttgacgacatagacgttgaggacagtggcgactttgtatgtgccttgtgacgcggttcaggctgtccggcaccgttgctgcggtggactctcccccactctcctggtctttgtgtcttgctgttattccatgttgtttgtttcagcgagctccgagctcccattttgttgttgtaatatcacatgttttgtgtaaccaaggtagtgacgctgtggataaataatagacgttatgtgttgtattcttgctgaattgttgttcagctccttctgtttgccctgtatgaactgggcagtttcatgagtaaaaaaaaaaaaaaaaaa

SEQ ID NO: 15774 - DNA, 1808 bp, Zea mays
cattgggtacctcgaggccggccgggcctgggcccccgccgggccacgactctatccaccaacttcgacccggccggccctatcaaaagctggccccttccacagcgcactccctcaccttcctccacggctccaccatcccctcccctgccctgcccccaccgccccgcttccttccgccttgctccgttgcttcctcccaccacagtccactccactcgccggccctgcagctcagtatttgactgagactggtggtggagctgctagcagcgagcctgctacttcctggtcctgacggtgcgttcagacctcagaccagtgccgacgacgagctgtgaggagagggcaaggaagcaagcctgtgaggaaggcggcgatggagaggtacgaggtgatcaaggacataggatcgggcaacttcggggtggccaagctggtccgggacgtcaggaccaaggagctcttcgccgtcaagttcatcgagcgggggatgaagattgatgagaatgtccaaagggagatcatgaaccacaggtcactgaggcatccaaacatagttaaatttaaggaggttgtgctaactcccacacatttggccatagttatggaatatgctgctggtggtgagctatttgaaaggatctgtaatgctggaagatttagtgaggatgaggcgagatttttcttccaacaactgatttcaggagttagttattgccactcaatgcaaatatgccatagagatttgaaactagaaaacactctcctggatgatagtatagcacctcggctaaagatatgtgattttggttactccaagtcctctgtgttgcactctcaaccaaaatcaactgtcgggacaccagcttacattgctcctgaggtccttgctagaaaggaatatgatggaaaggtcgccgatgtttggtcatgtggagttactctgtatgtgatgcttgttggtgcctatccctttgaggaccccgacgaaccgaagaatttccgcaagacgcttactcggattatcagcgtccagtacgcggttcctgattttgtccgagtttcaatggagtgcaggcatctgctgtctcggatctttgtggcgaaacctgagcaacggataaccatcccagagatcaagaaccacccatggttcttgaagaacctgcccatcgagatgaccgacgagtaccagatgaacctacagctagtcgacatgaatgtcccctcgcaaagcctggaggagatcatgtccatcatactggaggcccggaagcccggcgacgggctgaagcatgcgggacagctccccggccttgggagcatggagctggatgacattgatgttgacgacatagacgttgaggacagtggcgactttgtatgtgccttgtgacgcggttcaggctgtccggcaccgttgctgcggtggactctcccccactctcctggtctttgtgtcttgctgttattccatgttgtttgtttcagcgagctccgagctcccattttgttgttgtaatatcacatgttttgtgtaaccaaggtagtgacgctgtggataaataatagacgttatgtgttgtattcttgctgaattgttgttcagctccttctgtttgccctgtatgaactgggcagtttcatgagtaccacaatgtgtatgttgatggctctgtcttcccttgtctcagcctgatattttgacctgctgcatgtagccaatgtgttttttcttgtatttttgctagaagcaatcttatgagttacgagtactattaccaccctgaaaaaaaaaaaaaaaa

SEQ ID NO: 15775 - DNA, 1399 bp, Zea mays
cctcgaggggccggccgggagaccctcgagataagcactcagaccaccaccagcagttctgagctagctatggcgatgatgatgagagcattggcagcagcggccatcctggccacggcgtttgccgtgtcggcacgagccgagcccccgcagtgcggcgccaactccaccacggcgctctgcccctactgcctgtgctgcagcaaatggggcttctgcggcagcaccgaagcctactgcggcaacggctgccagagccagtgcgaccgctgcaacgccaccgtcgcgtccatcgtcacgcgggagctcttcgacgagctgctgctgcaccgcaacgacctcaggtgccccgcccagggcttctacacctacgactcgttcatcgccgcggcgggcgccgacgcgtccgacggcttcggcaccacgggcgccgtcgacatccggaagcgcgaggtcgccgcgttcctggcggagccggcgcaccggacctcgggcggctgggacggcgcgcccaacggcacctacgcctggggcttctgctacaagccggccggcgcccagaacgtcacggaccccgtcgccttcttcgagacggccatcgcgagctggatgacggcgtcggcgcgcccgcccaagccgtcgtgccacgacgtcgtcaccgagcagtggaccccctcggacgccgacaaggccgcggggaggctgcggggcttcggcgtcatcgccaacatcatcaacggcgacgccgagtgcggccgcggccccgacgccggtggccaggaccggatcggcttctacaagcgcttctgcgacatccttggcgtcagctacggcgacaacttggactgcttcgaccagaagcccttcggcgctgccaccgccgccgccttagctgaaactaccagcggcccgcgtcacgctgacgcgtaaaagaataatgcatgcatgggcaccgcacagggcacaaatcaataacagctctcttttaaataatctgcatgcttattcgcttgcataagcatgcacacgtagtagatcgtgcatgtgtagggcgagcatgtttactttcatcccgggcggccggggttgtgtcgtcgtgcgagttgccgtgaagatgtactatgcctcatgcatgttttctatgccatatattatataaataaatgcataaaaaaactgagctgcaacgatggcagcgccaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggccgttttaaaggacccaagtttagttccgcgggctggcaaggtaaaagtttttttttggggcccccaaaattaaa

SEQ ID NO: 15776 - DNA, 2245 bp, Zea mays
gcacgagcgaccacacgcaggtggccatcaaggtgctccggcccgacgcggcgcagggccggtcgcagttccagcaggaggtggaggtgctgagctgcatccggcaccccaacatggtgctcctcctcggcgcgtgcccggagtacggctgcctcgtgtacgagtacatggccagcggcagcctggacgactgcctgttccggcgctccggcggcgccggcgggcccgtcatcccgtggcagcaccggttccgcatctgcgccgagatcgcgacggggctgctgttcctgcaccagaccaagcccgagccgctggtgcaccgggacctcaagccggggaacatcctgctggaccgcaactacgtgagcaagatcagcgacgtcgggctggcgcggctcgtgccgccgtccgtcgccgacaccgtgacgcagtaccggatgacgtccaccgcggggaccttctgctacatcgacccggagtaccagcagacgggcatgctcggcgtcaagtccgacgtctactccttcggcgtcatgctgctgcagatcatcacggcgaagccgcccatggggctgtcgcaccacgtcggccgcgccctggagcgcggcgagctgcaggacatgctggaccccgccgtgcccgactggcccctggaggaggcgcagtgcctcgccgagatggcgctccggtgctgcgagctgcgccgcaaggaccggccggacctcggcgccgtcgtgctcccggagctcaaccggctgcgcgcgctcggcgaggacaacatgcagtactgcggcgccatcatcaggggtggcggcggcggcggcggcatgcacagctcgtcgccgttccacagcaacatctcacggtcacacgccgagatgatgatcgattcccagtacccaagatcagtgttcagctcaagagcgggcgattcgcccatgccgccgagaaggtcgaacgcttgacgggcatgaaatggacttttatttccagcatcggtgacggggtggtggtgatgtcttgtgcaggtgcataagctgcctagcacgagggggagctagagcaggtgttgtttctagcatgagtttggtgcagaattttattacacgaggtacgagctatgtattactagtaaatacagaatcgtacggctctgccattgccgtgtacctgttcttgtaacctgtggagcttcctctgttgtgtaatggatttttttcagttttgtgaaacagaactgttggattaggggcacctcgtccgttttttaacctctctacatataaaaagagcaaaaaaaagggctcatcctaaattatcctatccacattctaacatatctaatcaaatctcctccatcgggtgtgttttctattttccatctcacacatctaattgattacagtagcggaggataaaagaaaaatatggtatggctgagaaaaaaaacaaaatatacaagcagtgtgattataaactcataacgtacaacttaaaacacagcaacctatccaacacaccagaccttctatgattaaaatagaatatacataaacgctttaaaattaggggtacggcggaggccacactaagccataatgtctcatgtgcagggtcagttctaagcgcatgcaacagagtcgacggccagggccccaaaagtaataggggtctaatatatatcacaatgtaatacactagtttacactttacaaaactcaatcaaccaaataatctacacacccataatctttattaaatccaccaaacaaattacactcatacttaacacaatatcaaaatcaatagttcagatcgttaaataacatcatctctcttgctcactcaaacctgatagacaatattatttggatcatccttcagccatcacgtcctcacgtccacaccgccgtcaacccctcccctcgcgtcaccaccgtcgtcgttcaccccactcttccccttcttaggaacgtagcgttagcacgggctatatactagtagtaaaatagtataggtagctaacaagacggtagggctgggcacacggacgcccgacgcacacggaccacgcgacacatgttgcccactgcccagtcatcacgctcacatcgtagcgcgtatgtgcgaccataccctccacgtgatcgtcgttcaccatctcgccaattcaaccctccaagattctagggcgctataggcgccacttctccagcctccaggcacgcacggtcgagcaatcagg

SEQ ID NO: 15777 - DNA, 674 bp, Zea mays
actccttagggcgattgggttccccggccccggccgggagggcctgcaggacacaaaggttgaaggcaagggagagagaggaagaagaaaggcaggaggagaggcggaacgacccgtctccctccacctctctctgccttctcctcctgcgccgccatcctcacatcccgtcgtcgcaccacccactgaccggccggttgcacccttatagtaccggacggtggcgcgatgcaaggaggcccactcagcccggacgagtaccgggtggcgtcgccgccggcgctgctgcaccagccggcgcccgtcatcgtcgtggccatcgaccgggaccgcaacagccaactggccgcgaagtgggtggtggaccacctcctctccggcgcctctcagatcgtcctcctccacgtggccgcccactaccccgccaaccatgggttcgccatggccgagacgacgcagagcgcgctggaggctgaaatgaaggagatctttgtcccctacagaggattcttcaaccggaatggggtgtggatgtcttcgaggtagtgttggaagaggcagacgtgtccaaggccattctaggttacatcactgcaaacaagatccagagcattgcgctcggcggagccagcagaaatgcattcaccaaaaaaaaaaaaaaaaaatttgcggcc

SEQ ID NO: 15778 - DNA, 2787 bp, Zea mays
atccccttggaagggcgtctctcgcctcgggcagaaaattcaagaacgcggacgtttcgtcgaccctgatgaagtgcgcgccggactactgcaacatctacgtcgtggccaagggcaagtccgtcaatgtccggctcgccaagtgcggcgtcccgcccatgcacggtggcgccgacagcccttcggacaccgactccgtccgggaatcggggctgtacattcggcgtggctccaggggacacggacacctgccgccggtgatgcctgacgccaggcgctccatggacgggcgcagcaccctgccggagctcaccacgcgcccaccgttccgcgagcgctcgctcccgtcctcggccaccaagaacgtcgtcgtcctgccgggaaaggactactccgaggcgccctcccgctccgcgaggcacgactcgttcggcggcgacctcgacttcggcccgagcacgcgcttctcctccatggacttcggcgacaacctcgacctcaccgccagccccgctcgggagcccatgtcaccggccaccggcgtgagtgatttctgtgctatccaacccaccggacaccgttgcccctgacctacgcatgcgggcgcaggcgcaacgggatattgaggtcgagatgcggcgcctccggctggaactcaagcagaccatggacatgtacaacgcggcgtgcaaggaggccatcaacgccaagcagcgggccaaggagatgcagcggttgaaactggaggaggagcgtcccccgccgccggccaggcacgccgaggagactgctctggcactggccgagatggagaaggccaagtgccgcgcggccatggaggcagccgaggcggcgcagaggctggctgacctggaggcgcagcggcgccgcaacgccgaggtgcgcgcgcgccgggaggccgacgagaaggtgcgcgctctggatgccatctccaaccacgacttccggtaccgcaagtaccacatcgacgagatcgagatggccacggagcgcttctccgacgagctcaagatcggcgagggcggctacggccccgtctaccgcgcctccctggaccacacccccgtcgccatcaaggtgctccggcccgacgcgcaccaggggaggaagcagttcctgcaggaggtggaggtgctcagctgcatccgccaccccaacatggtgctcctcctcggcgcatgcccggagtacggctgcctcgtgtacgagtacatggaccacggcagcctcgaggaccggctgttccgtcggggcggcacgccgccgctcgcgtgggcccagcggttccggatcgcggcggagatcgcgacggcgctgctgttcctgcaccagacgaagccggagccgctggtgcaccgggacctgaagccggccaacatcctgctggaccgcaactacgtgagcaagatcagcgacgtcgggctggcgcgtctggtgccgccgtcggtggcggacagcgtgacgcagtaccggctgacggcgacggcgggcaccttctgctacatcgacccggagtaccagcagacggggaagctgggcgtcaagtcggacatctactcgctcggcgtgctcctgctgcaggtggtcaccgcgcggccacccatggggctcacgcaccacgtcgagaaggccatcgacgcgggcaccttcgcgcagatgctcgacatcaccgtcaaggactggcccgtcgaggaggcgctcggctacgcaaagctcgcgctcaagtgcacggagatgcggcggagggaccggccggacctcgcaaccgtcgtactgccggagctcaaccggttaaggaacctcggccacgcgtacgaggcacgcatgagcgccgtcgggaccaacagtggaagtggcgaaagtaatgaccaggtcagcgggagctcgccgacggcgggtggttcatggagaacggcggagagctagcgggtggtacggcgtggccatgagtcagttagagagcgagcttgtgatggggagagttcttttgttggacggagagttcaaaatccaaaaatcttggtgtatgtacagttgtctatgaggaatactaacacgtcttgcagtgcttctgcctctcatcacttcgacgtctcgtcccggccgtcgtcttccacggctccattcacctcatcgacgagatttgtcgctgttgcggtgggccatttgccggctgcacgggcgttcttgccggtcggcggcgtggtcgtccgctatagtcgtctgtcgtccctcctgtcctgttccacggagtcgccccgacggaatggtcgcgtcgctccgtccacccgcgcttcatcctcgaggctgcggttctacccctgctctggtgcccccatgtcccatgcgaccccacttgcagttgctccgagggtggacctaggaattggcctggtcggctgccggtgttggttctgttcgccgaactcgtcgacatggcgtcacacgtcacagcagtccacggtatgggcataggtgccgtgctcctgccattagaggccggtgagacttttttacttcttccagcccccctgccacctgcttcttgctcggtattgcagatttggttttctcggtggtcgccgttgccgtctgtggtgggatggttccgttcttgctcatgtcgttcgtcatctaggtcgtgtggaggcagggggcaatgccccctaatatgcttccttaattctatatgggctgttagtttcttcggctaattctcatataaatggtgtaaaaaaaatgtttctaacaacctccctaatctaa

SEQ ID NO: 15779 - DNA, 1895 bp, Zea mays
aaaaaccaaacgctttctaaaccaaacactccttgtcggtcgccgctagctcctccaacctcgttggccgttgccgtctccgtctcgcccgcccatctacgcggcgagatctgctcgcgccgcggaaaatatagagacctgccactcgttccctttcccaggcgcaggcgcctctccttgccaggcgtgacacagacgaactggtgccgcctctgctggggcttggtcctcccagccgagcgcgcctcatccggatcttgcgacgacggtgcccaagctcccggcctccctttcgcatccctgctgcgagccgtcggtctccggaaagagttagagccgtcggtctccgtaaagaattggagccgccaggcgccttgagaagggttttgtcccgggatgtcgtcgtcggggaagatggaggggccgtctgccccggtggtgcgtcgggatccctacgaggtgctcagcgttcccagagattcctccgaccaggagatcaagtccgcctaccggaagctcgcactcaagtaccaccctgacaagaatgctagcaacccagaagcatcggaactcttcaaagaagttgcatattcttatagcatcttgtcagatcctgagaaaagaaggcagtatgatactgctggttttgaggagttagaaaatgaaggaatggatatggaaattgatttgtccaatcttggaactgtgaacacaatgtttgcagcactttttagcaagcttggtgttcctatcaagaccacaatatctcctactgtgctggaagaggccatgaatggcacagttacagtgagaccactccctgttggaacatcagctacgggaaaggttgataagcaatgcgctcatttttttggcgtaacaataagtgaagagcaagctcattctggaatggttgtcagagtgacttcacctgctcaaagtaaatttaagcttctttacttcgagcaagaagttaatggaggttatggacttgctttgcaggaagatagtcaaaagactggcaaggtaacatcagcaggcatgtatttcttgcatttccaggtgtatcgtatggactcaacagcgaatgcgttggcaatggccaaagatcctgaagctgccttctttaaaaggttggaaggtctccaaccctgcgaagtttcagctctcaaatctggaacccatatatttgctgtatatggtgacaattttttcaagccagctagctatatgattgaagcgatgtgcgcaaagagttatgaagacacaacagagaggctgaaagagatagaatctaaaattctagctaagcgaaatgatctgcgtcaatttgaaactgagtacagaaaagctttggcacgatttcaagaagtcaccaacagatatacacaagagagagaagcggttgatgatatgctgagagagagggacaatatccattgctcgttcacaactgaacgaactttggcaaaccctgttggtgtcggtagtagcagtaggtataccatcgagcagagcattcctgagagccctgagaatggtagcgtagatggcagagacaaatctggcaaaaagaagtggtttaatctaaaccttaataggtccgacaagaaagcctgatgaatcttttgtcagggaacgtcatgtgttttcactttgttgtacattttggaatccctattgtattcatgccgtatgagttctttggttcccagttctctgggagttttgtagcatatagcagttttgggtacaacattctattctcatgtatgtattatcctaagtgactgcattgaccccatgcatcccaggcgaagttgaatcgcccgaccaagttattttatcgttataatttcttctatccaaggaaaaaaaaaaaaaaaaaagcggcc

SEQ ID NO: 15780 - DNA, 2397 bp, Zea mays
gccggccgggtccgggatccatccatcgcaccgcttggtgggctgtccacatcaccaaaccttctggcttctgcactgctctccaccacccctcaacgaagcctctggtgcctcggccaccgcagcagcctggccctgccccggcccccgggcgtggtgtcaggtctcaggtgtggtggcgctttctcctctccggcacggtggccgcgtcatcccagctctcccgcgcggcggcggcggccgtttcctctcctgcgctcctcctgccgcacacagccagaaaattgcagctgaagtttgtttgaggataagcgacagctttgcgagtccttcgtgttgaaggagaaattgtagctgaagtgaaaaaacagcagggaacaatggcactatcacgaagtatgagagcatgtttgcacagtggaagacttgcacttcttgccatattggtctctggtggaattgtattgcaaatcttggcttgtgctctctataacaactggtggccaatgctaacagttctcatgtatcttatcctaccaatgcccctcatatttttcctgggttctgatacttcctccatgatgtccaatgggggagacaggttgggtgttttcgtgtaatgctggcaaactaagcttatatcatcctaataattgtttgtagggacatcgtaagtaatccttgacgttttgtgcagttctcatgtaccttatcctaccaatgcccctcatatttttcctgggttctgatacttcctccatgatgtccaatgggggagacgggtaagtgattgtctctagtccaggctgctgcttttttccccttaatcacccctgccacctgctttggcactatttgttgcccccaaagatatgcattgccttgctggcattcatttttagtagagattctaaaacaaaggtcctgagccatcatggttggattgtcttcctaaacaacatttctggtgcacaaacgaatagacttcattgccatgaaacagtctgcttgttacgtgaaacctaattgctgattacattccctaggttctctttcacatctttctaactatatatattttttcttcatacatggcaaagttaattggtgttacctttcctgccactgcagctgggtgaacttcacgaaattcttgacgggcgcatcaatagtagggagcatcgccattccgtcgatcctgaagcatgcgggcgtcattggatggggagccctgacgatggagctgtcatcctttgtggtctttggcgtggcaatcctgtggttcctccagatgaacggtgaagacgagtacagcggagtgttctaatccaaacctgctgctgctggttctcttgccagcgtggcactctgtgctgtgcatggtagttgtgaactgggctgtactgctacaacaggggaagcattgccctgggacctgatttactgacaccagtacatgtttggtctgcgatttttgtttgtcctcgtaggtttgcctgacttccagaattttgtttacgtggccgtggtatctagatgctaaattgtcagctgcctccagcagaccaaaacggagacgctcggctccggtgctcgcacgtttccagaatccactgggcgtacggcacggcacctgggcaaatgcgaccctcatccctgacgctcccacgccaggagcatctgcgcacgcgtcttcctcctctctccctcctttgcccatctttacaaatacaatatttcagtaggctttccatatgcacagcacaaaatggcacgatgtttgtcgcgccaaggacatgttcggctcctatgactccgatttagcttctctttaagagcagctgagcaagtgtttttttaacaaatcatttgataaaacatctctaaaaataactccgatttagcttctctttaagagcagctcttctataggagctagtgtttttttaacaaatcggttggtaaaacagctcctcacgccaagggaagagcaagatagagtgggtggaggaagccgctaggagccaatttttttttgactccggcttctttatagaaatagcttcgacttctcagtgctttttgttaagttatttttttattgagtccgtttaggagggcttatacagaaatcgaagctgatttggaagccttctcaaacatgccctaagtgtctgtttagtagggctctatccaaacataccattcgtgcttgtttgggagggctcctaggtggcttcgactctgggcctcccaaacgacgtaaaaaaaaatggctcttgatggagagcacacggaagccagggccaacaaaaaggcccaaagccggagcaagaaaaaactgcccgacggctcctgcctgtgcatcacgctctgctggcactgcgccgacggcgc

SEQ ID NO: 15781 - DNA, 1063 bp, Zea mays
cattgggtacctcgaggccggccggggattgttccccatcataagggccgccccgcgaccccgaccgccatccatccatccatcgcaccgcttggtgggccgtccacatcaccaaaccttctggcttctgcactgctctcctccacccctcaacgaagcctctggtgcctcggccaccgcagcagcctggccctgccccggcccccgggcgtggtgtcaggtctcaggtgtggtggcgctttctcctctccggcacggtggccgcgtcatcccagctctcccgcgcggcggcggcggccgtttcctctcctgcgctcctcctgccgcacacagccagaaaattccagctgaagtttgtttgaggataggcgacagctttgcgagtccttcgtgttgaaggagaaattgtagctgaagtgaaaaaacagcagggaacgatggcactatcacgaagtatgagagcatgtttgcacagtggaagacttgcacttcttgccatattggtctctggtggaattgtattgcaaatcttggcttgtgctctctataacaactggtggccaatgctaacagttctcatgtaccttatcctaccaatgcccctcatatttttcctgggttctgatacttcctccatgatgtccaatgggggagacggctgggtgaacttcacgaaattcttgacgggcgcatcaatagtagggagcatcgccattccgtcgatcctgaagcatgcgggcgtcattggatggggagccctgacgatggagctgtcatcctttgtggtctttggcgtggcaatcctgtggttcctccagatgaacggtgaagacgagtacagcggagtgttctaatccaaacctgctgctgctggttctcttgccagcgtggcactctgtgcatggtagttgtgaactgggctgtactgctacaacaggggaagcattgccctgggacctgatttactgacaccagtacatgtttggtctgcgctaaaaataagaaataacacggggccctgaaaaaaaaagaaaaaaaaaactcgagggggggcccggtaccc

SEQ ID NO: 15782 - DNA, 983 bp, Zea mays
ccggccgggtgtccacagcaccagaccttctccctgctgctccgctctcctccacccctcaacgaagcctctggtgcctcggccaccgcagcagcctggccctgccccggcccccgggcgtggtgtcaggtctcaggtgtggtggcgctttctcctctccggcacggtggccgcgtcatcccagctctcccgcgcggcggcggcggccgtttcctctcctgcgctcctcctgccgcacacagccagaaaattgcagctgaagtttgtttgaggataagcgacagctttgcgagtccttcgtgttgaaggagaaattgtagctgaagtgaaaaaacagcagggaacaatggcactatcacgaagtatgagagcatgtttgcacagtggaagacttgcacttcttgccatattggtctctggtggaattgtattgcaaatcttggcttgtgctctctataacaactggtggccaatgctaacagttctcatgtatcttatcctaccaatgcccctcatatttttcctgggttctgatacttcctccatgatgtccaatgggggagacggctgggtgaacttcacgaaattcttgacgggcgcatcaatagtagggagcatcgccattccgtcgatcctgaagcatgcgggcgtcattggatggggagccctgacgatggagctgtcatcctttgtggtctttggcgtggcaatcctgtggttcctccagatgaacggtgaagacgagtacagcggagtgttctaatccaaacctgctggttctcttgccagcgtggcactctgtgctgtgcatggtagttgtgaactgggctgtactgctacaacaggggaagcattgccctgggacctgatttactgacaccagtacatgtttggtctgcgatttttgtttgtcctcgtaggtttgcctgacttccagaattttgtttacgtggccgtggtatctaaaaaaaaaaaaaaaaaaa

SEQ ID NO: 15783 - DNA, 894 bp, Zea mays
acccctcaacgaagcctctggtgcctcggccaccgcagcagcctggccctgccccggcccccgggcgtggtgtcaggtctcaggtgtggtggcgctttctcctctccggcacggtggccgcgtcatcccagctctcccgcgcggcgcggcggcggcggccgtttcctctcctgcgctcctcctgccgcacacagccagaaaattgcagctgaagtttgtttgaggataggcgacagctttgcgagtccttcgtgttgaaggagaaattgtagctgaagtgaaaaaacagcagggaacaatggcactatcacgaagtatgagagcatgtttgcacagtggaagacttgcacttcttgccatattggtctctggtggaattgtattgcaaatcttggcttgtgctctctataacaactggtggccaatgctaacagttctcatgtatcttatcctaccaatgcccctcatatttttcctgggttctgatacttcctccatgatgtccaatgggggagacggctgggtgaacttcacgaaattcttgacgggcgcatcaatagtagggagcatcgccattccgtcgatcctgaagcatgcgggcgtcattggatggggagccctgacgatggagctgtcatcccttgtggtctttggcgtggcaatcctgtggttcctccagatgaacggtgaagacgagtacagcggagtgttctaatccaaacctcccccccctcttgccagcgtggcactctgctgtgcatggtagttgtgaactgggctgtactgctacaacaggggaagcattgccctgggacctgatttactgacaccagtacatgtttggtctgcgcgatttttgttaaaaaaaaaaaaactcgagggggggcccggtac

SEQ ID NO: 15784 - DNA, 2028 bp, Zea mays
cctcgaggccggccgggctcgtgtccccacccatttccgccggcctcctcttccccccgcctcgccagcccgaattaggagctacgacgaatctaccgggccgagctcgccagctggcctccccgagggcgaggccctatcggctgccgttcccccattgacagggagctcagccccgccaccgccgcggctgcggcgtgtggacgtaaccggagctcctcgcagccgctgataagatccgaagggttcctaggctttttgtggcgggaggcgactggttccgtcgggtggtccggtgagcatggcggggcccaagtttgggtcgttcaaggcagaaaagggggactcagcggcggctgcaggcgcggcggcgcagaggagggacccatacgaggtgctcggggtggggcgtaatgctactgagcaggagatcaagagtgccttccgccgcatggcactcaagtaccatccagataagaattcagacgaccctgttgcctcagagaagtttcaagaggccacattctcctataatatcctgtcagatccagacaagaggcgccagtatgatgcatcagggtttgaggccattgaagcagatagtcaggaactggagctggacctatcaagtctcaatactgtaaatacagtgtttgctgctctgtttagcaaactaggtgttccaatcaagaccactgtctcggcaacagttttagaggaggcattgaacgggtcagtagagatttctcagcttcagctgggcaaatctctatgtaggaaggtagaaaagcagtcagctcacttttattctgtggacataacagataaagaagccaaaatgggcttagtttgtagagttcattcaacttctaaaagtaaatttaagttgctgtattttgagcttgaggacaatggtggattaagccttgctttacaggaagatagtgcaaaaactggaaaagttacttctgcgggcatgttctttctaggctttcctgtgtatcgatttgaacaaaataattcagctgctgctgcgaaggatcctgacagtgctttctttaaaagattggatggctttcaaccttgtgaagtaaatgaactgaaagcaggaagccattattttgctgtatatggtgacaatttctttaaaagtgcaagctatactattgaggttgtatctgctgaacccttctctgctcaaaaagagaagctacgaagtgtggaggcaaagataattgcaaaacgatctgagctgtctaaatttgagtctgagtatcgcgaggttttggcaaagttcactgagatgactagcagatatgctcaagaaatgcaaacgattgatgaccttctaaaggaaaggaatgcaattcatgcatcctataccaacaacccaactctgcagcggagttccagtagcagcaaagggaaatcaccctctaaagggtccagaagtgaggatgaccaaactgtaaagaaggaaaagaaatccaagagccagccaatggagggatccaaaagcgatgacgagggtcccgaaaacaaaaaggaagaaaagcctaaagatcggattcgaaggaagaagtggttcaacattcatttgaaagtggacaagagaaggccctgctgataactgcgatatatcatgtactcctcaagatctctgctccaagtacaaggaaaaattcccatttgacgtccaggaagatgcatcttgtcgatcattcccatgatcaagcccattctatttcctgaaaagtcaggaacctcgccagcttcaaaaatggtgtatgtaccacttagttttggacccctagtcggatactgttgtatttatctcaagttggacggttatgtacaatacagaccttagtagtgtgatgtccagaatggcagaatccaattcagatttgttcaatttgtttgatgttgtccgtgtcaaactttactacccaacttgactcagccatccgatcggggcgcctgatcctgtattccatgaggcaatctagcaatgtgcgatgctggtta

SEQ ID NO: 15785 - DNA, 2063 bp, Zea mays
  misc_feature (247)..(247): n is a, c, g, or t
ggttcgccaaaaggttcgagacgcgcaccgccagccgatacgaatccgacgagctcgatcgctccacttccccgatcgcacgccaatcagcaccagccaccgtggcgatgacggaggaggcggaggcgaaggcgaagggcaacgcggcgttcgcggccggccgtttcgaggaggctgtccagcacttcagcgacgccatcgcgctcgcgcccgacaaccacgtcctctactccaaccgctcggcggncgtacgcgtcgctctggcgctacgcggaggcgctagatgacgccaagcggaccgtggcgctgaagccggactgggccaagggctactcccgcctcggcgccgcgcaccttggcctcggtgacgcgcccaaggccgtcgaggcctacgagaaagggcttgcgctcgagccgtccaatgaggcgctcaaatccggcctcgcacaggcgcgccagtccgcatcggcgccgagacgtccggtgggctccggggctgacgccgttggcaagatgttccagggccctgagctatggagcaaggtcgcggccgatcccaccacgcgtggctacctcgaccagccggacttcgtgcagatgctgcgggaggtgcagcgaaaccccggcagactgaacagctacctttctgaccaacgaatggttcaggtgctcaccctcatgctgaacatcaagttccagaaccagagcagtggggcgcctgacccggcagcagcacaatcgaacccgccgccaccaaagcagcagccagaggcgaaggcaagagaaccagagccggacccggagcccgagcctatggaggtgacagaggaggataaggagcagaaggagaggaaagcgtcggcgcagaaggagaaggaagcaggcaacgccgcttacaaaaggaaggattttgataccgcgatccagcactacacagaagccatggagctcgatgacgaggatatctcctacatcaccaatcgtgctgctgtttaccttgagatgggaaagtatgatgaatgcattaaggactgtgataaggctgtcgagagaggaagggaactgcatgctgatttcaagatgatctcaagggcacttaccagaaaaggaactgctcttgccaaacttgctaaatcatcgcaagactatgatgctgccattgagattttccagaaggcgttaactgagcaccggaacccagatacactgaaaaaactaaatgatgcagaacgagcaaagaaggagctggagcaacaagagtactatgacccaagaattgctgacgaggagcgagaaaaaggtaatgagttctttaagcagcagaaatatccagaagcagtgaaacattacaccgaagctctcaggagaaaccccaaggaccccagggtatacagcaatagggctgcctgttacaccaagctaggggcccttcctgaaggtctgaaagatgctgagaagtgcattgagctagatcccacattctccaagggatacacaaggaaaggtgctatccagtttttcatgaaagaatatgacaaagcgctggaaacttatcaagctggcctaaagcatgacccgaaaaaccaggagttacttgatggtgtaaggaggtgtgttgaacagatcaacaaggcgagcagaggcgaactcagtgaggaggaactgaaagagagacagaacaaagccatgcaagaccctgagatccagaacatcctgactgatccgatcatgcagcaggttttgacggatctgcaggagaaccctcgggctgcgcaggcgcacctcaagaaccccggagtgatgcagaagatccagaagctcgtcagcgcagggatagttcagatgaagtagacggtggctggaatgtccgggttcagatctgggacctgtgctggaaatgctgtgaacttgatcattgtttcgcattttggaaactgaacccttttgtgcgaccatagtttggtcatggctgttaatgatccatatatgggttttcccatccgatatgttccaattcgtgcctttccccctggaatgcccgtgaaaaaggaagaatattcatc

SEQ ID NO: 15786 - DNA, 4034 bp, Zea mays
  misc_feature (315)..(315): n is a, c, g, or t
  misc_feature (834)..(834): n is a, c, g, or t
  misc_feature (1511)..(1511): n is a, c, g, or t
gagccctagagaattaaaagagaaaaaagagaggaagaaactagctaccacaattggaggcacttatacaatgaacagtctagtaggggtctagccccgtaaaacctggtctgctaatacataacccacagtccggtatgatcgctcgcataaactcggtctctagcgccctatgtggtcgagcccggtaagggccgcccttatgaacccggtccctcgtgatctctatgaaaaatctcacatatctagtaatgacgaaaggttttgctctcggtgtagttctagtaaattggttatgtcatcatagccttagtngaggtatgtttctccttctaccccctctcgagattctcaactttcttgttatcatgaaatctatattatataatatgcattgttgcttagtttatgtccccacttaatactgaacaagacacaggttgacaagcatctggtctaaaggaaaagtccacattctcacgggtggtccagagttaggtagccgcttagcctggtcccataccgtaagactacaccttccactgccccagaatagctgacctagtactttccatatcagatacctaaaaggcctacgcctcgttcaaaattaagggccggctctcataaactctactcgacaaaagcccggttgcataattcgatagattgagtacaacaaagtaaggatcctgagagtacactgctaggcacaatcaaggagggcctaggaatgatgtgtcaccacttattcctgggcctacccattgtccagacagaggtctggtgccaaagtgtggccagatgtacctgatgtaagccgtcggacggtgnctgacgtaagcatctaacatagggcctgccaacattaggtgcatatgggatgcatacttacctatgccagcaacatgtagcgtatcccccgcattaaatgcgcgaagcacgccagggttgcaacatgcgatttctactattatccgcacattaccaaggcaataatattgactcaatgtgtcgtctaggtgcccttcattatgactttcattgttccttgtgccttaccgaagcatgaagagacaggtgcagaagacgagacaacatcgtccacaacctagtgccctacacatggcagcatatcagactacaccacaacctactccatggaccaccacgacgaccaagaggagatacacactcaagaagatctagtgtcgccaggcttatctgacgcctcacgtcctactttgtaactactcttgggtccacctgtcggggctcaactcccttgtaacgtgccccttggaccataaaagggtgggcttgcactgtagcaggggaagagaggcttagactctcgactctcaaagcaatacagcacacaattgatgttggatattacgctccggcggctcaaaccactctaatccttgtgttcattcaatcgttcatgcaaatctctaagcctccttctcatcttaggattagggagggtgcgctccaccactcggacngaggatttcccctctgaaaaaatcaattacctaaaaagtggattcatagactaagagaatgtgtaaagaactatatttcttattccatgttgagtctctaaatacattgtaatgcaaaattattttaatctctattggagttaattaatgtacaattgtacggtgcaagtttctttgattagcttattatttatgctatttataaattagtatacacatgtgtatatattatgtggtattttttctagacccctcctataccttaaccctggctctgccctgatccaattataaaactaattacctaaaccgtggctaatttgtgacatgaatctattattcctaattaacttataatttgtccacttaatgcgatagcaaacatttgttaattatagattaataagatttaatagatttatctcacagattagccatgatttatgtaaattatattataattagattatatttaattatattaatcctaatctcttatataaactgaattaaattttagtctactacaagcaccccgacattttctcacggccctttggctctgggcgtctgtccggcgggttctcgttttctcctgttgtccggaacattccagaatcgtggagaccggtcgggactcgggactagaacccgtgccttctctctccactctttatacttgcccctcctcgacggttcgccaaaaggttcgagacgcgcaccgccagccgatacgaatccgacgagctcgatcgctccacttccccgatcgcacgccaatcagcaccagccaccgtggcgatgacggaggaggcggaggcgaaggcgaagggcaacgcggcgttcgcggccggccgtttcgaggaggctgtccagcacttcagcgacgccatcgcgctcgcgcccgacaaccacgtcctctactccaaccgctcggcggcgtacgcgtcgctctggcgctacgcggaggcgctagatgacgccaagcggaccgtggcgctgaagccggactgggccaagggctactcccgcctcggcgccgcgcaccttggcctcggtgacgcgcccaaggccgtcgaggcctacgagaaagggcttgcgctcgagccgtccaatgaggcgctcaaatccggcctcgcacaggcgcgccagtccgcatcggcgccgagacgtccggtgggctccggggctgacgccgttggcaagatgttccagggccctgagctatggagcaaggtcgcggccgatcccaccacgcgtggctacctcgaccagccggacttcgtgcagatgctgcgggaggtgcagcgaaaccccggcagactgaacagctacctttctgaccaacgaatggttcaggtgctcaccctcatgctgaacatcaagttccagaaccagagcagtggggcgcctgacccggcagcagcacaatcgaacccgccgccaccaaagcagcagccagaggcgaaggcaagagaaccagagccggacccggagcccgagcctatggaggtgacagaggaggataaggagcagaaggagaggaaagcgtcggcgcagaaggagaaggaagcaggcaacgccgcttacaaaaggaaggattttgataccgcgatccagcactacacagaagccatggagctcgatgacgaggatatctcctacatcaccaatcgtgctgctgtttaccttgagatgggaaaggtaaggactcgtaggtccctagttctaaatcacaagttatttacatatatatgtagtctttagttaaagaaaaaaaacgtaaaatgtgggttgtctgaattttgtcaatgtgatcagctaccgagaactttttacaacgtactgctaacagcttttagatataaaattggctaagtattggtctctccttggagtaatggggtcaattgatattccagttctacttgaatttgtcgagaactcgagttgcattggcctcctttggatcaaaggattggaaaaatgtaggaataggaaaaatacaggaatatgataggaatgccagggtaaaacacaggattgtagaagaggatttttgtgagaatggtcctttggataggctcgaggaaaaacacaggatttttaaagacaatagattcaaatgaatgtcaaattgtatttactaacatcatctgcaattgattatccatgtattagatgacttaggtcccatctagcttgtggttggcctcgatcctatgcgacaaggaagaaaaaatgaggttcaagtggatgttttaaatcctccaaatttcccatgaaactgtcaccttggaaattttcctaggcttttcccatgccctaatcctctgttccaaagggtgctatagtaccaattccaacaggaatgagaatcccaatgttttcgcgtgaaattcctttgatccaaaggagccctaaaaggaagttttgtggtacgagttggtgattgtgacagtgagcaaaatacattagtgttccacagtcatgaaattctgatacaggtagggtggtaatggg

SEQ ID NO: 15787 - DNA, 1630 bp, Zea mays
ttttttttttttttttggaaagttattttgtaatttattattgattttttataatccttttatattatagaacagatagataaattgggtacctcgaggccggcccctatccgttgaaaaaaatccggcacctccatcaaatcagatctcacgcccctgcagccaaaacaaaatcagcatccggatctccacattccccaccaaaaatcatcctccggacgaaatcagcggcggcggagatgggagcggagtgccggtacgaggtggcgcaggcggcgtacatcaagctggcgctgcacgcactgaagcacccggcgaccgccgtcaacggcctcctcgtcggtcgcctcgtcgagccttcgtcctcaccggccgtcgtctcggtcattgacgccgtgccgctttctcaccacccgcaccatctgccgctgctccccacgctcgagctcgcgctcaccctcgtcgaggaccacttcgcaacccagggcgaaggcctcgccgtcgtcgggtactatcacgccaacccgcgctgcgacgacaccgagctcccgccagtcgccaagcgcgtcggagaccacatcttccgatacttcccccgctccgcggtgttgttggtcgataacaagaagcttgaggaggccgtcaaggggaagttttctgatgcggtgattcagttacacaccagggattcatcaaaaagttggcgtcaggctggatcagatggaagcagtcagctgattctaaaagaaccttctaccaatgttgtcctagctgatcatgttacaacaaagaaatgggagaaaattgttgatttcgatgaccaccttgatgatattagcaaggattggtcgaacccaggcctccttgactgaattttcatgattgatctcgctatactgttttggaacttcgctagaaatgaggtggtgaagctcgtcctgctgtgctatggatttctctcagtcgcaacgagttgtaagcactaagcacggatttcattttaatgtaaatgagtgattttgtaacaattacagttcaaaatgctaaaattatgcagagaccatgagattgtttcaaggtcatgacaattattacgagttgtcacaaacaatttttgttcgtacatgactcttattttaaagaatgaaagttcacataaatttaagtgaaaaaaaaaaaaaaaaaaaaaaaaaaaaaaaaaaaaaaaaaaaaaaaaaaaaaaaaaaaaaaaaaaaaaaaaaaaaaattcacttcttttccaactttattaaacttagggcaaaaaaaaaaaagggtttcccccgaaaaagggaatttcaaaaaaaagggtttggggggttcctcttgttccccggggtttttttgcttttggggggggattttggccggaaccccaatcccgaaaaaaaaatgggcaaaataaagggccaaaataacggaaacccgccaaaaaggaaaaaaggcgggaaaaagtcccaaacccggaaccaccataaccttaaaaaaaatttttggaaaataaagggtaaacaccaccagaaccctgaaagaaaaaaaatttgggaacaaaaggcaataacctatggtttaagccaccgtccaaggccaaggttttttaatgagggaaaaa

SEQ ID NO: 15788 - DNA, 1061 bp, Zea mays
  misc_feature (40)..(40): n is a, c, g, or t
attgggtacctcgaggccggccgggaccaaatcacatacnaggaaatcagcggcggttgacatgggagcggagtgccggtacgaggtggcgcaggcggcgtacatcaagctggcgctgcacgcactgaagcacccggcgaccgccgtcaacggcctcctcgtcggtcgcctcgtcgagccttcgtcctcaccggccgtcgtctcggtcattgacgccgtgccgctttctcaccacccgcaccatctgccgctgctccccacgctcgagctcgcgctcaccctcgtcgaggaccacttcgcaacccagggcgaaggcctcgccgtcgtcgggtactatcacgccaaacccgcgctgcgacgacaccgagactcccgccagtcgccaagcgcgtcggagaccacatcttccgatacttcccccgctccgcggtgttgttggtcgataacaagaagcttgaggaggccgtcaaggggaagttttctgatgcggtgattcagttacacaccagggattcatcaaaaagttggcgtcaggctggatcagatggaagcagtcagctggttctaaaagaaccttctaccaatgttgtcctagctgatcatgttacaacaaagaaatgggagaaaattgttgatttcgatgaccaccttgatgatattagcaaggattggtcgaacccaggcctccttgactgagttttcatgattgatctcgctatactgttttggaacttcgctagaaatgaggtggtgaagctcgtcctgctgtgctatggatttctctcagtcgcaacgagttgtaagcactaagcacggatttcattttaatgtaaacgagtgattttgtaacaattacagttcaaaatgctaaaattgacgttgtgatgatatttaagtagattcgtcccagccgcatattaattatgcagagaccatgagattgtttcaaggtcatgacaattattacgagttgtcacaaacaatttttgttcgtacatgactcttattttaaagaatgaaagttcacataaatttaagtgaaatggtgtagacaagcggcc

SEQ ID NO: 15789 - DNA, 1100 bp, Zea mays
aaccaacccactcatcactcctcactcactcactcaaaacgaaagccattgggtacctcaggccccgcgggccgggcggggctcacacctcacacccacaggcctgccgccacagcaccgcggatagcagagcagagcggcagccaggtcggtcgtcgtcgtcgtcgtcagccatgagcaaggacaagcaccacaagcacgagcaccacctgcggcgttgctgcgggtgcatggcgtcgtgcctcctggcgctggtcctcatcgtggccttcgtctcgctggtggtgtacctggcgctgcgcccctcgaagccgtccttctacctgcaggacctgcagctgcgcaggcccatctcgctgggcgacccgtcgctgacggcgtcggcgcaggtgacgctggccgcccgcaaccccaacgaccgcgtgggcatcttctacaagcgcctggacgtgttcgtcacctaccgcgacgaggccgtgacggtgcccgtgtctctgccgccgcagtaccagggccaccgcgacttcaccgtctggtcccccgtgctgtcggccgagtccgtgcccgttgccgcctacgtcgccgacgccatgaagcaggacgtcgccgcgggcttcgtcgcgctgcaggtcaaggtggacggccgcgtcaagtggaaggtcggcagctgggtctccggcagctaccacctcttcgtcagctgccccgccgtgctctccgcgggctaccccggcgtcaacaacaccgcgtcgtcgctcaagttcgcccagcccacaggatgcagcgtcgaggtgtgatgagtttgtgaccaaacaagtgccctgccccctacgtattgttgcgtgctgctcaaatttcatcttttgggtgcgacggccgccgttaactgggctcttttaatttggttcatgtctcgttgtcaattctcattctcttgtgggccgggggaataaattatttaatttgctttcgccagacggctgtccacaaacttcaactcagttgtaccgtgacgtgtattaattatttgatttcgtccttttattccttttattaacctcaaacgatgtacaaccgccaaaaaaaaaaaaaaagcggcc

SEQ ID NO: 15790 - DNA, 1129 bp, Zea mays
tcgcattgggtccctcgaggccggccgggacggctcagtcaccaacccactcatcactcctcactcactcactcaaaacgaaagccagctcagctctgctcagctgctcacacctcacacccacaggcctgccgccacagcaccgcggatagcagagcagagcggcagccaggtcggtcgtcgtcgtcgtcgtcagccatgagcaaggacaagcaccacaagcacgagcaccacctgcggcgttgctgcgggtgcatggcgtcgtgcctcctggcgctggtcctcatcgtggccttcgtctcgctggtggtgtacctggcgctgcgcccctcgaagccgtccttctacctgcaggacctgcagctgcgcaggcccatctcgctgggcgacccgtcgctgacggcgtcggcgcaggtgacgctggccgcccgcaaccccaacgaccgcgtgggcatcttctacaagcgcctggacgtgttcgtcacctaccgcgacgaggccgtgacggtgcccgtgtctctgccgccgcagtaccagggccaccgcgacttcaccgtctggtcccccgtgctgtcggccgagtccgtgcccgttgccgcctacgtcgccgacgccatgaagcaggacgtcgccgcgggcttcgtcgcgctgcaggtcaaggtggacggccgcgtcaagtggaaggtcggcagctgggtctccggcagctaccacctcttcgtcagctgccccgccgtgctctccgcgggctaccccggcgtcaacaacaccgcgtcgtcgctcaagttcgcccagcccacaggatgcagcgtcgaggtgtgatgagtttgtgaccaaacagtgccctgccccctacgtattgttgcgtgctgctcaaatttcatcttttgggtgcgacggccgccgttaactgggctcttttaatttggttcatgtctcgttgtcaattctcattctcttgtgggccgggggaataaattatttaatttgctttcgccagacggctgtccacaaacttcaactcagttgtaccgtgacgtgtattaattatttgatttcgtccttttattatccgtaaaaaaaaaaaaaaaaaaaaaaaaaaaaagtactctgcgttgttaccactgct

SEQ ID NO: 15791 - DNA, 1072 bp, Zea mays
cccgcttggtgtgccactacagttttttttaaaagccaggtcgctcgccgcgccccgacggctcagtcaccaacccactcatcactcctcactcactcactcaaaagttcaaaacgaaagccagctcagctcagctcagctcagctcatctgctcacacctcacacccacaggccggccgccacagcaccgcggatagcagagcagagcggtgagctgcagagcagggcagccgaggtcggtcgtcgtcgtcgtcgtcagccatgagcaaggacaagcaccacaagcacgagcaccacctgcggcgttgctgcgggtgcatggcgtcgtgcctcctggcgctggtcctcatcgtggccttcgtctcgctggtggtgtacctggcgctgcgcccctcgaagccgtccttctacctgcaggacctgcagctgcgcaggcccatctcgctgggcgacccgtcgctgacggcgtcggcgcaggtgacgctggcctcccgcaaccccaacgaccgcgtgggcatcttctacaagcgcctggacgtgttcgtcacctaccgcgacgaggccgtgacggtgcccgtgtctctgccgccgcagtaccagggccaccgcgacttcaccgtctggtcccccgtgctgtcggccgagtccgtgcccgttgccgcctacgtcgccgacgccatgaagcaggacgtcgccgcgggcttcgtcgcgctgcaggtcaaggtggacggccgcgtcaagtggaaggtcggcagctgggtctccggcagctaccacctcttcgtcagctgccccgccgtgctctccgcgggctaccccggcgtcaacaacaccgcgtcgtcgctcaagttcgcccagcccacaggatgcagcgtcgaggtgtgatgagtttgtgaccaaacaagtgccctgccccccctacgtattgttgcgtgctgctcaaatttcatcttttgggtgcgacggccgccgccgccgttaactgggctcttttaatttggttcatgtctcgttgtcaattctcattctcttgtgggccgggccgggggaataaattatttaatttgcttt

SEQ ID NO: 15792 - DNA, 1721 bp, Zea mays
gtccttttctacatcctagccgtctgtatagataaaatatgtagtagtgagcaggagtagtggtcaatgagaatgagaagaaggtagacccagattttttataaaataaaaacggatataggtaaccaagattggagggtcgaacgggcaaccgtcgcgtcggccaccattattcctgtgggtttaaaatgtaagcgtggctgagtgaatctcaagctatgacgtgtgtacttcccggcgtcgcactcaagcaaaggtgaaaggtggacacgaatctcaaagcgcacatgcacacgcacaacccgacgtccccgtggctgacccggtggcccagtactggatgaattatgtgccggattagcagatggaggaatcttcttcggttgggacgttgctttccggccgccgctctctgcttgtctgctctactcaggctcaaccctgccgcgagggttaaccaatcgtgctgtgctagcaagggaagggaacccttttgagtggcacatgcatgcgctgtgtttcgtgttgtgtagtgtagtgtagtgtaggggtagcccgcttggtgtgccactacagttttttttttaaaaaaagccattacgctttcctagaccgcacggctcagtcaccaacccactcatcactcctcactcactcactcaaaacgaaagccagctcagctcatctgctcacacctcacaggctcacacccacagggccggccgccacagcaccgcggatagcagagcagagcggtgagctgcagagcagggtagccgaggtcgtcgtcgtcgtcgtcactcgtcagccatgagcaaggacaagcaccacaagcacgagcaccacctgcggcgttgctgcgggtgcatggcgtcgtgcctcctggcgctggtcctcatcgtggccttcgtctcgctggtggtgtacctggcgctgcgcccctcgaagccgtccttctacctgcaggacctgcagctgcgcaggcccatctcgctgggcgacccgtcgctgacggcgtcggcgcaggtgacgctggcctcccgcaaccccaacgaccgcgtgggcatcttctacaagcgcctggacgtgttcgtcacctaccgcgacgaggccgtgacggtgcccgtgtctctgccgccgcagtaccagggccaccgcgacttcaccgtctggtcccccgtgctgtcggccgagtccgtgcccgttgccgcctacgtcgccgacgccatgaagcaggacgtcgccgcgggcttcgtcgcgctgcaggtcaaggtggacggccgcgtcaagtggaaggtcggcagctgggtctccggcagctaccacctcttcgtcagctgccccgccgtgctctccgcgggctaccccggcgtcaacaacaccgtgacgtcgctcaagttcgcccagcccacaggatgcagcgtcgaggtgtgagtttgtgaccaaacaagtgccctccctgtcctgccccctacgtattgttgcgtgctactcaaatttcatctctgggtgcgccggccgccgttaactgggttcttttaattttgttcatgtctcgttgtcaattctcattctcttgtgggccgggggaataaattatttgctttcgccagatggctgtccagaaacttcaactcagttgtaccatgacgtgtattaattatttgatttcgtccttttattaaaaaaaaaaaaaaaaagccgccaaaaaaaaagcggcc

SEQ ID NO: 15793 - DNA, 1085 bp, Zea mays
caacccactcatcactcctcactcactcactcgaaacccaagcccagctcagctctgctcatctgctcacacctcacacccgcaggccggccgccccagcaccgcggatagcagagcagagcggtgagctgcagagcagggcagccgaggtcggtcgtcgtcactcgtcagccatgagcaaggacaagcaccacaagcacgagcaccacctgcggcgttgctgcgggtgcatggcgtcgtgcctcctggcgctggtcctcatcgtggccttcgtctcgctggtggtgtacctggcgctgcgcccctcgaagccgtccttctacctgcaggacctgaagctgctcaggcccatctcgctgggcgacccgtcgctgacggcgtcggcgcaggtgacgctggcctcccgcaaccccaacgaccgcgtgggcatcttctacaagcgcctggacgtgttcgtcacctaccgcgacgaggccgtgacggtgcccgtgtcgctgccgccgcagtaccagggccaccgcgacttcaccgtctggtcccccgtgctgtcggccgagtccgtgcccgttgccgcctacgtcgccgacgccatgaagcaggacgtcgccgcgggcttcgtcgcgctgcaggtcaaggtggacggccgcgtcaagtggaaggtcggcagctgggtctccggcagctaccacctcttcgtcagctgccccgccgtgctctccgcgggctaccccggcgtcaacaacaccgtgacgtcgctcaagttcgcccagcccacaggatgcagcgtcgaggtgtgatgagtttgtgaccaaacaagtgccctgccctgccctgcccccaacgtattgttgcgtgctactcaaatttcatcttttgggtgcgacggccgccgttaactgggctcttttaatttggttcatatctcgttgtcaattctcattctcttgtgggccgggccgggggaataaattatttgctttcgccagacggctgtccagaaacttcaactcagttgtaccgtgacgtgtattaattatttgatttcgtccttttattaagaaaaaaaaaaaaaaaaaaggccccta

SEQ ID NO: 15794 - DNA, 626 bp, Zea mays
tcacctaccgcgacgaggccgtgacggtgcccgtgtctctgccgccgcagtaccaggggccaccgcgacttcaccgtctggtcccccgtgctgtcggccgagtccgtgcccgttgccgcctacgtcgccgacgccatgaagcaggacgtcgccgcgggcttcgtcgcgctgcaggtcaaggtggacggccgcgtcaagtggaaggtcggcagctgggtctccggcagctaccacctcttcgtcagctgccccgccgtgctctccgcgggctaccccggcgtcaacaacaccgtgtcgtcgctcaagttcgcccagcccacaggatgcagcgtcgaggtgtgatgagtttgtgaccaaacaagtgccctgccctgccccctacgtattgctgcgtgctactcaaatttcatcttttgggtgcgagtgcgacggccgccgttaactgggctcttttaatttggttcatgtctcgttgtcaattctcattctcttgtgggccgggccgggggaataaattatttaatttgctttagccagacggctgtccagaaacttcaactcagttgtaccgtgacgtgtattaattatttgatttcgtccttttattaaaaaaaaagggcggccgc

SEQ ID NO: 15795 - DNA, 982 bp, Zea mays
ggccgcgagcgggcggtggaagccgtcggggaaggagaagccggtggtgctgccccgcccgtgtggcggagggagcctcctggtgggcgtgaagagggcgatgacgttcgtgccccgccgccggaagaagacggcggcgttgccgtcgtcggcggccctgaagaccggctgggtcatgcacgagtaccgcctcgccgcgccgctgcacaagaacggctgcagcctggctcaggcgcaaggagagtgggtcgtctgccgcatcttccagaagggcggcaacaggccgaggaggaggcagcgagaagcgtcgccgccgtccgctagcagcagctgcgtcacggatgcgtcgagctcggacctggacgaggtcagcagctagctagctagctagctagctagcagaaccgaccgtacgtgccggctggccacaacatgcagtcaagaacgtacgtacgtatgtataccgccaccagctcagctcgtcgcgcgcgcagctgtgctgcctgtgcatgccgtacgtgtgcggccggcctcgacctcgatctcgaagagaggatgtgatcaagctgagttacggataagggggaacaacccatccacacgcacttctcctccgacccaacattatttgttgttaactagtttttcttttctttatctctttctttcttttgcactctgtacgtgtaatgtaatgcagtgtaatttaattagtgagagaagcatgacgccctactaccggccggattattagttaacagcaaattaattactacgtacctactactcgcgtcagcagcttctactgtacttgaggtttcagaagcccaatatgtatattgtcaaattagtaacctgcattatatgcagaggtcgtcgtacgtgtccttaattagtgtctttgtaatatctcttcatgaagcgaggaggaaggaaggaacctgaatccatgcgtaacagcgcagtcgttgctgcataccag

SEQ ID NO: 15796 - DNA, 3300 bp, Zea mays
  misc_feature (2673)..(2673): n is a, c, g, or t
ttggtttatttcaagaacccgaaaaagaaagctcgttgtcggtgtccagggaaaaaaaaagatgaagaaaactggtttgggtacgtacggtgacggataatgaatcacatcgcacatatatatgccctggtggttgcaaatttatgccgacaccgagtggtagctgtacttaaccagtaagtactgctgcttgcagctcagatggaccggccgcccggccggccggattccgccgtgatctctctctgcttgtccctcgccccaccaccacaccacaccgtagaggtaggtccatggccaaccaacaaccaatcaaccgaagcagcagcgcctgaaccgctggcactttaattctgacgacgacgacgacgacgccttgattagcctgcaaatactactgcatgcatctgccgcatgccgccgcacagtacctgcgtgcacgagcagtacccgctggtcatcgatcggatggagttgaagtaaacacatcgactattgaattgatccgcacagtacacatcgctttgcttaattcgtcactcactgtggtagtagtagctgtagctgctctctgatcggcagcgccggcctcctgcagctagtagaccgctacacaccagactacagagtctacagtatagtctctcccttcagcttcagcttgcacaatagcaagatgctccgatccaccgccggaccctctgtgccccgcgcttttgtttcgcttgtcgttgacgctggtcactggtcttggtcatcttatatatccacgcagggctgcagcctggctcaggcgcaaggagagtgggtcgtctgccgcgtcttccagaagggcggcaacaggccgaggaggaggcagcgagaagcgtcgccgccgccgtccgctagcagcagctgcgtcacggatgcgtcgagctcggacctggacgaggtcagcagctagcttagctagctagctagcagaaccgaccgtacgtgccggctggccacaacatgcagtcaagaacgtacgtacgtatatgtataccgccaccagctcgtcgcgcgcgcagctgtgctgtgcatgccgtacgtgtgcggccggcctcgacctcgatctcgaagagaggatgtgatcaagctgagttacggataagggggaacaacccatccacacgcacttctcctccgacccaacattatttgttgttaactagtttttcttttctttatctctttctttcttttgcactctgtacgtgtaatgtaatgcagtgtaatttaattagtgagagaagcatgacgccctactaccggccggattattagttaacagcaaattaattactacgtacctactactcgcgtcagcagcttctactgtacttgaggtttcagaagcccaatatatatgtatattgtcaaatttgtaacctgcattatatgcagaggtcgtcgtcgtacgtgtccttaattagtgtctttgtaatatctcttcatgaagcgaggaggaaggaaggaacctgaatccatgcgtaacagcgcagtcgttgctgcatatatgcgttgggctctgtgttatttgactgtgtttctgccaaatctggatttaatttgatcggtcatattcaggcccccgggccgggctcgcaccgtgccgcgcccctgcaggttattaattagtatcaggaaaacgttaattacaaaatcattttttttagaaaaaaagtagcaggggaagaacacaacacagaagggaacgacgttttgcggaggagaccattttttaccacaagaaattctttgaccatttgactatcaaaaccgtccacacatctagctaccaagttatattgaaactgaaaggctggatattatgatataaagaccgagactatagtgctgttagttgaatcgatactcacgggtactatataggcctcgctgccagaaacatgttctttctcgaagtttctgcagagtgtatcactcagcaaaaaaaacgacactcgacaaataccatcggcttggcacatccatatttgtcgagtgtccaactattggcaaaccttgacactaggcaaagcgccgtcagcaaccgtctagatctgacgatcgttaactatgccgagtgtcaaacaatggtacttgggaaagatactggcaaagcgatcatagttgccgagtgtctggccacatattcggcacataaactgcgcatggggcccactcgtgctgtctttgtagagtgcctctaagacgagcactcggcaaaggctccatcgtcgtctctcaccaccgtcacagtgactttactttgtcgagtacctttgcgaactcggcaaagactttgctgagtgtctgatagaaagtattcggcaaagaggctttttccgacatcaggttcaccgagggatctttctcgagtgtgacactcggtaaagaattctgcactctgcaaaaaagtcgtgtctagtagtgggcctaaccatattccatctatctctaggattttatatttatgtgcagagtttctgtatattgccaattatgtctaaccataaatatatatctatacttctaacattcctcagttgtagtacaagcaaaagaaatgagtgtgactaaatttatttgaagtcatgtgctttcattatcttcttcactcactatcatcaactaactctctaatgnatggtttggaacctacgccactgcatgtgccccttcgagtgtcaacaattctccctcgcttattaaagaatacgcctaagaggtgatgaattaggctttccaaaattactccatgaagggatcaaaagtttggtccttgcgaattgcaagggcatttcgcaagaggttccaatgatgattagggagaatatgagcttcttgatatctcagtaaagtcatcaacaagagcctgtgtctctatctcaatcaagtttccacattattactatgtatctaggttgtgtgtttagaattctatttatctttctacgctagttgataggattagaaactagtttgcataactcttttttgatagacatagcaacaaacttattagcaaaatcttagtgatgattgatgattacaggccatagtttagagtatatgtttttagaaagcatgatttaccactttattaggcgttaatggtcttttcagatgatggtcacacaggtttaaacatgagacacgtgggtttatgagagtgatcgcaaagcgaggaaaacctagattaatggaacttcttagcaaaagctacaagcgaaaaagcagtgtgaactagcttcaacccccatgcccttatat

SEQ ID NO: 15797 - DNA, 1823 bp, Zea mays
tcgaggccggccgggagaacctcctcacttcccgcaatgactggctcactgctgggtgccacgagaccattacctagaacatcctgctttcgccacgtgaccccgaggcccgagcccgaagcggcggcgcgccgggcgtcttgacgtccccaatgacgccgcgcgtcgtggacggacctccgcagcttccctctcgtccgttccgcagtccgcacggggaggggagctacagcgacctaccgccgaggcgggccccaaccgcaccacgcctacttcaaaccctctcccacccccacctcctgccgttctcggaggggatcaagttcgcttctgcctgcgtgctctgctggagagctagatggcgatgccgtccgggtggaggggtatcctgggcttccactacggcatcgtgcaggcgccgttgggccccgacatctccggccccgagctcgtcgccgccgtggcgaacgccggcgccatcggcctcctccgcctccccgactggccggcgccggatcacgtcagagaactgatccggaagaccaggagcctcacgtccaagccgttcggggcggccatcgtgctggccttcccgcacgaggagaatctcagggtcgtcctggaggagaagctcgacgtgctgcaggtctactggggggacttccccaaccaccgggtccaagaggcgcatcgcgccggggttaaggtcttgcatcaggtcggcagccttgaggaggcagctaaagctaaagaagccggtgtagatgggatcattgttcagggacgtgaggcagggggtcatgtaattggtcaggaaggactgtttccactgttgccacgagtagtagatcttgtttcagactcgagcattccagttattgccgctggcggaattgtagatggacgtggctatgttgccgcattggcactcggtgcccaaggtgtttgtttaggaactaggtttgttgctaccgaggaaagctttgcacatcctatttataagcaaaagctaatcgagatgagtcacacagactacacaaatatattcggacgtgctagatggcctgatgctccacagcgggtcctggaaacacccttctatgatgagtggaagaataatttcccagaccaggaaacagaggaagatcaacccatcataggccactctatcatccatggtgtgcacaaggatattcgtcggtttgccggtactgttccaaacgcgacggcaacaggagatatcgacatcatggccatgtattcgggtcagggtgttgggctaatcacggagatcataccagctgctcaagttgtcaaaagtctggtcgctgaagcgaaggaagtcatcagagaaaagctttctggttaccaatagaatccttcctgaactgcaaactagaagtatctgtgtgtgagtagtcaccaatcagaataatcggaagcaccaaggtttaggtttgattcttgtgctatttttaagtacaataaagtaaaaaatgatgaaaataaacgagactaacaaaggtattctgtcagacatttgtgtgcgtgtgtgcgcgctctgcatatctgtaatagttttggagtgtcttcacatagccctgaaggtcttcaaaagggtatttttggaggataggttgcaaaccaaacatatgtgatttaggtttggatgttggttcggtatgtccatcaatccaaacatgttttacaaaatggtcatgagaaatactatataaactcttacatggcgcccttgtacaggttgggcaactgatatgatagccccaattaaaacaaaaaaaaaaaaaaagccgccctcgagc

SEQ ID NO: 15798 - DNA, 841 bp, Zea mays
cattgggtacctcgaggccggccggggaataattcaaactctccgagagaaaagcgcaaaaaaaaaaaaaagcaggacggcaatcgcatgcttgcgacgatgaccgcccgcctgcaaggaatccagccacctgcccgcgtaacttcttcttctttcgtcgttctactcccatcgaagctactactgaggacgggcgcaggcggagaacgagcggatccgctagcaggggaacagccggcgcggaggaagggtttggaggatgacagaagctgcagttaatacaaggtactggtgccatggatgcgagaaggtcatcgaggaggccatggtgggggaggatatcaagtgcccgttttgcggtggtgggttcatcgaagagatggccggggaggattccgaggggttgcagttagagcgggagtggggaacgccgccaggggacagcgaggacgacgatgacgacgatatagcccatgagttcgagggctttatcaggaggcacggacgggcatcggctctgcgccgggtgctcgacagcatccaggacgaccttagagccgacagggaaagggacaactccgtcctcatcaacgccttcaaccaagccctcgcctcgcaaggctcggcgctgctggatgccgacgaggcccgagacggccgaggtggatccagcaacagcaacgacgatggcttgctggaagagtatcgtgtcctgggggctgggctgagcctactgcttcagcatctggccgggaacgacccgaaccggtacggcacccctccggcgaagagagaggcggtcgaagctctgcccactgtccagatagcggagggcgtcagc

SEQ ID NO: 15799 - DNA, 5290 bp, Zea mays
  misc_feature (5122)..(5122): n is a, c, g, or t
  misc_feature (5164)..(5164): n is a, c, g, or t
tcttctctctcaagggaatcagcaaggataagggcatcatgtgttgatccctcccagccagcaagaacatatataaaccttagatcaaagtctacaacatctaagatgttgtgttgtggtgtgtttcctaccaaggaaggcaactctctgatttctaggaactcttgctagcacatgagtgccatcaatggcaccaatacagtcctacacatcagggaaaacatttgttactataaacccaatataaaaaggaagggatcaatagtggtgtgtttggatgactgaccttgaaataggggtaccatctgtgtctatctctatttttggttggtgtagcagttgaaggtgtcaagatcatttcattcctcaattcaccaaaagcatacaatacttccttgaagtatttgttgatggtctcaatagacctttgaaaggtcatgtgtataactctaaactttaagttatgacctaccacatgtaaaaacatggcaacctgctcctctactaagctatgaatgctatctttcaaaagctgcctagtgcaaaaaaggtcacacaactgcataaaaggggctcttctcatcccgagtatgtcaaaacactcaacattggtggattcataaatgaatctcatgttgttttgcctcttttggtcccttcggtgcattggccatcagttatagacctcctagcatgcagtcggtgcctcaattatgcatccaaccaagctaaattaactgctacaaggaccactgcctttgcaattaactaaagtcgtgcaatagcaggattaattgctagagtaataaaatagaaaaaatgagattagaggtctaagtttggctcatttagtgacatcattttgttgccttatgctgccaggatgagctccgtgataatgagcttctggtgtttgcaaacaaacaagatgtgcctaatgccatgaatgctgctgaaatcaccgatataagcttggcttgcactccctgcgccagcggcactggtatgtgtcctttctttcgggaagtgtggtgcgttgtcctgcaatatttgtttgacaagtatttgtacttaaagaattgttactgcttgctgcttgaattcgaagcgatccaaatcagtgatctttattcactgcaggtacatccagagcacatgtccatttacagccaagtggtcgcctaatttgttagcacatggttcctcctgcgttttccgttccatattttacgtttgcttcggtacttcagttttaaacttgatcaaagttatatttaacttcgacatcgtcgccgtgtaacctggacacagcgcagcgcagcggaagtacgtttgagtgtgctgggccgacaggatgactcgtgggctgcggccactcccgcctcgtcagacggcccgccgccaatcctttacaggcccggctgcaaatcaaatcatgcctgggctggcgttggacgcggccacggcgttctgtttcctttgttctgtccccacgccgccactaaaacgtgacgccggcgatgacgtcgccgcgccggtcgcccccatccaacacggacggagcccacgccatggccaccgatcttgaccgaccatgctaaaacgaggtggaatggaaatgaaatcccttctcgccctatcccagttcgcacggggtttcattttttttcttcatcgaagcggagctgaaggtcgagtggtcgacaagtgaccggcggcagacgcaacctcctggaagcgttcgttggattggaactggacggacggcctctcgcacgcggtcaatgccatgctgtgctgtgctgtatacaccggaaatttcttcggacgttggggctgcaactgcaatgcaagaatcagctctcaatccggtatcccgctactttggttttcctccacgattggttagttgaaaaaaaaagacgagtacgataagtttactttattatactatataataacagaataatggtggtatgcagagaaataaataaactaggaagaagccaacaacagttggggcaggaggaggattagctggtaggcacctttgcttgaaagggaggttttatcggtcaagctgcagatccagaggcactgaataatagaaactctccgagagaaaagcgcaaaaaatataaaagcaggacggcaatcgcatgcttgtaagtcacataataatctttattattggttggatatttgcgccgggaccaaataaaatatacgtattatatctctccaccatttaatggaaacaggcgacgatgaccgccagcaagtgaagaatccagccacctgcccgcgtaacttcttcttctttcgtcgttctactcccatcgaagctactactgaggacgggcgcaggcggagaacgagcggatccgctagcaggggaacagccggcgcggaggtcagtcgttggtctcttcgcgcgaactctacctcctcctcttcttcttggtggcttgtgtgggggcgattggttccggtacccgaaatcaagaacgcggaaccggcttgtttcggaccttcagataataataatatatatatgcacgtaccttgtgttgtctgatgaaattaaaggtgtgggtcgcctttgctgcttggtagaagattggggatttcttgttgaggggattggggatgagtttgcgaataatgcaatgtgagtgagtcatgagagagggcaagggattagtttttgtgttgcgggaaccacaagtacttgtgatggggctcgggcatggggctctcaataccttcttttggaatacaatcttgttcttcaaatagaaatcttggaattgggaccctattattgactcctagctaatctctgccttctctctaggacagcttgctgctcttgttcctatagaactgaagtgaagatagttttagtacctgcattcgatgcaaaacttagctttgttcttattctggataccgatttaccataagatatccatgcctgccattactgagtgaagtttagtcacagtgagatggccactgtatagtatagtcttcatgtttgtttcatctcttcttgataaagttgttgtagatgctgcgcctgctctgagttgtatcctatggttattcacttgggaagcgatgcatacttccctttttttttaatcgtagcgccttgttgacacctttttgtgtgtctctctctctgtgcaagcaggaagggtttggaggatgacagaagctgcagttaatacaaggtactggtgccatggatgcgagaaggtcatcgaggaggccatggtgggggaggatatcaagtgcccgttttgcggtggtgggttcatcgaagagatggccggggaggattccgaggggttgcagttagagcgggagtggggaacgccgccaggggacagcgaggacgacgatgacgacgatatagcccatgagttcgagggctttatcaggaggcacggacgggcatcggctctgcgccgggtgctcgacagcatccaggacgaccttagagccgacagggaaagggacaactccgtcctcatcaacgccttcaaccaagccctcgcctcgcaaggctcggcgctgctggatgccgacgaggcccgagacggccgaggtggatccagcaacagcaacgacgatggcttgctggaagagtatgatgtcctgggggctgggctgagcctactgcttcagcatctggccgagaacgacccgaaccggtacggcacccctccggcgaagagagaggcggtcgaagctctgcccactgtccagatagcggaggccgtcagctgttcggtctgcctcgacgatcttgagctggggtccccggcgaagcaaatgccctgtgggcataggttccactcttcttgcatcctgccatggcttgagctccacagctcttgccccgtgtgccggttcgagctgccgtctgaagagacgaaagatctgaacgagcctagcgatgtgcacagaagaacagagagcgcccgagagaacgacagcgagagcggtaacagcgcgtggccccttgtcccttggttcttcagcgggctgttctcggtacctgaaccgcacactgacagaggcactctcaccaccgatcaacagagcccttccaccaacccaaatgctggaggaaattgatttcgtcatcctttgtgaataatgctcatacatctgagaatagcaaggagccttgtcagtagatggcttattttttttctgtactgataatccttctcggatgaatcgcaaggtacggagtctgtgtctgctctattgtcaggattctagcgatcgtttcgcctctagttaatctcatagctactgagactgtctgtctgcatcctatgcaaaagatcggttgctttctttgttcttggctcttctgactggatgtctttgagctatttctggaatatgtaaactatcatgccttgtatttattcattgtttagttgaaatatatcttcatatcaagtaagaaaaaactgctggctggacatgaggaaattaaccctattgaaatccacctcattcaacaagcctggaacaagtgctcatggccactcagggatactaaaaccagaaacatgaagggcgtgtgatatgtgatatagcacaggaaatacacatcttcagaaacatacatggctggaaggctgttgtttttcccctcaagaaccagaaacataaaggacatgtttgggctcgcaaaggaacttcctgctctgctcaggttctagtatccttgagtggccatctgttcgcttcagattaaaaccgactgtttagactgctgcagttataattcatagagacaaaaacactatagaagtagtagaagttggtacggactaaagccaaacgaacaagcttcgctggcctctcctttctctagaaagtaaacggctcagtgtgcagactaaagctaaatgtatccacatgggcacgttttttttatagacgaggcagcaatcttttcgtcgattaaggggccttggacagtccgtggacgcgattaaaagtgtgtttagtggatgtcggataggatctatgcactatgcttggacctttgcatcactcatcttgctgttattcgtcaggaatgtacgangtgcgtgagtgcctgtgcatagacgcaatatctgaccagtgnaccggtctcggggttctctactgtatcaggttcgaagcgctgtagacgaatctaagaaaagaagaagagttttcttggtatgacgattggtatacaagctctcttgattagttcataggcaaggaa

SEQ ID NO: 15800 - DNA, 3372 bp, Zea mays
  misc_feature (1150)..(1150): n is a, c, g, or t
  misc_feature (3327)..(3327): n is a, c, g, or t
gaggctggccgggcccccctctcccgtcgtccccacctcctcccggtcgcgcgcggtggccatgcctcccctcacaagctccctcctctcccgctccaccaccggcggctcctctacccgcgccgcggcagcggtcgcagcgatctccaggcccgccgcaccttcctcctcgtccccgcccgcccgctcgaccccgaggccgcgctccagcccggcgtcgcccttcgcatccggcctcgcgagccgcctcttcggcggccaccgcgccgtcgcccgctccgcgtcgtctgcagccgccgtcttcgagcgccggtttgcctcagcggcgaccaggaactcgtacgatgaaatcctgacgggcctcgctaagccaggaggcggagaggagttcggcaagtactacagcctgcctgcgctctccgatccgcggattgatcggctcccatattctataaggattcttctcgaatcggcaatcaggaactgcgatgacttccaggtcaccggaaaggatgttgagaagatcctggattgggagaaaagtcctccggtgcctcgtggccgcccgggcaagcccgctcgtgtcctcctccaggattttactggtgtcccagctgttgttgatcttgcttgcatgagggatgctatgagtaaacttggcagtgacccgaacaaaattaatcctctggtacctgtagaccttgttattgatcattcagtacaagttgatgtggcaagatcagcaaatgctgctcaggcaaatatggagcttgagttccatcgtaacaaggaaaggtttgggttcttgaaatgggggtcctctgcattccgtaacatgcttgttgtccctcctggatctggcattgtccaccaggtgaatcttgaatatctggccagggttgtgtttaacaatggtgggatcctttaccctgacagcgttgtaggcaccgactctcacacaactatggtagatggtcttggagttgctgggtggggagttggtggtatagaggcggaagctgcaatgcttggccagccaatgagcatggtcttaccaggtgttgttggctttaagttatcaggcaagctgaggaacggagttacagccacagacttggttctaacagtaactcaaatgcttcggaaacantggtgttgttgggaaatttgttgagttttgcgggcaaggcatgagcgagttgtcacttgctgatcgggcgaccattgcaaatatgtctccggaatatggtgcaactatgggtttcttcccagttgatggaaagacgctggactatttgaagcttactggccgaagtgatgatacagtggccatggttgagtcctacctgcgtgcgaataagatgttcgttgatcacagccaggttgacgctgaaagggtatactcttcctatctagaacttaacttggaagaggtagaaccatgtctatcaggaccaaaacggcctcatgatcgagtgacattgaagaatatgaagtctgattggctttcttgcttggacagcgatgtaggattcaagggttttgctgtccccaaagaatcacagggcaaagttgcagaattttcgttccatgggactcctgcaaagataaagcatggtgatgttgtaattgcagcaattaccagttgcacaaacacatcaaatcctaatgtaatgctgggagctgctttggttgccaagaaggcttgtgagttgggcctggaggtaaagccatggattaagacgagccttgcacctggttccggtgttgtgaagaagtacttggataagagtggtttgcagaaatatctcgaccagcttggctttcatattgttggctatggttgcacaacctgcattggaaattctggagagcttgatgaatctgtgtctgctgcaattactgagaatgatattgttgctgctgctgtgttgtctggaaacagaaattttgaaggacgtgtgcatcctttaaccagagcaaattaccttgcttcccctcctttagttgtggcttatgcattggctggcacagttaatattgattttgagaaagaacctattggcatctcgaaagatggaaaagaggtttacttccgggatgtttggccatccacagaagagatagccgaggttgtcaagtcaagtgtgctccctgacatgttcaagagcacatatgagtcaatcaccaaaggaaatcctatgtggaatgagctgccagtctcaacaagcactctctacccctgggatccatcatctacatacatccatgagccaccttacttcaaggatatgaaaatgagtcctcctggcccgcggcctgtgaaggatgcatattgccttttgaattttggtgacagcatcacaaccgatcacatctcacctgccggaaacattcacccagacagcccagctgcaaaatatctgaaggagcgtggcgttgaaaggaaggacttcaactcatatggtagccgaagaggaaatgatgagatcatggctaggggaacctttgccaacattcgtcttgtgaataagttcttgaagggtgaggttggacccaagacaatccatgttccatctggggagaagcttgcagtttttgatgctgctatgaaatacaagaatgaagggcatgacactattatcctggctggtgccgagtacgggagtggaagctctcgggattgggctgcaaagggcccaatgctgcagggagtgaaggctgtgatagcaaagagcttcgagaggattcaccgcagcaatcttgctggcatgggaatcatccctctatgctacaaagcaggggaggatgcagacaccctgggcctaaccggccatgagcgctacacggtccaccttccaaccaatgtgagtgagatcaagcctggccaagatgttaccgtgacaactgataatggaaagtcgttcacttgcacactcagattcgacactgaggtggagcttgcttactacgatcatggtggcattctaccatatgtcgctagaaagatagcggaacaatagattgtaccgtcgagatggttgcgatgcttgcggtgaatcgtaattggtgtaaacggtttgtttagtagtacaacccatttttgcggactacttataataacctctgagtatctcagagtgagctgtctgaaatttgatgaactgctacaattctggtgcgccatgaggatgggatccttttgccttctatgttaataatatgctaacttctgcaataccagatatacatttggcagaagattttgcacgctgtaaatgacactagtattaacactgatgcggtccaaaaaaaaaaaaaaaatgntatctgccaaaaagaaaaaaaaaaaaaagtcgacgcggccgcgaa

SEQ ID NO: 15801 - DNA, 1957 bp, Zea mays
gctgctttggttgccaagaaggcttgtgagttaggcctggaggttcggttctggatttcatcttccaacttgttttctttatatattttttgtcctgaccaacatgactaaaatattgatccactggttcacagctaaattactttggtttggtatattcctctttggtggtctgtggctagaattctctggcaattaccatgacaatttaaaaagcattgctgcttttgctcactgttttatatgaaaaccatcctttagtaacactggtatctgtcgatcaggtaaagccatggattaagacgagccttgcacctggttctggtgttgtgaagcagtacttggataagagcgggttacagaaatatcttgaccagcttggcttcaatattgttggctatggttgcacaacctgcattggaaattccggcgagcttgatgaatccgtatctgctgcaattactgagaatgatattgttgctgctgctgtattgtccggaaacaggaattttgaaggacgtgtgcatcccttaactagagcaaattaccttgcttcccctccattagttgttgcttatgccttggctggcacggttaatattgattttgagaaagaacctattggcatctcgaaagatgggaaagaggtttacttccgggatgtttggccatcaacagaagagatagccgaggttgtcaagtcaagtgtgcttcctgacatgttcaagagcacatatgagtccatcacccaaggaaatcctatgtggaatgagctgccagtctcaacaagcactctctatccctgggatccatcatctacatacatccatgagcctccttacttcaaggatatgacaatgactcctcctggcccgcgaccggtgaaggatgcatattgccttctgaactttggtgacagtatcacaactgatcacatctcgcctgccggaaacattcaccccagacagcgcagctgcaacatatctgaaggagcgtggtgttgaaaggaaggacttcaactcatatggtagccgaagaggaaatgatgagatcatggctaggggaacctttgccaacattcgtctcgtgaataagttcttgaagggtgaggttggacccaagacaatccatgttccatctggggataagctttcagtttttgatgctgctatgaaatacaagaatgaagggcatgatactattatcctggctggtgccgagtacgggagtggtagctctcgggattgggctgcaaagggcccaatgcttcagggagtgaaggctgtgatagcaaagagctttgagaggattcaccgcagcaatcttgctggcatgggaatcatccctctatgcttcaaagcaggggaggatgcagacaccctgggcctaaccggccatgagcgctacacggtccaccttccaaccaatgtgagtgagataaagcctggccaagatgttaccgtgacaactgataatgggaagtcgttcacttgcacactcagattcgacactgaggtggagcttgcttactacgaccatggtggcattctaccatatgtcatcagaaagattgcggaacaatagattgtacaatttgagatgattgcgatgcggtggatcgtaattggtgtaaacgacccatttttgagtacttataataacctctgagtttctcagagtgagctgtctggaacttttagtaaccttttgctttctttaagacactgttaataatatgttaactcctgcaatatctgaatatacatttggcagatgattccctatgttgtaaatgacactagttcataacactgacgcagttcaaagcggttcttgttatctggtggtactcaaattagtactgcaaacaatcgatgagctgatttttatttgagttttgtattacgaacccttttgactgttgaaaccgttatttcatttgctttaggcaatttgg

SEQ ID NO: 15802 - DNA, 818 bp, Zea mays
cctactatcctgcctgctgccgactacggcagtggaagctctcgtgattgtgctgctaagggcggcgtgctgtatggagtgaaggctgtgataacaaatatcttcgagaggattcaccgcagcaatcttgctggcatgggaatcatccctctatgctacaaagcaggggaggatgcagacaccctgggcctaaccggccatgagcgctacacggtccaccttccaaccaatgtgagtgagatcaagcctggccaagatgttaccgtgacaactgataatggaaagtcgttcacttgcacactcagattcgacactgaggtggagcttgcttactacgatcatggtggcattctaccatatgtcgctagaaagatagcggaacaatagattgtaccgtcgagatggttgcgatgcttgcggtgaatcgtaattggtgtaaacggtttgtttagtagtacaacccatttttgcggactacttataataacctctgagtatctcagagtgagctgtctgaaatttgatgaactgctacaattctggtgcgccatgaggatgggatccttttgccttctatgttaataatatgctaacttctgcaataccagatatacatttggcagaagattttgcacgctgtaaatgacactagtattaacactgatgcggttcaaagctgtccttgttttgttatctgccaacaattgatgagcagattttgtttcagatttgtattacgaaccttttaccacgttgccatgtgcgactggtaatgactctgaagcaaccgatgggtgtaaaactgtcatgtaagccaa

SEQ ID NO: 15803 - DNA, 3283 bp, Zea mays
aattcggcacgagggcctgcctcccctcacgagctccctcctctcccgctccaccaccggcggctcctccgcccgcggcgtggcggtggccgcagcgatctccaggcccgccgcggacgccgccccttcctcctcgtccccgcctgcccgtccgaccccgaggccgcgcccaagcccggcgtcgcccttcgcgtccggcctcgcgggccgcctcttcggcggccaccgcgccgccacccgctccgcgtcgtctgcggccgccgtcttcgagcgccggtttgcctcagccgcgaccaggaactcgtacgatgaaatactgacgggcctcgggaggccaggaggcggagaggagtttggcaagtactacagcctgcctgctctctccgatccgcggattgatcggctcccatattctatcaggattcttctcgagtcggcgatcaggaactgcgatgatttccaggtcaccgggaaggatgttgagaagatcttggactgggagagaagtgcaccgaagcaagttgaaatcccgttcaagcccgcccgtgtcctcctccaggattttactggtgtcccggctgttgtcgaccttgcgtgcatgagggatgctatgagcaaactcggcagcgacccgaacaaaattaatcctctggtacctgtagaccttgttattgaccattcagtacaagtcgacgtggcaagatcagcaaatgctgctcaggcaaatatggagcttgagttctatcgtaacaaggaacggtttgggttcttgaaatgggggtcctctgcattccgcaacatgcttgttgttccacctggatctggcattgttcaccaggtgaatcttgaatatctggcaagggttgtgtttaataatggtgggatcctttaccctgacagcgtcgtaggcactgactcccacacaactatgatagatggtcttggagttgctgggtggggagttggtggtatagaggcggaagctgcaatgcttggccagccaatgagcatggtcttgccaggggttgttggcttcaagttatcaggcaagctgaggaatggagttacagccactgacttggttctaacagtaacccaaatgcttcggaaacatggtgttgtcgggaaatttgttgagttctatgggcaaggcatgagtgaattgtcacttgctgatcgggcgaccatcgcaaatatgtctcccgaatatggcgcaactatgggtttcttcccagttgatggaaagacgctggactatttgaagcttactggccgaagtgatgatacagtggccatggttgagtcctacctgcgtgcgaataagatgttcgttgatcacagccaggctgaagctgaaagagtatattcttcttatctagaactgaacctggaagaggtagaaccatgtctatcgggaccaaaacggcctcacgatcgagtgacattgaagaatatgaagtctgactggctttcttgcttggatagcgatgtaggattcaagggttttgctgtccccaaagagtcacaaggcaaagttgcagaatttttgttccacgggactcctgcaaagataaagcatggtgatgttgtaattgcagcaataaccagttgcacaaacacatcaaatcctaatgtaatgctgggagctgctttggttgccaagaaggcttgtgagttaggcctggaggtaaagccatggattaagacgagccttgcacctggttctggtgttgtgaagcagtacttggataagagcgggttgcagaaatatcttgaccagcttggcttcaatattgttggctatggttgcacaacctgcattggaaattccggggagcttgatgaatccgtatctgctgcaattactgagaatgatattgttgctgctgctgtattgtccggaaacaggaattttgaaggacgtgtgcatcccttaactagagcaaattaccttgcttcccctccattagttgttgcttatgccttggctggcacggttaatattgattttgagaaagaacctattggcatctcgaaagatgggaaagaggtttacttccgggatgtttggccatcaacagaagagattgccgaggttgtcaagtcaagtgtgcttcctgagatgttcaagagcacatatgagtccatcacccaaggaaatcctatgtggaatgagctgccagtctcaacaagcactctctatccctgggatccatcatctacatacatccatgagcctccttacttcaaggatatgacaatgactcctcctggcccgcgaccagtgaaggatgcatattgccttctgaactttggtgacagtatcacaactgatcacatctcgcctgccggaaacattcacccagacagcgcagctgcaacatatctgaaggagcgtggtgttgaaaggaaggacttcaactcatatggtagccgaagaggaaatgatgagatcatggctaggggaacctttgccaacattcgtctcgtgaataagttcttgaagggtgaggttggacccaagacaatccatgttccatccggggataagctttcagtttttgatgctgctatgaaatacaagaatgaagggcatgatactattatcctagctggtgccgagttacgggagtggtagctctcgggattgggctgcaaagggcccaatgcttcagggagtgaaggctgtgatagcaaagagctttgagaggattcaccgcagcaatcttgctggcatgggaatcatccctctatgcttcaaagcaggggaggatgcagacaccctgggcctaaccggccatgagcgctacacggtccaccttccaaccaatgtgagtgagataaagcctggccaagatgttaccgtgacaactgataatgggaagtcgttcacttgcacactcagattcgacactgaggtggagcttgcttactacgaccatggtggcattctaccatatgtcatcagaaagattgcggaacagtagattgagatgattgcgatgcggtgaatcgtaattggtgtaaacgacccatttttgagtacttataataacctctgagtttctcagagtgagctgtctgaacttttagtaaccttttgctttctttaagacactgttaataatatgttaactcctgcaatatctgaatatacatttggcagatgattccctaaaaaaaaaaaaaaaatagttcataacactgacgcagttcaaagcggttcttgttatctggtggtactcaaattagtactgcaaaaaaaaaaaaaaaaaaaaaaaaa

SEQ ID NO: 15804 - DNA, 5755 bp, Zea mays
  misc_feature (981)..(981): n is a, c, g, or t
gacccgcgggttagacccgtatccgatccgagataaagtggacatggatttgaatattaaatctcatccgcggataatccgttggatatccgaaattaaccattagtccattattgtcggcccacacatggacaccaatgaacaaatcgccaacccacctttgtccattgagcccagccgccaggcgccagcccaccaaagcaccattcagcggttcagccaaatgccaaacgcccaaaccagcaaagggaaaaccctaatctccatccccttaatcctcaatccctcatctggtcaattggtggcaatatgcagggatcaagtatccaactttgagaaaaattgctcgagatgtaatggcaattcctgttacaacagtggcatctaagtccgtctttagtactagaggagagtaattagcccacatcgtagtagacttgctccaaaaacagtagcggggttgatgtgtatgcaagcttgggcccgagctgacatgttaggcaaccaatcctgttttataaatgcactaatgacttgtttggaggatgaagacatgtatcattgactagaaaaatttaaacacagctactatagcgttagctcaagtgctcaacactacactcagatcggatcagaatcataaggcaaaaggcttaaggttaaaagtagacatgtatttgttgtcatgtatttgttttcatgttgagacatgtagacatgtatttttgtcatgtcgagaatgttgcttgttgaaggacatgtatatttgtttaaatttttattaaattttaagttatgtatgatgttgaattgggaagaaatttgattatttatgttattcaattgctgaaaatggttctttgtcatatctgatggatatccaatggatatccgaaacccgatgggcatggatatggatgtgaatttctatccacggatatagtcgcgggcggatattatctatgaccgtggatatgactncgggcggatatttccaatatccgatccgaatccgacccgttgccatccctaagtagcagcttcaagcgcagccgaacggcttcgaacatctgccgctgcgcgcaagattgccgtaggaaaacttagggcgtgttaagcagaatggaaacgacttcattcctatttttttttgacgtttggttttccaacagaagaagagcgaagcgatttctagaatctccagacgagagaatttagcataaatagttgggacgcttacattccaccaaatgacggaatgtgagcgctctactctcttttctccacatcacactcatatgactcttcaaccaaataaaaaacggagcagctccactttattttactctccaacaaaacgaaaaacgaagtgactcaattctgctggatcggctccattatcagaaacgagaatagagccgtttcattagttgattccacaaccaaacgcacctttattaagcgatgacagattttgtgcgaataaataagcaaccactgtaaactgaggcgcatcagaagacgtcgcgtctaggttcgacaagcaaaggaaaaaaaaactccacccatatattagaattaattgctaataaataaataaacgatcagggtttctcaagtctcaaaaggttgaaaggagcaggaagaaaataattgcgcgtgcatttcggtccagacggtagacaccgcagtaaccaccggcttaatcattgaaggtactcctacattagggacgagggatggaccccacaaagatgcccccattgtcaaaccagctgcttttcccgtgaccacagaggcctgcggcagattggcctccgttcatttcctcaccaccgggtctttttttttttttttttttgtctaagcgcggctctaataattgccgtcccctaaataaacgggatccgagacgcggataacgaactcaacaaacgagggggaaataaatggaaataatgcacgtcctctcatccgcctagatattccgctggttcaagcgagacgagggactgaggctcttagcaaaatccatgaatgaccaagcacctagaattacgagaaatcttacgcagaccagttctaatccccggtaacaagcacgcgtcgcatttcctattcgttcgcctcgcttccggcaaaacccgcaaggctacgaaacgaaacgaaacccccagaaaaatcttgacgagacaagagagagagagagagagagagagagagagagagagagagcataaggaagcttctgagcatcaatgaaaagcaggagctgtacagatcaccatatgattattattattataaaaaaacgctcaatcaacgataatcgtggtcctgcctttttttctaatcggaacggtatccgcaggcacatgggggcgctatgaggatgcccgttgcgttgcattgcatcttccaatcatcgcgtcatgaaccacaccaggaggacgcacgcctcttccagcagacaggcaggcaggggagggaggaatacaacaaacaaaacgctagctagggttagccgcgcgcacggcgcacctcatccagactattatacccctagctagctagtgtgtcctgtctccgaggcacggcatcgcgtggaagttttcgcgccagaaccataaaaaaaaacaaccaaccaacatacctctagccacagccgatgcaatcatctgtacagatcggaggtccgattctctcggctgattgcgaacgtctttgggattggacaagaggtttctgattggagaccctcggggtcctaaagaaaaaaaaatttgcttcgctggctggatggacgacacgacacagagggaaaaggaagatgctccgtgttcctctgcaacgcaaaatgcttttgatccggcatcctaattattggctccaggtaacaagtgacccagagttgtctctctgcgacaacagacgacggtgctagagaccctagcgtacatgttttgatgagtgagaagttttcccggttgtgtagtttccctgcttcaggtcacactcattcagagtaccaaaaaaaaaaagacaaaaaagaaaattgagcatcaatccttttgccaatcgtgtaatcttttttacttagctggcttgagtacaaagtaacaatatttcttgatataggaaggacgaactgtcgggagttccttgtagtagtttatggtagtgacgttgcagtaatagcgtaccagcagggggggctctgaagcccaccgacggttgatgaagggacacaaattctaggggaggcgctgataagacacaaggacacacgttttctacagagaagcaaagggaaaggctaagacgctcccacagccacgagctttaaaagaaggagaagagagtggcccttaaccctaccgttctcttctccctaatcctggtaatcagtagtagccactagcgctgctgccgttctcttcccctacccgacacaagctccaccacctctatctaccacacgccaccactgtaggagctcctccacgatcatcccgccctagagccataataattcgttgaagaggagggggttcttagaaccagagggcggctacctgtgaaggatacccgtgctgctggctgctgctgttcctcgagctagagccgtgtgtgggctgtgcagattgcagagcgcagcttccagtctcagcattgctttcaatggggaggcactcctgctgttacaagcagaagctgaggaaggggctctggtctcctgaggaagatgagaagctcatgaaccacataaccaagcacgggcatggctgctggagcactgtccccaagcttgcaggtacaaccatcaaaatcaaaatcaaatcctgcacgctttgctctaccttctcaattgtccatctccactgtttcctgctccttctccaaggctacttctttctcccaactcctcctctcgtacctgctcaattgattgattaattaattaattaatggtggcagggcttcagaggtgtggccaggcctgcaggctgaggtggataaattacctgaggcctgaccttaaaagaggcgcattctctgaggaggaggaagacctcatcgtcgaacttcatgctgtactggggaacaggtaaaaaagctaagcccaaaatcatcacagacacagaattttgcacaggccgattgcttccaagcaagctttcttttaaccaggcctttttctttttttttccccacatccatggacaggtggtctcagattgcaacaaggttgcctggaagaactgacaacgagattaagaatctctggaactcgagcatcaagaagaagctccggcagaaaggcattgaccccaacacccacaagccgctccttgtcgaggttgaacgcagcaaagcagctccaacgaccagtaccgagaggacctctgagtccagtgatgttgacccttcaagtggcggcgcacttggcaactcgagccatcttcttctcagcgagacagcacaatcaccacagctgccagcgctcggtaagcatcgcagagaaactactagcctcgcacatctaagggtgccgcccaaggagttgttccttgaccagctggtttctggtcatgagaacctcactggctgccgcacagcaggcccagttccaaatttccctttccaacagctcatgtgctacagcaatgaatttggcaacaagaatggtgctagtaacaattcactctggtttaaccacaatgagacaagtggcagcaccatttccactgtgatgccaccagtttcgccatcaactctctcaacatcaacagggctcaataggtcaccagacaacccacactcgggaggcactggtattcagagcacccagttctactgggacactgctaatcctagcagctgcagcagtagaggaagcagcggaagcaacggcttgggatttgagctgcaaagcacaagctcgcttctggagagtagtgttttcccatggacagaattaacaccagacaaaaatagccaagttcaccttggggaagaactcaagtggcccgacttgctccacggaacattcacggacacacctgcaaccatgcagaatcttagccagtcactgtacgaagatgttatcaaagccgagagccaattcaacatagagggcctctgtgcagcctggtctcaaaatctgcagccacagcaacatctgcaggtatcagatttgtatgacaaggatttgcaaaggatgtccttgtcttttgagaatatctagacagcatgtttcagcatgcagggaacagagaaatagcagaaagctgagtcaatgaagccttaaaaaatacaatatttcttcacagattcatttgaaggctatgtggaggtgtgttttacgtaggtacattcttatgatgaaacagagatcaatactgataactgttcaccagtgtacatgaaaaaagggaaaaaatgaatctatattacagcataatgtatagactagagaaagtacatcctaggagtttacctcctttcatttaaaagttgctgtctttatctgtacatgcatgtagctcggctttttttgtataagtgagtcatggttgatctttgtctacaaaataaatgaggcaagaatgtgaaatactgcacctgtcagtagctcttcggaaccatacaagaaatttcagatttttttagctgttattttgttactgtatatgcttgagatgcaaattaattgttgatgatgcacttttattctttcgatttatttcttttc

SEQ ID NO: 15805 - DNA, 2085 bp, Zea mays
attgggacctcgagccggccggaaaaaaatattaagctctgggtacctcgaggccggccgggaccgttctcttctccctaatcctggtaatcagtagtagccactagcgctgctgccgttctcttcccctacccgacacaagctccaccacctctatctaccacacgccaccactgtaggagctcctccacgatcatcccgccctagagccataataattcgttgaagaggagggggttcttagaaccagagggcggctacctgtgaaggatacccgtgctgctggctgctgctgttcctcaagctagagccgtgtgtgggctgtgcagattgcagagcgcagcttccagtctcagcattgctttcaatggggaggcactcctgctgttacaagcagaagctgaggaaggggctctggtctcctgaggaagatgagaagctcatgaaccacataaccaagcacgggcatggctgctggagcactgtccccaagcttgcagggcttcagaggtgtggcaagagctgcaggctgaggtggataaattacctgaggcctgaccttaaaagaggcgcattctctgaggaggaggaagacctcatcgtcgaacttcatgctgtactggggaacaggtggtctcagattgcaacaaggttgcctggaagaactgacaacgagatcaagaatctctggaactcgagcatcaagaagaagctccggcagaaaggcattgaccccaacacccacaagccgctccttgtcgaggttgaacgcagcaaagcagctccaacgaccagtaccgagagaacctctgagtccaatgatgttgacccttcaagtggcgccgcacttggcaactcgagccatcttcttctcagcgagacagcacaatcaccacagctgccagcgctcggtaagcatcgcagagaaactactagcctggcacatctaagggtgccgcccaaggagttgttccttgaccagctggcttctggtcatgagaacctcactggctgccgcacagcaggcccagttccaaatttccctttccaacagctgatgtgctacaacaatgaatttggcaacaagaatggtgctagtaacaattcactctggtttaaccacaatgagacaagtggcagcaccatttccactgtgatgccaccagtttcgccatcaactctctcgacatcaacagggctcaataggtcaccagacaacccacactcgggaggcactgccattcagagcacccagttctactgggacgctgctaatcctagcagctgcagcagtagaggaagcagcggaagcaacggcttgggatttgagctgcaaagcacaagctcgcttctggagagtagtgttttcccatggacagaattaacaccagataagaatagccaagttcagcttggggaagaactcaagtggcccgacttgctccacggaacattcacagacacacatgcaaccatgcagaaccttagccagtcactgtacgaagatgttatcaaagccgagagccaattcaacatagagggcctctgtgcagcctggtctcaaaatctgcagccacagcaacacctgcaggtatcagatttgtatgacaaggatttgcaaaggatgtccttgtcttttgagaatatctagacagcatgtttcagcatgcagggaacagagaaatagcagaaagctgagtcaatgaagccttaaaaaatacaatatttcttcacagattcatttgaaggctatgtggaggtgtgttttacgtaggtacattcttatgatgaaacagagatcaatactgataactgttcaccagtgtaaatgaaaaaagggaaaaaaatgaatctatattacagcataatgtatagactagagaaagtacatcctaggagtttacctcctttcatttaaaagttgctgtctttatctgtacatgcatgtagctcggcttttttgtataagtgagtcatggttgatctttctctacaaaataaatgaggcaagaatgtgaaatactgcacttgtcagtagctcttcggaaccaaaaaaaaaaaaaaaaaagaaaaaaaaaaaaaaaa

SEQ ID NO: 15806 - DNA, 3728 bp, Zea mays
  misc_feature (831)..(831): n is a, c, g, or t
cgactcgcccgagggtgtcttgtgcgactgtccggtgagacccagattggcccaagtgtggccaaacttgtttacttcatttttagctagatttgaaaagttatatagcacttagacaaacatgattagcacctaaaacaattgactaagtaatagaaacatacctttagtctttttcaacaccaattgacaactctttaactggttttggacagaaatggcatctaaagaactaaaaatttaaactgatgatattggagggaaccacgtattttttttatggtattggagggatcgatatagttttagacggcattcaatggattttatttttctctatattctattctttctagagcatgcagtagcatcaactgctcctcgacggggagagaatgggaatgtaggagtgtccttttcctgtcgtcggataagcgtcctgtcctggcgcgcgccgaagacggcgagatttgctgctgccatgcatggatccgtcttgttgcagcagggttgggagtcgctctcggcggttgccggagcccggagggaaaagctagtccgatcaaagcgtctgctcctgtatctggtaggtgaagccgtgaagcagaggacagaggcagaggcagaactgaacctcgtgctcgatccgtattgcattgcacggtgagcatgagcagatgaaggcaaaaccggactacatgcgtgtgtaatgacgcccatggctcgattacttttgatctcgagagcatgacggactcatggatcatggatggatgagtatatattctggatggatggatttcatggctgatgacgctgcaagctcgtggncaacaggccaagcagacaacgacacaagtgtttgcagggagacgcgcgccgggattacagcggacgccaacctacgtccaaacagaaagtcagcacaggattcaagattcagacatcagcattgagcagacaacctgctcccacttgcatcgcctctcgtctcgtcaaacgaccgtcctgcaaacgccaatcactttaccttcgtccatggctggccggccgtctcatctcatctctgtcatgtactcatgtgcctgtcgtctgtgatgcattcagctgcagtcacgcatcagcagccttccacttcactgcagcagagacatgatatatatttcgtgttagttctagagcagtagcatcaactgctcctcgatgggaaaagaatggaatgtctgatattgtctggtcgtcggataagcataagatttggccacttgctctgggcagttgccggagcccgtagggaaaagcgcgtctgctgcggcctctgtatctggcgaggtccatgcacgccagctctcctgctcctgcctgccccaacggggtgggcacgagaccattacctagaacatcctaatcgaaaaaaagcaaactcacttccttccctcgctaattagcctctgtgcgcccagcttggcctctccaaccaccaccaccgttccgatcctctccgccgtcgcgatggcggcctcctgccgccgccgccgtcacacgccaccgcagagctagctaccgacgaagacaaggcgggcaatggccaaggcgcccctgccgcttccgtcgctgctcgtcctcgccgccttcttcttccaccacccctgctgcacggcgcagggccgcgccgaaaacatctcggaggtcgaggccgcggtccgcgcccgcgcgtccgagctgctccgcgacgccaccagccagctcgtcgacctgcccctcccggccaacctctccggcgcgggcgtccgggcctcggccctcagcgtgcgcagcaacgcgctctgggccggcggcgtcaacaccaccggcttcaccgtcccgccgcgcgtcgtgccggccccgttcgcgcgccgcctcgccatcgtcttcgagctcttcgtgggaaactcgacggccgcgttcgccgcgccgcgcggctacgcgctggccacgcccgtggccggcctcctcgcgtacgacgcgtcggcggggcccgacgcgcgcgtctcgctccgggcgctcggcgcgccggtgcgcgtcgagttcaaggacgacctgtcggcggcggcggctctggacaaggggttcgagttcgacgccaccaccgcgcggtgcgtgacgttcgcggccagcggggaggtcgtggccacgcacgccgtcgcgccgggctccgcgtgcgcggtgaacggcacgggtcacttcggtatagcggtgctgctgcccgagacgccgccgccagcctcggccgtgagggccaggtggtgggcgtggacggtgggtgtcggcgccggtggggtgctgggagccagcgccttgacgctctctgtggccggcgcggtgagctggaccaggatgcggcgaagggaggagatggatcggcgggcgatggccggggaggagctggggaggatgacggtgcgcgggagcaggatgccatcggcgaaggtggtaaggacgcggccggagttggaagagcgcagctagcacgccgccgtagcggtaggcgagctcctctccgagtacgttgcaccagccggggggtctggctcctcaactgatggcaacggggagttccccgccggaaatagctcaccgtctccgtccccgcgacgaaaaaacttccctgcagggatcctacgaacgctttgcgaagaatatttcttccttatccctgttcctcgcggggataaatccccaacgggatctcatccccgtttaaattacaattaagacatacgtactttgctattaatgttaaatattgtcacttatacacattgtcagatataagaaatcattatgcatacatcaaaatgaatacatttgtacaattagtggtctcttgataagataattatttatttttgtcgttaactagtacataaaaaacatagtcacgtgcaagtttaacggggtccccgcgggaaacggagatgaggaatgcttccccgtccctatccccgttcaccagtcgggaataaatttttcctgtttatatccccgcagggagagtttcttccccatcccctaatgaagaaattccccgcggagaatcggggatcgggtccacattgccatctgttgtgtgtgtgaggattctaacgtttccctcgtcgttttgtcacacatcaggtgacaactaaatcatctgcgacgcaagagacttgtacagctcgatgtacactgtccggattacgtacatatgcaatcgctatagatatttatatagatatacgatgtcgtctttctataagtgtgtacgtcccaaacagaacatctatctttgagctatgttttctagttcgaaccatcttccaccactgtacaacgaagtctcagtcaaagaattagacaatcgcatatgtcatgctatctatagaatagggttagttggttccatgtattataaactttggttatctaagatttcccattatacttttggaaacaatgtcggtgccatcaaaatggcaaggaaattgaaatttaccatagtaaacgcctttggtgccacatccccgccttctaggccaacatattcttcttattttcactcttgcgcctgggccctcgtgtccttagttcccattgtgtcgttcattctcgcgcctaaatccctagcagccaacaaagacgatcggtttccttccatcgtcccccaccctcccctcgtcgccccctccccatctgccattgccaccacc

SEQ ID NO: 15807 - DNA, 1095 bp, Zea mays
cattgggtacctcgaggccggccggggcgtccctcttcccaaccctaaccttctctcccccactccgccgccgcattgagcacggggtcgcaaacctcgcctccggtcctccgcacacagggcagcgactctgcgtgcgcacctcccgcctccggtgggccgtcgcgccgcaccccggcggctgcactgctcgccgtgggcgggtagcgggagccagcagccgctgctgctccacctaggcggccgcgccgctatgttagcgcttgtgccccaagcgaagcgttacccatccgtttagcgcgtgcgtctagtgccgcattttggaacccggagcgatagtacatgcagtatttcaatcttggtttcttggtcactgaccgtaacactttgctttgtatgcatggcccttaagatcgcctcccttttgctatgtgggagcgtgtcgagtcatagccatgcaaaattaacgacgaggtcccagagagtttttctctggaacttcctcccttcctgttgcagttctaggtgtcttcatccggggcatcgagttccctgtagtgtatgaccattatgtggcagctgttttctgcagcgcttctgtgagctcatcactcgtgcgactctttgccaaatcaaatggagatgtctaagctttggaagggaacatgttttttaaaaaaagaatttgtgaattgtttcctcgtatagttctaccataatttcgaatttccattagttcagtcaaactgcagtacacagttttaccattattcttaattctactgattgtcaattttcttttcaactttgacctttaagatgtcttgcttccagtggatcaatgttcactaattctggtttctgtcaagattgcaacctaattctggattgcagcactataaggctatgactactgcaattttagaataggaggtggggatgaggaagctaatggagatagacttagacatgttcggttttctaggattggagctcagaaatgattcctactcggattatttctctaatttatataaatttttatgagcgggaacgaatcctggcctggacaagcgaacgggccagtgttcattt

SEQ ID NO: 15808 - DNA, 1308 bp, Zea mays
ctcgaggcggccgggggcagtcctgtggtcgcacggtccttcactcctgcgtcctgcctcggtgcctaccagagtcccagacccaggcggccaggctcccagcctcccaggtccccggtggcggcagcaggctcccagtcccagatggccaccagttctaaaccctagccgccaaaccaacacgagcagctgtcgccctccaggccggtcgagcggggcgccgggcaccgtcgcgccgagctgagcggagagtggagcacctgcaccgagcggccagcggtgcgccgtgcgccgagcacctgagtggccagcggggcgccgagcactcgtctagtcgtcttctctgatcctgggcgtgcctgccaatgagcaagaagaggaagcatctggatccagcgaactcgttgaaagacagcgaacaagtagtcgcctcagatttcataagaggagacgatcttgatgacctattatcgaagcttatcaggagtgtggagattgccaaggcttcaaggggaggcttaccagaaaagatatggatgaagcaacaatttgctatcggcgtcaatgatgtcacaagggttcttgagcgaatgccgcattctgtcactgctcatcctgctcaaatgtctagtggagcaccaactgtctcaggccgacgtcaagctcctttggtgccattgcaggctgtccttgtagctgccgactgcaatcccaaatggttaacaaaacacataccaacactagcgtctacaaggcaggtaccggtattgtgcgtgaaggacaacaagggaggctcagtaaggttaggccatgtggtgaatgtcagaacagcccttgccattggagtaaaggccaaagatagcgttctcaacaagaccattgatgagttcctgaaagacagtaaactggttgccaatgaaccataaagtaaccccaagtctagtgacacgtttgtactaaaaagcctgtacttctgggcatgcaacatcccaggatcatctcataaatgggtttaagtttgagaaggggatcaagtatcttgagcacattgtggcaatatcaatttggagggacttcttgagagaacagtcatgggaaataggacagactatttgtttggtccgtgcaatattgtttgactggtgaacctagttatccattgtgatctagaacttgtatcaaactccaatgtaacgagatgttagaatccttgtttattgggtacagttttttcttcttctcgaggctcgacaccgcgacagcaacgtttcttgttttttatattctatagtatatataataatgtgg

SEQ ID NO: 15809 - DNA, 2451 bp, Zea mays
ctttttgtgttgctctaaccctttcggctgcgctgcgcacgtcccctcccacgagaaacaccccacgtctcaagctgcccctttctcaccgccgcggccgccacgcgcagcagcaaccgagcaggagcgcagccagcaagctcaggcccgagccctactgcaaccgccgctgctaccgcactgaacaccatggccgacccggcggagcaccgtccagcggaggaggacgaggaagccgcggcggccggcgaggatgaggacaccggcgctcaggtcgcgcccatcgtgaagctggaggaggtcgccgttaccaccggagaggaggacgaggacgtacttgtcgacatgaaggcgaagctctaccggttcgacaaggaggcgaaccagtggaaagaacgtggcacaggcactgtgaagctgcttaagcacaaggagaccgccaaggtccgcctcgtcatgcgtcaggcgaagacgcttaagatctgtgctaaccatcttgtggtggcgacgactaagatgcaggagcacgcagggagcgacaagtcgtgcgtgtggcacgcgctggacttcgccgacggtgagctcaaggaggagatgtttgctatccgttttggatctgtcgagaattgcaagaagttcaaggacactgttgaagagatagctgaagagcaaggaaagaccgaggtgaaagaaaacgaggaagtctccattgccgccgcagatttggtacagaagttaacagtgacagaggctagcaaggagggagatgcagaggaagaggaggctcctgcatctgaccataagaaggatgctaaagggtaaagattgaaggcaaacaaggccaaatgattatgattccattcatttcgttgtcaaggttcatcttccccacaaattttcattacaaagtttcattgcattttctcctgagatgatttgtgtgtgtgtgtgtgtgtgtgtgtgttgggtgaaatctgagttgtcagtcatctacatgtctttcttggttgttagacttattctcagtcgcctgtttatctgggatggctaggtacatcatgtttgtacaattatttggggttgattttggaatggctctaaagctcgagatgagatagatggtatcatggtagttattagtgatgatttcttttcgcttcttgttcgttcgttctgaaataatatgggatgctttgttatacttgttgatccattattagcttgatgcgtcgttgatccaaaaaaaacggcacgagttccagcattggttgaatctttgttccagtgcagcagcaaggcaagatctcccagttatctgcaataaaaacctaacgctgagatcttcatccacgggatgtgcgcgttgcactcatcattgctggcacacacacattcccatggtataggcaaggcatgaatacccgctgatttgcagtaaacgcctatgggtccatggcattggatgttgctggatcgtgatgtgatccctgcgtgcttggctcgcatccatccatccgttgtgccgtgccggtactgagacaaggcgaggagacagcaagttgttggtgtaccgcagatgtgtgatcccttccacgggttgagattgatgcgcgttgtagggcgggtacacatgttttgagcgcgagtatgtgataccccattgatggcggtggttgcgcgcgccggccttaccatgcatggcacggcccaacgggggatgccaatgcttcccagccgctgctgtttcagcaaggggatttagcgcttcatgtacgtgcgtcgtgcgggtacggacagacccgatgcgaagagaattttgtcagctctcgtacaaagacagcccctctctcaaaaccggcaccaggatctttgtgctgcaaagatttcatggaccatgcatgcatgactgcgtgctttcacgcgctgctctgggatcctggcgtgttctgttgtctgctctgcttcggcgtggtactcagcaggcgtcgctgtctacaccgcaatatatagtaaacgaacacgatctgatactagctggtagcaataacgaaaatactctacctgcgtttcctgagaaaagagcagaatccatcgctttgccgttctccaggtccatgccggcctgtcattctgggcaggttcaggatccagaccaccatggcaattggcaacagcggaaatgcccttctgcaattccggatgaagcgtgctgttttcttttcttctttggccggccaccccgatcaaagaagaacgcatgcaaaacggcattggctgcttgatttgacacagattttgattgaattgagtggacaaagggaataacagtacatggtacgagcacaggtacaacagccaacggcggccagcggagtcctaccaccccaaacccgcatttacaccaacagcagtgactgtgacaaccaggacggccatggccacaggggagcc

SEQ ID NO: 15810 - DNA, 1183 bp, Zea mays
gcacgagggtgaacgtggtgagcctccgcccagaatgcaaccctactagtgctagctttcggccgcgaaaaacgtccccacccccacgtctcaactttatagccgccccctccccaccgccgcggccgccacgcgcagcagcaacccggtagcagcctagcaggagcgcagccagcaagctcagccccccaggccccagccctactgccaccgcgccgaacgacatggccgagccggcggagcaccgtccagctgaggaggaggaggccgcggcggccggcgaggatgaggacaccggcgcccaggtcgcgcccatcgtgaagctggaggaggtcgccgttaccaccggagaggaggacgaggacgcgctcctggacatgaaggcgaagctctaccggttcgacaaggaggggaaccagtggaaagagcgcggcacaggcactgtgaagctgctcaagcacaaagacaccgccaaggtccgcctcgtcatgcgtcaggcgaagacgcttaagatctgcgccaaccatctcgtggtggcgacgactaagatgcaggagcacgcggggagcgacaagtcgtgcgtgtggcacgcgctggacttcgccgacggcgagctcaaagaggagatgtttgctatccgttttggatctgtcgagaattgcaagaagttcaaggacactgttgaagagatagctgaacagcaaggaaagagcgaggagaaagaaaatgatgaagtctccactgccgcttctgatttggcacagaagttaacagtggcagagcccagcaaggaggaaaatgcagagaaagaggaggctcctgcatccgatgataagaaggatgataaagagtgaaggttgaaggcaaacaagggtcaaatggatgccattccattcatttcgtttccaaggttcagcttccccgcaaattttcattgtgttttctccgagatgaatgtttgtgttcggtgaaatcagagtcgtcagtcatctacatagcttttcttggttgatagactgttattttaagtcgcatgtttatctgggatggctggggtcagcatgtttgtacaattatttggagttgcttttggaatggacgcggtttgatgagttgcctacagaaaaaaaaaaaaaaaagctccacttttctggttcaacccaccgcaatagaatgggatgct

SEQ ID NO: 15811 - DNA, 1245 bp, Zea mays
atacacggagtatcaatctagactagaggagacgggtgaacgtggtgagcctccgctcagaatgcaaccctactagtgctagctttcggccgcgaaaaacgtccccacccccacgtctcaactttatagccgccccctccccaccgccgcggccgccacgcgcagcagcaacccggtagcaggagcgcagccagcaagctcagccccccagccctactgccaccgcgccgaacgccatggccgagccggcagagcaccgtccagcggaggaggaggaggccgcggcggccggcgaggatgaggacaccggcgcccaggtcgcgcccatcgtgaagctggaggaggtcgccgttaccaccggagaggaggacgaggacgcgctcctggacatgaaggcgaagctctaccggttcgacaaggaggggaaccagtggaaagagcgcggcacaggcactgtgaagctgctcaagcacaaagacaccgccaaggtccgcctcgtcatgcgtcaggcgaagacgcttaagatctgcgccaaccatctcgtggtggcgacgactaagatgcaggagcacgcggggagcgacaagtcgtgcgtgtggcacgcgctggacttcgccgacggcgagctcaaagaggagatgtttgctatccgttttggatctgtcgagaattgcaagaagttcaaggacactgttgaagagatagctgaacagcaaggaaagagcgaggagaaagaaaatgatgaagtctccactgccgcttctgatttggcacagaagttaacagtggcagagcccagcaaggaggaaaatgcagagaaagaggaggctcctgcatccgatgataagaaggatgataaagagtgaaggttgaaggcaaacaagggtcaaatggatgccattccattcatttcgtttccaaggttcagcttccccgcaaattttcattgtgttttctccgagatgaatgtttgtgttcggtgaaatcagagtcgtcagtcatctacatagcttttcttggttgatagactgttattttaagtcgcatgtttatctgggatggctggggtcagcatgtttgtacaattatttggagttgcttttggaatggacgcggtttgatgagttgcctacagcatgagatgtcttttcgctccacttttctggttcattcgttctcaataatatgggatgctatacttgtgttgatccccaaaaaaaaaaaaaaaaaaagcaaaaaaaaaaa

SEQ ID NO: 15812 - DNA, 668 bp, Zea mays
gaaaaaatgtttttcatatttctcccttttcccagatgattataaatttgataagtctgagattattcgtttatgggattcaataggaatcataggttctagtatacagcaaaagaaaatagaggacataggatcggattattttgatgaactattagatagtggttttcttataaaagggagcaatgatttttatgtaatgcatgatttaatccttgatctttcacggtactgtttcaaaacaagattgtgcctatatcgattgttctagttttgaggcaaataacatcccacggtctatccgttacctatccatttccatgcaagatcattgtgctcagaatttcgaggaagaaatgggtaaactgaaagaaaagatagacattaaaaatttgcggagtttgatgatatttggaaaatacattaggttacatctgctcaatattttaagggacacatttaaggaaataagacgtcttcgggttctatctatattcatatactcccatagttccttgccaaacaacttttcagagcttcttcatctccgctacttaaaacttttgtcaccttattactcaaaaatgtcattgccaaacacggctcaaggttttatcacctgaaatttctagatcttgaacaaggggaaggatcgttctttgcctagg

SEQ ID NO: 15813 - DNA, 2777 bp, Zea mays
  misc_feature (2559)..(2559): n is a, c, g, or t
gaggtgtgtctatggcaagcgacgtagtcttagcaaccatgttgggtggcgtaggaagcgcaggaacggcaccgtcgattgtcgtggatgccacaatgtcgtcctcaactggcgttgaacccacaagcaggacaatattcttaatcacataatctacatgcatgatgtcgccattggcaatggcgggaatccatcgtccatgtgacacctgaaactgtagcttagagagaagggatgagaggagacggaagggaggataagtgcacgacaaagactaacacatgggcaactttgtcctctcctctcgcgcgaaggcggtgcgttcgttacaaaaccagctcttcgtagtgcgctcaatccaaaattctcccttaagtttatagtagtaagggctagtttgagagcaccattttctcatgagatttctatttttctcaaggaaaaataaactaattttctttgaaaaagtaaaaatatcttagaaaaatgtggttctcagagtagtccttaaatgttactattagagttgctctaaccggcgttggcttgtgcatcatcctggtagaagaggtagtagtagctagtaggtgacaacacgtccgatctggattggtagaagatgtagtaggtgacaacacgtccgatctggattctgctgaaacccgaatggttggtgggggtccaaaaattctccaccaccttcccccgccttcctccgagtcgacccacccgcacctctcctcccccggcatctcactcctcatccgcagttccacaccaccaaatccctacctcctcagtcctcacccattcattcgtccatcccacctaccatggccaccgcctccggcactgacgccggtgcccagccgcgcgacgaccccagcctcctccccttcgcgtccttctcgctcggcctctccatccgcgcgccggccacccccacactcgcctccgtcccctccaccctccacctccccactcaaatctctacactcgccgtctgcctccacccctccgccgcgcagccctcctcccgccgcaccacccgcctcaattccgccacctcctccgtcatcgccccgctgccctcctcaacgcccggcctctcccgctccttcccttcgggcgcgcccgccgcagcagggcgccgccgcacgctcgtctggttccgcgccgacctccgcctccacgaccatgagccgtttcacgccgcagcgggggcgtcgtcctccctcctccccgttttcgtcttcgatccgcgggacttcggcaagtccccctcggggttcgaccggacgggcccgtaccgcgccaacttcctgctcgattcggtcgccgacctgcgccggagcctccgcgcccgcggtggggacctggtggtgcgcgtgggtaggcccgaagtggtcattcccgagctcgcgcgggcggcgggcgcggaggccgtgtacgctcacggggaggtatcgcgggacgaggtccgcgccgaggagagggtgcaaaaggctgtggagaaggagggtatcaacgtgaagtacttctggggtagcacgctataccacgtggaagaccttcccttccgcctcgaggacatgccgtccaactatggcggcttcagggaggccgtgaaggggttggaggtcagaaaggtgctggaggctcccgaggaggtcaagtgcgtgcccatgaagaatgtgctcgagcccggtgacatccccacgcttgctgagctcgggctcactgcgccaccagccatgtcacaggactcaaaacctgctgttggctctactctcattggtggtgagacagaagctctggagaggttgaagaagtttgctgcagaatgctctatgcagccaaacaaagtagacaaaagcaatacccaagatagcatatatggtgctaatttctcttgcaaaatttctccatggcttgctacaggttgcctctctccacggttcatgtatgaggagttgaagaagcatgctactaaagcaattccttttgggtcaacacccaagaataatgatggcacatctgatgctggaacaaattggttaatgtttgagttgctgtggagagatttcttcaggttcatcacaaagaagtacagctctgtacagaagacatctgaagttgccactggctgcactcccgccccagcgcttgcatgaacttacttagacaagctgattgccagctgcttttttggggtgataaacttatgtgcattttcaatggagtcttttttttgccgccaataatgttggtagtcaaagtgaacgccgaatgcgcattcctgcgttttggtttggtcgatgtatttaatgctgtcgacatccctccaaatgactgttgaatgcaaatgatactgtgagcaacctatcatctgctgtgtaaatgtgttctgtcgacgttcctccaaatgacacttcgatgcaatgatattgtgagcaacctgtaagctgttatgtaaatgtgatagttagatgcatatcatgcatgtgacctgctattgttctattgttctactgatatcaggactattgttctatatanaaacataaaattgtatgtaaaaaaaaaaaaaaaaaaaaaaaaaaaaaaaaaaaaaaaaaaaaaaaaaaaaaaacccaaaaaaaccccaaaaaaaaaaaaaaaaagggccccaaggcccgggcccccctaaaaacaagggaccccccgggcttgaagaatttgaatttaaggtttttcaaacccgccacccccagggggggccccggaaccaattcccc

SEQ ID NO: 15814 - DNA, 1712 bp, Zea mays
gcacgagaccattacctagaacatcctaatcgaaaagaagagcagaacgacgaggagattgcttggtgggaggagttggtgaggagaggtcgcgaccatggagaaccttgctctgctttggggcgcgacgaccccagccttctcccgttcgcctccttctcgctcgcgctctccatccgcgcgccggcaacccccacactcgcctctgtcccctccaccatccacctccccactcaaatctctacactcgccgtctgcctccacccctccgccgcgcagccccttccccgccgtcccacccgcttcaattccgccacctactccgtcatctccccgctgccctcctcaacgccgggcctctcccgctccttcccctcgggcgcacccgccgcctccgggcgccgccgcacgctggtctggttccgcgccgacctccgcctccacgaccacgagccgttccacgccgcagcgggggcgtcctcctcccttctcccggtcttcgtcttcgacccgcgggacttcggcaagtccccctcggggttcgaccgaacgggcccataccgcgccaacttccttcttgactcagtcgctgacctgcgccggagcctccgcgcccgcggcggggacctggtggtgcgcgtgggcaggcccgaagtggtcatccccgagctcgcgcgggcagcgggcgcggaggccgtgtacgctcacggggaggtatcacgggacgaagtccgcaccgaggagagggtgcaaaaggctgtggagaaggagggtatcaacgtgaagtacttctggggtagcacgctataccacgtggaagaccttcccttccgcctcgaggacatgccgtccaactatggcggcttcagggaggccgtgaaggggttggaggtcagaaaggtgctggaggctcccgaggaggtcaagtgcgtgcccatgaagaatgtgctcgagcccggtgacatccccacgcttgctgagctcgggctcactgcgccaccagccatgtcacaggactcaaaacctgctgttggctctactctcattggtggtgagacagaagctctggagaggttgaagaagtttgctgcagaatgctctatgcagccaaacaaagtagacaaaagcaatacccaagatagcatatatggtgctaatttctcttgcaaaatttctccatggcttgctacaggttgcctctctccacggttcatgtatgaggagttgaagaagcatgctactaaagcaattccttttgggtcaacacccaagaataatgatggcacatctgatgctggaacaaattggttaatgtttgagttgctgtggagagatttcttcaggttcatcacaaagaagtacagctctgtacagaagacatctgaagttgccactggttgcactccggccccagcgcttgcatgaacatactatcggcagctgctttttttggtgatgaacttatgtgcattttcaatggagtgtgtgtgtggtggggttggggggtggggtgggggggattgtatgcctgagtcatacaaatccacgcgtttgcagacaaatagtcggatcgaactggctttagactatacagttctgtgtatcttgggtttcgagcagatcggatggtcaatatagatatgattcgacggcatctacctgatgaaaggcaaatatcactatatatgactcccacaaaaaaaaaaaaaaaa

SEQ ID NO: 15815 - DNA, 3274 bp, Zea mays
ttaattttacttttaattttatatagaacacttgtaataattcgaacacacttgtcataggttagtgggtttcccgtcgggttgcaggtttaggcaatagagaatatactcatgcccaccacacccgttgagtataataaatggtccaacaaaatactcgtgggcatcaaaatttaccatacccatgttctaataatagtttttatccatcacatatcaggtttctgctaccattgccatctctacaagcagtcaagcgattccacttcatgcgagtacattgttcacgtgtcacagcacctcatcattaggcttcgatcatcgtaagatgatccactgcttatcaatctatcatcgaacctatttgagtcaactttttttaaaatattttctaagaatctggattcctggataatataattgtcatcagaatctggatatcatgggacttacgtgtggaacaaaatcaaggagaagtctacacaatttagggtttaggaagcggcgaattcctcccgactctgcgattagacaaattctacgttcacgttggtttggacgaagttttatagaagtaatttccacataagtgggccaaaataaagaggctattgtatcgaatactctctatcgtagagaattttaagtgtgaacaagtacattattcatattatgccacttttttttttttttttcctcaatgtacaagtatattacattgtttacaacatttaccctatacatatttacatccacatagtgtgtgagacaatgtgagccacgtactgtatctgtacatgcgtgcccaagacgtagaaaaaagaagaaaaaaataatcaaggtatgcaagaaagaaccaggtgtcctgcactcctactaccctacaatactctgctcctggtctgggacacgtgtgcacgcgcatcggctcacggttgcccaaagacatcctaacgaaaagtgtgcgcaccggcttagaccgcgcccccgcgcccggggcacgaggcgtgccggagcagccagacgtcgatgcacggcaggtggaacgtgtgcccgcactccggcaagctccgcgccgtctcgcctgcctcgaagtcctgcaaaatcaaaccaccgaccgggtcgatgtcgaccatcaaaaactgtgcagaaacgacacgaaactcggccatgcacagcctgcactccctgcaagcatgcgcggcggcggggatctgtaggtagctgacctgaaggcagacggagcagccgatgggctccccggaggcgtcggcgacggtgtgctcggtgaaggccatgatggggagcgccgcgacggcggcggccggcatgcccttggcgtcggcggcgcccgtctcgaacatgtccgccagtgtcggcgccatgtcctgcgagtccgcggtgttcatctgcgcggccgatcgagagcacgttagcttggctggagacttgaggttcgtctgttgagatgatcctggctggactgtgagcggctgatttggggctttgtgcttacctgactgtcgacggcgctttgcacggccgggtccaccttctctcgcaccaggcggccggtcagcaggctccagaggacatcgagctgaaacgttttagcagaaaattgatcttttgttactaggttggtgaacgaagagattggattgggtatgaaacggcgaaactgattgttacgtaccacgtataggacgctccagatcccggactcgtcggagcgccagatggcgacggaggaatcgacaacttccatggacacgacggcgccggagatggacccgatgccggcgccgcgcaccaggccgctctccgtggcgagcccgatcagcgcgcccgtgacggccccgaggaccatgcccactgcatgaaaccaagaatcagtgagcctcggttggtccgttgaacgcgccagaaccacttgtgtagcagtagcacgcaacggcggaggaagagggcacggtgaacacatgaatcgaatcgatcgatcaaactgatggcaagtcaaaatctatccaccgacctgccgcgaagacgaaggtgaccaggccgcggatcaccgcgccggcgacgcgcgctggcaggcgggagatgctcctgccgcgccgcgacgtggacgacgacgcgctggcggtcccggagatcgcggccgcctccatgtccatgatgctcgctcgctcgctcgttcacttgtcggtgcgcgcgcaggagaggacacgaaaggggaagaagacctgacggtggagctgtggtttagtcgtggtacaacagatggcacagcagactagacgagggatttgcggacgggcggactttgtggcgtgccgcgtttggaaatttataggttgttctggctggtggacgtacgcgttgttcttgttctgccgcccgcgcccacgcctgcgcttggctcggcaggtcagtcgtgcgcccgcatctgctctcgacggcgactctgacgtggagagcctggctggcggtggaacgcgcccacgcacgcacgcaaagcgtccgggaggcagcaaccaggcaacagcacgcacggaccgcgctgtgccgggcgcataaatgctaaccatccgtccggcgcgcgtctgacggcgacggcgacggcggccccagcccgaaagggtggttggcgaaggatcgccgcgccgtgcgtgcccgccttggtttccttgttccgctcgctctcttaacggctaagcttccctcttcccgcacaccaccaccaaccacgacgccgtcccgctgccctgcctgctcttgcgttgcgcatggatctgtcacctcatctcactcgttgcgggcaccccggacgggcggatcgatcgcgctttgaaagggagttccgaagcatcgcgctagagatggcactcaccgacccgatatctattgaccccatatataataggtatttactttattacgttatatatacgagctaaatattctaccaatgattttcttattggccaaaaacgttcacccaatgaataaacgggtattagaacgttccattatcacacatgcccgttaacacatggtataaaatacccagtacaaaagcgtgaacttaggcttcgatcgttcatctattttaactatttaacaaactttttggcggtaagaaaatataaggcttaacaactatttgatgatcatataatgaaacatgtaatgtgttatgtggtactatcttagtgttgctaatttatctaattattcatggtgttgttgaatgaatgattaaatgatgctc

SEQ ID NO: 15816 - DNA, 1027 bp, Zea mays
cctcgaggccggccgggaaacgcaggatcgcgactccgggcaaaaaaaaacgccgggcgcaatcgggaacggggaaccctagggcagccggcagcgtcgctccgccccggccgtcgtcgtcgcgcgtcgccgtccactcgcttcctgctcgggccttcgcccctcggccacgtctctgccctcgccccttggtcgggaccgacgtcctcgctccatctagcaagctgatcagctcgactgcttgagctcgtcctcgccatcgccgctttgatttcttcctttcagcccgacccggctcaaagcagccagatcacggcactccgtccgaccctcgaagcgatcaccttcaccgcctctcctcctcgtcacaggtgaagatgattccgcagagccagagcagctccctgcagcgccttcaacacgtcgagaagcggatagtgcgggtgctggagcttgcgggagcggtgatggaggagctgggaaactcccatggccctcgcaccgatgcagtcagcgcgcactgccgtgagttcatgatcgctatgaaggaaattcaaacgacgttgcgtgaggaaatcaaaagtgcttgtgaatatcgtccatttgaaaagtgtgattacagtgcaaggattgctaatgagatatgctgcaagaagctggagtatgtaattgagaagttggataccatgcaacagagccttgaacatatcactgatgatgtttagcgagctagctacatattaggtactatactctttttgtgcaataaagtgtaatctacttagtgaataagaggatactttatgatgatagtatccactcaatcaggtgattttgtcaatactttgctgcagtggtagagttggtgaattagatattttcagtttcttggtacttgcaaaatgcaaccattattatatactacatgacttccattgcattatatattgtgtgtttacagggactttttaaatttgcttgcagttctttccactatagcaagccttcattaaaaaaaaaaaaaaaa

SEQ ID NO: 15817 - DNA, 4110 bp, Zea mays
tgcctgcagtgtaactcttacatgatgaaacttcacacgccaattgtttttctgagtggaaaaatgaaaagaacggtcaaaaagataattgccatacttctattccaggctcttctcaggatgggggtggagaaagtgcaaagaagacatcaaatgaggtaaactctggggacacttcttcaaaaatatgtgtccattctaaggataaagacattaatgatactcttgagggcttgtctcaacaagatttgtgtataaaatgtggtaaagttggtcagttgcttgaatgcagcagttgttctttagctgctcataatagctgttttggttcatcggtgacatttgaagagaccaacttattctactgcccagtatgcttctataagagagccaccgaagcatataaaaaggcaaagaaaacatatggggaagctaggaagaacgttgctgctttccttggcacaatacaggtcaccaagcaacataatgaacaactaaatggagttcaaccaggaggtgccaacagagaggatcattctgacacatcaaaaaggactcatgaaaatgaagtatataatcttgctcatcaggatgaagagcctcatcagtagaggaagatgcagaaaaataaatgctataggtaatggttatcgtaaggaggtactcactgagaaagttcctttccagaactcaacgttctgcgtccactaataaacatttaatgctccagaataacattaaaacacgagccacgggtgaaaccctcagggccctcgcactgatgcagtcagcgcgcactgccacgagttcatgatcgttatgaaggtaaccaacccactgcctgccctcatatcgtcaggctgtgggttcctgttgttaccagttatgcgccacaatcctcactaatcccatgctggagagacttttggaaaatcaacatctgttttagaatgctgtgtgcagaattttgctgtccaatgttactttgtttccatcaaattaactgtaaatatatgtatatgctctcaattggtttttatttgaagcagtatacatgccactaataattcatgataactcactgcttaattatgttttggttggagtaggaaattcaaatgattttgtgtgaggaaatcaaaagtgcttgtgaatatcgtccatttgaaaaatgtgattacagcgcaaggattgctaatgagatatgttgcaagaagctggagtatgtaattgagaagttggataccatgcaacagaaccttgaacagagcactgatgatgtttagcgagctggctacatattagtaagtgtacctttttttgcaataaagtgtaaactacttagcgaataagaggatactttatgatgacagtatccactcaatcaagtgattgtgtcaatactttgccgtagcgttagcatgattttagagcttaggataagaaataaagtttcaaattttttgctctcccttgttatctcaatcacttttgccacgattcttaacgtgtattcacttcattgccttttagatttatggtatcattagcacgggcaccttactagtagttcataatccacagcatcgagaaacaaatcaggtttcacactgcatgatacatggtgagggagtaatgcatgaactggcgttagaagcacgcacatctatcctcccctgcgcggtcgggccctcttgggcctctgttgggcacaaacgtggccctcagaataggtgtaacggtctggggacctcccctgtcgtttaggacgcccctcaggtggctgatggggtaggtcttgtgactgtatcgatggcgctcctcccaactatgaagacccgatgatatcgtgctgacccaagcgctcgatctcgtccaaggtgacactagcgtcatccgggacgaacatgctggacagggaacctgtatgaagaataaaatgtgttcataataaaaattaaataaattctgcattggttagaatcaaattgttaagtacctggtcgtgtagacaaagaagggcccgctcctagggtgtggtagaagtgtagaaccctgtgtttgtgtaattaattagttgccacatatgtccaaatagtatgagtataaatatacatgataatcctaccgacacttgtgtaggcagccgccggtgtcataggtgggccttgtggtgcatactgtggtggcatcgtcccccactatggtgccaaaggtggcagagcacggtttgggacaaagttccacgaggggcggtcccatggtcccgcttgggcatacgaggtaggtgggccatagcctaagggcgtgtttgcgaccttggcccggtggcctggctgcgctcctgggatgcaacgtccgtgtttgcgttgcctggcttgctcgggagctcggtcctgcgcgtgcaaaagcggctcttcagtctggctcccaggaaacgaaggcagggtccgtttttttttgagctcggctgctcgtggcgcaagtcagctgctcgtggctgctcccaggaaacaaaagtggcttttagtccggccgcctgcgtgtggcaaacaccggctcacttgaaccaggcttatttggtacaagtgcacacacaagatcagctgcagctccccgggctggctagcttcagcctgggcgacacgagcgggccgagccggccagatacgcgtcgcaaacacgccctaagtgtattcaaagttacagattcatgcatttgtacggtattaaacaaggtcgtgcggcaagtaggcgacgtcctatagcgtaggtgccatctccccacaagggaggtggaacgtgtgggtctcgggcctccacctatcaacgagggccgtcaagagagaactgtccagctgcacaagcccaccgtctaccagacgaactaaagtgaggagaccggcatcctgcaacctaaagatacatgcgagatcagtacacgataacatttaaagtgaatatttgatcaattcattacaaacctcggaaaccaacagtggtgtagctcgatacgctcctcgggtggacgtggacgtagtacatgcaggttagcgtgctcgaccgctgccagaaaagaccggtgacccgagtcgattacttggtccaagagctcaggcgttgcaggatagttacctgccatacttacaattaaatagttcataaaagcagttacgaacataatatgtgaataaacatcgaataaaggcctaaacataatgataattattacaaatacccttgcataattaatataatacaattgtacttacctaatcgtttctaggttgtaatgacacagatcgtctagggcgtggacgacttgccgaggcagattcaaaggggggtgcgtggtgctccatctgtgggattccccaaaggcccggcttcagctgcatcatgtacatagttcgtagggcatcttttgtaactatgaccgtcagcgccgcataggttgcaccgtttttttgtcttgcctgcctctgactcatccatagcattcttgatagatgctgacgatggcctctacctttcttagtagctgggtcaggctcatacagtttaggattattctcctgagtgaacggttccagtattccgatcgaccccatgtatctcctgccaccaagttcttaaggctgtttcctttgagaagtatggtgaaacaaatgcccttgcctgtagaccacactatccgcatgcagcaatcacatgcgagcatggtagatgcagcaggtttggcttcatacatgagcaacgaactataccatccggccaaaaaaagaattcctgcaccaccctttccctgtgtacaccccgaccgattctatccttacatgcaacctcaaatctttgttcatgtgtacccataggttgcacacgatgcagttgggccttcttcatcttatcctccgtgtatgccatcaccctagtgcagaactcaatctgtaggttactcatgttgagacttgcagccatataacgctccctaaagtacttcacacaaccatacataatgaactccacaattcccactagaggaaacccccacgaacggaacgcatgaccatattgtgacactgcatggttggttgtctgaatgttgtaccg

SEQ ID NO: 15818 - DNA, 1354 bp, Zea mays
atttttttccaaatattaaaaaaaaacgccggctgcaactgcaatcggcgacggtgaaccatagagcagccggcagcgtcgccgtcgcgccgctcccgcactgctcccctgccccggccgccgccgccgtcgtcgtccgcccgctcaccgctgatcgatgaccgcccgctctggcgctcggccttcgccccgtttctgccctcgcccctcagccgcctcggcgcctgtccgagaccgacgtcctctctccatccagtcagttgaccagctcgactgctctagctcgtgctctccgtcgcggatttgatttcttcctttcagcccaacccagcccaaagccgccagatcgcggcactccgtccaaccctcggcgccaccgatccccttctccaccccctctcctcctcgtcgtcggtgaagatgattccccagagccagagcagctccctgcagcgccttcaacacgtcgagaagcggatagtgcgggtgctggagcttgcgggagcggtgatggaggagctgggatactctcagggccctcgcaccgatgcagtcggcgcgcactgccgcgagttcatgatggctatgaaggaaattcaaacgacactgcgtgaggaaatcaaaagtgcttgcgaataccgtccatttgaaaagtgtgattacagcgcaaggattgctaatgagatatgttgcaagaagctggagtatgtactcgagaagttggatacaatgcaacaaaaccttgaacagagcactgataatgtttagcgagctggctacatattagttgggaatacaacagatatctgatcgatcagtatgcagaaggaatgtagaagcattctatcaactcatgattggaggaactctgggattgtaacttgtgattccatgttctgtggcagagttattagttttggctgcctgctgatgtccagtagcatagcaatgggtccttgggcttgaagtcgtgggattttgaggcactatttttaccgacgagaatttcctcttctgtattttatcgacttgcttcatccttaaaacatgcctttggtacattgttaacccatttcttcactggtgatcttcatatattatgcagtgaccgctgttccgattaaaaaaaaaaaaatggcccgacatccattgcattagaagctcatcaggttttatcggctgcaaatgttgtatgactgtttagtctagcaatctagtttagagagcaagtaagacataaatgagccatttatctgtcactaaccttgaagtctatgacttgtataaaatggctgggtatgccgacaatatcaacctcttcggacatcccaaaaaaaaaaaaaaaaaagcggcc

SEQ ID NO: 15819 - DNA, 3649 bp, Zea mays
gtgcctacattacgactgacctaaattactgacgatataattcaaaggaagaaccgttttctattgagacttcggaacttcaatacaccatactgtttttttaattgacatcaaataacttcaaacctgaaagtgtcaaatggctcgaaatcgacacacacacacactccatcgatcacgggcagaaacggctccatccagtttgtccttcaaaatcaaaatggtctcggatcacaaaccgggaaagccccccgacctacttcccctccgctgcccacctatttcacctctagtctctaggctctggagacctcgcgcaccatcccaccagcagcaagcgcccactaattccgcaccacaacgcgcactctccggcaccaccgccgtcctcgcgacgtcacatagtacgcattacgcactcgcgcgcgcgcgtgcgcgtacatttacgcagcgatgagctcgagaacgcaccacccctgctttgcgtctgtggagtcatgggagcaagcggcgatggcgcacgacggcttcctcggcgatcttgcctgcccgctcccgctcgctcacgctgcaaccgcggcgccgttcgacccgctgcgggtacatgtggcgcacgcgctcacgggcgccggcgcggggtgggaacacgacgccgcgacgggcgcgctcgtgccgtcgcggccgcgaccgctgtcgccgtcctcgctcgcggcggccaccgccgtagtagttggaggaggaggagacgccgtggaggccgccctgatggagcagcttgcgagcaggctcggcgtcagcgtgccttcgccgccgccatcgcggtacgcgtcctgccacggcacgccggcgggctccccctccaagtcggcggcgccgtgggtgctggccggggacgcggcgcctgcggagcgcgccacagggctcccgtgcttcccggcctcctgtggggagctctcgcgcgtgcccagctgccagtcgtcgcttctcggcgagcacgcaccgactccggcgcccgcgccgttgcctggcgctgctaaacagcacgcgagcgacgggtcgtgcagcgatggcccctgccggaagcggaaggcgtcgggcggcaaggccaaggacgtggtcaccacggccacacccaaggtactaaccatctctgtttcgccatttttgaaactctgtcaaacaagcctctgatgaatgggtgtcggaattcggaaactgtcaagtcccgggagccggagacgatggccaagagacgcaagctctcgacagacgccgcccgcgacgaggctgggtcgcacgggaacggcaaggggaaggaggtggcgccggcggcagagccagagccacagccacccaaggactacatccacgtgcgagcgcggaggggccaggccaccgacagccacagcctcgccgagcgggtacgtgtacgccgccggcgaacacctttccttcgatcgaacagtttcttcagtaaaaaaaaaaaaagaaaacattagttgctgatggtcgccgtcaccggctctcttcaggtgaggagggaaatgttcttgcgtgcgcatgaagctgccgcaggacctcgtgccaggctgcagcaaggtaagtaaacatcgacggcccttgctcaaaattcggttgaaaacacacgcatatttcaatttccaaagactcctcgacctcgtgaaggttaccgggaaggccgtgatgctggacgagatcataaactacgtacagtcgctgcagtgccaggtggaggtgcgtgcgtatgatctgcactctgctctgtctgctcttcttaggacgtagagcatagctttttcctttttaattaacggaaaagaaaacacgagctcttctgaactcgagcaaaacgggtttgcttgcttccgggacagttcctgtcgatgaagctgtcgaccgtcgacccgcgccgggagctcgacgtgggctgcttcgtcgtccccagagacgacgtaacgatgcaggccaacaggctgtgcgcgcccgcgacgtcgtcgtcgagctcagccttctgctacgccgcgcggagtgttgttacgaacgccaaaggattcgagacgccgctgcccttggcgaaccatggcgtcgcggcggacgacaggccacttgagcggcggactcgagacgcaggtccccaggtacgtcaagacctgctgcgtccatctatttcctgtcgctgtgcgatccactccaaactgtagatcgccatggatttcaggcggggagcttgtgggaagaggacgatctgcagagcctggtcctgatgggattccggggccgttgatcgttgacgctctgattaggctaggccgctagggacgacagttcgtttccaccgaccgccaaccaaagcgagagttgcagggccacgtaacagcagggttgggctccaatcattgggaactctccatgattgtacacagacaggacgcttacacgctaatttccagctcggcggaggccaagaaacgaaacaaaaaaaaaaggcgaaaagaagatgtttttttctcgcattccccctcacgaatttgcagtttaatcgatgtaagataactcaatgtaattattaatggtatttgagtcttatagacatcaagttgatgaaattttatactacacaagatgctttcggtaacagctgatctggatgccttagtttcatgtcggcacctactaccttcctttacattgtttgttgtttgcctgatgcagtctacgtgtgagctggacgtgtcaaccactctctatgtatgtagaatcctaaccccttttagcgtctcgctatcatgcatgatcactttgtttatctcatccggacaacgaggcagggggttagacgcagccggtttttttttatattctgtcctgtcctgtcccttcggttgcgttgcattgcatgatgagcggaactgccatatagttcgcaacctttcatcgcggccggccggccggcaatgatgagttcccgcgcccgacgtgtgtataaaactccctctcggcattccgagtaatgatgtgaaggacactcggttatatgtatggaaaatgttagtccccctatctggttcgagggattaaatgttagtccctacattttagtctctaaactaccaaacgatgagactaagacatagattaaactgcgacagatgactaaaaaagattaaatcatattaattcatcttttatctctaacatatttcagtggtaccaaacagagtggagactaatcatttagtccccgaccaatctgaaatcaaacagagtagagaccactttagttctcccactaaactttagttccttgactaaagaaacaaaataagaccttagtttattcagtaatgcaaaaaaaaagtagcgttgatactctgatagtaatcttgacatggaactgtggttcgttggtcactggacgcgtaacatggaacatgatagaatagctgcaagaaaacgaaggcaggggttgggtcatagtggagaagattccatccagcgtagaagcatctgtgtgtgacaggcagcgtcctcttcttccctagtcgcatcggtgtacgaacctgtgatgaacgcttggcacactgcccttcatggccaatgtccccggagaaaaacatccaaaagtact

SEQ ID NO: 15820 - DNA, 1848 bp, Zea mays
agtctctaggctctggagacctcgcgcaccatcccaccagcagcaagcgcccactaattccgcaccacaacgcgcactctccggcaccaccgccgtcctcgcgacgtcacatagtacgcattacgcactcgcgcgcgcgcgtgcgcgtacatttacgcagcgatgagctcgagaacgcaccacccctgctttgcgtctgtggagtcatgggagcaagcggcgatggcgcacgacggcttcctcggcgatcttgcctgcccgctcccgctcgctcacgctgcaaccgcggcgccgttcgacccgctgcgggtacatgtggcgcacgcgctcacgggcgccggcgcggggtgggaacacgacgccgcgacgggcgcgctcgtgccgtcgcggccgcgaccgctgtcgccgtcctcgctcgcggcggccaccgccgtagtagttggaggaggaggagacgccgtggaggccgcgctgatggagcagcttgcgagcaggctcggcgtcagcgtgccttcgccgccgccatcgcggtacgcgtcctgccacggcacgccggcgggctccccctccaagtcggcggcgccgtgggtgctggccggggacgcggcgcctgcggagcgcgccacagggctcccgtgcttcccggcctcctgtggggagctctcgcgcgtgcccagctgccagtcgtcgcttctcggcgagcacgcaccgactccggcgcccgcgccgttgcctggcgctgccaaacagcacgcgagcgacgggtcgtgcagcgatggcccctgccggaagcggaaggcgtcgggcggcaaggccaaggacgtggtcaccacggccacacccaagtcccgggagccggagacgatggccaagagacgcaagctctcgacagacgccgcccgcgacgaggctgggtcgcacgggaacggcaaggggaaggaggtggcgccggcggcagagccagagccacagccacccaaggactacatccacgtgcgagcgcggaggggccaggccaccgacagccacagcctcgccgagcgggtgaggagggaaaagatcagcgaacgcatgaagctgctgcaggacctcgtgccaggctgcagcaaggttaccgggaaggccgtgatgctggacgagatcataaactacgtacagtcgctgcagtgccaggtggagttcctgtcgatgaagctgtcgacggtcgacccgcgccgggagctcgacgtgggctgcttcgtcgtccccaaagacgacgtaacgatgcaggccaacaggctgtgcgcgcccgcgacgtcgtcgtcgagctcagccttctgctacgccgcgcggagtgttgttacgaacgccaaaggattcgagacgccgctgcccttggcgaaccatggcgtcgcggcggacgacaggccacttgagcggcggactcgagacgcaggtccccaggcggggagcttgtgggaagaggacgatctgcagagcctggtcctgatgggattccggggccgttgatcgttgacgctctgattaggctaggccgctagggacgacagttcgtttccaccgaccgccaaccaaagcgagagttgcagggccacgtaacagcagggttgggctccaatcattgggaactctccatgattgtacacagacaggacgcttacacgctaatttccagctcggcggaggccaagaaacgaaacaaaaaaaaaaggcgaaaagaagatgtttttttctcgcattccccctcacgaatttgcagtttaatcgatgtaagataactcaatgtaattattaatggtatttgagtcttatagacatcaagttgatgaaattttataccaaaaaaaa

SEQ ID NO: 15821 - DNA, 1212 bp, Zea mays
  misc_feature (1166)..(1166): n is a, c, g, or t
  misc_feature (1189)..(1190): n is a, c, g, or t
  misc_feature (1208)..(1208): n is a, c, g, or t
ttttttttttttttttgtatcacattatatatttaaatatttattactaatattaaatatagtctaaataaaaattaattacacaactacaaactaaacgtcgagacaattttttaaaaccaatgtgacgggagaacggcggaacgagagctcaatgtaatttgagtcaaggcaggcccactagaaagcccagaacataccaaggccgcactctctctctttcttccccagcaatgcaattccgcagacagacgcaggcggcaggcggcaggcggcggcgcaccgcaccgcttcttcctcttctatctctcatctacagccttcgctgcgccgccatggccaccacccgcttgctgccgctgctccgacgccgcctcgccgccgcaatcgccggatcgcctgctccctactccctccgaggaccctcatttcctgcaccagcagctgcagggctaaggtccctcctaacagttgctggagcgagcgatactgcaacagaaccccaggaccaacagcattccgaaacaactcccccgccggcttctgtcccgacaccggagtccggtctcaaagtcagggacacctccaacctgaagatctcaccaaggcatgacctcgccatgatctttacgtgcaaggtgtgcgagaccaggtccatgaagatggccagcagggactcgtacgagaacggagtcgtggtcgtgcggtgcggtggctgcaacaacctccacctcatggcggacaggcttggctggtttggggagccagggagcattgaggacttcctagcgacgcaaggggaggaggtgaagaaaggttcgacagatactatcagctttactttggacgacttggctgggtctcaggtcagttctaaggggccttccgaacaaaattaatatgatagtgtttggtccagtaagaacctgcagaagcctctctttactataaagaagacgcacatgtcacctgtgtgttgaagagaagaaaaaagcgcctctagaagcctaccttaactgttgcacctgtagttctgcttaacttcatgggcttttcatgtgtagctttcgagcccatcaaatacgcgatgttgtgatctattgtatgttactatttcctataccaaaaactggatccaagaaaacctacattaattgaaggaatgnccgcatttccgatcatgttatcnngttgtgttgccgcattcnttcc

SEQ ID NO: 15822 - DNA, 3518 bp, Zea mays
aattcggcacgtgccgctcgcggtttcaccccgcgttcgctctctctcccgtggcgacgactgggcggccgccgcagccgccctagcccggtgcggctcttcgtcgggtccttcgccggcgacgggcacctaccaggatgaagacgaggatagtgtactccagggagtttctgctgtcgcttggcgagttggagcattgcaagaagctgccccctgactttgatgcagcgctgcttagtgagctgcaggagctgtcagcgggtgtgcttgagagaaacaagggctactacaacacatcccagggacggccagatgggtcggtgggatatacttactcttctcgtggtgggaacactggagggaggtgggatactcgctcatctggatcaagtgatcgggatggggaacctgatcgtgagtctcagacacaggggcgtggtgcaaaccagtacagacgcaattggcagaacacggagcatgatggcctacttggccgtggtggtttccctaggccatcaggatatactgggcagttgtcatcaaaggatcatggcaatgcgcctcagctaaacaggacatcagaacgctaccagccaccacgtccttacaaggctgctcctttttcacggaaagacattgactcgattaatgatgagacattcgggtcttctgaattatcaaatgaggatagagcagaagaagaaaggaagcggagggcatcttttgagttgatgagaaaagagcaacataaagcagtgctaggaaagaagagtggtcctgatatcctgaaggagaatcccagtgatgatatattttcaaagttacagacatctactgcaaaggcaaatgccaaaactaaaaacgagaagttagatggttctgtagtatcctcatatcaggaagataccactaaaccatcttcagttctactagctcctgcagccaggccgcttgtcccgccgggttttgcaaatgcattcgctgacaagaagcttcagtcacagtcgtctaacatcacacatgagccgaagctagaggatgaccagtcagcaacagggttcacatctgaaagtaaagagaagggagtttctggtaacgatgctactatgggtccaaagcacacgcatccacctggtagtgttacctcttcagctgaattggcttctagcgttctgaaagggagcgaggattgggaagctgatgtaatggataagtattctattggaaaagaagccacccccacgtccttggacccgggggggaacgatgattcagtagcaatcttagaacagttctttggcaatgttttatcgaaaagcggcagcaacctaccaacttatgttgagaaccagccattgaaaactgatgatgacatgatcacttctgtgccagaatcatccaaatttgctcattggtttcttgatgaagacttgaaacctgcagaagacttatcttcaaagagcctgctctccatgattgtcaaaaatgaaaatccaggtctagaaaatttaaaccatactcctttatctgatgctgctgcccagaatttatccccaagagcacctattgataaacttgattctgcatcagagcttatctcatttacatcctctacgcctgccaatggagttcttgaacaatgcatccattctgatgttccagaggcagttcctattatgacatgtgaggatcttgagcagacgatgttagcacaggttagcaatagcagctcaactcagataaatgctacaaaggagcaactgactgttatggatgaaccagttgccatgcagaaagtaactgtagataatcatgcatcacaacatcttctttcattgttgcaaaaaggaacagataataagggagcaccttccctgggtttccagagagaatcaactgatgaacctctgagtgttgacacaaatttaatggcaaatggtggaatatctggaagtgatccggttaacagtgttgaaaatgttcctacttctgggaaggacttgacattggaagcgttattcggggctgcatttatgaatgagctccactcgaaagatgcaccagtttctattcgaggagccacaactggtggtcctactgagtttgcagagatgggtaaaactctgttgtcatctagccatgaaggatactaccctgttgaacagaccgtacacttcaacaatactaaagatgctgctgtccgtagagaaccaggtattgagcattcagcagtacctggtctaagtcaggggagtgctagttttgacaagaaaggaatggaaattcatctgcctgaagaagataatttgtttaccatgagtgattctctgcttggtcaaaattctgatattttggcatcagtaggatccagcagggttgaagggctattgcctgaaaaggcacttgataacctcagctataggtttcaaagtcttgtgcctggtgatgcagaacacattcaagtatatggtcctgatgcacttggatctcatcctcgtgattctcagaatatgtatcatcttctacagggtaggcctcctatgatggcacctcaccctatgatggatcacattgttaataggaaacagccagctccatttgatatggcacagtcgatacaccatgattctcaccgttctttcccatctaatgtgaatcatatgcaacataatcttcatgggccaggggtccctcacttggaccctgctggacatattatgcgacaacacatgtccatgcctggaagatttcctccagaaggcttgccaagaggtgtccctccatctcagcctgtgcatcacatggctggttatagacctgaaatgggtaatgtaaataatttccatatgcaccctcgccagcccaactatggagaatttggattgatgatgccaggcccatcaggtccagaggtgaggggcaatcatccagaggcgttcgaaaggttgatccagatggagatgtcagccagatcgaagcaacagcaggtgcaccaccctgcaatggccgctggccgtgtgcctagtgggatgtacgggcacgagcttgatgcgaaattgagatacagatgatggatgcctggatgcttcactccgtacagaggacctggaggtgtggtttgttgtatgtgcgtggtcactctttgcccagactgctgtgtattatttctgctaacatggtttagcatcagccgtcggtcgcgactgattggaggcctgcctcacttgtagggttgtagcatgtacatctgaacgggtgatggaacggagtgggtctaagatctgtaggagcggaagtctaccgggaaaaggggttatggtgtgctgaatggaagacgtggcgtcgacgtcttagcagccacatgtgtaatgacgttttctgtctactgtttctgacgactatgcagtttccattttgtataagctctgttatgcaaaaggaaaaaaaaagaagaaaaaaaactgagtcagattaacagattggcgacaaaaaaagctgaccctaaaaaaaaaaaaaaa

SEQ ID NO: 15823 - DNA, 1510 bp, Zea mays
gaccctcgggcttgctctctctgtctcctcacccgacgcccaaagaagcagagcaggcaacggcacagttagagagagagagagagaggcgcagagccaaggaagcggagcagagcaacagcagcaggtcgaggaagaggagaagagaaggtccaggagacagcacagcagccaggaagagcaagagcaagatgctgcgcgggggcacgggcatgctgggggtggtgaacttcataaccttcctgatctcgatcccgatccttggcggcggcatctggctggcgtcgcgggccaactccaccgactgcatccgcttcctgcagtggcccatcatcgtggtggggctcgtcctcatggtcgtctccctcatgggcttcgccggcgcctgctaccgccagacttggctgctccgcctctacctcttcgccatgttcttcgtcgtcctcgcgctcctcttcttcgtcgtcttcgccttcgccgtcaccgaccgcggcgccggccaggtcgtcatgagccgccgcttccccgagtaccagctctccgactacggcggatggctccgcgaccgcgtcgccgacccgcagtactgggccaccatcagcgcctgcctccgcgacggccacgcctgcgccggcatgaggcgcctcgcgcgggaccccaacacgggcatgctcgtgccggagacgcccgccatgttctacggccgcaacctctccccgattcagtctggatgctgcaagccaccgacgtcatgcgcattcacctacatgaacgagacgtactgggaacaaaaccccggtgtcccgaccgtgcccaatgaccctgactgcagcaggtggagcaacgaccagcagatgctgtgcttccagtgcgactcgtgcaaggccggcgtcctcgcgggcatcaagaagagctggcgcaaggtggccgtcctgaacatcgtggtgttgatcatccttgtgattgtctatgtcgcgggctgcgccgcgttccgcaacgccaagaggatcgacaacgacgagccggtgggcatggcgcggatgaccaagtcccatccaagcaggttccagttctaggcaggcagctgctgccgtcgcgggttcggaagcttctgccttgtacagatgatgaccagaccagtgggtggtgctaaggcctgggctttgctatatcttactgagatgtggattgtactgcatttgggggtgaaaaggggaagttcagtgtggtttgagttcgtgtttgatttagtgtttagggtaggtatgttatgtggtagggggtacaatatgggatctgcaagaaacaagagaagatcaatcatctaggaactgttctgtattggagatttttttttaaaaaaaaatctgggggatatttgtatgatggtgcttggtgccagccatgatggaatattttctgaatttctcactgtatgggaatgctagaggtatgaatgtatgatgatatggctgtacggcagcttccagtatgaatattagggttctag

SEQ ID NO: 15824 - DNA, 979 bp, Zea mays
cattgggtacctcgaggccggccggggctggcctgtgcttatgctgccttgcatctgctctcccgtacagccgcaccctccgccccgcccggcgctaaaaaccgggaccccctgcctcccgcccggactcaccacgcacgcacaaagcagagcaggcaacggcacagcccagcacaggtagagagagaaagagaagcgcggagtcaagaagcggagcaacaacagcaggccgaggaagagaagagaaggccaggaggcagcagccaggaggaagagcaagagcaagatgctgcgcgggggctcgagcgtgctggggatcatcaacttcatcaccttcctgatctcgatcccgatcctgggcggcggcatctggctggcgtcgcgggccaactccaccgactgcatccgcttcctgcagtggcccatcatcattgtggggctcgtcctcatggtcatctccctcatgggcttcgccggcgcctgctaccgccagacctggctgctccgcctctacctcttcgccatgttcttcgtcgtcctcgcgcttctcttcttcatcgtcttcgccttcgccgtcaccgaccgcggcgacggccaggtcgtcatgaaccgccgcttccccgagtaccagctctccgactacggaggctggctccgcgaccgcgtcgccgacccacagtactgggccaccatcagcgcctgcctccgcgacggccacgcctgcgccggcatgaggcgcctcgcgcgggaccccaacactggcatgctcgtgccggagacgtccaccatgttctacggccgcaacctctccccgatccagtctggatgctgcaagccaccgacgtcatgtgcgttcagctacatgaacgagacgtactggacacaaaaccccagcgtcccgacggtgaccaacgacccagactgcaaaaggtggagcaacgaccagcagacgctgtgcttccagtgcgactcgtgcaag

SEQ ID NO: 15825 - DNA, 1531 bp, Zea mays
agcttgcatgcctgcaggcccgttgctctccccgaacagccgcgagcgtgctcctcgacgacctcgttaaaagccttcgggtccccgggcgcccccgctctctgtctcctcacccgacgcccaaagaagcagagcaggcaacggcacagcagagagaaggcagcacagttagagagagagagagagagagagaggcgcagagccaaggaagcggagcagagcaacagcagcaggtcgaggaagaggagaagagaaggtccaggagacagcacagcagccaggaagagcaagagcaagatgctgcgcgggggcacgggcatgctgggggttgtcaacttcataaccttcctgatctcgatcccgatccttggcggcggcatctggctggcgtcgcgggccaactccaccgactgcatccgcttcctgcagtggcccatcatcgtggtggggctcgtcctcatggtcgtctccctcatgggcttcgccggcgcctgctaccgccagacctggctgctccgcctctacctcttcgccatgttcttcgtcgtcctcgcgctcctcttcttcgtcgtcttcgccttcgccgtcaccgaccgcggcgccggccaggtcgtcatgagccgccgcttccccgagtaccagctctccgactacggcggatggctccgcgaccgcgtcgccgacccgcagtactgggccaccatcagcgcctgcctccgcgacggccacgcctgcgccggcatgaggcgcctcgcgcgggaccccaacacgggcatgctcgtgccggagacgcccgccatgttctacggccgcaacctctccccgattcagtctggatgctgcaagccaccgacgtcatgcgcattcacctacatgaacgagacgtactgggaacaaaaccccggtgtcccgaccgtgaccaatgaccctgactgcagcaggtggagcaacgaccagcagatgctgtgcttccagtgcgactcgtgcaaggccggcgtcctcgcgggcatcaagaagagctggcgcaaggtggccgtcctgaacatcgtggtgttgatcatccttgtgattgtctatgtcgcgggctgcgccgcgttccgcaacgccaagaggatcgacaacgacgagccggtgggcatggcgcggatgaccaagtcccatccaagcaggttccagttctaggcaggcagctgctgccgtgggttcggaagcttctgccttgtacagatgatggccagtgggtggtgctaaggcttgggctttgctatatctttactgagatgtggattgtactgcatttgggggtgaaaaggggaagttcagtgtggtttgatttagtgtttagggtaggtatgttatgtggtagggggtacaatatgggatctgcaagaaacaagagaagataaatcatctaggaactgttctgtattggagattttttttttaaaaaaaatctgggggatatttgtatgatggtgccagccatgatggaatattttctgaatttctcactgtatgggaatattagggt

SEQ ID NO: 15826 - DNA, 532 bp, Zea mays
aactcaccacgcacgcacaaagcagagcaggcaacggcacagcccagcacaggtagagagagaaagagaagcgcctctacctcttcgccatgttcttcgtcgtcctcgcgcttctcttcttcatcgtcttcgccttcgccgtcaccgaccgcggcgacggccaggtcgtcatgaaccgccgcttccccgagtaccagctctccgactacggaggctggctccgcgaccgcgtcgccgacccacagtactgggccaccatcagcgcctgcctccgcgacggccacgcctgcgccggcatgaggcgcctcgcgcgggaccccaacactggcatgctcgtgccggagacgtccaccatgttctacggccgcaacctctccccgatccagtctggggggggggatgctgcaagccaccgatgtcatgtgcgttcagctacatgaacgagacgtactggacacaaaaccccagcgtcccgacggtgaccaacgacccagactgcaaaaggtggagcaacgaccagcagacgctgtgc

SEQ ID NO: 15827 - DNA, 1555 bp, Zea mays
cccacgcgtccggctgccttgcatctcctctcccgtacagccgcagcgtgctccgcgaccgcgctaaaagccaaccgccctgtctccccgcctccctcactcaccacgcacgcacaaagcagagcaggcaacggcacagcccagcacaggtagagagagagagagagagaagcgcggagccaagaagcggagcaacaacagcaggccgaggaagagaagagaaggccaggaggcagcagccaggaggcagcagccaggagcaagatgctgcgcgggggctcgagcgtgctggggatcatcaacttcatcaccttcctgatctcgatcccgatcctgggcggcggcatctggctggcgtcgcgggccaactccaccgactgcatccgcttcctgcagtggcccatcatcatcgtggggctcgtcctcatggtcatctccctcatgggcttcgccggcgcctgctaccgccagacctggctgctccgcctctacctcttcgccatgttcttcgtcgtcctcgcgcttctcttcttcatcgtcttcgccttcgccgtcaccgaccgcggcgacggccaggtcgtcatgaaccgccgcttccccgagtaccagctctccgactacggaggctggctccgcgaccgcgtcgccgacccacagtactggaccaccatcagcgcctgcctccgcgacggccacgcctgcgccggcatgaggcgcctcgcgcgggaccccaacactggcatgctcgtgccggagacgcccaccatgttctacggccgcaacctctccccgatccagtctggatgctgcaagccaccgacgtcatgtgcgttcagctacatgaacgagacgtactggacacaaaaccccagcgtcccgacggtgaccaacgacccagactgcaaaaggtggagcaacgaccagcagacgctgtgcttccagtgcgactcgtgcaaggctggcgtcctcgcgggcatcaagaagagctggcgcaaggtggccgtcctgaacatcgtggtgctgattatccttgtgatcgtctacgtcgcgggctgcgctgcgttccgcaacgcgaagaggatcgacaacggcgaggcgatcggcatggcgcggatgaccaagtcccatccgagcaggttccagttctaggccgctgctctgctgccactgcgggttcgaaagctcttgccttgtacaaatggccagtggtgtggtcctaaggcttgggcttcgctatgtcttgctgaattgcggattctactgcatttggtggtggaaatggaaagtccagtgtagttcggggttgtgtttgtttgagtgtttagaataggcctattatgtggttggctggggtataatatgagatctgcaagaaacaagagaagttgaatcatctaggagttgttttgtaagggagatgtttaaattcttgggggatagttgtatgatggtgccagccaaaaaaaaaaaaaaaatgaatttctcagattgtatggcaatactagaggtatgatgatatggctgtactgcaaaaaaaaaaaaaaaaaggccccta

SEQ ID NO: 15828 - DNA, 1549 bp, Zea mays
attgggaccctcgaggccggccgccgttgggaccctcgaggccggccggcactcaccacgcacgcacaaagcagagcaggcaacggcacagcccagcacagagagagaagcgcggagccaagaagcggagcaacaacagcaggccgaggaagagaagagaaggccaggaggcagcagccaggaggaagagcaagagcaagatgctgcgcgggggctcgagcgtgctggggatcatcaacttcatcaccttcctgatctcgatcccgatcctgggcggcggcatctggctggcgtcgcgggccaactccaccgactgcatccgctttctgcagtggcccatcatcatcgtggggctcgtcctcatggtcatctccctcatgggcttcgccggcgcctgctaccgccagacctggctgctccgcctctacctcttcgccatgttcttcgtcgtcctcgcgcttctcttcttcatcgtcttcgccttcgccgtcaccgaccgcggcgacggccaggtcgtcatgaaccgccgcttccccgagtaccagctctccgactacggaggctggctccgcgaccgcgtcgccgacccacagtactgggccaccatcagcgcctgcctccgcgacggccacgcctgcgccggcatgaggcgcctcgcacgggaccccaacactggcatgctcgtgccggagacgtccaccatgttctacggccgcaacctctccccgatccagtctggatgctgcaagccaccgacgtcatgtgcgttcagctacatgaacgagacgtactggacacaaaaccccagcgtcccgacggtgaccaacgacccagactgcaaaaggtggagcaacgaccagcagacgctgtgcttccagtgcgactcgtgcaaggctggcgtcctcgcgggcatcaagaagagctggcgcaaggtggccgtcctgaacatcgtggtgctgattatccttgtgatcgtctacgtcgcgggctgcgccgcgttccgcaacgcgaagaggatcgagaacggcgaggcggtcggcatggcgcggatgaccaagtcccatccgagcaggttccagttctaggccgctgctccgctgccactgcgggttcgaaagctcttgccttgtacaaatggcctgtggggtgtggtcctaaggcttgggcttcgctatgtcttgctgaattgcggattctactgcatttggtggtggaaatggaaagtccagtgtagtttggggttgtgtttgtttgagtgtttagggtaggcctattatgtggggttggctggggtacaatatgagatctgcaagaaacaagagaagttgaatcatctaggagttgttttgtaaggggagatctttaaattctagggggatagttgtatgatggtgccagccatgatgcagtgttttctgaatttctcagattgtatggcaatactagaggtatgatgatatggctgtactgcagcttccaggcccaaaaaaaaaaaaaaaaaagcggccaaaaaaaaaaaaaaaagaaaaaaaaaaaaaaaaaagcggcc

SEQ ID NO: 15829 - DNA, 1874 bp, Zea mays
ctcgaggccggccgaaaaaaagcatgcgaattattcgaggcggctttatggtcggacggatcacccccagcaaggagccgccacccgccactccgccagagcattgcagcgccagccacctcgccccctctcgctgtcccgcaccacccgctccgagggaaggagaggtaaccggtgggggggcgcggcggcgagcggagatcccgggaactccgatcgagcgcaagcggcgggacctgcgggagcagagagcgcgcagggaggacaagtgagtagcgtggttcgatggtaagggagacgggatactacgacgtgctggaagtgagcccgacggcctccgaggccgagatcaagaaggcatactacgtcaaggcgaggcaggtccatccggacaagaacccagatgatccgcttgcggcggcgaggttccaggaattgggggaggcataccaagtgctcagtaatcccaagcagcgtgaagactatgacttacatgggaaacctggtatttcaacggaagcgataattgatcctgcagcaatttttgcgatgctgttcggtagcgagctttttgaggactacattggtcagctggcgatggcatccatggcttcacttgatggttttactgaaaacgaacagatcgatccaagaaggttgcaagagcaaatgcgagttgtacaaaaagaaagagaggagaaacttgcagaggcactaaaagataggttgcatctttatgttcaaggaaacaaagaggaatttatccagtatgctgatgctgaggttactagactctctaatgccgcatacggtgttgatatgttgagtactattggttatgtgtattcgagacaagcttctaaggagcttggaaagcaagctaaatatcttggtgttccatttattgctgaatggttcagaaacaaagggcattctattaaatcccaaataactgctgcaacaggtgcattagctcttatgcagctgcaggaagactggagaaagcatctcagtgatgagtgccactacaatgaagaggaactggaggcttacatgctgacacataagagtgttatggtggactcgttatggaagcttaatgttgctgatatagaggaaaccctgtcacatgtgtgtcaaatggtgcttcatgacagcagtgccaggaaagaggaactgcgagttcgagctaaaggattgaaaactttaggcaaaatattccatcaagccaagcttagcactgctgagggagatccagcagcaatgaataatacaataaataacttggatgagaatgatgatagttcaccggagtcatctccaagatctcccagggaccaaatgttcgatacaaacccaccttattcccagagtccatacgtggaggcccctgagttgggcgggtatttttccttcgacttcccaatgcctatcgctccgcctggcgcgcagagggaccctattccgtgaccgccgtgagtgcggcggctctgttttgtgtggatcgtcattttgtacaatattgcctgtgtaaatcatttttatttgtaacattagtagcagtagtgtgagacagcagcttggcacccattgcatcgtttcttttctttttcatcgtgtaatcaatcaatcaagcatgcgacgacggcagccttgtcttgttcgtagggcttggtctgcttctggccacgggtcagccattggtgtacatgaactaccacctctttgtttcttgtgtttatcagtttatgggtgcataattgtttagcctatgggcccatctgggcaaacaacacttgcttgtgctaagctttgctcgaacttcgtctcgtgaaatttgatcatctcctcttcctgcaaaaaaaaaaaaaaaa

SEQ ID NO: 15830 - DNA, 1914 bp, Zea mays
aagcgattaccctggtggaggacggaacgaaggcaagggaagtccagcgacgacgaacacgatgccgccccaccgtgccggaggggccgcaggcggcggtgacacgagcgcgttcttcgcggcgacgctagtgctctgggctgtgtctgtggggttcgagatcggcgtccgggggcgacgcgagctggcgcccgtggccgccggcttcgccttcttccaggccgccaacgccgcggtccgcggctcggtctcacgcgacccgctcttcgtcaacaccgccgtatcgctcctccactcctccctcacatccgtctccgttatctttgttcttgtcaatcaatggcgtaataagggccttgagaacatgtttgagcatgaagaactatttggtggcagttggattggagcatattctgctttgtgcttttcttgtggctactttgcatatgaccaactggacatgctccgttaccggctgtacaatggatggattcctggaattctcatgcatcacttgatcctactcatttgctttacactagctctgtataggaatgtcacaatcaactacctaattctctcccttgtatgcgagctgcactccatatttttgcatgtaaggaaagtgaggcgaatggttggatttcgagatttcgacagaacaatggtgaagctggaatggttactcaactggactacctttgtgacagcaagggtgatatgtcatatcttgataacttacaagctcgtcgctgatgctcacaaatttgggaagggcattgagcttccactagctcttcttggtatggcaggaatgaatctgctcaacatatttctagggcttgatctacttaaagcattcacacgagaaagaaaccagcagagccatcaggattgaatgtgcttttcttgatggtggtgtactcaaaattttgagaaggctgtagttccgttcaagtagggcagagagatatgtttaagtcttaattagcaactacactggaggcaatttttgtatgcattctttatgtataccaaaatgtactaatgctaagatctctaccagaaagggttgttgctagtattttcatccatgtaggtataatattcattagcagaatgcaggcgggtacctggatgcaggatttacatacatattgcaattagaaagaagtgtgtcaaaacctttggtctcaactccctaacctcatgtaaagtaaacccgaaagcaaaaccttgtggattggccctgtgaggctacaatgctcttatttatctttttaatagttgataatttcttgctgcaaagcaaaaaaaaaaaaaatatagctcatacccactggctctactgtggtacggcttgggaaggaagtacgcaaagcaaacatgcattctgaactgtattttcattctgacgtgttttggctggaccaacaacctgaaacgaacttgcattatgaattctgagggaaaaaataaagatcccaccgagttccaacccaggtaatttgcattctgaattgtattatgttgacgtgttttggctggacgggaaaaaaataggttccaccgggattcgaacccaggtcgccagattcaaagtctggagtgctaaccactacactatggaaccagttattgattttggggtgctgatatagatatatatatacattacatgccactaaacccattttccattagcccgaaaccgtttcctctagatagagcagaatgaaataccagaatatctaacgaatacctggtgattttgttgcacccgaaacagcaggatgtacggctatgaaatgaattttttttgcgaagggatggaaaataaatctaacttacagcaacgttgccacagcgggcttttttactcgtgaaattttttccttcaaaatagagcttcaa

SEQ ID NO: 15831 - DNA, 1068 bp, Zea mays
  misc_feature (723)..(723): n is a, c, g, or t
  misc_feature (770)..(774): n is a, c, g, or t
  misc_feature (871)..(873): n is a, c, g, or t
  misc_feature (1028)..(1053): n is a, c, g, or t
atccacatggactgtatagctaaccgaacaagccctaagcgattaccctggtggaggacggaacgaaggcaagggaagtccagcgacgacgaacccgatgccgccccaccgtgccggaggggccgcaggcggcggtgacacgagcgcgttcttcgcggcgacgctagtgctctgggctgtgtctgtggggttcgagatcggcgtccgggggcgacgcgagctggcgcccgtggccgccggcttcgccttcttccaggccgccaacgccgcggtccgcggctccgtctcccgcgacccgctcttcgtcaacaccgccgtatcgctcctccactcctccctcacatccgtctccgctgcactccatatttttgcatgtaaggaaagtgaggcgaatggttggatttcgagatttcgacagaacaatggtgaagctggaatgggtactcaactggactacctttgtaacagcaagggtgatatgccatatcttgattacttacaagctcatctctgatgcccacaaatttgggaagggtcattgagcttccgctagctcttcttggtatggcaggaatgaatctgctcaacatatttctagggcttgatctacttaaagcattcacacgagaaagaaaccagcagagccatcaggattgaatgtgcttttcttgatggtggtgtactcaaaattttgagaaggctgtagttccgttcaagtagggncagagagatatgtttaagtcttaattagcaactacactggaggcaannnnngtatgcattctttatgtataccaaaatgtactaatgctaagatctctaccagaaagggttgttgctagtattttcatccatgtaggtataatattcnnnattagcagaatgcaggcgggtacctggatgcaggatttacatacatattgcaattagaaagaagtgtgtcaaaacctttggtctcaactccctaacctcatgtaaagtaaacccgaaagcaaaaccttgtggattgggcctgtgagggtgcagtnnnnnnnnnnnnnnnnnnnnnnnnnnataatttgcttgctg

SEQ ID NO: 15832 - DNA, 1813 bp, Zea mays
gtgatttagaggacgttgttggagaggaaggagatatagagggtggaatcttttagaggagactgtaaaggatggatatagaggatgaatatagaggacgttgctggagacagcctaatacatgagtaatttccctcaaagttgtatataaactatcgttagagttcattccaagataaaaatagaggtattaggatattcatgagctaaaattgagcgagatcggtcatggccacataaaaacagcatgaccttttcatctccactgatggtgtgcgtgatcatggtcacatgaaatttcactttgtaaccagtgtattctaaaataatatatgcacatatgataaatggttcagctttgaaaatatttttatgcactgttatttttagaaaatacttttaaaattaaagcgttgaaataaaaaaaaatcttcgagccaaaggccggcgtacagcgtacttgcgtacatagagccgagcgctctgcgggtgcggctcgccgttcgccatccgagccaacgacgaacccgatgccgccccaccgtgccggaggggccgcaggcggcggcgacacgagcgcgttcttcgcggcgacgctagtactttgggctgtgtctgtggggttcgagatcggcgtgcgggggagacgcgagctggcgcccgtggccgccggcttcgccttcttccaggccgccaacaccgcagtccgcggctcggtctcccgcgatccgctcttcgtcaacaccgccgtatcgcttctccactcctccctcacctccgtctccgttatctttgttcttgctaatcaatggcgtaataagggccttgagaacatgtttgagcatgaagaactatttggtggcagttggattggagcatattctgctctgtgcttttcttgtggctactttgcatatgaccaactggacatgctccgataccggctatacagtggatggcttcctggaattctcatgcatcacttgatcctactcatttgctttacactagctctgtataggaatgtcacaatcaactacctaaatctctcccttgtatgtgagctgcactccatatttttacatgtaaggaaagtcaggcgaatggttggatttcgggattttgacagaacagtggtgaagctggaatgggtactcaactggactacctttgtaacagcaagggtgatatgccatatcttgattacttacaagctcatctctgatgcccacaaatttgggaagggcattgagcttccgctagctctacttggtatggcaggaatgaatctgcttaacatatttcttgggctcgatctacttaaagcattcacacgagaaagaaataagcagaaccatcaggattgaatgcacctttcttgatggcggtgtactctaaattttgagaaggctgtagttccgttcttgtagggacatagaggtatgtttaagtcttaattaatcagcaactacactggaggctatggattctttatgtatcaacacgtgctaatgctaagatctctacaagaaagggttgttaccagtatgtgtaatcatgtaggtataacattattgttcattaggagaattaagagagtgcaggcgggtaactggatgcaggatttacatacattttgcaatcaggaatcggaaagaagagaagcgtaccatgtatcaaaccccttggtcccaactcccatacctcatctaaagtaacacctaagcaacttgtagattggcactgtgactttgaggctacaatgctcttgtttattaatatttataatatttgacgaaaaaaaaaaaaaaaa

SEQ ID NO: 15833 - DNA, 5335 bp, Zea mays
ctaaaattagggttttattgttgagcagaacattttgttgttggtgccctagattatggtctggttccgcgttcatcccaacaaataccaaacaaaccctttgattctcgcatcaagatttaaggaatcctattttgcagtactaacataaattgagggggcgcccttgggttgcttgtgttccgacaaagtagcatatgaggcatttattaacatacccccccacgttacatttcctcgcctgtccagacgttgagccagccaacaaatagtaacaataaacaatagtaatccttacatcacaccagtgacttacacgggcagccgattccatcggctgcaaaatttatcatgcatgatatggtatcgcttcgaatgtctttttgcagtgcaacagcacactctattttcttctatgcaacaaaatgaaccaaaaacatacacaaccagcaccatgccacaatcaccaaaacaaaccagaatagacagacatggagcgaaaatatgtttcacatgtgtctgatgccaaggatgctctgagctgtgtaccagcgtggagcaggctcagtgaagtcagcaccaccactctctagcctgacgaggcatggccacttgttgcagagggcttcgcaacgtagatctgcttcatcctaccagtgcctgaactcctgtcggaaccagaaccttgattcctaccctggtaccctgatcgtcgctgccactcgttaccagtaccagccttctgagtcgcacgggcacggcgatcctgattgttaaccagatgctggtattgcgggtctgatgatgatgacgaggactgatgggtcttggaaggtatgctggtgacctggggggcgttcgtgctgccagccgcccctgctgcaattccagggttgactttggatggggtcaccctaaccatggctttggcactggttgggacttcattgctgatcaagcccgcctggccaaacgaaggctgaacagtttgggagcttgagctggttgaggctggctgttcgacaagacctaactcatccctgtactgagagacggctgcatttgggaaggttttgttgccgtctgatggcccagcagaagcagaggactcctgaaatcggttatttgtaccagacttgtctattggcacgttatgaacaaactgttgtgtggctgtaccctctactggatgctgcttaagtgcaactgataatggaactgagtgtagaggaggtacaggcatatgtggccagcacgtttgcatctgtatgtctgtagatgtctggaaaggagcaatgtcgaacatggtcaatggagacgggattggcatgatagaagttgggcgtagatgtggaactggagcaggaacactaggagcgtttacttgaccagacaccatattttggctgtttggatcactctggcttacaccaacaataggtggcccttgactttgcttccagtcaggctgcttgtcaccagggatataagtggctcccataaaaccaagtcccatctgaccaaattgacctactggggcgaagtggttatagaccaccatatgtgggggggcttgcacgcctgggattcctcccggagtgatgaaaggaccagcgtacccagttggagggcggtagaaagagtctaccccagaatgacactgtggccaagctcccaatggtgctgaaggcaatgcattgcttctttgagggtgctgaccttgagaaccagcagattcgtcacttgggccaaatgcaaaaatgtgccctcctaacatcgagttcatatcaaagcaggaaaagtgggatggctgtgcaccatgaaactgagaaagcattggccctgatgcttgtggactggctataggaggccacaaggacatggatggagtatcaaccgataagtctgcaggaagagcaactgcgagtggctcttctgtggatgattgaccagcttgacctgttcttgcccctcctgatgttaacccactgagatccttgcttgtaaagctcttgtctggagccgatgcagtagttgcatcagctggagatccctcatcagtgctaatagctgccacagccacagcagaagcagctgcttcagcctctgcttccgcatcctcggtactcggacataattccttggaatttgccttatcaggaccactgttatcgctaggcaagcctcgatcgatcttcatatcaggcctagatgaacctggagctccaagaccacttgaaacagttcggctgactgggggtagcatggttggtgacgttactgccccaaattgaatcttctctccagccagaagggagttaataggactagcagatgaaggcaacaccttttctgtgattactgtgggagacaaagcattgttggactccaacgaaaagccaggcccagcctgctgttcaaatttagctggtcccatagcttcttcaagttgagtttgagttaatggcatgacctgttggtttatttgtgaattatccccaggaaacccatgttaaatggagtactaatagatggccctttattgtcgccatcagataagccactcacaagctttgcaggactcgaggtgaccaagtcagaggatgcctggatctggataggctgattggcaaagcagtttgtatgagtttctgcattggttgagggtggccctatgaggttcatggaggctgtatcacccatcaatggaattgaagattcagcatagtcaacaattcttccttctactgtgatggcggaaccagaagaaactttctttgtaacttctccactagaaggagctgctcgcttattcacactaggaccaactgagctttgtagggaaatactatgctgtttgcggggagcctttgccatccttattttggatctgttttctttctccctctgctctctcctgacactcatgatctgccttttggatcttacttcaatgaagccatctgcatcaacagggacctcaatgccttgctgcttcacaacacggacagctccagcttgcaatgaggtagtatctccatcaggaacagcacccgttctagacttcttgttcccaccatgagatctctcataagggacattgtgtgtacctcggccccggccacgctgatcacttgctccatttatcctagatgccttgctcatatcaagttcccttctattagtatttctcgctggaatatctcttgttccattggagcttgttatctcatcttgttcaccatggcaaaatgattcagaagtttcattttgattcttctcgatgttttcccgaactctaaactcagttcgtcttacattcctacgagcccttctctggaatcctcctttggaatccttatgagaaggctcaacaattgagccagtagatctcatgttaatgtctttaacagcatatccatatctcctcccccttctatcagagacaacaccaagagcctttggatcacccatggctctcccctccaaaccatattgagaagattctacattgttggacgtaggtctgtaattcctcttcaaagagagaccttgattcctcccacttggagttgtaccctcagcaaactctctgtccacttgactactaaatccgtccacaccagccatctgattgtttgcaggagcattgagatactgggaatttgaattgtccatgccaaggggaaccttggttgtaggtgctgctgatttgttgataaaggtggatgagcttgcctgagctgggatgttctggtttgtacctccatccattagctcaggtagaacactggacacattctgattcaatgtatgttgagctgatatggaagaatgtgcagggcgggtggcctgagaaggcagcgatcgaacactcggagcgataggacgtacatacctcaactggccaaattgatacaaaggggttgttgaagggtgcatatgaggcagggatgggttaaactgattgtggagatggattggcatctgtatggaaccaatttgaatggctggaaccggagttggtattagaggaggacctgtaaacaaaccaaactggaggctgacaggtacttcattctgcccaactactgttgaagctgacgaaaaaataggacccacagaagatgcctgaggtaactgggaacttgaagcaggtgtccttgagctattggatggctccccattactgtcttctgtcaggccatttacaccatcaagagtcaatgcctgcagtgctttctctgcttcagtaacaggatcagaatggacaactgaaccactgacattctcttgctctgcaactcctgagtttagatgtactccaactgtcctttccgtgctcctcacagaagctaattcaagttgactattcggtggaatttcaacctgcacgccctcatcaaacccaagtataactggttccagttctacgggtgtatcctgcccctctaagaactcatcatccaagtctatgttctcctcgtccccttctttcatttcatcttcctggtagctatcattgtcttcatcatattcatcctgttttcgcctatcatcattgtttacacttgaccattcatcctcctccaagtggggcactcctgaggcagcaattctgcttgtattgtctgcatctacagtcagagctgcatgatggttgtcagagagcgccgtatgttcaccatcagcagaagtcggtaacacaggagaatcaccagatacgtccatctcatcatgtgaaacatgtggaggtgagctaggagggcttgaaacagaaagagaagattgtgaacccaatacagggctttttctgtccacaatttgttgctcattgacagaaatgtggtcagatcgtatcccatgctggcgagatgtctcttggtatacacttccgtactgaccctgcataatctgcacatcatctctaccagaacactctctgttcccaccatccacaaaagatgaattgaaacgttgtgctgaagcaccaattgaacttctgtgcacagaggtcacaattgggggtgggggaacacgtggttgcctcatagagtagcgtggtctggtaaaagaagacaattcattaacatcaggactctgaaacatcctatctccttgttgagcattgaggcttccatgagaactactaggcagccaagctgtatctccaaacctgtcgctgttaaaaaactcattatcaaattcagattgtttgctgaaacggtcaatctccctaggcgcatcccatcgtggaaccttttcatgatggaaatcttcaagtgcccatgaagaatcagttgttcggcctgttgaagattgcctaaccgaaaca

SEQ ID NO: 15834 - DNA, 1712 bp, Zea mays
ctacctcagaagaagcagatacagcatatgttcttgtaggttgaatagaagagaagagtggaaccaccaagctgtaccaatggggcgtggaaaagtagagctgaagaagattgagaatccaacaaaccgccaagttaccttctccaagaggcggatggggttgttcaagaaggcaaacgagctagccattctttgtgatgcgcaaatcggagtcatcatattctctggcagtggcaggatgtacgagtactccagccctccatggaggtgcgtgaagcattctttttttattttttttatttctgaagcttgtttagtacagtaacatatatggttcagctttattctgctataaggttttagactttagtaatgagttcaaaaattcatgagaccttcagaactgatttgcaattattcctgccaactacaatcttatagcttggcatgcatcatggaaccttttaacttaccatatacagtttgaagccttcagtaaaaaaaaaacaagaagagatgatgattaggtgtgggtctaagacgggtatcatatattcatgttgccagcagttaatagtttcaatagtgattatttatgaattatgactgagcacccatcaggccatcaggggttttacgacgtttttataccgtgctatatatcactgctgcttctggttgcagaatagcaagcgtctttgacaggtacctgaaagcccctagcacccgtttcgaggagatggacatccagcagaaaatcgtccaggagatgactaggatgaaggatgagaggaataggctgaggatgatcatggcgcagtacatggcggaggacctggcctcgttctccgcgcaggatctgagcaaccttgagcagcagatcgagttctcgctgtacaaagttcgcctcaggaagcaagagctactcgaccagcagctgctcgagatccgccaaagggagatgcacatgccagcagagcagagcggctacctgtgcctcatgaacccggctgcggctattgctagcgggcagcaccagcaggctggcgagatggtgggaattaacccgaggccgttcccgtggtgggacgtgggagccagtggcagtggcagtggcagccagagccagcagctgctgctgcacggccgggacgccgcggagtcgtcgatgacggcgctggggctgtcgccgcagatacacgggtacaggctccagccgcggcagcccaacctgcagcaggacgccgacatccatggctggctgtgatttgctttggtcgtgggtgtgcgtcctcaacgagacgagacgacgctgaacgtgcagctcctctgcttgcgacctgttcattctagagtctttgatcatgacctgcccccgtaatgaaaccgccagtagtcgtcaatatctccttctctaacctaagattggacctaagagggacataatgtgatcgcaaatccatataatagagtctatccgtcgcctcagccaacgtgccctgctgaaaataaactttactggagctggcttgttagtgctgggagctgggttgtcatcgcgttgcgcgtcgtttgtgttgaggttgtaaagtagaaactgtgcgagaatgaaatgagaacctctgtttctttattgaataaagcaatgtatttatacaaaaaaaaaaaaaaaaaaaggaaaaaaaaaaaaaggggtcaaaagccacgtccgt

SEQ ID NO: 15835 - DNA, 4051 bp, Zea mays
  misc_feature (3756)..(3756): n is a, c, g, or t
  misc_feature (3763)..(3763): n is a, c, g, or t
gaccgataccgggaacaggaatttttagtggttaccggtaaaattaatcgatcgatatatctttcctggtgtacgggatctatcctaagagtaaaataggccatttgaactgaattgcgtttctgtggatctagaactgttgtgttagtcaaacggttccacggtgaatcttaggtcaaccaccagtgaaattgctctttgataaatcacaaatccagattcgttttttttctaagataaagctgtgccaatcatgctccaatattaatttgaagtaagtaattttaaaaagggttagcgagcatgccgagagatacgcgagcagaagtgttgccctgttgatgcagcggcgaggggccaggaggacgtacggataagcaagcagccaaaccgagctacggcagtgtgcagtgcagtacgagagcgtgcgtgtccggtattcgctagcccggagacagacaggggcagaaagggagaggttgagctggagcgaggattcagttaatccccccttctcctctcgctcagtcgcacggcccccctgccccagtgtggtagatttttggggagagactaaaggctcatcgccaatctataaataggctgccacctccctggcctttccttccaccccaacaccccatctcatctcttgctcctcgtccgtagttgcagttgcagtgtcctcggccgcctctagtcctagccgtttactccttcctttcaccgcatcaagcagagagcaagcgaggcaagagccatgggcgcctttctgctcttcgtctgtctcctggcgccggtcgtcgtgctcgcctgcgccgtccgcggcaggaagcggcgggcgtcctccgcggcggcgggcggcaaggcgctgccgctgccgcccgggtcgatggggtggccgtacgtgggcgagacgttccagctctactcgtccaagaaccccaacgtgttcttcgcccggaagcagaaccggtacgggccaatcttcaagacgcacatcctgggctgcccctgcgtgatggtgtccagcccggaggcggcgcgcttcgtgctcgtcacgcaggcccacctcttcaagcccaccttcccggcgagcaaggagcgcatgctggggccgcaggccatcttcttccagcagggcgactaccacgcccacctccgccgcctcgtctcccgggctttctcccccgaggccatccgcggctccgtgccggccatcgaggccatcgcgctgcgctcgctcgagtcctgggacggccgcctcgtcaacaccttccaagagatgaagctggtgggttggcttggcttggctatgcggctatactctgttatgctctgttctttcctccatcctcagttgctcatcctgttcatcttccgcgccgcgccgcctgcagtacgcgctgaatgtggcattgctgtccatcttcggcgaggaagagatgcggtacatagaggagctgaagcagtgctacctgaccctggagaaggggtacaactcgatgcccgtgaacctgccgggcaccctgttccacaaggccatgaaggcccgcaagcgcctgggcgccgtcgtggcccacatcatcgaggcccggcgcgagggcgagcggcagcgcgggagcgacctcctggcctccttcctggacgaccgcgaggcgctcaccgacgcccagatcgccgacaacgtgatcggcgtcatcttcgccgcccgcgacaccaccgccagcgtgctcacctggatggtcaagttcctcggcgaccaccccgccgtcctcaaggccgtcatcgtaagttcttctctccctgccggctcatgcctggcaccagatcgactgcgtgcgcccgccgcgcggagactgacgggacgagctggtgttgtaggaggagcagcaggagatcgcgcggtccaaaggctcctccggcgagcccctgacgtgggcggacaccaggcggatgcgcacgacgagccgtgtgatccaggagacgatgcgggtggcgtccatcctgtccttcaccttccgggaggccgtggaggacgtggagtaccaaggtgaggcgtcaatcatactcatgcggtcatgcccctcgctgtcaaaaaaaaaaaaaaaaactcccgccaccgtttcacgttggattggaggcgggggcagtctgtccctgtcgtgcgctgctgcggatgaactggacggacgggacgcgttcctaaccgaaatgaatagacagactgactcatccgctgtgtgcggctgcaggcatgcaggcccccaagggctggaaggtgatgcccctgttccggaacatccaccacagccccgaccacttcccctgcccggagaagttcgacccctcccgattcgaggtcagactctctctgcctctgcttctgcttcgccatttgtgccatgtcgagacaggtcctcatggccggcctcccgtttcgaggttgctcccaagcccaacacgttcctgccgttcggcaacgggacccactcgtgcccgggcaacgagctcgccaagctggagatgctcgtgctcttccaccacctcgccaccaagtacaggtggtccacctccaagtccgagagcggcgtgcagttcggccccttcgcgctgccgctcaacggcctgcccatgaccttcgtccgcaaggactgatgagccgccgacagatgtgtggatcgtggacggagccacaccaaaaccacggcaggccgacggaaccaaaccaaagccaacaacaaacaggcggatggatatggtatggcggtatatgctagctagtactactataggagccgcgaaaaccgcttccgggatttggcgttgcggcggtcgccatcggacgggacggggacaggcatcaggcaagcatgggatgatcagaggaaaggaaaaaaaaagataacggtgtacagattcttcttcagctagtaggaccggatcccaagaagccggaagaggagaccaaacacaaaattaggcctagccacgttggtgtcactcggtgtaagctactccagtaggcatcagatggcccagcgccacaaagaagtggcgcttagttgtaaaaccaaacccccccttttttctccatcgtcttctttttcttccccccttttcagattttttataagctataagctagccagacaacacctgtaggagaagaataagggaaaccataaaagaaagagagggaggccctgattgggattgtaagctagctaggttgtccgcctgaaagcaggctggcagctaggcacaataatccatggacggatggatggattggatgggtcgccggagtcaaaaggaggccacgtcgtcttccccgcaggcgcagccaaggactacggcccgggacggcgaccccgccttgtatttgtttcgtgatttcgtccaatgcaaaaaagacagtgactgctttcacagcaccaactgcccgtattactaatttaattctctaaagtgcgtctgcgtctgtgttgcgttgcatatttgcattgctcgcctactcatctccgacgactaaggctgtccgtccttgggttctcccgctaatttgaccaaccaatgtttagctaacgctgtttggatcatctggcaaacctgtttattaatcttattgactttcccccctattcctccactttgcgtcgagagtgaggacgaggacagcataacatatataggcccagcacgatttcatttgatttttttaataaaaatgtgtatattatatttgattataanatacganagataaaacttgcttattttgttggttaagtggatatgaacgtgtatttagagttagcaaccatggttcctcaatctttacttaagcacatttttttagtttatttgtagctcatctatgatgaaaacgggtatatgaatggttaagaaaattttaatattttaaaatagatatgtataaaatttaatgaaaatcttttccttatgttcaaatagataataataaaatcttgcatatttctatacgttttttactccctacaacataaaatatgaaaaaagtatatgt

SEQ ID NO: 15836 - DNA, 3250 bp, Zea mays
  misc_feature (3137)..(3137): n is a, c, g, or t
agctgccacctccctcgcttttccctccaccccagtccccacctcttctcttcctcctcgtccgccgttgctgtctgtctgcctcctcctccgccgcctagctgcttacctgcttccaccgcaacaagcagagtgcgagcaaagacagaaaaccatgggcgccctgttgctcttcgccgtctgcctgctggcgccgatcgtgctggcctgcgccgtccgtggcaggaagcggcgggccgccgcgccggcgccggcgccggcgtgcggcaagaaggcgctgccgctaccgccggggtcgatggggtggccgtacgtgggcgagacgctgcagctctactcgtccaagaaccccaacgtgttcttcgcccggaagcagaaccggtacgggccgatcttcaggacccacatcctgggctgcccctgcgtgatggtgtccagccccgaggcggcgcgcttcgtgctcgtcacgcaggctcacctcttcaagcccaccttcccggcgagcaaggagcgcatgctgggcccgcaggccatcttcttccagcagggcgactaccacgcccgcctccgccgcctcgtctcccgggctttctccccccaggccatccgcgcctccgtgccggctgtcgaggccgtcgcgctgcgctcgctccgctcctgggacggccgcctcgtcaacaccttccaagagatgaagctggtgggttggatgggagctgctgctgctgttgttgttcttcttcttcttcctcctacatcatatgctctgttccgctctgtccgtcgttgtatcctcctgaccgtcgtgtgctgaatgctgattacacaagtgacccgctgcctgcagtacgcgctgaatgtggcattgctgtccatcttcggcgaggaggagatgcggtacatcgaggagctgaagcagtgctacctgacgctggagaaggggtacaactcgatgccggtgaacctgccgggcaccctgttccacaaggccatgaaggcccgcaagcggctgagcgccatcgtggcccacatcatcgaggcccggcgcgagcggccgcggccgcgcgggagcgacctcctggcctccttcctggacggccgcgaggcgctcaccgacgcccagatctccgacaacgtgatcggcgtcatgttcgccgcccgcgacaccaccgccagcgtgctcacctggatggtcaagttcctcggcgaccacccggcggtcctcaaggcggtcatcgtgagttgtccctcccggtcccgggtcttgtttattgggtggcatcaaactgcgggcgcccgccgcgcggagacagactgactgacgggatgagctggtgtgtgtgtgtgttgcgaacaggaggagcagcaggagatcgctcggtccaagggctcctccggcgacgaacccctgacgtgggcggacaccaggcggatgcgcgtgacgagccgtgcgatccaggagacgatgcgggtggcgtccatcctgtccttcaccttccgggaggccgtggaggacgtggagtaccaaggtgagacgtcgcgtcacggcccctcgctgtccgcccgcgcccccgcgccaccgtttcacgttggattggagctccctgcccctgtccctgtcgtgcgctgcggatgaactggacggggggacggcttcctaatcctaaccgaaatgaatagactaactcatcgctgtgccttgcctgtgctggctggctgcagggtacctgatccccaagggctggaaggtgttgcccctgttccggaacatccaccacagccccgaccacttcccctgcccggacaagttcgacccctcccgattcgaggtcagtctctctctgcccctgcttcgccacgttctcatgtggaaaggggggaactgactgactgactgactgatcgaatgggctgccggcctcgcctctgaacctctctgatgcaggttgctcccaagcccaacacgttcatgccgttcggcaacgggacccactcgtgcccggggaacgagctcgccaagctggagatgctcgtgctcttccaccacctcgtcaccaaatacaggtggtccacctccaagtccgagagcggcgtgcagttcggccccttcgcgctgccgctcaacggcctgcccatgaccttcgctcgcaaggactgatcgaggagccactgcacggccatggatggtggtatatgctagcactacactactagtaatacccaggaacgcgaaaaaccgcttcccggcagcgttgcggcggcggccatcggacgggacagggaaggtgacggtgacgggcatcaggcgagcgggcatgggccatgggatcgatgatcagagaaagaaagattacgcagctccttgtacagattcttcctcagctagtagggccggatcccaagaagccggaagaggagaccaaacacaaaattaggcatagccgcttaggtgctactcactctaagctactagtactccagtaggcaagcatcagatcacccagctgcgctacaaacaagtggcgtttaattgtaaaaccaaaccattttttttctctatcttcttcttcttctttttccctcccctttagattttttttataagccagccagatagtggcacccataggagagaagaacacaaggaaaccataaaagaaagagagggaggccctgattgggattctaattgtaagctagctaggttgcccacctgaaagcaggctggcagctaggtcgagtaacccacggatggatggattggaatggaatggatgtatcgccggagtcaaacgggaaccacgtcgtcgtcttcccgcagctcttgcgtttgtttcgtccaacgcaaaagacagcgactcctttcgtaacagctatacgtactgtgctgtgccccgtgctaattttaaattctctaagttattgttcggttatttccattatatataggttagatatgattagaaaaattttacaaaaactttaactttttaggatttaaacccacctaacccatatgaattaagagctaaccgaacaagccgtgagtctgcactgcgttggttttactccatctccggtcattaagttgctgattaagcaatatctgtccacgatcgcttcgaaggaacaaagcntgcaatgcactgctgcccctgcagctctgaaccaggaagaaataaataagctgcttgactttggggggtgtcgacaagtacggatttccctgggtcgaactgaagacgccatg

SEQ ID NO: 15837 - DNA, 2011 bp, Zea mays
attgggacctcgagccggccgggatatgcttccattaaaaatgtccaacttacctttttccccaaaaaaaaaaaaaaaaaaaaaaaaaaaacccagcgcccgccggaccccccaacaccccatctcatctcttgctcctcgtccgtagttgcagttgcagtgtcctcggccgcctctagtcctagccgtttactccttcctttcaccgcatcaagcagagagcaagcgaggcaagagccatgggcgcctttctgctcttcgtctgtctcctggcgccggtcgtcgtgctcgcctgcgccgtccgcggcaggaagcggcgggcgtcctccgcggcggcgggcggcaaggcgctgccgctgccgcccgggtcgatggggtggccgtacgtgggcgagacgttccagctctactcgtccaagaaccccaacgtgttcttcgcccggaagcagaaccggtacgggccaatcttcaagacgcacatcctgggctgcccctgcgtgatggtgtccagcccggaggcggcgcgcttcgtgctcgtcacgcaggcccacctcttcaagcccaccttcccggcgagcaaggagcgcatgctggggccgcaggccatcttcttccagcagggcgactaccacgcccacctccgccgcctcgtctcccgggctttctcccccgaggccatccgcggctccgtgccggccatcgaggccatcgcgctgcgctcgctcgagtcctgggacggccgcctcgtcaacaccttccaagagatgaagctgtacgcgctgaatgtggcattgctgtccatcttcggcgaggaagagatgcggtacatagaggagctgaagcagtgctacctgaccctggagaaggggtacaactcgatgcccgtgaacctgccgggcaccctgttccacaaggccatgaaggcccgcaagcgcctgggcgccgtcgtggcccacatcatcgaggcccggcgcgagggcgagcggcagcgcgggagcgacctcctggcctccttcctggacgaccgcgaggcgctcaccgacgcccagatcgccgacaacgtgatcggcgtcatcttcgccgcccgcgacaccaccgccagcgtgctcacctggatggtcaagttcctcggcgaccaccccgccgtcctcaaggccgtcatcgaggagcagcaggagatcgcgcggtccaaaggctcctccggcgagcccctgacgtgggcggacaccaggcggatgcgcacgacgagccgtgtgatccaggagacgatgcgggtggcgtccatcctgtccttcaccttccgggaggccgtggaggacgtggagtaccaagggtacctgatccccaagggctggaaggtgatgcccctgttccggaacatccaccacagccccgaccacttcccctgcccggagaagttcgacccctcccgattcgaggttgctcccaagcccaacacgttcctgccgttcggcaacgggacccactcgtgcccgggcaacgagctcgccaagctggagatgctcgtgctcttccaccacctcgccaccaagtacaggtggtccacctccaagtccgagagcggcgtgcagttcggccccttcgcgctgccgctcaacggcctgcccatgaccttcgtccgcaaggactgatgagccgccgacagatgtgtggatcgtggacggagccacaccaaaaccacggcaggccgacggaaccaaaccaaagccaacaacaaacaggcggatggatatggtatggcggtatatgctagctagtactactataggagccgcgaaaaccgcttccgggatttggcgttgcggcggtcgccatcggacgggacggggacaggcatcaggcaagcatgggatgatcagaggaaaaaaaaaaaaaaaaaaacggtgtacagattcttcttcagctagtaggaccggatcccaaaagccgggagaggagaccaaacacaaaattaggcctagcccgttggtgtcactcggtgtaagctact

SEQ ID NO: 15838 - DNA, 2728 bp, Zea mays
tgcaggcggcccggaaggggcacggtggagagtggagaactggagacgcagcggagcccctcgccttttcatcttctcctgctcctgctgcccggtagccccccgagggagacgctgctgacctgacgaactgagcccacggacgagaaggaggggcacaccacgcaggagacctggaggagagcgcgcgcgcggatccacctcgtatacactctcctcttcttctccgtgtccttgcctcagatttagttgctgcgccgcttcttaggattgattgctgcttcacccggtgatcgcgtcgtcatcttcgcgtttgcttaatcgcctggttgctgcatccgttttttttttggtgttgtgtggttgggggtgccggcacagggtttcctcctgtttagcctggattggtgtaggatttcgatgtgatcgatgccggccgaaaacaaaatttcaggtttcgttcggttcactgcgcgtcttgctgtcctctctgcttggaatcacaaattttagtcttccctgctctgattggtaccagctttctgctgctgtgcaggatgttggcaagaccaccagcaccgcctttggtgactgctcaaactcctgaagtcggcatcttcattacagctgtaagtaagatccccaatctagcttgctgatattggcgagaaactaccagcaatgacccttgcttgcatcgcacttcctccctctccagcgcaacgtctcgggtgcactggtcgccaagcttcctggtaacaaaaacaagtgtggaggaagatcgaatgtccggcagcggaacatccaacctgggaaaaggggctgtcgtcgggagtggcgggcgctctcagcagctgaccaagcgcaggcttctaccttggacgtagatgaggagtgcaaacgggtgctcactccattgggtttctccagcgaagacgccgagaagatgctgaagaaagcgtttggctggacccactcgccgtactggagcgaggagagggagaaggaggttccgaccgccgaggcggtagctggagtgctggactacatcaggagcctggggctgtcggacgaagaccttggcaggctgctgaagaagttccccgaggttcttgggtgcgacctcgacggcgaggtgaggccgaatgtgggcaagctggacagtgactggggaataaacgggaagaccctgcggagccttctgctgaggaaccccaaggttctgggctacaatgttgactgcagaggggattgcatggcccagtgcacccgctgttgggttaggttctgatgatgatggttttgttcttcgtcgccacatcgttgctcaggaacttgggacttggttttgcttgctggccatttttctgtaagctagcacctgtcgaatgtagcacaatcgctagctgctggatattgggttggccactgttagttcttatgtacgtacaacagattcaagagctaaaccatgctgctgttgtctgtaaaagagttgcaataaatacggccagaattcctggttggcctgtggtaccgcagtgacttgctattgttcttctgctctggatttccacattgtcttgttgtgatgtgagatcctgtccttgtgctttgatgcatcccccactgtgctgtcatgtttttgtttgtatgaattacagctgaagtagttcaaagcgatcaaatccatcaaagtacatgtgagcatgtgatccggatcttatctacttgttatacaggctaatgccaattgagtgaggacaaatcattctttgtgttttttttggtttcttattctgagttcagaaatcgattggtggtgccccgaagagatcaaatccatcaaagtcacaggaattaggcctgggcaatcggttaaccgttttttttcggttcggtttttcggtttttttgtaacttcggtttctggaaaacggtaaccgaaatcttctgcggaaaataaaaaaccggaccttcagttaaccgattttttcggttcggttttcggtttaaccgaaaaaaccgaatacgaataaaactacagtcagcacagcacaaatacaatataaatgttttgatttagagcacaacacagcacgaataaaaatgcagacgcaactgaggcttgccaaacgtcgtcgatctgtacagaagcaaataaaatggcaatcgaactgaactgtccgcactgcagctggtttggttccagtgcgtgagggagaacgccggcagcggctgaagccgcctgtcttcagctccaaaaccgagctgcattagcatccattctcattatgagttcccagaaaacgattaaagcaaacaactgcatcaacagggacgcactaacctcctcgagctaccggcagacaaaccgctcgctaaaaaacgtcgcttctttcgtcggacgggattattcctataaatctatttcgtagtggattctgtacgcagccactcccattacgccgaacaggtccgcggcgtgttattccctgacgaccacctaccctactactactaccacccctatggaaagttcttggcctttgtgaatccatgcatgcgtgcgtggaatcacaagcagccgcattgtttatctccacttgattttttttaataaacacttgtttcgaaccagtcatgcctcgaagccccgttcttggttcaaacggacagagattttgctagtggctactgctagtagaaatatagataggaaatgtca

SEQ ID NO: 15839 - DNA, 1137 bp, Zea mays
agttggctcttgcgggagggatgagatgggaatgggatggcgacgggcgggcgtgtgcggctgcaagcggctcggaaggggcacggtggagacgcagcggaccctcgcctcttctcctgctcctgctgctgacctgacgagctgagcccacggacgagaggggagacgaggaggggcacaccacgcaggagaccggaggagagcgcgcgcgcggatccacctcgatgttggcaagaccatcagcaccgcctttggtgactgctcaaactcctgaagtcggcatcttcattacagctcgcaacgtctcgggtgcactggtcgccaagcttcctggtaacaaaaacaagtgtggaggaagatcgaatgtccggcagcggaacatccaacctgggaaaaggggctgtcgtcgggagtggcgggcgctctcagcagctgaccaagcgcaggcttctaccttggacgtagatgaggagtgcaaacgggtgctcactccattgggtttctccagcgaagacgccgagaagatgctgaagaaagcgtttggctggacccactcgccgtactggagcgaggagagggagaaggaggttccgaccgccgaggcggtagctggagtgctggactacatcaggagcctggggctgtcggacgaagaccttggcaggctgctgaagaagttccccgaggttcttgggtgcgacctcgacggcgaggtgaggccgaatgtgggcaagctggacagtgactggggaataaacgggaagaccctgcggagccttctgctgaggaaccccaaggttctgggctacaatgttgactgcagaggggattgcatggcccagtgcacccgctgttgggttaggttctgatgatgattggttttgttcttcgtcgccacatcgttggtcaggaacttgggacttggttttgcttgctggccatttttctgtaagctagcacctgtcgaatgtagcacaatcgctagctgctggatattgggttggccactgttagttcttatgtacgtacaacagattcaagagctaaaccatgctgctgttgtctgtaaaagagttgcaataaatatggccagaattcccaaaaaaaaaaaaaaaaaaaaaaaaaaaaaaattgttc

SEQ ID NO: 15840 - DNA, 2123 bp, Zea mays
gtaaataaatgcacccaggaacaaaagtcggcaccaaacaggcaaacaccgcatctcgaaaccatggtgccgcgcggactcgtcggtccgcaaaataccgtagacgcccggcccggccgcccgcacctgcccccgctcagcgtggcggctggcgtccccatcccactcgtcgcccatctgccgtgacgtctctcctctctccagcggttcccatctactacttaactcgcaggccgcggccccctagacccctctcacttcgcgggtacgcagagtcgctagacgcacctcgctcgcaacttgttggactcgaaggggcaatagacagcaggcagggccccgaactgcgggaggagattcccaaggatctcgtcggccgggtagaggaagggacggggacgggcgatggcggcggacggcggcggcggggtggactgggagagcctggcggaggccacctccggggcaatcggctcgctcgtcagcaccaccgtgctctacccgctcgacacctgcaagaccaagttccaggccgagctccagacgcaccagggcgctcagaagtataggaacctttcagatgtcttttgggaagcgattcgtaaaaagcaatttttgtccctatatcagggcctgaacacgaagaacattcagtcttttgtctcctcgtttttttatttttatgggtatagctattttaaaagactctacttggagaagagtggagcaaagtctatggaacaacaggcctgctgctgattccatcccttccctatggctcttctctggtcgcctgatccgtacgacggggctcgtgtgcctgactcgtcggaagctggtgcccctctctctctctctctctctctctctctctctctctctctctctctctcgtcggtccgtgaggatttggatctgactctgcggaggatgatagaggtttcctgtttttttctctctctcaaaatcgtgatttgcaatttggccttttgtatctagagaggtttcctgaactgtgcagtgggcgatgagagtgcttgggacggcttggagagtctcacttcagtcagtcaggacgataatgcctttgtttttgaaagtttggagtatttgcagtaatcaggtcttgattgaggggtgcaaatcacgattacacaatatataggcacgttcatccggtttatggaaatagaaccggagaggggttatccgacgccaattaagtaaaccacaagtaattaaaccgcaactaagacacccaacccttgtataatctttctaggcaatctaacacccctccgcatctggaacacgtcggtggagcggatgttcacgttgaaccgaaactccaagaagactaaggaatgaaggcccttcgtgacgatatcagtggattaggaggtcgttgggacatatataacacgaacaacaccggcagcaatgcgtgaaggtcgatctcgacgtgtttggcgcgctgatgttgcaccgggttcgtctctagatagatgacacttaggttgtcacaatagacaaatgtcaaatgtggcacgttggagaggctatttaagctcaaggagttggcggagacaggagacctctactatgctattggcgattgcgtggtattcggtctcagcattggagcgtgacagaatatataggcactgtaccatgagacaacactgaggtaatcacgcctccattgatacaaaccacgattacacaatatataggcacactcatccagtttatggaaacagaactggagacggattctcaagcgcaagtaaggaaaccacaagtaaggtaaccatctaggcaatctaacaattttgacactagttggccccaaattctccatgatcgctattgaatcgaactgtctgcccatgaggtcacatttatgtgtgcttatccagccttcctgtgtcaagtcgttgtaaaacagaaagagggtaaatgttttgcttataacctttagaactagcgtagactgaattgtttacgtgagatggacacatgaatgggtgccttactctattaggctgcgataaatttgtttctcctgggatctggggattgacaatatggtcagcaattatcataaccaggctagctgggaa

SEQ ID NO: 15841 - DNA, 1571 bp, Zea mays
gggtacctcgaggccggccgggttcctctcacttcgcgggcacgcagagtcgctagacgcacctcgctcgcaacttgttggactcgaaggggcaatagacagcaggcagggccccgaactgcgggaggagattcccaaggatctcgtcggccgggtagaggaagggacggggacgggcgatggcggcggacggcggcggcggggtggactgggagagcctggcggaggccacctccggggcaatcggctcgctcgtcagcaccaccgtgctctacccgctcgacacctgcaagaccaagttccaggccgagctccagacgcaccagggcgctcagaagtataggaacctttcagatgtcttttgggaagcgattcgtaaaaagcaatttttgtccctatatcagggcctgaacacgaagaacattcagtcttttgtctcctcgtttttttatttttatgggtatagctattttaaaagactctacttggagaagagtggagcaaagtctattggaacaacagccaacttgttagttgctgctgctgctggtgcttgtactgttatcgtgacacagccattagatacagcagcttctaggatgcagacaagtgtctttggaaagtctaaagggctgagagaaactcttgcagaaggtacttggatggaagcattcgatggcttaggcatttccattatattgacttgcaatccttctattcagtacaccgcgtttgatcagttcaagcaaaggatacttcataggcagcggcgcaaaaatgcaggatcagcggaggataattccggagttgctctttctgctttctcagcttttctgcttggcgccgtctctaaaagtattgctacagtattgacttatccattaatcagatgcaaggtgatgattcaggctgcagaccctgatgaggatgatgacgatgaacctggaaggccaagcaaatcaagaacaccaaaaacaatgctaggtgccttgcatgctatctggagcaaggaaggcattccaggcttcttcaaaggcttgaatgctcagatccttaaaacagttctgagctccgccttgctgctgatgattaaggagaagatctcgaagttcacttgggtctcactgcttgccctgcggcggtatcttttcgtttctcagaagaggatcaagagtgcaactgtataaatacgttagctccaaaacacaaactagcacacatagcgacatggtgcttctggagatgttatgccaaggaataaatctgaggaataatcagcagaaatacttaaccaagagagagagaataaggtgtgtatctggggtcgatagcatcagagggctcttcaataagtttgtccatttcttttttttctctctctctctgaatctcttgtagctagtgacgtagatgttgcgcggatctgaaactggactgtacttttagcgtttgttgcctgtaattaggggtgataatgggctctgaattttacagtataatatttaaggttcggattaaaaaaaaaaaaaaaatctattcatttttaattaaattttatttaggactctaag

SEQ ID NO: 15842 - DNA, 1723 bp, Zea mays
acgccggcggtgtatagcaaaaaatgccccacactcccacccggcgtggcggcggccgtcccccgcgtcccgtccccactcgtcgcccatctgccgtgacgtcaccccattcttcatcggttcccttcctcgcctcggttcgcgggtacgccgagtcgcagacgcacctcaatcgcaaccttttggactcaaaggggggcaatagacagcagggaacagaactgagcgaggagattcccaaggatctcgtcggacgctagaggaagggacgggggacgggcgatggcgggggacgccggcagcggggtggactgggagagcctggcggaggccacctccggggcaatcggctcgctcgtcagcaccaccgtgctctacccgctagacatctgcaagaccaagttccaggccgagcttcagacgcaccagggcgcgcagaagaaatataggaacctttcagatgtgttctgggaagcgatttgtaaaaggcaatttttgtccctatatcagggccttaacacgaagaacatccagtcttttgtttcctcgtttttttatttttatgggtatagctattttaaaagactctacctggagaagagtggagcaaagtctattggaacaacagccaatttgttagttgcagctgctgctggtgcttgcaatgcaatcgtgacacagccattagatacagcaacttctagaatgcagacgagtgcctttggaaagtctaaagggttgagggaaactcttgcagaaggtacttggatggaagcattcgatggcttaggcatttccattatattgacttgcaatccttctattcagtacactgcatttgatcagctcaagaaaaggataattcagaggcagcgacgcaaaaatgcagcaacggcagaggataattccatagtgtctctttctgctttctcagcttttctgcttggtgccgtctcgaaaagtattgctacagtattgacttatccattaatcaggtgcaaggtgatgattcaggctgcagaccctgataaggatgatgacgatgattctgaaaggccaagcaagtcaagaacaccaaaaacaatgctaggtgccttgcatgctatctggagcaaggaaggcattccaggcttcttcaaaggcctgaatgctcagatccttaaagcagttctgagctccgccttgctgctgatgataaaggagaagatctcgaagttcacttgggtctcgctgcttgccctgcggcggtatcttttcgtttctcagaagaggatcaagagtgtaactgtataaatactagctccaaacatagcgacatcgtgcttatggagatgttatgccaaggaattaatctgaggaataatgagcagaaatactgaagcaaaagagtgtgtgtaaagtgtgtatgtgtgatcgatagcatcagatggctcttcaataagtttgttcattctttttttcccctctctgaatctctgatagctagtgacacagtgttgcacggatctgaaactggactgtacttttggctttggttgtctgtaatgtgtaaaatagcagccgtgttaatattccctttctcttaaaagaaaatgaatcgattggcagtttgatgtaagatgtgttgtcgatcgttcccttttgcattggatggtgactgtcagataagcatgaatcagtttggtatggcccccggaaagactttagcctgcaggcatgcaag

SEQ ID NO: 15843 - DNA, 899 bp, Zea mays
accatccactgcatgcctggcgcgagaggcaccagccacagcccacagttccccccatttcatttgtgtggtagccgaggactgggagggacctgctcaaccttttttttgtgtgtgtgtgaaagatcgagagcgccgctcaaccaatagagcggtttctctgccttgtgtctttcctctgtcctgtggtctgcggtggccgcagctgcggcgcgcggtgatggagttcacatctaagaagacggcttcgcttgccctcctctgcctcaagctctcctgcctcctcctccttcttcttcttccccggtcttcctctgctgcgcctctgtccagaagcctgtcgctgacgaggaaccgcctgcagcccgcggatgaccctgctccggaggttcccgctcccgcccagcagggtgcggatgcgggtgctggtgctggtgcggtgggagttcgagaccccggcggcgaggtggcggcgaggatggacatcgaggtcaacgactaccctgggtccggtgccaacaaccgccatgaaccgaggagccctgggaggccatgaggcttgaagctagcccatcgtcccctgcgtacgtctcagacaggaatcaggaatgaagaccatggcatggagctgctgctgcgctgtcttgagagttttataagtagcgaagcgaaggagagtacattgcttgttgttagctatagagaggtcaaggagagccttatcgtgtacttaattagcttgttaattattgctacgtactccttgttaagagtcttcaacggcggatcggatcggatctgcttgagctattagcttttgctatctctgatctggaacacaagcatcagttagtaacgtagcatcgtcaacagctatagtactcttgagatatttactt

SEQ ID NO: 15844 - DNA, 849 bp, Zea mays
accatccactgcatgcctggcgcgagaggcaccagccaaagcccacagttccccccatttcatttgtgtggtagcctaggactgggagggagctgctcaaccttttttttgtgtgtgtgtgaaagatcgagagcgccgctcaaccaatagagctgtttctctgccttgtgtctttcctctgtcctgtggtctgcggtggccgcagctgcggcgcgcggtgatggagttcacatctaagaagacggcttcgcttgccctcctctgcctcaagctctcctgcctcctcctccttcttcttcttccccggtcttcctctgctgcgcctctggccagaagcctgtcgctgacgaggaaccgcctgcagcccgcggatgaccctgctccggaggttcccgctcccgcccagcagggtgcgggtgctggtgctggtgcggtgggagctcgagaccccggcggcgaggtggcggtgaggatggacatcgaggtcaacgactaccctgggtccggtgccaacaaccgccatgaaccgagaagccctgggaggccatgaccatgaggtttgaaggcttgaagctagcgtacgtctcagacaggaatcaggaatgaagaccatggcatggagctgctgctgctgtcttgagagttttataagtagcgaagcgaaggagagtacattgcttgttgttagctatagaggtcaagggagagccttatcgtgtatttaattagcttgttaattattgctgcgtactccttgttaagagtcttcaacttaacggcggatcggatctgcttgagctagctactagcttttgctatctctgatctagaacaaaagcatcagttagt

SEQ ID NO: 15845 - DNA, 566 bp, Zea mays
gcgtattttccatttgcaattgcaaacgcgttgactgcccggcttgatgatggaaatccactcgttgatgagcagctagtgctcctgatgtactgcctatttacagtggctctgtacatgcattttgctacatcagttattcatgagatcaccaatgcactcgggatcccctgcttcaggatcactaggaaaaaggcatagttcatccccgggcatcagcgttgccctggattgtgattgtgtaatcaatcccaattcccaaggtggtgcctgacagacaagcaatttttcatatttaatggatgctacttcctgattactcacatggatgacgtgccccgcccctggaaattcacatcggcatgaacgtgcggatgagaaagcagtgttttttttgaaacaattagcaacatcatgctgtatcttaccaatttttttgtggaattcgttgagcttgctgatagtgatgtattgcaacttaagaattgtttttggtattgttaaaggaatgccccctcaatgcctcccaaaaaaaaaaaaaaaaaaaaaaaaaaaaaaaaaaaaaa

SEQ ID NO: 15846 - DNA, 3585 bp, Zea mays
gccggggcttctggctgcccgctgtcccgtggtccctctctccctccctgtcctgtccgccgccgccggtccccgacggcggctctgcagccacacgcacaaggactagagcggacataatacggcgcaagcggagggaccccaccgcaaaagcgcacagttcccgttccccctccgacccgttcattccgcttggttttctcctcctccgtcctcttcgctccccgtcagaccatccctgtgaggctgtgacgcaaccgggcgccggcggtctctcctgcaccacagggcacgccgcctcccgcgcacgtgttctcctcttccggggattcagatctggggattgctattctgtccgtctgactccgtccgtcccgaggcgcggcgaggggagcgagatgggttacattggccaccacggcgtcgccacgctgcggcgctacaagtacagcggcgtcgaccactcgctcgtcgccaagtacatcctccagcccttctggtcccgattcgtcaacatcttcccgctatggttcccaccgaacatgattacactgacaggtttcatgtttctactgacatcagcattccttggctttttatattcaccccatctagatacagcaccccccagatgggttcaccttgctcatggactgcttctctttctttatcagacttttgatgctgtggatggaaaacaagcaaggcgtaccaactcatcaagtcctctaggcgagctttttgaccacggatgtgatgcgcttgcgtgtgcttttgaatccttggcttttggaagcacggcgatgtgtggaaaggctaccttctggttttggttcatttcagctgtcccattttacttcgcaacctgggaacacttttttacaaatacacttattcttcctatagtcaacggaccaactgaaggccttatgctgatctacttgtgccattttttcacctttttcacaggagccgagtggtgggcacaggattttcagaagtcaatgcccctgctgggttgggttcctcttatctctgaaatcccggtgtatgacattgtgctatgtcttatgattgcttttgctgtaatcccaacaattggatctaacatccacaatgtatataaagtcgttgaagcaagaaaaggaagcatgcttctggcactagccatgctctttccttttggtttgctcttggctggagttcttgtctggtcctacctttctccttcagatataatgagaacccaaccacatttgctaattattggaactggttttgcatttggatttcttgtgggaagaatgattctggctcacttgtgtgatgaacccaagggtttgaaaacagggatgtgcatgtcccttgcgtattttccatttgcaattgcaaacgcgttgactgcccggcttgatgatggaaatccactcgttgatgagcagctagtgctcctgatgtactgcctatttacagtggctctgtacatgcattttgctacatcagttattcatgagatcaccaatgcactcgggatccactgcttcaggatcactaggaaaaaggcatagttcctccgtccacgggcatcagcgttgccctggattgtgtaatcaatcacaactcacaaggtggtgcctgacagacaagcaatttttcatatttaatggatgctgcttcctgaatactcacatggatgacgcccccccccccccccccccccgccccttaaaattcacatcggcatgaacgtgcggatgagaaagcagtgttttttttgaaacaattagcaacatcatgctgtatcttaccaattttttgtggaattcgttgaacttgctgatagtgatgtattgcaaattaagaattgtttggattttgttaaaggaatgcccccccaatccctcatacaggttgtgtgctatcctgtgccaaaggcaggcaaatgcgctgcctgcttcattcaccagatttgcatacggcgccaaagccaagcaaacacactaggccatcagtcagttcgttcgagacagattcattcaccaggccagctctttcgatcgatgctggtgtgatgggggcagcaacatctatctacataaggttggaaaaaaactgcccaagttttctgaaaagtgcaaatacaaatggttcttcgtttgctgcatcaggcgatgggtctgtgccgtcctcaggcaccggcaagctggccagccactgctccacccggtctcgcttcgccacgagccgccctctgtttctcgccgacagcttcaggggactccccatccgtcccagcacctcctgcgccagctcccgcactctggactcgcctcggacgtcactgtgcttcccaacgccgcacaccaccgacacctccaacggcaacgcgcgggcgcggcccctcaccgcgtccacccactgcagcaccagcacgtaggctgcaaccgtgctgaacccgtgcaggttcagcttcgcctcggcctccgaccactccatcgccctgtccagaaccgacgccgacgacgccaggagctcccgcaccacctccacttccgctgccggtgccggtgttgtcgacgcagacctgagccacccgaccagcccggccgtcgacagcggaagctcagggcccagctcccgcaccaccgaagcgagcgacggacacgagttgagcaccaagttgtagcctttcgcggtcaccgcgacgcgcagcttccgcatcctcttcagccacgccagagtcctggcgtggtcgcggcaggcgctgtagcacgacagcacggcatccgccgcgccggcgccgaggcggatgccgccggcgtccgccatggacgcgatgacccgctccatgtcggccggtgagccggccctgccgtagcacctcgcgacggccccgaactgggccgcctcgggccggtgccctcgcgagaccatctccctgagcgctgcctcggcctcggccggcatgcccagcaggcacacggtcttgaccatcgccgcgtaggccttgcgcccgcagagcgccggcatggtccgtagctccatgtggaactccgtcgcccggtccttgagcccgcgcgaggagaacgccgctatgaggtcgcagtagaagagggctacctcgtcggtcgactgctggaggtgctgcgagacggagtcggcgatcagggacctggattctccggcgcgtccgttggcttcgagcaaggcggcgactgcagctgcgtggatcgagctccatttgaaccaccgtgcctgtgtgaccgcctcgtagaacgggatggcgagggggtcggagtccatgagtagcctggagagcgcggcgagcgcggcgcgctccgacttggtgccgacgtagctgcggatgacgcgctcggtcgcgcccgctgtcactgtgcgctccagctccgacatgagccgccgctcgctccgccagctagacccgccgcccgacgcgacccggcgcagcgaggacgagaccacgggggagaacctccgccgccgggcagccgcgggcggcgcccaaagggacgccacccctggcatcgctgcttgggctggcctgtgtggtgatgagctttcgag

SEQ ID NO: 15847 - DNA, 790 bp, Zea mays
atgtgtttttaatatatgtatgtgggctgtacatgccctaatccaccatcttactcctgattccgacgccaaccccctgccctgccgccgtctctctctaacccgcttctccacctccctcacatcggctactctccgcgcgcctaccgttccgcgccgcatcggattgggtggtcggggcctagtcgaggttgcgcgggacagcgtcagtccatggcggagcttgtgggaccgcgcgtctacagttgctgcacttgccggaaccacgtttgccttcacgacgacatcatctccaaggcctttcaggggaggaatggccgtgcgtttctgttctctcatgccatgaacgtagttgtgggggcgaaggaggatagacacctcatgacagggctacacacagttgctgatatctactgtaatgactgccgtgaggtgttaggctggaagtatgtgagagcatacgaagagacgcagaaatacaaggaaggaaaattcatattcgagaagtcaaagattgtgaaggaaaactggtagtgcccccaagttgccaatcaccaaatgttctggtgaagatgaaatggccatttagtgtgcttttggatgtttgtgtccttgtaaatagcttttcctccgtggattgcagtgctaaggtgccccatgttcacgcctcagtgacaattgtaaagcacacttgttcctgttcatttgtgtgaataaggtacttcatttggttatttggtatggaatggcctctaatgtgcataacatggtgggccctcaaaatttgtta

SEQ ID NO: 15848 - DNA, 1329 bp, Zea mays
ttccgagacgccactcattccaagaggcattcgcggtctcctctccaccccggccgccggccgcccccacagtgccgtaccccgaccagccatgcgcatcttcctacggcccattgggtacctcgaggccggccgcggcggcgtacaccacaagcactgggacggcgtggtgcccccagaatgcgcgccggatccgtccatcctccgcctttcctcggcgcagcagtgggaggaagcccgcgagccgctccacgccgacatcgacacaaccaagacctgtggcatcgggcccgggatggcattcgcccgcgctgtgctctcgagcctgcaggaggacacccctggcgcggcggcccagatcgggctcgtgccgtgcgccgttggcgggacggccatccgggagtggtccctcgggaaacatctgtacgagcagatggtatcccgggcgcgcgtcgcgaccttgtacggcgagatcgaggccatcctatggtaccagggagagagcgacgccgaatccgatgccgacacgagtgcctacttggagaacgtcgagaggctcatctgtaatgtcagggcagatcttgggatgccgcagttaccctttattcaggttgcacttgcatctgggaataaaaggaacattgaaaaagtcagaaatgctcaatttagtgttaatttgcccaatgttgtaactgtggatccgatgggtatggcactgaatgaagacaagttgcatcttaccaccgagtcacaagtaaaacttggcaaaatgctggcagaagcgtacattttgaacttctctacatcaacttgttaggtgaatacaagtgtctcaagatcttcaatccacaacaagtatatttgataaggtcgcctagtgacaagattactatgtgctcaagcacttaatcaatcgaagacattgtatctatcttatgtccgagaatacgctaaagtgcctcaattcttgtatagcatttcaaactcgcttcataacatttctttcatattgtaataatggttgcagcctaaaaaaaaaaaaagctaaaaaaaaaaaaaaaaaaaaaaaaaaaaaaaaaaaaaaaaaaaaaaaaaagggaaaccaataaaaagaaaccaaacctcacacaccgcgcaaaagaaaaaaaaaaaatctcttaaattgagaccccataaaacaaaacacagggcctcggtgttacacaaccggcgacaggggaaaaacccctggggttcccaaaactaattccccttgaaacaaatccccttttcaagagggggcgaaaagccaaagggcccctcccataaccctttccaaaaaatttgcaa

SEQ ID NO: 15849 - DNA, 2350 bp, Zea mays
gtttgctcattactattcagcacacatgtctcaaaacccaatgactccacaactctgaaccaaaaatcctgaggaaacacatatgaggttagtaggtgttggatgttgttggataattgatttcaatcccctgaaggtgttgagaatcaaggcaacacaagttaggaatgaggacattcgtcatgagtttaacacttctttagagtgttaacgcgaaggatgaaggtcttcgggtaaaaatgtaaatagaaatgatgtgtaatggaataacacagtacaatggtgtatgcgaacttatctcctttgccttagcattttcattatgcctcccattacaccaaataaatttacaagcatacatttgactccttgacaaagggtggtacgaaggttcttcgaaggttgagcgacacgaagctacgatcctcgaaaaggtactttatgcaggtcactgttcatctatttataggggagatgaatcacctttgtacagatgtacaataatgcccatcaaggttttatacacactatttacaaacggtattagggcaatagcgtcgcggccccgtccgcggctatgcgggcttcgaccgtcattatttagcagcttctcctttgggttgcattcgaagttgtcgacttcggctgttgtcctcgttgcttgcacacagacgaaacttttctgcacactgcttcggttgaagccaggttagcttcgtccgctagtgaaaatgttcctggaacacacttgttcgtgccgaagcagcatgttaatcaggtgatcttcgacataagaggcccccaatagatgttttgtttagttttcagttttcaaaaattaaggtcggtttagatgccaatagatagcaatctatattatattgtgaacataaaccaggttaactcattgcccaaatagtaaattgtgggggtatcaatttgggttgcaagtagtcaacctatcaacactcatcaattagtttgtgtacattgagatcgaacttttgaaaatgaacctgcaactgacaatttgggctgcacgaaatcaacctatcaacgttcatcattggtttatgtacattgagattgaacttctgaaaatggcaaagatatgctgtctaatcagttttcataatccagtgcaatttgtaaatatagtacatattagtagcgaatgatgtgttctggaattacacacaaacctatcctcaaccatattatgcagctatagcaaaaaataattaaattcattttaagatgacacttagaatgacactcaaaataacggaattgataaaagtacaggtacaattaaacagtgcaatcttatgcaggattcaagcagcttgcaggctgtcataggttcatcattgaatctttagtagcttttcatttttttctgaaatatagaatgcatcatcgttttaacttcacacatatttttttcttatattttgtagcttgccatcagaatttgtttcatcatgctataaacaaaaaaattgctcaattcttaactggtaaagtaatgttttttacttgctacttgtgatatttaagcactagaatttgcaattatgttatttaagtaaaacaagaattgatttcaatattgataccttgtccttttcgcattaagcaaccatcctttattttcctagatactccttgaatgtctagtacctttttctatatcaatatcttttattatgaagggcatgtctagtaaagtggttagagctgtctcactaagtcaacaggtgccgtgtttgaggagtctctcctcatcgtctaggctctaggaggctttgaaagtgggtctatctaagattgtttatgatctgaccaggttgcacttgcatctgggaataaaaggaacattgaaaaagtcagaaatgctcaatttagtgttaatttgcccaatgttgtaactgtggatccgatgggtatggcactgaatgaagacaagttgcatcttaccaccgagtcacaagtaaaacttggcaaaatgctggcagaagcgtacattttgaacttctctacatcaacttgttaggtgaatacaagtgtctcaagatcttcaatccacaacaagtatatttgataaggtcgcctagtgacaagattactatgtgctcaagcacttaatcaatcgaagacattgtatctatcttatgtccgagaatacgctaaagtgcctcaattcttgtatagcatttcaaactcgcttcataacatttctttcatattgtaataatggttgcagcctaaaataaagtaagacactataaataatttgttaaagaaatatgtaataaatttatataatattccaaaaaaaaaagggcgg

SEQ ID NO: 15850 - DNA, 1444 bp, Zea mays
aattaaatcaattattcaacggatttgtacgttaagaaaataaaaattgaaaaaatatggtagttgatatatatatatatatatatttatgagcaggggatatataggggaatatataggagaaacagttgcgggaagattgaatataggggagggaaaatttagggccgcagcgcatgccgccgcccgccccctccctttcgtatgccggctataggagctgaaaatcgctgcagcgctgccccggcagggctcctacctggaggtccgcttctctctccccatcgttttggtgtgcgtgtggctgccctccaaacacggttgacgtgggctcacttttaattattaatgaaaaatagatatagaaaatgatattttatagttgtagtggggtatagaggaatatttaggtggaaccgccgtatgagatgaaaaagaaacagataaattatttatgatgtgacaaaaaaaaatgatataaggagaattttagagcgagccgatggggggtagtgttacgccactcattccaagaggcagccgcggtctcctctccaccccggccgccggccgcccccacagtgccgtaccccgaccagccatgcgcatcttcgtgctgtccgggcagagtaacatggccggccgcggcggcgtacaccacaagcactgggacggcgtggtgcccccagaatgcgcgccggatccgtccatcctccgcctttcctcggcgcagcagtgggaggaagcccgcgagccgctccacgccgacatcgacacaaccaagacctgtggcatcgggcccgggatggcattcgcccgcgctgtgctctcgagcctgcaggaggacacccctggcgcggcggcccagatcgggctcgtgccgtgcgccgttggcgggacggccatccgggagtggtccctcgggaaacatctgtacgagcagatggtatcccgggcgcgcgtcgcgaccttgtacggcgagatcgaggccatcctatggtaccagggagagagcgacgccgaatccgatgccgacacgagtgcctacttggagaacgtcgagaggctcatctgtaatgtcagggcagatcttgggatgccgcagttaccctttattcaggttgcacttgcatctgggaataaaaggaacattgaaaaagtcagaaatgctcaatttagtgttaatttgcccaatgttgtaactgtggatccgatgggtatggcactgaatgaaagacaagttgcatcttaccaccgagtcacaagtaaaacttggcaaaatgctggcagaagcgtacattttgaacttctctacatcaacttgttaggtggatacaagatcttcaatccacaacaagtatatttgataaggtcgcctagtgacaagattactatgtgctcaagcacttaatcaatcggagacattgtatctatcttatgtccg

SEQ ID NO: 15851 - DNA, 3030 bp, Zea mays
  misc_feature (1403)..(1403): n is a, c, g, or t
aaaattacagtctctgctacggtctcctcgtgagaagctgttttgtcaaatgaattacaaaacggctctggctcctctagagaaccaaagaagccagagggaagccgttaggagccctgccaaaggggcctaaaggccggtttggtagacagtaaaatagagaagatctataaaagagataatctctttgttaacagtaaaatagaggagatctataaaaaagataatctctttgctagttttaatcccttccaatcgactcgatacaaatcgttttcgtactcgcaatttgctcgatcctccactaggagtgggagggagatctcaggtcaaatgcctcggtcctctgccagactgttccctctcacgtgctgactgacaactccgcgccgatcgatccacgggcgttattagtatagagcgcgttcgcctgcactacaaaaaccactgttgcagctgcaaaatactgttgcagctgcaatcactagagagaaaatactgtagaagccgcagccgcagtcggattaaagccgcagcgaacaagcccatatatcgccgtcagagccatcaccccgatggatccctgcgcttcgtgctcaggttcagcggaaactgagccgtgagcaccgccgccgccaccacctttgcgtttgcggtgacgacacgacaccaataatggcggcggcaaggacaaggagcctgctcgcggcggcgttcctggcgctggcggcggtgccggcggtgctctgccaggcgccaggccccgcggcggcggcgccgcccaacaagggcccgccgaacgttacggcgatcctggagaagggcgggcagtacacgacgttcatgcggctgatgaagtcgacgcagcaggacacgcagctgaacggccagctgaacaactcgttcggcagcgggtacacggtgttcgcgcccaccgacagcgccttctccagcctcaagcccggcacgctgaacaagctgtcgcagcaggagcaggtgtcgctggtgcagtaccacgtcctgccgcagttctactcgctcgactccttcgagaccgccagcaaccccgtgcgtacgcaggcgtcgggctccgacgggccctacacgctcaacatcaccgccgacagcagcggccaggccaacgtgtccacgggcctcgtcgccacccgcgtcggccaggccctgcgcgcgcagcagcccctcgccgtctactccgtcgaccaggtgctgctggccaacgacctgttcggcgtcaagcccccggcgtccgcgccgcccgccgccaggaagccggccaagggcgggtccgtcgccgaggcgcccgccgccggctcggctgacgcgccgccctccggcgcggccgcgcgcggcgccagcaggaccgccggatggagctcgctgcnccgctctgctgttcctggccgccgcggcctccttcctgtccctgttgtgagaatgtaaacatggttcgtgcttgtcgagcacaaaagagctcgtcttcttgcggtttgtttctcttctggagttctagtaacctggatctgtccctgaatgttgatgaagccagctgttaatttctccatgcatcttttcttctcatgagtggtctcgagtctgaccgtgcatggctagaattagtaattttttctcttcttttgttagcagaatcagtagtgctccgtttgcttcagcgttgtttcagttcagtgtgcgtttttaaaatttcaaaagtcccatcttgcagcggctccaccccggggccctcttacaattcagtgatttagcaggccatgtgactggaaaatgcatgcttagcccggccccagagcccaaacaggcccaggaagagcccgcactcagcgcagccctgtccagacccagagccacgaagcttcatttaacttgtgcggttcgcgtgatagtgcttgcggccgcaagtgacggtgggtttggtggtgctggtgctgctgctggagcgtagcgtgtgattgaacccgggcgaggtgagactgtgagagcgatggcatgtccgtcagcgtgtggtcgccaacgccgagcagctctcgttgagccgtcggttttcttcgatctcttctcccggcctcagctcaagcttgttgttcaagtggcgacgggtgcctcagtgctcacctgtcgccggccgacgttatttttttctcgcacgcagcgtccgtccagtgtctcgctcgcgtacgctcagtagtcatacgcacatggcgagatctgcaggggccaaatcccgatccgatcactcggcgatggactttaattacccagctctcgtcgaatccaccacacttctgaaagtctcaactcaaaccagagatttcccatgacaccatgtccaattgtccactgtacttggcagcttcagatttcctttttagagttattatattatgtgctgtcgagggcttgagaacaccatgtccaattgtccactgtacttggcagcttctgcttggcgtgtcgccgaagacgaacgggactgtcgattgagcgggccttgctgatcggcggtccttctccggccgctgccgcatcgccgtcgccggtatctccctcgcgcgccttcgtctctgcctacttccactccaccgctgctttctatgaccgcccccctcgcattttccacgccgctgcagacgcaaatacgcactggcgtagccaccgcccaccaatttccgcggcggttggttcagggaaacccagcagatctgcacagcagcgttcaataagattttcactgtaagaattcagacctctagtaagaattcagtgtaattcaggagggggctgctgtttgcatcgtatatacacgccggacgggttttcagtgcgcacgtcgtcgtggccgcgttgcgcagacgctgtcactgcatttacagctgtggtctgaagctgacacgcagcttgcattagaagaagaaagcaggggcgtagactgtcggtgggattcgtctttgcccagttgcctctcaaacacagcatgattaccatattattctt

SEQ ID NO: 15852 - DNA, 1150 bp, Zea mays
cccagcgtccccggccccggggccgccccccggggcgcgactgctagctactcgatcggatcctgaccacgcccgcctaccaggccaccaccaccaccacccacaaatccccaatggcgaggcgcatcgccgtggcggcagcgttcctggcgctggccgtggtggctaccgccgcgctggcgcaggctcccggccccgcggcgacgccgagcgggccgccgaacgtgacggcgatcctggagaagggcgggcagtacaccatgttcatgcggctgatgaaggagacgcagcaggacacgcagctgaacagccagctgaacagctcgtacgccagcagcggcggcgggtacacggtgttcgcgcccaccgacaacgccttcaacaacctcaagcccggcacgctcaactcgctgacgcagcagcagcaggtggcgctggtgcagggccacgtcctgccccagttctacagcatggactccttccagaccgccagcaaccccgtccgcacccaggcctccggccgcgacgggccctacacgctcaacatcaccgccaccgccaacaaccaggtcaacgtctcctcgggcgtcgccgaggtcaccatcaacaacgcgctcagcgccgtcaagcccctcgccgtctactccgtcgacaaggtgctcctgccgctggagctgttcggggccaaggcgcccgccgccgcgcccgccgcgtcccaggggaagcccaagaagggcgggtcctcggacgctccctccgggtcggccggctccgacgacgccgcgcccacgggcgccgccggcgccagggccgtcggctggagcttcgctggcctcgccgccgtccttggctgcctgttgtgagagtgagaccgtgcgtcatttctagggacggaggacggacggacgacaagctagttgaagatgagaatgccatgccatgcccgggcatgggcgccttcttccatctttgcctgagattgttagtggccgtgttcccttccccttctttctctctgcttgtttatttaaacttctttcatctcgctagtttctttattttgtactattggtggtttgtaagattggcttatgtgattcaatttatgcgcatgccgctgttgatactgcgtcaataaaaaaaaaaaaag

SEQ ID NO: 15853 - DNA, 1257 bp, Zea mays
cctcgaggccggccggattgggacccccggccgggccgggtacccatcgctcactacgcgaccgctagctactccgatcggatcctgaccacgcccgcctaccaggccaccaccaccaccaccacccacaaatccccaatggcgaggcgcatcgccgtggcggcagcgttcctggcgctggccgtggtggctcccgccgcgctggcgcaggctcccgggcccgcggcgacgcctagcgggccgccgaacgtgacggcgatcctggagaagggcgggcagttcaccatgttcatgcggctgatgaaggagacgcagcaggacacgcagctgaacagccagctgaacagctcgtacgccagcagcggcggcgggtacacggtgttcgcgcccaccgacaacgccttcaacaacctcaagcccggcacgctcaactcgctgacgcagcagcagcaggtggcgctggtgcagggccacgtcctgccccagttctacagcatggactccttccagaccgccagcaaccccgtccgcacccaggcctccggccgcgacgggccctacacgctcaacatcaccgccaccgccaacaaccaggtcaacgtctcctcgggcgtcgccgaggtcaccatcaacaacgcgctcagcgccgtcaagcccctcgccgtctactccgtcgacaaggtgctcctgcccctggagctgttcggggccaaggcgcccgccgccgcgcccgccgcgtcccaggggaagcccaagaagggcgggtcctcggacgctccctccgggtcggccggttccgacgacgccgcgcccacgggcgccgccggcgccagggtcgtcggctggagcttcgccggcctcgccgccgtccttggctgtctgttgtgagagtgagaccgtgcgtcgtttctagggacggacggacgacaagctagttgaagatgagaatgctatgcccgggttcccttccccttctttctctctgtttatttaaacttctttcatctcgctagtttctttaatttgtactattggtggtttgtaagattggcttatgtgattcaatttatgcgcctgccgctgttgatactgcatcactagtcttgagtcatttgtgggtacaaaactacaaatccttgtaagaggtcacatccagtgatccatcattttcttagctgcagtgaaacgtggtgcttttctcttgttcggtgggacacaatgtcccagaaaattgacgcaacgtttattagttggtcc

SEQ ID NO: 15854 - DNA, 1295 bp, Zea mays
gggtacctcgaggcccgccctaatcacaaatcgctcactacgcgaccgctagctactcgatcggatcctgaccacgcccgcctaccagaccaccaccaccaccaccaccaccacccacaaatccccaatggcgaggcgcatcgccgtggcggcagcgttcctggcgctggccgtggtggctcccgccgcgctggcgcaggctcccgggcccgcggcgacgccgagcgggccgccgaacgtgacggcgatcctggagaagggcgggcagttcaccatgttcatgcggctgatgaaggagacgcagcaggacacgcagctgaacagccagctgaacagctcgtacgccagcagcggcggcgggtacacggtgttcgcgcccaccgacaacgccttcaacaacctcaagcccggcacgctcaactcgctgacgcagcagcagcaggtggcgctggtgcagggccacgtcctgccccagttctacagcatggactccttccagaccgccagcaaccccgtccgcacccaggcctccggccgcgacgggccctacacgctcaacatcaccgccaccgccaacaaccaggtcaacgtctcctcgggcgtcgccgaggtcaccatcaacaacgcgctcagcgccgtcaagcccctcgccgtctactccgtcgacaaggtgctcctgcccctggagctgttcggggccaaggcgcccgccgccgcgcccgccgcgtcccaggggaagcccaagaagggcgggtcctcggacgctccctccgggtcggccggctccgacgacgccgcgccaacgggcgccgccggcgccagggccgtcggctggagcttcgccggcctcgccgccgtccttggctgcctgttgtgagagtgagaccgtgcgtcgtttctagggacggacggacggacgacaagctagttgaagatgagaatgccatgaccgaggccgggcatgggcgccttcttccatttccatctttgtctgagattgtcagtggccgtgttcccttgcccttctttctctctgtttatttatttaaacttctttcatctcgctagtttctttaatttgtactattggtggtttgtaagattggcttatgtgattcaatttatgcgcctgccgctgttgatactgcatcactacttgggtacaaaactacaaatccttgtaagaggtcacatccagtgatccatcatttttcttagctgcattgaaatgtggtgcttttctcttgttaggtgggacacaacgatccagaaaattgacgcaacgtttattagtt

SEQ ID NO: 15855 - DNA, 2266 bp, Zea mays
gcgaggtgtatccattccacccctcgccgcgccccggcaccgagccggacggcggacgccctggacctcatgtcctcctgctcacgtaattggagcaacggccattatctgctccgtcgcgcacgcatgttctcatattccacgcgcccccgccggtcgtaaccaccgggcaaccaccgcccggctcactcagtacgccccgccccaccaccagctcagctccagccgtgcgacgctgtaccccgcccccgctttcagccgagcccctatatcaaccaaccccaccactctctaccctctgtacccatcgctcactacgcgaccgctagctactccgatcggatccggaccccgcccgcccccgccgcccccgccaccaccaccaccaccacccacaaatccccaatggcgaggcgcatcgccgtggcggcagcgttcctggcgctggccgtggtggctcccgccgcgctggcgcaggctcccgggcccgcggcgacgcctagcgggccgccgaacgtgacggcgatcctggagaagggcgggcagttcaccatgttcatgcggctgatgaaggagacgcagcaggacacgcagctgaacagccagctgaacagctcgtacgccagcagcggcggcgggtacacggtgttcgcgcccaccgacaacgccttcaacaacctcaagcccggcacgctcaactcgctgacgcagcagcagcaggtggcgctggtgcagggccacgtcctgccccagttctacagcatggactccttccagaccgccagcaaccccgtccgcacccaggcctccggccgcgacgggccctacacgctcaacatcaccgccaccgccaacaaccaggtcaacgtctcctcgggcgtcgccgaggtcaccatcaacaacgcgctcagcgccgtcaagcccctcgccgtctactccgtcgacaaggtgctcctgcccctggagctgttcggggccaaggcgcccgccgccgcgcccgccgcgtcccaggggaagcccaagaagggcgggtcctcggacgctccctccgggtcggccggttccgacgacgccgcgcccacgggcgccgccggcgccagggtcgtcggctggagcttcgccggcctcgccgccgtccttggctgtctgttgtgagagtgagaccgtgcgtcgtttctagggacggacggacgacaagctagttgaagatgagaatgctatgcccgggttcccttccccttctttctctctgtttatttaaacttctttcatctcgctagtttctttaatttgtactattggtggtttgtaagattggcttatgtgattcaatttatgcgcctgccgctgttgatactgcaaaaaaaaaaaaaaaaaatttgtgggtacaaaactacaaatccttgtaagaggtcacatccagtgatccatcattttcttagctgcagtgaaacgtggtgcttttcaaaaaaaaaaaaaaaaacaatgatccagaaaattgacgcaacgtttattagttggtccaaatgtgttctctgattgatggcattagacgttagttttcggttttggatttatcaacgaatgggggtcagtcaggctagtaatggagttggttggtgctggtggaacggagcgcaaaaggtttgggcgagcacgtggtgccaggttcgctcgtttggtaatcagtcgattcttcttccactcaggtacggagtactctgcaatgcaggctgcagggtcttcggttgaatgcatctggttttctgcgaagcagaaactttacccaaattacagtagattcaaattgggaagcaaatcgatcaaatggtatacccaaatagattccaaacaacgatacacgaattatgaatttatgatcgtcgatggcctgctcttgctggcttgttgctcagctaagacgcagatcgtaccgtagccaatcctgcaccaggcatctcttctctgcgctgtcatggactcaagcgggagtatatacaagttgcgacgcgtcactactctcaatcatcagcggccagctagcagtgtcggtacactccgttttgctcagcacggacgattgattatccagcacgcatagctggtaggtaggagccactttggcacggaccaccggcgctttcatttgattcttctgatttgactaggtgagtgcccgtgcgttgcaacggcaacttataaatatcatgataacttatatacaataggtaaatgtccgtgcattgctacgaataaaaatgttatg

SEQ ID NO: 15856 - DNA, 1370 bp, Zea mays
gtctcgctgactcgctgcatcctccggctcctcccagacctaggctatttcccgatcagacctgttatttcccgatcagacctattcctctctcggcctcccaccgccaccggcggcgacgagtaactcgcccgctgaccccagcaggcagccatgggagggcacggcgggttgaacatcctgccgcagaagcggtggaacgtctataacttcgacaaccgtgagaaggtgcaaaaagacgaggccgccgccgcccgggaggagcagctccagcgcgaggcggaacgccgccgcgagtcggatctacgcctcgctgcactacgccgtaaccgcggcctggtccaggcggagacgccccccgctcctccatctcaccccgccggccccgctgatccggcggacgcccttccttccccggcggacgcccttccttccccggcaacggatggagaccacatcaacctcttctcaggtggatcaggcgtcgccactgatttcgatgcgctcgcctcggccagtggtgggaggggcgcggctcgggagcgggagcctgatgccgaccctaaccctaagaagcggaagaagaaggaagaggaggtgagggttgtggggcccgatgaggagaagtacaggctgggctacggccttgccgggaagggcgtggcggtgccctggtacatgtcgagccctgcagcggcagcggccaaggaggggaggggcagagatgcaagggagggtaacggggtgaagaggagtggagggaagaagagcatcgaagagctgagggaggagaggaagaagagagaggccaaggagaaggaacgcgagcgagccatccttgttgctgcagggaggaaggagagacaggtggatcgggggcgccagtcaagatgggctcggtgatgtaaggattttcatggtataatgtccaagaatactaaggaattaaggataagtcatcgaaccgggcatggcctgactaccttaccatgcagatgcatgtggctgcaaaaattacaccgttcagttgccaaaggatagttgtgagcagtccaagagcatcatgatatcagtaacaagaagattgtatcatttgttggaaatcaatttatttggatctttttttgtaaaatattccgtgtaatatactgagaatgcaatgaagtcatgaagctagcagtacatgtaacacaggtgttgcttgctgtttgtaaagctatttacttggattgccccgcccttcccccctttttttgaaatttcttcaatggcagataacttcaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 15857 - DNA, 814 bp, Zea mays
attgcaagtcaaatctttcagagtttgatgatgttgaaggccatctaggattcgataagcagggaacacgtttcaagcgactgataaagggccgtaatgatcacaagcaagtcgaggagggtgtcaaccgtcttatcttatgttctgggaaagtttactatgaacttgacgaagagcgtaaaaagtcggagcgtggtgatgttgcaatttgcagagttgagcaactttgcccgttcccctatgcccttatccaaaaagagctgaagagatacccaaatgcggagattgtgtggtgccaggaggagcccatgaacatgggtgcatacagctatatctctcctcgtctgtttactgcgatgaaggctcttgggcggggttcgtttgaagacatcaagtatgttggcagagcaccttcagctgctacagcaacaggcttcctgtcggttcatgcgcaggagcagtcagagctagtgaaaaaggccctgcaggcaaagccgatcaaattcctctgatgtatgccccgtatctacagcaacaacctgcctgcatggttgcaggaacatgccagggattttcttttccccggccagttttgaggcttttcagcgttggaactaatgacgacttctttccttgaagacatcatattttttttttctcgaacgcgcaggaggactgcacgtcattatattaagaaaggaaaaggtccaagacatcatattaattgccctaatcagctatctagtagttaattataaactacgtgcgaacagaccctggtttagctggccagttcaatttgagacctgggttc

SEQ ID NO: 15858 - DNA, 912 bp, Zea mays
gacaatatgaacaatttgttgcattgtgcaggtttactatgaacttgacgaagagcgtaagaagtcggagcgtggcgatgttgcaatttgcagagttgagcaactttgcccgttcccctatgaccttatccaaagagagctgaagagatacccaagtacggctgagtgctgcctcgttgcccgttcccctatcaccttatccaaagagagctgaagagatacccaaatgcggagattgtgtggtgccaggaggagcccatgaacatgggtgcatacagctatatctctcctcgtctgtttactgcgatgaaggctcttgggcggggttcgtttgaagacatcaagtatgttggcagagcaccttcagctgctacagcaacaggcttcctgtcggttcatgcgcaggagcagtcagagctagtgaagaaggcactgcaggcagagccgatcaaattcctctgatgtatgcaccgtatctacagcaacaacctgcctgcatggttgcaggaacatgccagggattttcttttccccggccagttttgaggcttttcagcgttggaactaatgacgacttccttccttgaagacatcatattaattgccctaatcagctatctagtagttaattataaactacgtgcgaacagaccctggtttagctggcagttcaatttgagacctgggttcaaaaaaaaaaatctctgagtcgggtttaaggcagccagacaacacaggagttcagcttctgacccataataaaactatttatatttaataaaactatatttaacaaagttcagcagctgatactcttccggggaagaaaaatacacagaaccttacctgcagcgcatatatcagccccaggctcaacaaacaattttcatgcaaccaaaatcacaaatatca

SEQ ID NO: 15859 - DNA, 2263 bp, Zea mays
gccgtcaagtaccacctgggtacctcctatgatcgcccaactcgaggcggcaacaggatccatttgtccttggtcgccaatcccagccatctggaagccgttgatcctgttgtcattggcaagacgcgtgctaagcagttctactccaatgatgctgacaggacaaagaacatgggtattctgatccacggagatggcagctttgctggccagggtgtggtctatgagacactccatctaagtgccctcccaaactacactactggtggaaccattcatattgttgtcaataaccaagttgcctttacgactgatccaagagctggcaggtcctcccagtactgcacagatgttgccaaagccctgaatgctcctatattccatgtaaatggcgacgatttagaggctgttgtttgtgtttgtgagcttgcagcggagtggcgccagactttccactccgatgtggtggttgatctgatttgctaccgccgtttcgggcataacgaaattgatgaaccttccttcacacagccaaaaatgtatcaggtcattaagaaccatcccagctcattgaagctttatgagcagaaactgctaggaacgggtgaagtcatgaaagaagatgtccagaggatccatgacaaggtgaaccgaatcttgaacgaagagtttgctaagagcaaagactacgttcccaacaagagggattggctctcagcttactggactggctttaagtcaccagagcaaatatcacgtgttcgcaacactggggtgaagcctgaaatactgaaacgtgtaggtcaggcaattactacactgcctgaaaacttcaaaccacacagagcagtgaagaagatttttgagctgcgtgcagctatgatagagagtggtcaaggaattgattgggctgttgccgaagccctggcctttgcaacacttatagtggaaggcaatcatgttaggctaagtggacaggatgtggaaagaggaactttcagccatcggcatgcagttctgcatgatcaggaaactggagcaaagtactgcccacttgaccatgttgcaatgaatcaaaatgaggagctatttactgttagcaacagttcactttcagagtttgctgttcttgggtttgaattgggttactccatggagaaccctaattcattggtactttgggaagcacaatttggcgattttgccaatggtgcacaagtgatgttcgaccaatttttgagcagcggcgaggcaaaatggttgcggcaaaccggccttgttgttctgttgcctcatggttatgatggccaaggtcctgagcattctagtgcccgcttggagcgcttccttcagatgagtgatgataatccttttgtcatacctgagatggaaccaacacttcgcaagcagatacaagagtgtaactggcaagttgtgaatgtgacaactcctgcaaattattttcatctgttgcgtcggcagatacatagggagttccggaagccgctgattgtaacagctcctaagaacctgcttaggcacaaggattgcaagtcaaatctttcagagtttgatgatgttgaaggccatctaggattcgataagcagggaacacgtttcaagcgactgataaaggaccgtaatgatcacaagcaagtcgaggagggtgtcaaccgtcttatcttatgttctgggaaagtttactatgaacttgacgaagagcgtaagaagtcggagcgtggcgatgttgcaatttgcagagttgagcaactttgcccgttcccctatgaccttatccaaagagagctgaagagatacccaaatgcggagattgtgtggtgccaggaggagcccatgaacatgggtgcatacagctatatctctcctcgtctgtttactgcgatgaaggctcttgggcggggttcgtttgaagacatcaagtatgttggcagagcaccttcagctgctacagcaacaggcttcctgtcggttcatgcgcaggagcagtcagagctagtgaagaaggcactgcaggcagagccgatcaaattcctctgatgtatgcaccgtatctacagcaacaacctgcctgcatggttgcaggaacatgccagggattttcttttccccggccagttttgaggcttttcagcgttggaactaatgacgacttccttccttgaagacatcatattaattgccctaaaaaaaaaaaaaaaaactgcacgtcattatattaagaaaggaaaaggtccaagacatc

SEQ ID NO: 15860 - DNA, 1394 bp, Zea mays
cctcgaggcggccggagctccactactatccctctcttcctctctgctttccccttccaatggaatcctgtagcttccgcgccgcaaccgcgccttctccctttccctccgctccttccccatcttcatccccgcgcgccccatgtcccatactccgatttcccaggccaaaaaaagggaggcagattggggtgcggaggagggcgtccggatttgatgccttcgcgtctttcgccggcaaggtcttcgtggatgaggcgattggagcggaatatggggagggcttcgaaacatttcgaatggatggaccactcaaggttgatgtggattatctgaatgaaaaattgcaagaatgcttccttcaaaggataaggcatgctatgaagccggatgaggcgtttggtctaattttttcgtgggacaatgttattgctgatacagactcgctaaagttgaatgcttggagacaacttgctttggaggaaggtaaggatatcccaagtggtgctcatgtccggaagagcattcttcatggtgctgctgaccatgttcttagaaaggttttgtactgggcaaaagaggaagataaaatggaaaaattgaaggcacgccttatagagttgtactacgagaacctgttcaaactcgatacacctgtagaaggattgagagaatggctggatgctgttcagacagcagggataccttgtgctgtcgcatcaccccttgacaggagatgcatgatcgaagctttggatcggatggcgctaagcaaatatttcaaggcgatcgtgactgacgaagatgatatggagtcgatagcaaatcgatttctgtcagctgctatgaagttggatcgtaaaccctcgaagtgtgtggtgttcgaggatgacccaaggggcgtcacagccgcccacaactgtactatgatggcagtcgcattgattggtgctcatccagcgtatgagttggtacaggcagaccttgccattgcaaagtacagcgagctctcagtgatcaacctcagaaggctgtttgcgaacaagggaatcagcttcatggacttgcagaagcagataatcgagaagtcacctcccaagaggaggctgacagtagacaccattttctgatagatacacttttatttggtgtctgcctgttgttcttgagtagccaacaaccttcggcattatggcggtggcgttgtatataagatagtgctgatgttaggtgatccgctgtgtacctccttgtgaatgcaatgcggtagttccatcaaggtaccatgaggaagactgctgcaacaatgttgttgctgatgtaagctgatattattcaaatttattcatatttcatggtcgaaaaaaaaaaaaaaaaaaaccgcgaatgccaga

SEQ ID NO: 15861 - DNA, 1517 bp, Zea mays
caaaaaatctccatagtgggaaccgggaagccccccgcggagctccacgcctccactgctatccctctcttcctctctgctttccccttccaatggaatcctgtagcttccgtgccgcaaccgcgccttctccctttccctccgctccttcttcatcttcatccccgcgcgccccatgccccatactccgatttcccaggccaagaaaagggaggcagattggggtgcggaggagggcgtccggatttgatgccttcgcgtctttcgccggcaaggtcttcgtggatgaggcgattggagcggaatatggggagggcttcgaaacatttcgaatggatggaccactcaaggttgatgtggattatctgaatgaaaaattgcaagagtgcttccttcaaaggataaggcatgctatgaagccggatgaggcgtttggtctaattttttcgtgggacaatgttattgctgatacagactcgctaaagttgaatgcttggagacaacttgctttggaggaaggtaaggatatcccaagtggtgctcatgtccggaagagcattattcatggtgctgctgaccatgttcttagaaaggttttgtactgggcaaaagaggaagataaaatggaaaaattgaaggcacgccttatagagttgtactacgagaacctgttcaaactcgatacacctgtagaaggattgagagaatggctggatgctgttcagacagcagggataccttgtgctgtcgcatcaccccttgacaggagatgcatgatcgaagctttggatcggatggcgctaagcaaatatttcaaggcgatcgtgactgacgaagatgatatggagtcgatagcaaatcgatttctgtcagctgctatgaaggcatgctcctgccccacttctaatcgttgtacatcatgttaatatatataggtcacacatttgcgtgtttttcttttcttcctggcagttggatcgtaaaccctcgaagtgtgtggtgttcgaggatgacccaagcgcggcgtcacagccgcccacaactgtacaatgatggcagtcgcattgattggtgctcatccagcgtatgagttggtacaggcagaccttgccattgcaaagtacagcgagctctcagtgatcaacctcagaaggctgtttgcgaacaagggaatcagcttcatggacttgcagaagcagataatcgagaagtcacctcccaaaaggaggctgacagtagacaccattttctgatagatacacttttatttggtgtctgcctgttgttcttgagtagccaacaaccttcggcattatgcggtggcgttgtatataagatagtgctgatgttaggtgatccgctgtgtacctccttgtgaatgcaatgcggtagttccatcaaggtaccatgaggaagactgctgcaacaatgttgttgctgatgtaagctgatattattcaaatttattcatatttcatggtcgaaaactagctaaaaaaaaaaaaaccttgttgggc

SEQ ID NO: 15862 - DNA, 2325 bp, Zea mays
gaggaaccgcggtcggcggagctctcgctctcgcttcgttgaaggctcccctcttcctccaagtataaaggagcctccttttcctttgccggtgcggtgccgcgtgcctgccattctcctcccgagccttcttccttcacgcctctttgccgcagcgcgggtgggtcgtcgtttgctgtttgttccgagatcaccggagccagccagccagccacagccagccagagtcagagatgaggtggtcggcgttcctgtgggagaccgcgtccggccgccgcccgggggtttccaacctcctcctcgtcgtcgcagccgccagtagcggaggtctcgtcgcgtacgccgactccggatcagatgctgctgtcgagcagccgcagcttcctccgaggaagaaggtcgtggtgcttgggactggttggggcggcacgacgttcctgaggaacctcgatagcagactgtatgatgtgcaggttatatctcctcggaactacttcgcgttcacgccgctgctcccgagtgtcacttctggaacagttgagcctaggagcattgtggagccgatccgtagggttttggagaagaaaggtggagaaatcaaattttgggaagcagagtgtttcaagattgatccacaaagcaagaaaatccattgtcgctcgaatgttgggacaagccttgaggggaatggcgagttcttggttgactatgactatctcgtggtagcagttggggctaggacaaatacattcaatactcctggtgtggtagagaattgccacttcttgaaggaagtagaggatgctcaaaagatcagacggagtgtgatggactgctttgagagagcaagcctcccctttcttaatgaagaagagaggaagaagaatcttcattttgttgttgtgggtggtggacctactggagtggaatttgcagcatctttgcatgattttgttaccgaagatttatccaagctttacccctcgattcagcaccttgtcaagatatcgttgattgaagctgcagatcatatactgaccatgtttgacaagaggataacaaattttgctgaggataagtttggaagggatggtattgatgtgaaaactggatataaagttgtgaaggtttctaaggatgatattaccatgcaaaatcctgccaccggggatatttcagtcccttatgggatggctgtctggtcgactggtattggaactcgtccattcgttgtggaatttatgaaacaaattggccaggccaatcgccgtgtcttggctactgatgaatggctaagggtccgtgaatgtgatggtgtctatgcaataggtgactgtgctacaataaaccagaggaaagtaatggaggacatttcagaaatattcagagtcgcagataaagataagtctggaaccttgactgtgaaagaaattcaagatatccttgatgatatctacgtgaggtacccgcaagtacagctctaccttaagagcaagcagatgaacggcatcgctgatctagtgaggagcgccaaaggagacgctgagaaggaatccgtggaactgaacatcgaggaattcaagaaggctctttcgctcgtggattcacaagtcaaattcttacctgcgaccgctcaggtcgcatcgcagcagggccaatatcttgctaggtgctttaacaagatgaaggatgctgaagaaaaccctgaaggcccaatccgcatcaggggagaaggccgccatcgcttccgccccttcaggtaccggcatctgggccaattcgccccactaggaggggagcaaactgctgcacagcttcccggggactggatctccattggccacagctcccagtggctctggtactccgtgtacgcaaccaaacaaatcagctggcgcacgaggatgctggtggtatcagactggacacgccgattcatcttcggaagagactcgagttgcatatgatcaagagggaaaagattttgctgtgacatatattcagatgaacgaggccagtacagcctcttcccacttttttttagtctgatttcacataaatgttccccttttgttgttagggaagaatctgacttcccctgcactttgtatagtgcaccacgaagaaattcctttgtacctaccttttctttttgagagagttgcactgcacttttgcggtctgagtaagctcagaattcttttaatagctattttttctaccactaatatgtgatatggagaagggtcagtttggacctgattttgttgtgtgaaatcctaaaaaagcaagccaccgggccccgagcgcctggttcagttggtt

SEQ ID NO: 15863 - DNA, 876 bp, Zea mays
cctcgagccggccaaaaaaaaaattgggtaccccccgccccgcccgggcctaggctttcagccgctctcctagtctcctactctcctctcagccgtcgccgtcgctctccacaccgctctcctctctcctccgagccgcagctcttctctctccctctcccctgcgtgccgccactgcgggcaccctgcacgccgccgctgcgtggccctacacgccaccgctacgggtgccctacgcgccgccgtcactgctccagctctcctctgtttcccagccaatgccgccgctctaactccccaaggcatcgccccgacgacggctcaacgaagccccgtcgacgcctcgcggacgccctgcgccgcagcgggcgctttacgctccatggcaaggcgcgttagatgcctcaggttccacaggcgccttagcgcctaagcgacgctaaggcggcgcttcagataagcatgcttttgaataagatgtgaaggattaaagctcatgtgaaagattctaagactacaattggtatcaagcggttgctttcttatttctcatacgctcaaccatgctcctgcatgctaaggattcagttaggaagatgcattcagttgctaagaactactttgtgtctgatcttactcatcctccaagatccttgaacagagcttccagacatgttgttccattcaagacccgtttctttacgcattgctcacttgagagccgttcagttgaccaagagattgtgattgctatgggaagcaatgtaggcgatagagtcagtacattcaacagggcattgcagctgatgaaaagctctgacgtgaacatcactaggcatgcctgtctctatgagaccgcccctgcttatttgactg

SEQ ID NO: 15864 - DNA, 821 bp, Zea mays
  misc_feature (739)..(739): n is a, c, g, or t
ctgtgccgcgcccccgccggcaggcacacgaggaagagagagagagagagagagatcagcaacttaacaacaataatggccaccgccatagttcccacggacgccgagctgctgcaggcgcaggccgacctgtggcgccacagcctctactacctgacatccatggcgctcaagtgcgcggtggagctccacatcccgaccgccatccacaacctaggcggtgctgccacgctgccggacctcgtggccgcgctgtccctgccagcggccaagctcccgttcctcgggcgcgtgatgcggctgctggtcacgtcgggcgtcttcgcgtcgtcgtccgagtccggcgacgtctaccggctgaacccgctgtcctggctgctggtggagggcgtggagtcggaggaccacacctaccagaagtacttcgtgctgggcaccgtctcccgccactacgtggaggccggcatgtccctggccgactggttcaagaaggaggaggacgaggaccgccagctgccgtcgccgttcgaggccctgcacggggtgcccctcgtccacgagagcaccaagctgctggacgaggagctggacagggtcgtggaggaaggcgtggccgcgcacgacaacctggccatcgggaccgtcatacgggagtgcggcgccgacgtcttcagcggcctccgctcgctcacctactgctgcggcaggcaggggaacgccagcgcgggcgccatcgtcnagcccttcccagacatcaagtgcaccgtgctcaaccttcccaggtcgtcgaggataccaccaccaagacatcaccatcccgc

SEQ ID NO: 15865 - DNA, 1925 bp, Zea mays
  misc_feature (1361)..(1361): n is a, c, g, or t
  misc_feature (1410)..(1410): n is a, c, g, or t
gggacctcgagccgcccagcgggcacgggaaggaagaacgaagagagatcagcgacttaacaacaataatggccaccgccatagttcccacggacgccgagctgctgcaggcgcaggccgacctgtggcgccacagcctctactacctgacatccatggcgctcaagtgcgcggtggagctccacatcccgaccgccatccacaacctaggcgggtctgccacgctgccggacctcgtggccgcgctgtccctgccagcggccaagctcccgttcctcgggcgcgtgatgcggctgctggtcacgtcgggcgtcttcgcgtcgtccgacgacgtgcagtaccggctgaacccgctgtcctggctgctggtggagggcgtggagtcggaggaccacacctaccagaagtacttcgtgctgggcaccgtctcccgccactacgtggaggccggcatgtccctggccgactggttcaagaaggaggaggacgaggaccgccagctgccgtcgccgttcgaggccctgcacggggtgcccctcgtccacgagagcaccaagctgctggacgaggagctggacagggtcgtggaggaaggcgtggccgcgcacgacaacctggccatcgggaccgtcatacgggagtgcggcgccgacgtcttcagcggcctccgctcgctcacctactgctgcggcaggcaggggaacgccagcgcggccgccatcgtcaaggccttcccagacatcaagtgcaccgtgctcaaccttcccagggtcgtcgaggagacgacgaccaagaccatcaccatcccgcctgcgcaggctgtcatgctcaagctcgtcctgcacttctggagcgacgacgactgcgtcaagatcctggagctgtgcaggaaggccatcccttcccgccaagaaggagggaaggtgatcatcattgagatactcctgggcccgtacatggggccggtcatgtacgaggcccagctgctgatggacatgctcatgatggtgaacaccaagggcaggcagcgcggcgaagacgactggcgccacatctttaccaaggctggcttctccgactacaaggttgtcaagaaaatcggagctcgtggtgtcatcgaggtctacccatgatccatgatcgatgtcatgtgactgtgagaggacgatactgtacaattaaataaacggggtatctagctactactcagcttttgtacctcgagatccatgcatgttaattacttgcttccatctgttttcaaaatgcatctatgtaatgtacttcgcttcttcgtccaaaaaaaaaaaaaaaatggctttattacttcggtacagatcgagcagttgttccattccagnaactgtaagtgtaacctgaagttcagatcgtactccatcgtcagcagcnggatatattatactagcttagtaggtattcaaagccttggatgctaaacaaagatctactagctgctagctcttgtcgcctctcaggaggcagcccaacgtgagctaagctagataacaactttgccagcctccaacaattattagctatacgtgcaaagctagccaacctccatctaagtactctatgctcaaacccaagtatgtgtgctcatgggcaatacattcaaaacaaaatccatggcaaacttcaaaggatttgcaaacgagcccttaacttcctctgatttctttcaatgcaagaagcaatacttagactatcttcagcagcttatccatctctaccactatattcaaacatagttctgcgaacagtgttgtctataataatgcaaaacaatgttttgggtgaccatatggatgaactgctggagtcggtctttaggatgtgtacaatgagtgtcttaatccgtgtcttcgactgtgtttagatgataaatgtaaaaaaaactcaag

SEQ ID NO: 15866 - DNA, 1356 bp, Zea mays
cccgcccggggcctgcgtcctctgcggggcccgcaggcacatttaaggaagaacgaagagagagatcagcaacttaacaacaataatggccaccgccatagttcccacggacgccgagctgctgcaggcgcaggccgacctgtggcgccacagcctctactacctgacatccatggcgctcaagtgcgcggtggagctccacatcccgaccgccatccacaacctaggcgggtctgccacgctgccggacctcgtggccgcgctgtccctgccagcggccaagctcccgttcctcgggcgcgtgatgcggctgctggtgacgtcgggcgtcttcgcgtcgtcgtccgagtccgacgacgtgcaggtgcagtaccggctgaacccgctgtcctggctgctggtggagggcgtggagtcggaggaccacacctaccagaagtacttcgtgctgggcaccgtctcccgccactacgtggaggccggcatgtccctggccgactggttcaagaaggaggaggacgaggaccgccagctgccgtcgccgttcgaggccctgcacggggtgcccctcgtccacgagagcaccaagctgctggacgaggagctggacagggtcgtggaggaaggcgtggccgcgcacgacaacctggccatcgggaccgtcatacgggagtgcggcgccgacgtcttcagcggcctccgctcgctcacctactgctgcggcaggcaggggaacgccagcgcggccgccatcgtcaaggccttcccagacatcaagtgcaccgtgctcaaccttcccagggttcgttggaggagacgacgaccaaagaccatcaccattccgcctgggcaggctgtcatgctcaagctcgtcctgcacttttggagcgacgacgactgcgtcaagattctggagctgtgcaggaaggccatccctttccccgaaaaaggagggaaggtgatcatcatttagatactcctgggcccgtacatggggccggtcatgttcgaggcccagctgcttatggacatgctcattatggtcaacaccaagggcaggcagcgcggcgaaaacgactggcgccacattttttccaaggctgggtttttcgactacaaggttgtcaaaaaaatcggagctcgtggtgtcatcgaggtctacccgtaaacttctgcatgatcgattttatgtgactgttaaaggacgattctgttaaatttaattaacggggtagttacctactcagcttttgtagtacctcgagatccatgcagggtaaatacctgcctccatccggtctccagggggggggggggggggggggggggggggggggggggggggggggggccgtg

SEQ ID NO: 15867 - DNA, 1400 bp, Zea mays
  misc_feature (779)..(779): n is a, c, g, or t
aggcacaggaagaacgaagcgagagagagagagatcagcaacttaacaacaataatggccaccgccatagttcccacggacgccgagctgctgcaggcgcaggccgacctgtggcgccacagcctctactacctgacatccatggcgctcaagtgcgcggtggagctccacatcccgaccgccatccacaacctaggcgggtctgccacgctgccggacctcgtggccgcgctgtccctgccagcggccaagctcccgttcctcgggcgcgtgatgcggctgctggtgacgtcgggcgtcttcgcgtcgtcgtccgagtccgacgacgtgcaggtgcagtaccggctgaacccgctgtcctggctgctggtggagggcgtggagtcggaggaccacacctaccagaagtacttcgtgctgggcaccgtctcccgccactacgtggaggccggcatgtccctggccgactggttcaagaaggaggaggacgaggaccgccagctgccgtcgccgttcgaggccctgcacggggtgcccctcgtccacgagaccaccaagctgctggacgaggagctggacagggtcgtggaggaaggcgtggccgcgcacgacaacctggccatcgggaccgtcatacgggagtgcggcgccgacgtcttcagcggcctccgctcgctcacctactgctgcggcaggcaggggaacgccagcgcggccgccatcgtcaaggccttcccagacatcaagtgcaccgtgctcaaccttcccagggtcgtggnaggagacgacgacgaccaagaccatcaccatcccgcctgcgcaggctgtcatgctcaagctcgtcctgcacttctggagcgacgacgactgcgtcaagatcctggagctgtgcaggaaggccatcccttcccgcgaagaaggagggaaggtgatcatcattgagatactcctgggcccgtacatggggccggtcatgtacgaggcccagctgctgatggacatgctcatgatggtcaacaccaagggcaggcagcgcggcgaagatgactggcgccacatctttaccaaggctggcttctccgactacaaggttgtcaagaaaatcggagctcgtggtgtcatcgaggtctacccgtaagctagctgctgcatgatcgatgtgatgtgagtgactgtgagaggacgatactgtacaattaaataaacggggtatctagctactcagcttttgtagtacctcgagatccatgcatgttaattgcttgcttccatctgttttcaaaatgcatctatgtaatgtacttcgcttcttcgtccattgtgctcgtagatttggatttattacttctggtcccacgaaaaaaaaaaaaaaagggcggccgctcgcgatctagaactag

SEQ ID NO: 15868 - DNA, 1471 bp, Zea mays
tgggaccctcgaggccggccgggccgggaggcacaggaagaacgaagagagatcagcgacttaacaacaataatggccaccgccatagttcccacggacgccgagctgctgcaggcgcaggccgacctgtggcgccacagcctctactacctgacatccatggcgctcaagtgcgcggtggagctccacatcccgaccgccatccacaacctaggcgggtctgccacgctgccggacctcgtggccgcgctgtccctgccagcggccaagctcccgttcctcgggcgcgtgatgcggctgctggtcacgtcgggcgtcttcgcgtcgtccgacgacgtacagtaccggctgaacccgctgtcctggctgctggtggagggcgtggagtcggaggaccacacctaccagaagtacttcgtgctgggcaccgtctcccgccactacgtggaggccggcatgtccctggccgactggttcaagaaggtgcggcacgaggaccgccagctgccgtcgccgttcgaggccctgcacggggtgcccctcgtccacgagagcaccaagctgctggacgaggagctggacagggtcgtggaggaaggcgtggccgcgcacgacaacctggccatcgggaccgtcatacgggagtgcggcgccgacgtcttcagcggcctccgctcgctcacctactgctgcggcaggcaggggaacgccagcgcggccgccatcgtcaaggccttcccagacatcaagtgcaccgtgctcaaccttcccagggtcgtcgaggagacgacgaccaagaccatcaccatcccgcctgcgcaggctgtcatgctcaagctcgtcctgcacttctggagcgacgacgactgcgtcaagatcctggagctgtgcaggaaggccatcccttcccgcgaagaaggagggaaggtgatcatcattgagatactcctgggcccgtacatggggccggtcatgtacgaggcccagctgctgatggacatgctcatgatggtcaacaccaagggcaggcagcgcggcgaagacgactggcgccacatctttaccaaggctggcttctccgactacaaggttgtcaagaaaatcggagctcgtggtgtcatcgaggtctacccgtaagctgctgcatgatcgatgtgatgtgactgtgagaggacgatactgtaaaattaaataaacggggtatctacctactcagcttttgtagtacctcgagatccatgcatgttaattacttgcttccatctgttttcaaaatgcagctatgtaatgtacttcgcttcttcgttcaatgtgctcgtagaaaaggacccgtccctttggtacagatcgagcagttgttccattccagcaactgtaagtgtaagctgaggttcagatcgtactccatcgtcagcaggatatattatactagagggattcaaagtaaaaaaaaaaaaaaaaaaggccccta

SEQ ID NO: 15869 - DNA, 868 bp, Zea mays
  misc_feature (16)..(16): n is a, c, g, or t
tgggaccctcgacccncgcacgccccgccggacaaaaaaaaaaaaaaaaaaaaaaggaagaacgaagagagatcagcgacttaacaacaataatggccaccgccatagttcccacggacgccgagctgctgcaggcgcaggccgacctgtggcgccacagcctctactacctgacatccatggcgctcaagtgcgcggtggagctccacatcccgaccgccatccacaacctaggcgggtctgccacgctgccggacctcgtggccgcgctgtccctgccagcggccaagctcccgttcctcgggcgcgtgatgcggctgctggtcacgtcgggcgtcttcgcgtcgtccgacgacgtgcagtaccggctgaacccgctgtcctggctgctggtggagggcgtggagtcggaggaccacacctaccagaagtacttcgtgctgggcaccgtctcccgccactacgtggaggccggcatgtccctggccgactggttcaagaaggaggaggacgaggaccgccagctgccgtcgccgttcgaggccctgcacggggtgcccctcgtccacgagagcaccaagctgctggacgaggagctggacagggtcgtggaggaaggcgtggccgcgcacgacaacctggccatcgggaccgtcatacgggagtgcgggcgccgacgtcttcagcggcctccgctcgctcacctactgctgcgggagggcaggggaacgccagcgcggccgccatcgtcaaggccttcccagacatcaagtgcaccgtgctcaaccttcccacagggcccgtccaaggagacgacgaccaaagaccatcaccatcccgccctgcgcaggctgtcatgctcaagctc

SEQ ID NO: 15870 - DNA, 864 bp, Zea mays
tggggcgctcgggccggccggccgggccgggaggcacaaggaagaacgaagagagatcagcgacttaacaacaataatggccaccgccatagttcccacggacgccgagctgctgcaggcgcaggccgacctgtggcgccacagcctctactacctgacatccatggcgctcaagtgcgcggtggagctccacatcccgaccgccatccacaacctaggcgggtctgccacgctgccggacctcgtggccgcgctgtccctgccagcggccaagctcccgttcctcgggcgcgtgatgcggctgctggtcacgtcgggcgtcttcgcgtcgtccgacgacgtgcagtaccggctgaacccgctgtcctggctgctggtggagggcgtggagtcggaggaccacacctaccagaagtacttcgtgctgggcaccgtctcccgccactacgtggaggccggcatgtccctggccgactggttcaagaaggaggaggacgaggaccgccagctgccgtcgccgttcgaggccctgcacggggtgcccctcgtccacgagagcaccaagctgctggacgaggagctggacagggtcgtggaggaaggcgtggccgcgcacgacaacctggccatcgggaccgtcatacgggagtgcggcgccgacgtcttcagcggcctccgctcgctcacctactgctgcggcaggcaggggaacgccagcgcggccgccatcgtcaaggccttcccagacatcaagtgcaccgtgctcaaccttcccagggtcgtcgaggagacgacgaccaagaccatcaccatcccggcctgcgcatggtgacatgctcaagctcgacctgcacttctggagcg

SEQ ID NO: 15871 - DNA, 859 bp, Zea mays
  misc_feature (781)..(781): n is a, c, g, or t
gggtacctcgcggccggccgccccgcgaattcccgggccgggccaagagagatcagcgacttaacaacaataatggccaccgccatagttcccacggacgccgagctgctgcaggcgcaggccgacctgtggcgccacagcctctactacctgacatccatggcgctcaagtgcgcggtggagctccacatcccgaccgccatccacaacctaggcgggtctgccacgctgccggacctcgtggccgcgctgtccctgccagcggccaagctcccgttcctcgggcgcgtgatgcggctgctggtcacgtcgggcgtcttcgcgtcgtccgacgacgtgcagtaccggctgaacccgctgtcctggctgctggtggagggcgtggagtcggaggaccacacctaccagaagtacttcgtgctgggcaccgtctcccgccactacgtggaggccggcatgtccctggccgactggttcaagaaggaggaggacgaggaccgccagctgccgtcgccgttcgaggccctgcacggggtgcccctcgtccacgagagcaccaagctgctggacgaggagctggacagggtcgtggaggaaggcgtggccgcgcacgacaacctggccatcgggaccgtcatacgggagtggcgggcgccgacgtcttcagcggcctccgctcgctcacctactgctggcggcaggcaggggaacgccagcgcggccgccatcgtcaaggccttcccagacatcaagtgcaccgtgctcaactcttcccaggggntcggtcgaaggagacgacgaccaagaccatcaccatccccgcctggcgcaggctgtcatggctcagctcgtcctgcac

SEQ ID NO: 15872 - DNA, 2058 bp, Zea mays
ctggcaagcgcaaggccactttcacccggcgacctgctcatctccaaaggcggcgtctttgccctcggtttcttctccccgtccggctccaacaccagcacgagcctgtacgttgcgatctggttccacggcatccccgagcgcagccgcaccgtcgtgtgggtcgccaaccgcgacagcccagccaccacatcgtcgtccccgacgctcgccatcagcaacagctttgacctcgtgctttcggactcccagggccgcactctctggaggacgcagaacgccgccgccgcggccgtccacgacagcggcactcccctggccgtgctgctcgacacgggcaacctgcaactccagctgcccaacggtacggtcatatggcagagcttcgaccacccgactgacaccattctcccaggcatgcggttcctgatgatccacggggctcgccccgccgcgcgcctggtctcttggagaggccccgccgacccgtccaccggaggcttctcgttcggcctcgaccccgtcaccaacctccagctgatggtctggcacggggccgagccgtactgccgcatcagcgtgtggaacggcgtgtcggtgtcaggcggcatgtacaccggctcacctagctccatcgtgtaccagaccatcgtcaacaccggcgacgagttctacctcacgtacaccgtctccgacggctcgccgtacttccgtatcatgctcgaccacaccggcacgatgaagctcctgagctgggacaccaactcgtcgtcctggacgctcatctccgagcgccccaccggtggctacggcctctatggctcctgtggccccaacgcctactgcgacttcaccggggctgccccggcgtgccagtgcctcgagggcttcgagcccgtcgccgccgatctcaactcttcagaaggatgccggagaacggagcctctgcagtgcagcaaggcaagtcacttcgtggccttgcccgggatgagagttcctgacaagttcgtgctcctccggaacagaagctttgagcagtgcgcggctgagtgcagcaagaactgctcctgcaccgcctatgcttacgccaacttgagcagcagcggtgccatggaagaccagtcaaggtgcttggtttggaccggggagcttgtcgacacctggaaaagcatcaactatggcgagaagctgtacctccggcttgccagccctggtacgcaccgtttcatcctgtgctgttcagatttgttgagcagaggaacagtttctccaatgttggcacagatattcatctagcaatgaaacggaagacaccataatgagaaatgtacactcagaattgaattttcattgatttgatttaaagaacacaagcattttaagtctaataaaactgaatgacattagagcatttctagaagataacattacaactcccccaatggctcgtagagagattttcctacttcgaatggctctgtttacttcacttatcactagaatgaaatgacatctgaaataaaaacaaacaacgacagatatagctcttctagttaattaattactcagtacattctaacaagtttcactttggcagttaaaaccaagagcaatatagtaaagattgtagtcccggttgtagcatgcctgctgctacccacatgcatagcccttgtcttcctatgcaaattcaaaggtacaacattaagcggcttgttttcaacgtgtaatgtgattgtgtatatgaaaagaaaagtatcaatgtcccaccagcagggaaatggcaaaagaagggaattcagaagaaagtgatgttaggatacttgagcacctccaatagactcggagacaaaaatgatgaatttccatttgttagcttcaatgacattgttgccgcaaccgataatttctctgactgcaatatgcttggaagaggaggctttggcaaagtttacaaggtaatgacagatttaacataatatgcattaaagaatttctaaagcagaagaaagaattttggatttcatcgttttcacatcagaaggatgcaatcatgca

SEQ ID NO: 15873 - DNA, 3638 bp, Zea mays
caatctttcatgctatgcctttatgtggttatatgctttctagctactaactgtagcatatttctgtatgctgggtacaggtaatgtacatggtttgggagtggaagccttgcagatgctcactcagatggtgctcagcaatgaagaagagctcaagatcaaatatttcaaggatgactccctgaacagactttgcccagttgatgtttttttgaaggcaatgctggatgttccatttgtgttcaagagagtagatgccatgctttacattgccagcttctatttggagatcaatcggctgagaatgtcgtatgctactcttgaggtaatgccatgttctttatggaatacaacatagttatactgggcagagattgcttctgctgaaatgatatctaccttcttttgactatcatgtattcatatctgaatgtttcatccatgttgtttattcatctagggggcttgccaggagatgagaagcagcaggctgttccacaaagtccttgaggctgttgtgaatttcggcaatttcatgagcaccaattcggggtctccaagttcaaaaggcttggagccaaacactgttctgaagatagctgatgtgaaaggagctgatgggaaggctgctctcatgcagttcattgtccaggaaattgtgaaacctgaaggatatgatgtgatgcagcatggttcaggtgcatgcaagatgagcacaaacactctgcagtgtgatgccgagtgcaggaagcatggccttgaggttgttgccaaacttgcagcccagctgagcaacaccaagaaagccgcctccattgacataaaaaggctgagccaaagcgtgtcagagcttggaatggggcttgggaaggtccacgacgtggtgaggctgaacagcatggttacatctgttgatagcgctcggcgtttccacaatagcatgagcacattcctaaggcacgccgaggaggagatcctgaagctccagtcccaggagagcatctgcttgtcatcagtgaaggagatggcggagtggtttattggagagtcagtcaacgatgaagctcacatgttcagaatctttgctggagtgaaggagttcctagctatgctcgatcatatctgcaaggaggctggggaggtgagcagcaacaattgggtcggcgcgacaacggcgagctggatggctgcacccatggggatgatgccttaagccgctggagctgtcttggcaaaatctgtagctaccctttttgtagaatatttcatatcaagctatttggactagtatggttcctagtattagcagtagatgagaacgatgttatggtatgttaagccgaagcctctctctatataaatatatctggataatgtatgctggacacccgtctattgtaaagtttactgttactggtaatggggtttgccgtcctttcctgaatgctgctacagtcttcttgtcaatggagtagcctgctactccaactccattggggccctgcttctaaaattctgatagtggatgtcggtcagaattttgtgtgatgacatgatcttttatttggtttgggatctgggcaatagacgaataacttttttttttacgtgcttttgatctgcaacagcaggttatgctgttggtttgtatcgcagtcagtttctgaagtcctgaagtcgtcttcctccacctcgaagcaaaccagcaagcagtgcgaagttagtcgccggccggcagcgtccccctcgccccccaagtccctagtggttgacactgacagaggtctgcagagactagcggcgatggcgccaccctgccccgaaccctaaccccactccaccaccggccatgggatcccagccgccggcctcccgcgcggccctggagcacctcgctacgcttgaccccgccgcactcgccggcctccctgtctcctccccgctcaccgtccgctccgccgccgtctccgcccacctgctctatctcggcaccggcggcggcaagctgctcctcttctccctgcaggatccctccactcctgagttcctccgcctcctccccatcggcgccaccctacccgtctctgctatcgtcccgctcccctccgtcgcccgcctcctcgtcctcgctgacggcctcctcctcctcgccgacccgctcctctcgcgccccgtccgccgcctcggctccctgcgcagcgtcaccgccgtcgccgcccgccgcgtcgtcctcgcggacccatcatcatgctccgtcgccatctccgtccggaagaagctgctccgtgtcgacttcacgctgcacgacgccgacgagctggatgtacagacgcgcgagatcgcctcagtcgagggggtcaaggcgctcgcttgggtcgacgattctgtcttcgttgccactgccactgggtactccctctactcgagcaccaatggtcagggtgtggatatattctcgctcccagaatccgccggtcacccaagggtgaagccgctctctggaggtgacgaggtgatgctcctggtcgacaatgtcggtgttgtggtcgatagatttggccagcccgttggaagcagcttggtgttcagcaccacgcccgactacatagctgaggtattcccctatgtgattgttgctggggactccaaggtcgatgtgtacaggaggaggaacgctgcacacctacagaccattcggttgccaggactggtcaaggcgttctgattgtggctggggatgatgatgggatagacacggagctagttgtgatcgctacaacttataaggtaacgtaggtacctcaactcgtgagttattcattccaacttctgtttccattttcttttagtgttatgtgctgccataactgatgaaaggaaatgattttacattgcttcctaagtactccctcttccaatttataggacgttttagctgttctaaatacattacttttattatgtatctagacatatcatatatctaggtgcatagcaaatgctatgtatccagaaaagccaaagtgacctataatttggagagggtggtagatgtagtctcccaagcacaaaggactatatgatcaggaaagacagcctagatgaatttggcatgacttgatagctaaagggtgtatacaactgtggttgccctttactttacttttacaaggacggcaggttaccttgcaaaatcataatgtttgtatatatactagttataagttgcataaataaggctggcttttacacttgtataatttgtacggtgtgtattatctaagattctaaaatgtaaaggaaaggcatcacggtagtggaaacagagaatgtttagtctgactctaatttacgcagattatagtcatgttacactgataatctgatataggaatgaattcgtttatccaggtcttttgctaccgtaaagtatctgcattggagcagattaaggcatctttacgaagaaagaactacaaggaagctatttctttgctagaagagtttgagtcggacggtgaaatctcaaaggatatgatctcctttgtccatgctcaacttggttttttattgtttttcgacttgcgtttcgaggatgctgtgaatcatttcttgctatcggagactatgcagccaaa

SEQ ID NO: 15874 - DNA, 2257 bp, Zea mays
accgagacccagccctcctcctccggcgacggcagcctcccgacgttcccggccaacatctccaccctcgtcgccccgaccccgcgcgcctccggctcccgccgcttccccgtgctccagacgctgctgctctccttgctctccctctgcctcatcctcctctcagcgctcctctccatccacctcgtccgccgcctccgccaccgtggtggcgccgcggcatcctccccctccgctgcccagcgccgctccgcaagtaaccaccaccaagacgacgacaacgacgacggggacgaggagggccgcagcctcaagccgccaccaatgcccacctcctccactaaccccagcactgagttcctctacctcggaaccctcgccaccccgccgccgccggggccgcagcaccccgggacaagttccagtctacgccctggctcgccggagctccgccctctgcctccgcttccgcgcgtcggcccgccgtccggcgagttcttatcccgcagctccgcttccgaccccagcaccgtgcctcccgccgccgctgccgatgcctcgtcgtcctcgctctctccctcctcgccgtcggcatcctcgcccacgctcggctctagccccgtccatttccgcccgccgaccatcccccagccgcgtggccgagcccccaatccctcgccgcctaaacggaggccgtcgccgcccaagggtgctgcggagccagtggcggcgcacgggtggaaccccttcgtgccgctgccgccgcgaccagctgtggcttcatcagatgatggtgactctgatcagatgatggacctgcgcaagtcgcggcctttgcactcggacaagctcaagcccggctctttgcacatgaaggacgaggtgatccagctatacctcaacaattcggcagcagttgcggcgccaagggaggtgtgtttgcttggtgccctcaggtgtcatggcatcgggatgattgtgggagcattgggagtttccaaggagcaactgaaggatgcgctcttggaaggtaatgtacatggtttgggagtggaagccttgcagatgctcactcagatggtgctcagcaatgaagaagagctcaagatcaaatatttcaaggatgactccctgaacagactttgcccagttgatgtttttttgaaggcaatgctggatgttccatttgtgttcaagagagtagatgccatgctttacattgccagcttctatttggagatcaatcggctgagaatgtcgtatgctactcttgagggggcttgccaggagatgagaagcagcaggctgttccacaaagtccttgaggctgttgtgaatttcggcaatttcatgagcaccaattcggggtctccaagttcaaaaggcttggagccaaacactgttctgaagatagctgatgtgaaaggagctgatgggaaggctgctctcatgcagttcattgtccaggaaattgtgaaacctgaaggatatgatgtgatgcagcatggttcaggtgcatgcaagatgagcacaaacactctgcagtgtgatgccgagtgcaggaagcatggccttgaggttgttgccaaacttgcagcccagctgagcaacaccaagaaagccgcctccattgacataaaaaggctgagccaaagcgtgtcagagcttggaatggggcttgggaaggtccacgacgtggtgaggctgaacagcatggttacatctgttgatagcgctcggcgtttccacaatagcatgagcacatttctaaggcacgccgaggaggagatcctgaagctccagtcccaggagagcatctgcttgtcatcagtgaaggagatggcggagtggtttattggggagtcagtcaacgatgaagctcacatgttcagaatctttgctggagtgaaggagttcctagctatgctcgatcatatctgcaaggaggctggggaggtgagcagcaacaattgggtcggcgcgacaacggcgagctggatggctgcacccatggggatgatgccttaagccgctggagctgtcttggcaaaatctgtagctaccctttttgtagaatatttcatatcaagctatttggactagtatggttcctagtattagcagtagatgagaacgatgttatggtatgttaagccgaagcctctctctatataaatatatctggataatgtatgctggacacccgtctattgtaaagtttactgttactggtaatggggtttgccgtcctttcctg

SEQ ID NO: 15875 - DNA, 732 bp, Zea mays
acggcacccggtcgctgtcaccgtcgtcatcttcctcctgtgatcgccccgctccgcttctgcaggccacggctgggcgacaccctgatggcgtcgcctcctcccgtggcgaccgcggggcctcacagcgtcttcgtgtacggcacgctgatggaagaggaggtggtgcgtgtgctcctgggccgcgccccgccctcctcctcccccgcgctcctccccgaccaccgcaggttcagcctcaggggccgcgtctacccggccatcctccccgcccgcgcccacgcggtgagcggaaaggttatccaggggctcaccgacagggaactccatgtgttcgacatgttcgaggacgaggagtatgtgaagacaaccgtcgaggtctcactgactgatgcatcggagaaatcactcgcctacgcctacatatggggtaaccagggtgatcctgacctctacggggaatgggattttgaggagtggaggaaggtgcatttgaagtactaccttgagatgactcgggaattcatgctggaactcgggcaattttaaacacttctctggtttgtaactacacaggagtcagaggatccttgcaaaactaccatagaataatttgtgtcttgtgctcgacgagttcttgctactatgctgctttgggaacatacacatgttatttgagccatttagtcatttggatgtgaacaaatcgattcttcaattctgcccgccgcc

SEQ ID NO: 15876 - DNA, 5604 bp, Zea mays
atggataccttagagacactgctgatgttgctgcggtgttgatgagtaacgaagttgaggaggatgagtaatatgtgatgattttacactactttcactacactgagacattcttcttccattacactgcttatctaatagtaatcattcataattttctactcgcatattatcgatctttgttgaacgtggtagatatgttagtgggtactgtacatattttccaacccggacatatagttgagagaatagagacaaaaacacacataaaattggttttaaatatatggctcatctatacaactacttaggctatggtcaacagattatgtatgtggccgtgtaaaacaatattttacaatttaaaataggagatgataatgactaaaagctatcgaagatagccttacaagtttagataggaggcaagctacatgcgctgtttgttttagcttctggtcaccagaatcggcttctgatagccaaacactttgcttctcagcctgtttatgtgagaatcatttccgtcaaaattgtccaacaacgtgaatacaaaaaatgttaagtcgtcctagaccatcatctttcttcatgcgacatccaaattcttatgacaaatagattatttagaaatatagactctcaccaaaacatttcagaaaaagttgtcccaacaggtgcatagtatggtagaaacgcgctagaacgatgaagcgtaacagtgagtgctgcaatgcaaatgttaacagaagttttgtataacactagccgtccgactcactcaacaacacaacagctacaactacaaacgcctgctgcaggccgcttccttcccctgcctgctgtctactcgcggataattttgcaggtaacctctcgtctctcccgagcacagcaaatccatcaatccaacagaccaacacaaacccaacctgcccccggccgatcgcgcaaaccctagcgccgtcgcctccctctcggttctacaccgtcctctccagcctcgcccgcgtgcaccgcagatcaggggacgtacgtcgcccgcgcgcaccgcagatcaggcaacgtacgtcgcccgccggagatcggaattctgtatttttttccttctgtgctcgcggctgctacggcgatggcgggcggcgggagcaggcgcgccggcgcggcggagcagccgaagatcggcagcggcaacgtcttcgccgcgctcgagacgcttaagaagaagaagaagccggcggacaagggggccaagcccgccgccagggaggaccccaagccagaggtcttctgggcgcccgcaccgctcaccgccaagtcctgggccgacgtcgaggacgacgacgatgacgactatttcgccaccaccgcgccgcctcccaggcccgtctggggggacgcccaccgcgacgctgccaaggaccagcacgacgcgcccgcactggaagaggtccatctcgcctgaatttcatcccgttttctttctcttttcattgagctttgtggatagctgagtctcacaatgcgtctttccaggattttcttttctttttattgttatactaagtctatgtttatgttttatatatgtactcttgatggtggtatgtagaatgatcttgaagacaattgcccgcaggtgctaattttagtatcgtcttcgagtggtttcatggaataagatctgcctagtgggtcataggtatcttgcactgagttggatgttgaatgataagactatgttgtcgatatcggttatccaaacattgctagccattatatcctggggacatttgaattaacggtttacacagaaagcaactaatagattgtggtttcagattactagatttcgaagaattataatccttggtacatgaaccgacatgttaaatttctatcaaaattcctgctgttatagccataacatcgtaaggttagttgataattacgcacatacgggaagtcaaaaaatagaagtttgacgttaatggaaatggggatacttctcttttcggaaaaagagcttaagaaggtcatcggatagggaatcaacaacacgtggtgggctctatggtaacaaaagcaactttcaatgtcctaagaaatctagaaattcttatgcttgctgctgtaatcgtggcattgtaatgcttgcttagaattgcacagatattggtagtggagaagtttgtgatacaaataaataactctataaaaaccacagaatcagatagggaacaagcaaagctagtgggctccatggacacaaaagcaaatcagtgtccttgggcagtcaagctctagttacagatagattggattgctggattagtgccacctgcctactttggatatgcaactaaaatatcttcacaagggtatacacttttatcttagcatgtggccttattgattccttgattcttgcctttttgttagtaccttcagaaatctaaatgctctactgcatatgattttaatgaaaataaagcaggttgaggaaacaactttgtacacattggttactattatgaaatagtgtctgtgtctctcatccatattgtttgaccatttgtgaacattgctgtcttattgtgatattgtcgattgtgtctagcatctgctactatgttatctagaaaagccaaaacctcttataatttggaatggagggagtgtatgttgtcatgctagatgtttggtttagggcatcataaaaaagccactactgggttgttcttgttcttttttcaaaatagagcgctgctacacgtacgactctactggtagactcaggtatgacttgtgtcatctaatggcttattattcattagttcagaacaagaggcaacaacagatgtagattaatgttggtcttactcaagttgtacgggtgggtcatatgtaaaacatttctgttcaaaatatgttgttggagcatattgttctgcatttgttaagtacttttgccttccatttcatacatcgactgagcttattttgtcaccttttcatgcgttccagtttagatctatattatgtcatattcgtacctgaatatactatgttctctctctaaatgcttcttccacattgcaggagattgagagtgaacatgatggccttgatgatgaggttgatgatgacgctgatgaggaccatgaggataaagcagatgatgctgtccctgctgaaccaaccgcgaagaatgcgacagctccacctgcaccacccaaagatactgaaagacaactttccaagaaggaattgaagaaaaaggaactcgctgaacttgatgctgttctggctgagttgggccttggcacatcaaacaattccatacaagaggaaccccatggtaagttctaatacatgctgttctctctctctcgaaagaatttaccttcaggaagatttccatgaaaactgaagaaactcaatttggttgtgttgatgtcttcctgattggccatgttggctcaagatttgccagtttctttatgatgatgctgaatcttctgttgcaggtaagaaaggtgcagatcaagttgcagatggagagaaaaaggaagatgcacctgctcctctagaaagcaagaactcaaagaagaagaaatctaagaaagaaaagtcttcaaaggagctaaaggaagcgcaggatcaagccaatgggttggaagcagcagctgttgcagaacctgatgaagatacagcctctgtggatgtcaaggagcgcataaagaaggtagcctcgatgaagaaaaagaagtcaagcaaagagatggacgctgcggcaaagattgctgcatccgaggccgcagcgaggagtgcccggcttgccgctgcaaagaagaaagagaagagccactacaaccagcagcctgtgcggtgaactcccctgatctgaggccgcagcgaggagtgcccggcttgccgctgcaaagaagaaagagaagagccactacaaccagcagcctgtgcggtgaactcccctgatctggtgtctctagaaaccttttgagctctgatgtcccctgttcgttttggacctgcaataaaacttttgagactgttttttgacatggtggaggtgccgtctgatgctcgttttgggaattaaattacatataggtacataggggttgtcttgtcgctggattctgtttggtgtaatgagctatgaactgttcgtcaatcgtcatatgaaccctgctgactatttatatggaaaatgtgggatatttgatacctaactaatccgccctggatgttgcatattgttcttcattgtgccatagcattgatttcccttgtacaggttttacatgtccttggctggtttggcctgcgcgactcggcgcggccgcggcccggccggtgtgtttggattattatctccacgagggtatgttggtttcctaatccatatgactgcatgggattggttggatttaaatccctagtaagttaaaatcccttctaatatatgtcaatctcttaatttatatagattacaaataaccgaacaagcgggtatgttggtttcctaatccatatgactgcatgggattggttggatttaaatccctagtaagttaaaatcccttctaatatatgtcaatcgcttaatttatatagattacaaataaccgaacaagccttgagtggttgcctgagggttgcctggaaacagaggttccacaggcgttcgattttttttagtattaccattacattttctatatatcacatgaataaaccatgttttaataaaacacaaaaatatatgttctattgattgagtgtaaatgtagagtgaaaaaaattaaattttacttgtgcacaattttatcttatttttttataaaacaggaaaaagggtgacaatgatcatagaatagtgaaaattggcattttatatagtagagattttgtagctcgtttagctcagtttttttcgtgcaatctttcgccaactctggttgccaaattatacctttttctcgctttcatcatggtgaagcccctcactgtcaaacaggtctttaccttcctacttattttgatggaaatggtaaagtattttagggatggagagaaattttaagaagagatctgccagaactttgttttctctcttcatcctcttcatacaggaacataagtgaatatttgttttatgtgaacgtatcctatgcacataaatgcaacacacacggaaacctcggactgctcgttgtctacgcaaaacaatcgttcattctacacatttggaaaatgacaaaagaacaatacaccaagcatatgcaacagagtgaacataagtccaatagaaagtatacacaccaaaagtgaaatctaggttctagggtagactaatacacctagaggtttgtggttctctaagtactgcctatctcagtggattacatagcttaactatagctatcttaatgaattaccaaagttattccaggggtgggatcatatattaaatgagattaatttcacaaagttaaccacttaactattcattggtgtttcctttttattttccttttaataaataatccatcacttaaaatgaacctattgtctact

SEQ ID NO: 15877 - DNA, 1734 bp, Zea mays
gcacgagaccattacctagaacatcctaatcaaaaacacaacagctacaactacaaacgcctgctgcaggccgcttccttcccctgcctgctgtctactcgcggtcgcggataattttgcaggtcacctctcgtctctcccgagcacagcaaatccatcaatccaacagaccaacacaaacccaacctgcccccggccgatcgcgcaaaccctagcgccgtcgcctccctctcggttctacaccgtcctctccagcctcgcccgcgtgcaccgcagatcaggggacgtacgtcgcccgcgcgcaccgcagatcaggcaacgtacgtcgcccgccggagatcggaattctgtatttttttccttctgtgctcgcggctgctacggcgatggcgggcggcgggagcaggcgcgccggcgcggcggagcagccgaagatcggcagcggcaacgtcttcgccgcgctcgagacgcttaagaagaagaagaagccggcggacaagggggccaagcccgccgccagggaggaccccaagccagaggtcttctgggcgcccgcaccgctcaccgccaagtcctgggccgacgtcgaggacgacgacgatgacgactatttcgccaccaccgcgccgcctcccaggcccgtctggggggacgcccaccgcgacgctgccaaggaccagcacgacgcgcccgcactggaagaggagattgagagtgaagatgatggccttgatgatgaggttgatgatgacgctgatgaggaccatgaggataaagcagatgatgctgtccctgctgaaccaaccgtgaagaatgcgacagctccacctgcaccacccaaagatactgaaagacaactttccaagaaggaattgaagaaaaaggaactcgctgaacttgatgctgttctggctgagttgggccttggcacatcaaacaattccatacaagaggaacccaatggtaagaaaggtgcagatcaagttgcagatggagagaaaaaggaagatgcacctgctcctctagaaagcaagaactcaaagaagaagaaatctaagaaagaaaagtcttcaaaggagctaaaggaagcgcaggatcaagccaatgggttggaagcagcagctgttgcagaacctgatgaagatacagcctctgtggatgtcaaggagcgcataaagaaggtagcctcgatgaagaaaaagaagtcaagcaaagagatggacgctgcggcaaagattgctgcatccgaggccgcagcgaggagtgcccggcttgccgctgcaaagaagaaagagaagagccactacaaccagcagcctgtgcggtgaactcccctgatctgaggccgcagcgaggagtgcccggcttgccgctgcaaagaagaaagagaagagccactacaaccagcagcctgtgcggtgaactcccctggtctggtgtctctagaaaccttttgagctctgatgtcccctgttcgttttggacctgcaataaaacttttgagactgttttttgacatggtggaggtgccgtctgatgctcgttttgggaattaaattacatataggtacataggggttgtcttgtcgctggattctgtttggtgtaatgagctatgaactgttcgtcaatcgtcatatgaaccctgctgactatttatatggaaaatgtgggatatttgatacctaaaaaaaaaaaaaaaaaagacgcggccgcgaaaaaaaaaaaaaaaaa

SEQ ID NO: 15878 - DNA, 1669 bp, Zea mays
acctcgaggccggccgggaccggaatccaacagccagccaaccaaccaaccagaccagggatggatggtgcgcaccaagaaagggggcaccgccccgcgcccccggccgggaagaagagaggtaggatttaggcacggcacctatagcccctgacgagagagagagggagagagatttggtcttggataagagtggagagactggagacgggtgggtggagtgagagaagtcactcggggagcctccagattctgaatctcccgcaacccgtctcatcgccggagtggagttccaggcgagtgattatcgagccagtaagccatttgcaagcactgaactgaaccctcagagcgttgttgcgatggaccaaatcgctacccccgacgaaacagcacatgcctctgcaccttcagttcataagctgtttgatgctaaattaggccaccatagcgtgatggatggcaccttggcatccacgagtcagtcatcaaacatcaagacccagctgatccggtcatcaagcttgtcaaggagcatatcagttaaccttgagaagaggagccctgaatctgatcctgaaagcccacagtctcacgtctcgcatcctaaatttgcagaacccatgttctcgaattcttcgacgttctgcacaagcttgttttcgtcatcttcgacaacagagccatgccgtcaaatgggcactttacctttcctgcctcacccccctaagtgtgagcagcaggtttcagctggtcactcatcgagctcctctctgcttttaagtggtgataccggtttagatgtggctgaacagtcagatgatctgaacgacttgctcaatctttcgggagatgcttctgatggcagcttccatggagaaaacaatgccttagcttttgacgaacagatggaatttcagttcctgtctgagcagctagaaattgccatcactgacaatgagaagaatcctcatttagatgtaagttaacctagccccttaaccactgccccactataatttgaccatcaatttgggttttgcagcacaccagatcctttgttccagtttctttctagattttgtatggtgatattcctctgacacaatgcttttaggacatatacggcacaccaccacagctgtcatcacttccagtatcatcttgctccaatcagaatctagggtcaccagttaaagtccagcttagctcatctcagtcatcttctagctctgcaacagctaacaagtcaagattgaggtggacacttgagcttcatgagcgttttgtggaggccgtgaaaaagcttgaaggtcctgaaagtaagttggtcattctgctttatctctcacatgttttcaggttatcttaataaatagtttgttcatatatttacagaagcaactcccaaaggtgtgctgaaactaatgaaggtagaaggtctaacaatttatcatgtgaagagccatctgcaggtatacaattgtgtccgctgaaaaattaattctcccttctatgttttcattaacttacattttctcgcatatactcttcgtatagaagtatcggcttgcaaaatatattcctgagcctaaagacggtaagcttaaattacctactcactgtatacttctttataatagcactttttttctgaaaagaacaaaca

SEQ ID NO: 15879 - DNA, 1510 bp, Zea mays
aaccgcgtccccaacgcgactctgcctccccccgccgcccggcagacggtagagagtcgaacaatcgccggctcgacgcccctcttcccgacgccgcacgccttcactgtcctcggcagccgatcttccagagcggttcgacaccgtgctcgccacggtcgacatcactgccgccgccgccggaaagttgggccgccgccggaaagttgagcatcgctgtcgacctctttctccccttcttccacccaggaggcaacatgtcgacgctcgccgctgagagagcggataacttctactatccgccgcaatggagccccaagaagggtgggctgaacaagttccatggccagcatgcgctcagggagcgagcgaggaagctcgaccagggcatcctgattataaggtttgagatgccttttaacatttggtgtggcggatgcaattccatgatagcgaagggagtaagatttaatgctgagaagaaacaagttggaaattattactctaccaagatatggagcttcaccatgaaatcaccctgttgcaagcatgaaattgtcatacagacagacccaaaaaatactgaatatgtcataatcagtggggcccagaagaagacagaagattttgatgttgaggatgcagagacattgctgctgccagcagatgaagatcgagacaagcttgcggatcctatgtatcggcttgaacaccaggaagaggatcttcggaagaaaaaagaagctgagccagttttagttcgccttcagcgactctcggacagccggcactctgatgattatgccctgaacagagcactccgcgatcgtcttaggagccaaaaaaagagagttgctgaagagaagaagtccgcgagaaagataggccttggtgtgcggctcttgcctccctccgcagaagatgccaccgcagcggcttcagtgaagtttgcatcgaaatttgagaaaagcagaagggataagagggccgcaatcaaagctgcctccatctttccggagtcatcaagctcagcatcacatggtaaacccgacctcgtgctgaagaggcggaacataaaagctggagccgctacagcactgatggcaggcagggtgaagccgtcctcgtggcagagcgccagttccacgagctcaaggactcggatgcctgttctggcagcacgcaagtaggcagctcgttgcctcaggctttgtgtgggaaatagggggcttgtgaaatatggacttgcccgtaatattgctatgtttctttggttgtactatactcacaaatatgacaccgttgacttttttcaaaaatttgaccactcgtcttatttaatttttttttcaaaaatgttaaattttaaatcaaacacaaactaccaaacaaattaaaaaaaataaataataacttattatttttttaaataagacgagtggtaaagtttttttataaaaaaataacggtgtaatatatttatgaatggtagtacttttacggattgtct

SEQ ID NO: 15880 - DNA, 2349 bp, Zea mays
attttgctttttgccttatttgtgctaaaatgtgaccctactttgtgggttccattgtaatttgatgtataataataagatcctttgttctattgtgttctgtcttcttgcatatgtttgtttttttttctcccagaaaaaaagtcttgtgaggtacaaaatgttttatgcagtagctttgttatgtagaatcatttactaaagtttgtgtagtagttctgtagaaggattatatgccagtagaaagaactgtcttaacttcttggtacagccttagtcatatcacaggataaggtccgcatgttatatataatacattactaataaacttagtttgttctcttctgagacctgagaaattcttaatgcctagaggttgccatatgtttctgttgtttaatttcacacattcttctaaatcaatttctccctatgttgttctgacattgtttcgccaaattgttatttgccagatatggagcttcaccatgaaatcgccctgttgcaagcatgaaattgtcatacagacagacccaaaaaatactgaatatgtcataatcagtggggcccagaagaagacagaagattttgcggacgcgtgggcagagacattgctgctgccagcagatgaaggttcaatcctgtaaaggatgatttcaatcatgagaaacccttgtttaaaatgcatgatgtttatttactgatttttcctcagatcgagacaagcttgcggatcctatgtaccggcttgaacaccaggaagaggatcttcggaagaaaaaagaagctgagccagttttagttcgccttcagcgactctcggacagccggcactctgatgattatgccctgaacagagcactccgcgatcgtcttagggtcatccaatgaattcctataaattgatcaactatttccaccataggccatgcaatgatcacatttcttattcacctgtttgtgtttttatgtagagccaaaaaaagagagttgctgaagagaagaagtccgcgagaaagataggccttggtgtgcggctcttgcctccctccgcagaagatgccaccgcagcggcttcagtgaagtttgcatcgaaatttgagaaaagcagaagggataagagggccgcaatcaaagctgcctccatctttccggagtcatcaagctcagcatcacatggtaaacccgacctcgtgctgaagaggcggaacataaaagctggagccgctacagcactgatggcaggcagggtgaagccgtcctcgtggcagagcgccagttccacgagctcaaggactcggatgcctgttctggcagcacgcaagtaggcagctcgttgcctcaggctttgtgtgggaaatagggggcttgtgaaatatggacttgcccgtaatattgctatgtttctttggttgtactatactcacaaatatgacgccgttgacttttttcaaaaatttgaccactcgtcttatttaaagtactttttcaaaaatgttaaattttaaatcaaacacaaactaccaaacaaataaaaaaataaataataacttattatttttttaaataagacgagtggtaaagttttttttttcaaaaaaaacggtgtaatatatttatgaatggtagtacttttacggattgtctaaggggcgtttgttaattagtgttttcattgttttctttacggagttatcactggtattggttgtatataaaaataaattttacgaaggttaatgtgggatggtaccacaaacgtaactttgagaggttctacctatctacccctcgtaatgaacaataaggtgcgtttaatgtatgtcatgacacatcatggtatatttgtatcgtttggtttgaaggacaatcatggtatattttatattagattctgtttggtttaagggattaaagtttagttcctctattttagtatcatttagtccttaaatagctaaaaagtgagattaaaatataaactaaatcgctttagtctttagcaggtatttagtttatagagactaatttttagtccctttattttattctattttagtctgttaagtatcgatgtatttgataatttatggactaaaataaaataaagtgaaggaactaaaaattagtctctataaaccaaacactccttagtcccttaagaggtgactaaaaggaactaaaccttattaatttcatcttctctcatttattttagttgcactaatgacaaataatgttaaggagcattttagtcatcttatgagtcattaactgtattctgaatacttttagttcctgcaaccaaaaagggtagagactaagctttagtcacttaactaaacttta

SEQ ID NO: 15881 - DNA, 640 bp, Zea mays
ggtaccggccccttctcgagttttttttttttttttttttttttttttttttttttttttttttttttttttttttttttttttttggggggatagggaggatcgggtgggcatagcctgataacacataaaattctttggtgggtacctccttaaccaatttttttaaaaaaaaccataacccggctcagtttagaactacatgatccacgcaaaccgggcaaaatcaacatccatgggacatccataggagggggggcaatcattggagccaatcattttcagggggggggaactcgaccatttggataccccttccagaaacagaaaggggggacttcctttttgcccgggcatggaaaacatttagagtttcaggctcgggccccctaatgatagcatgggagtattccgggaattggccggttaatcccattttccagcattttactttttgatcaaggccagtagagaacgaccaagggccgtctggccagattcctttaactggtgcactatgagctgaggctaccttagggggatatagaattttaaggggggcattggcatgcgaatttagccttgctggggttgttaagcaatcctccgaagatattactctgaagttgaagcactgaac

SEQ ID NO: 15882 - DNA, 619 bp, Zea mays
  misc_feature (540)..(540): n is a, c, g, or t
gcaaaacagtgttttgtatgtgtatatgtaggatctgtttgtcatagcctgataacacatcaaattctctgtttgttacatccttaaccaattttttttaaaaaaaccacatacccgtctcagtatagaactacatgatccacgcaagccgagcaaaatcaacatccatgtgacatccatagcaggggttgcaatcattgtagtcaatcatcttcaggtggtgagaactcgaccatttgcataccccttccagcaacagcaatgtggtacttcctctttgcccggtcatggaaaacatctagagtttcaggctcgggcacgctaatgatagcatgggagtattccgtgaattggccggctaatcccatcttccagcatcttactctttgatcaaggccagtagagaacgaccaagtgccgtctgtccagattcctttaactgctgcactatgagctgatgctaccttatgttgatatagaattttaagtgtgtcattgtcatgcgaatttagccttgcgtggggttgttaagcaatcctncgaagatattactctgaagttgaagcactgaacagattgatcatctccaccacttataatgcagtatgacttgtcaggt

SEQ ID NO: 15883 - DNA, 2117 bp, Zea mays
ggtcgcccacgcgtccgcccacgcgtccgattcctcctacctcactggctcactctcgtctcggtttacaaagcctccgccgccgcaagtccactccacccgttgtccaggttagttggttggtttcaatttcgagttcgccgagcgacagcttgcgcctgccatttctcggctccgcgtgccggagctcgttcatctccagcttctccggccgttactcgctctgaaccgacgacagtaccgataaagccccgactcgccatcctccggcgacgatgccttcccgatcggattccgactccctgctggtgcgcgccgagggcatgcgcgacgcggcgctggactaccacggccgccccgccgaccgcggcgccaccggcggctggaggtcggcgctcttcatcatagcggtggagatcgcggagcgcttcacgttctacggcgtgtcggcgaacctgatcaactacctgactggcccgctcgggcagggcaccgcggcggcggcggcggccatcaacgcctggaacggggtggcgcagctgctgccgctgctgggcggggccctcgcggacaagtggctcggccgctaccgcaccatcgtcatcgcctcgctcctctacatcctcggtctgggtatgttggccttttctaccttcctctcctccggcagcggccaccagtgcaccgccgcagggggccagatctgtgcgccgtctggccttaaggtgaccttcttctacgtctccctctatatcgtggccgtggcgcagggcggccacaagccgtgcgtccaggcgttcggcgccgaccagttcgaccagaccgaccccaaggagactgtctccaggagctccttctttaactggtggtacttcggcatgtgcgccggcactgccgtcacgctcgtgctcctcagctacgtgcaggacaacatcggatggggcctcgggttcggcatcccgtgcgccgccatggcagccgcgctcgccgtattccttcttggcactcggacgtaccggtactacgtcactgccgggcagggcctgttcgctcgtgccggcgaggctttcgctgagtggcggagcaggcgcaaggcgggccagcttgttcaggattcccaagaactcgatccgcccgcagcagatgcgccaaggttcagtgctggcgtcgatgtggaggagcaggctgcagtgagaaataatggaggcctcgtcaaggaggccaaggccatcatccgtttgttcccgatatgggcggcatgcctgctctacgcggtggcgtactcgcagtcgtcgacgttcttcacgaaacaggcggcgaccctggaccggcggatcgggcggcacgtccaggtgccacctgctgcgctgcagagcttcatcagcgtcacaatcgtggtcatcatccctatctacgaccgcgtcctcgtaccggtgtcgcgccggtactccggcaaaccatcagggatcaccatgctgcagcgcatcggcacggggatgttcctctcgctcttgtccatggtgatcgcggcgctcgtcgagaagcaccggctccgcgtcgcgggggacgctggcctcgtggacaagccgaaggtcccagtaccgatgagcctgtggtggatggtgccgcagtacgtgctgttcggggccgccgacgtgttcaccatggtcgggctgcaggagttcttctacgaccaggtgcccgacaagctgcgcagcctcgggctggcgctctacctcagcatcttcggcgtcggcagcttcatcagcagcgcgctcgtgtcggtcatagacagggtgacgacggacaggggcgggagctggttctccaacaacctgaaccgtggccacgtggactacttctactggctgctcgccgcgctcagcgccgtcgagctcctcgcctatgtcttcttcgcggtgacatacaagtacaagaacagaggagccgtacatgcaactgttgatggttagcgggaggagtaagtacatagtataggttatggtgcatcgtacttgtaaatctctttttttttcctcaactaggatttgtgatccaaactttaccttcgataatgattcccgttttttatgaaaaaaaaaaaaaaaaaagcggcc

SEQ ID NO: 15884 - DNA, 2125 bp, Zea mays
cattgggtacctccggccgggaatccactcccccccgccgtccaggttggttggtgggtttgaattcgagctcaacgagcgacggcttgcccctgccgtttctctgctcagcgtgccagagctagttcatctccagcatctccggccgttacttgctctgagccaacaacagtatcaaaagccccgacccccccatcctccggcgacgatgccttccggcgacgattccgaccccctgctggcgcccgccgacggcatacgcttcgcggcgctggactaccgcgaccaccccgccgaccgcggcgccaccggcggctggcggtcggcgctcttcatcatagcggtggagatctcggagcggttcacgttctatggcgtgtcgtcgaacctgatcaactacctcacgggcccgctcggagagggcaccgcggcggcggcggcggccatcaacacgtggaacggggtggcgcagctgctgccgctgctgggcggggccctcgcggacaagtggctcggccgctaccgcaccatcgtcgtcgcatcgcttctctatgtcatcggtgcaggcatgctggccttctcgaccttgctctcctccggcagcggccaccaatgcaccaccgccgggggccagacctgtgcgccgtccaccattaaggtgaccttcttctacgtctccctctacatcgtggccgtggcgcagggcggccacaagccgtgcgtccaggcgttcggcgccgaccagttcgatcagagcgaccccaaggagaccgtctccaggagctccttcttcaactggtggtacttcggcatgtgcgccggcaccgccgtcacgctcctgttcctcaactacgtgcaggacaacatcggatggggcctcggtttcggcattccgtgcgccgtcatggcagctgcgctcgccgtattccttctcggtacaaggaggtaccggtactacgtcactgccggggagcggggcctgttcgctcgtgccggcgaggcttttgttgagtggcggagcaggcgaaaggctcttcagcatggtgatcgacctgtagcagagggggcgccgggattcagcgctggtgtcgacgaggaggagcaggctgcagtcagccatgacgcaggcctcgtcaaggagaccaaggacatcctccgtctattcccgatatgggcgacgtgcctgctctacgcggtggcgttctcgcagtcgtcgacgttcttcacgaaacaggcggcgaccctggaccggcgcgtcgggcggcacttgcaggtaccaccggccgcgctgcagagcttcatcagcatcaccatcgtggtcttcatccccctctacgaccgcgtcctcgtgccggtggcgcgccggtactccggcaacccatccggcatcaccatgctgcagcgcatcgggacggggatgttcctctcgctcttgtccatggtgatcgcggcgctcgtcgagaagcaccggctccgcgtggcagtggacgctggcctcgtggacaagccaatggtccccctgccgatgagcctatggtggatggtgccgcagtacgtgctgttcggggccgccgacgtgtacaccatggtcgggctgcaggagttcttctacgatcaggtgcccgacaagctgcgcagcctcgggctggcactctaccttagcatcttcggcgtcggcagcttcatcagcagcacgctcgtgtcgatcatcgacagtgtgacgacggccaggggcgggagctggttctccaacaacctgaaccgtggccacgtggactacttctactggctactcgccgcgctcagcgccctcgagctcctcgcctatgtcttcttcgcggtgacatacaagtacaagaacaaagcaaccgtgcatgcaactgttgttggtcagtcgctttagttcaaaaatgaattagcggcaacaaatattcgagaatggagttagtacatcatcctacgacatagtataggtgatatgacacacaactaaatgtaaatggtaccttttctccgttagggtttgtggtccatacttatctttgattttgattcccatttgtatctgttgggacttgggagggtcaatgctatcattcaattcttaaggcaagggttcatccgt

SEQ ID NO: 15885 - DNA, 1920 bp, Zea mays
  misc_feature (1828)..(1828): n is a, c, g, or t
aattcggcacgaggcctcccccgaggccccgacccccgagttcgctgcgcttccgccttccggtgacaagcgagtgaccgatctaccccgacccaccacccaccgcaccacgcgagccgcgagcgagatctctcggctccagggtaggctcccttctatggatctccgccgcctcgcggtgtttgcggccgccctcgccgccgggtggtggtcccgcggcgcggaggcgtcgatccacacctacgaccgggagcccttccgcgaggtgggcaacgccttcctcctctccggcggcagcgagggcatcgtcgccgacggggcagaccccgccgcccccgcatcctccttcatcaagtttgtgaatgttacattttggagaaccccagaagctgcggaatcacacgcaaaaatggcacatagtacaggcttggtacaggctatcctatttgaagttgtggacagggataacatcgggggatctgcctatggcggacagaggtccatatgttgtaccccagatcttgctaaactagagggctgcaagcaaggggaagtaatcaggaggccatcctctgatgatccagattggcccttcgtgctagacacacacttcagtgctaatcacctttcagtgaagttagaagatgagccagtgcgcattacaaagacaggcatgtacaacttgttcttcatatcctgtgatccaaaactgagaggccttactatgagtggcaagactatctggaagaatcctggtgggtatctaccgggacgaatggcgcctttgatgaaattttatgttctcatgtcgctggcgtatctgttggtaatgattgtttggtttagccagtacgtaaggttctggagggatatattgccaatacagaattggatcactctaatcattgcacttggtctgtttgagatgacactatggtactttgagtacttgaacttcaacagcagtggtgtgaggccagttggaatcacaacttgggtggtcactgttggagctatcagaaaaacagtttcacgtctactcatcctttctatctcaatgggttatggtgttgttcgtccaactttgggaggtctcacttccaaggtgttgctactcggacttacatatttcctggcatctgagttgctggacattgcagaaaatgttggaacaattaatgatatatctggcaaagcaaggcttttcctggtccttcctgatgcatttttggatgcttttctcatactctggattttcacttctctttcccgcacactagagaagctacaggcaaggaggagttctgtgaaattggatatatacagaaagttcacaaatgcattggctgtttctgtgatagcttcagttgcctggattggttatgaggtctatttcaaagcgacagaccccttcagtgagaggtggcagagcgcatggatcataactgccttctgggatgtccttgcgtttgtgttgcttcttgtgatttgttatctgtgggcaccttcccaaagctcgcaaagatatgcatattctggtgaagctgctgacgatgacgatgaggaatctcaatctctgacgaaaggagatggtgcagtaaggatgggaaaaattgaccaggacagaaatgctggtgtcaggaagggtttcggcttataagatgaggctgaggaggacaagcgggaataaccatttcttggttctgatgtcccctaaggcccagaaaaatcgatattttggagaagaatatttggaagaaactttttttcagttacttggggtggtggaaaaaggcttggtattgtaaaaatggcaactctatttaanaaaaaggattaggaattccaacaaaaaacaaaaccaaaaaaaaaaaaaaaacaaaaaataacaaaaaaaaaaacaaaaaaaacaataacacc

SEQ ID NO: 15886 - DNA, 4720 bp, Zea mays
taggggttcccgatccttcctttcccacttccccttttttgcccgaccgctacccaaccgccgccgcggttctcgctgccagcgacggacgggccacaccgcgcaggggctcagccccgccacccaccttaaccccgccgtcgggaggcgtcgtccccggcccggcccggcccggccctcgccctctactgcaactggactggcgcgtagacctgtccccgccacgagatcgttccgccctatgtcggtgaagatgctctttgcatagctcaagctgcaatctgatggactctgatgacaagaagtttggaaatggaccaagggagctcactggtgctgttgatttgatcagccactacaaactgctgccacaccatgatttcttttgcaagaaacctttgccgctggcaatatcagatacacattatcttcacaatgttgtgggagacactgaaattcgcaaaggagaaggaatggagttagatcaacttgttcataatgcatatctgagggataaacctgcttatattcagccctttgatatggaaactctggggcaagcgttccaacttcgagaaacagctcttgtggatttgccttctactgaaaaaggtataccgactatttcgggtaaaccaaaaagtgagtccaaggacaaagagaagaagcataaaaggcacaaagacaaagacaaggaacataagaagcacaaacatcggcataaggatcggagtaaggacaaagataaagacaaagacaaggataagaaaaaagataaaagtggccatcatgaaaagaagaggaagcatgagggaacagaagattcagtagatgtgcataagcacaagaagagtaagcacaagagctccaaaaccgatgagatggggaatggagttagttaacacttcctagctctacctccaatccttgtaatttgctgttaaaacttaaaaggagacagacggtctctgctatcaaaaccctgtgcagaatagtgggtatcatgaatgggagctcttatttttgcagagtccattgtgaagagaattgaatttgttaatataggtctaatccttccaactgtgcaaatcaactgtgttcctccctgaagcattggttgtagggtgcgcttgaaaggatgtgcaatgagattgtttcgatgtaacgtgcatgagtacactgagtagctgtggatggttatacagtttgtggtctagggatgtgcagtgagggcagggaattgggaataatttcgtgcccccatcgaccttgatttgtagggtaggatgatttactgtttaaccactagcaaatgttagtagccagttccatgttcatttactccacggcaactgtgctttcgtgtgccaataaccggagttgatccacatgtaatgaattggtgtcaaattgacgatcctgtgtttcaaagtatggttattggatcgtgttgccaaaaaaaaaaaaaaaagtcacacgtataatcactatagctgacttgctggtacaaatagcaatgggtaaaaatagggtgggtatatgcctggtaactaagaccatgttcggtagttgagtgttggagatagtctaacattaacctgaaaaataatttgtcctgtaaatgagtcaatatattaataaggaaggagaaaagaaataagtgatatttgactttaacttaagctttattacaagtactattaataatgttaggagacgcaagttatgttgattttaagctgaatttaaaactcatggatttgtaggtataggtagtgcaagaataaatttatgtacatacacattggttttttttgaagctattaataaacatatggataaagaaaatagttgaaacctatgcagcaaaatctcatcaggtctagagtggttacccatcgcaaatctctacttgctggtaagctgacttgcactagatatatagccagaaggttgcaaattaagaagcttctcgcttagctgtttagtgtgtacaacaagtccaccagctagtcagtcaagcagggccttttgctgtttaaccgtgttggcaagtgtgcattatattattgctgtctcagcatcatctgtttacttcgtttgtcagtttccaccagctactcgacttcttcatcgcagatataaagtcataaacaaacgtgccacagatcttacaaaaaaaagttccgattattgttgtcatcaaacttcaaaagcctcgatcaaaacagattttcaactcacacgagacacgaacaattcaaccacacccgaagaacgcatacgatccagtagtggatgtaaacgtacgtaacagtagctcaacacacgaaccgaacaaagccacaccacgaacatctgtctgtcagatcatattatccagctcggcctcagggacagggacgagatggtcggccggcaccggcgcccgcgcctgcggcggcgccggcgccgggtctaggaggcgcaggtactgcttgatgctgtggaagcgcaatggctcgagcaaggtaaggaacggcagggggaagcgccctgacccgcctgagctaagcaggcgaacgttggtgccggcgtccgcgtacccgaagaaagtcggcggcagcgtgggcacgacgtcgcggtcgacgatgacgcgctgcacggacacgtggcgctgcccggccacgagctcgtcgcagaacgcctggttgccgacgcggggggccgcgaacgtcacggctctgacggcggccaccaccccgagcgccgccgcgggggcggcggcgtcccacgcggccagcagggccagcgcgccgccgaggctgtgcccggtggccgtgacgcggatcttctcgccggggtgcctgctcctcacgtacgtcaccagccgggtcagctcggccagcacctgggtgcgcgcgctggtccgcatggcgcaggcctcgcagctggacgtgtacaggctctcgaagcccctctccacccgcactgtcccggcctgctgctcgccgtggatcggaacgaggaccgcctgcaggtccttgagcagctcgtccagcgccgacgtgccgcgccacacgaccgcgatgtcgcggtacccgacgcggtcgcgctcggcgtcggtcgcgagggccacgtatccgatccagtgctgctcgtgctggcaaccgtcgtcgtcgtttccctcgttcacgccgtcgccggccaagatgttgacggtggcgtagatgaacgaggtggccacgtagccgctgccgccgaggccgacggcgggcagcatgtcggccagggagtagcggcaggtgccattgtggtcgtcgtaggcggcgtaggcggcctgcgcgagcttgcagtagttgaagacctggccttcgtctgcggccatggtgtgtggcttcgtctacacactctacactagctagctagggcaacaacttcctcttgttctattggcgcgttatcaccatgatacacctaaacacgtatttatagccgcttggcccttgcaactgtatgtatattgtcgcagcgacacagcccatgactagctacatggttgagattcattatattatatactcgtaaaaatggccgtatgttgctacaattttcatttatgtttaattatagagtataaagtacaaagacatgtattctgttagttaggtgggtgtgaacgtgagtttagagccaatgaacaatggtttaaatctctatttatgtagtataattttaattattttatcatttaaatgtgtgggagcacaacgatggtagaagccgtgtaaccgtaaaaataattggtgctttatacagtagaagatatatgctatgaaaattctcaacctcatccaattcaaaatgtgcgtgtaggcattagacaaacaattaaaactgtactaaccactaacccacatatataagtagtaaatgagatgacacatgcatacacacattttgttcggatgaagcctttgatatggtcgtacaaaaaatatgaaacatccacttgttggcaacacgatgactaaatgtgctaataatgtgcatggcagatggaccttagcttgactaatacaaaagcgcgtgacgtactgcacgcgcggtgacaaaaattcataccccggatgtaatttcccccctactttgcatatggtgtaagagcttcttgatagattgtttttgcagaattcatatcctttcacccaccaccctcgtacggccatgttcggttattctcatcatagattggatatgagattaaaaaactgagaaagattttgatttgttaattagggatttaaacacacactcgatgctttccaatctgcacatggattgatatgtatttatagcctcttggcccttggtactgtagtatgtatatcgcagcccagtgcaagctccatcgacgagatactttatatatatccgatggaaattctcaactggttccagtttaaaatgtgtgtaggcattagacaaacacttaagactgtaacccactaattaactctcactagtctaatacattgcgacggtacccaaccagatattgattggacgagcaagcggcacttgagagtttaatggaccatccacataaaaatacccataataaatgaatttaatgtcaaagtgaacatattgtttatataccagatattgaactggtgaaacaaatattacacttgatctcagccaaaagaccgaaaaaatgagtgaaaagaagccccta

SEQ ID NO: 15887 - DNA, 1061 bp, Zea mays
  misc_feature (21)..(21): n is a, c, g, or t
  misc_feature (28)..(29): n is a, c, g, or t
ttgttggagtcggcgcacagngcacagnntgctggaccagtggaccggcgggacaaggaaacccgcgcggtatccggtggttggccattgggcccctcgaggccgcccggcagaaggcaagctataggcgaaacttcgggggtcgtcgagggttctcgaccctcccttcccctctctcgcccgctcgctccctcaccgccggcgttctcgccgccagctacggacggggcacactgcgcagggtcccagccccgcctctcacccgaacgtcttcgctcccctcaccgggtaggcgtcgcgctctactggcaccaccccggccctcgcgctctactggcaccggaccggcgcggggtggcgcggagacctgtcccggccaggagaccgttccgtgctataccggtgaagatgctctttgcatagctcaagctccaaactgatggattctgatgacaagaagtttggaaatgggccaagggagctcactggtgctgttgatttgatcaaccactacaaactgctgccacaccatgatttcttttgcaagaaacctttgccactggcaatatcagatacacattatcttcacaatattgtgggagacactgaaattcgaaaaggagaaggaatggagttagatcaacttgttcagaatgcatatatgagggataaacctgcttatattcagcccttcgatatggaaacactggggcaagcgttccaacttcgagaaacagctcctgtgattttgccctctactgaaaagggtataccgactatttcgggtaaaccaaaaagcgagtccaaggacaaagagaagaagcataaaaagcacaaagacagagagagggacaaagacaaggaacataagaagcacaaacatcggcataaggatcggagtaaggacaaagataaagacaaagacaaggataagaaaaaagataagagtggtcatcatgattctgattcccagaaacatcatgaaaagaagaggacgcacgagggaactggagattcagcagatgtgcataagcacaagaagagtaagcacaagagttcca

SEQ ID NO: 15888 - DNA, 1426 bp, Zea mays
cggcgtccttcttcctcaacgcgggggcttcggtggggccggactttggggacgacgtgggcaatggcccgcactcgttcctgcagggcaacaagcctttccatggactcatgcagctgcccgacctccaaggcaacggtgctggggggcccggcggctcaggccccagcctcttcaacctgagtttctttgctaacaatggcaacagctcggggtccagtcacgagcatgcaagccaggggctcatgaacaataatgaccacttcaacggcggagcaggtggaggcggcgggggttcggaggcttcggaggctgggattttcggcggaaacttcgttggtggtggagatcaagttccaccgcccgggctctacagcgatcaagcctccatgctgccgcagatgtcggcgacagctctgctccagaaggcggcgcagatgggcgcgacctcgagcgcgaacggcggcgctgcatccatgttccgaggcttcgtgggctcatcccctcacgtgcggccggcgacgccgcacatggaacagagcgacgcgaacctaaacgacctgatgaactcgctcgctggaggtggtgtcggcgccggaggaatgttcggcagcagcaacggcgccggaggcccggggatgtttgatccgaggcagctgtgtgacatggagcacgaggtgaagttcggccatggtggcggagacatgacgcgggacttccttggcgtcggcggaggaggcatcgtgcgcgggatatcgacacctagaggagaccaccaaagcagcagcgatatgagctccctggaggccgagatgaagtcggcctcgtccttcaacggaggcaggatgccatgaccgacccatcggtcgagcttataaacaagacataagctcgcgcacagtaagcaagagacttgatcaagcagatgcagtgagaagagtaaggtcatcgttatatagcgtagtagcaatcaatgcaagttatcaactgagtcgcatgagtgagttcatgcatggataaagctggctagcttagctagctttcatcatccgaagggaccttgggtgagagagaggcgtctttctctgactaatggagtaagctagagtgcgagttggacgcatgtgatgacccctttggtcgtggtgggggttggtgttcctgttggttttcccttgctttgtagttggataatctttgttggattaagtatagtttctggtgatagaaccaataaggatgtttgtagctagcttataatgagggcgtgaattgcagcttaatttgcttcactcccctcctattttttattaccttttctctttttgcaaagcaatattctccttacaatgtcattaatcgtgcaagctgaaattcatgctattttcttgtgtcaaaaaaaaaaaaaaaaaaaaaaaaaaaaaaa

SEQ ID NO: 15889 - DNA, 629 bp, Zea mays
agtagcaaatgcagttacaactggtgttgcttttgcagtatttcaaggtggctttttcatgatcgggcagaaattctcaaagccaccaagtgaagatacatactactctcggacaagaagcatgctgcacaaactgggtcttgaaaagtatgagaagaatttcaagaggggtctcctcaatgatcaaacgttaccactccttacggacagtgctctgagagatgtgaagattcctcctggacccagacttttcatactcgaccaaattaaaagggaccccgagctggttcaagcaaagtagcagtcacaattgtcgacagctggttctttctgggttgcatagggtttgaaagcgatgccgtctctagtttcttaataaactttctaggcaagcaagcaagaatttagttgtgctgtagttaattgttttttggccgatcagtttgcatcgatcctattaaattctgaacaacaggtatttatacgcatcttattcaaatttaaactggcattctctacattatgcaaatatgttggaaacaaggttgatggattaatttggcgtgaccggctgtcgtgtatacttgagtggagccacgaggaaataaatattgcttctagaggctaac

SEQ ID NO: 15890 - DNA, 1123 bp, Zea mays
tcgacgccggccgccccgggcccgcctgagaaacgcgaggtcacgagatatggcggacggcaagcgaggggaggattcggccgtggcgttgaagacctcgccgtcgtcggcggtgatggctgggggtttacgcggcgttagcaaccctctggaggagtggagcgggcgcgtgaaggcgattgaggccgggttccgcgcgtggatggcgaagcaacccatccaaatcgaggccgcggtgaccacggccgtgggggcggtgcagggcggggctctgggtgggctcatgggctcgctcacagctgacggcgggtcgccgttccccatcccgcagccgccgcccaacgccaacccagaggccatggcgtcgttcaagcaggcccaggctttagctggtggacccttggtgcaagcccggaactttgcagtcatgaccggcgcaaacgcaggcatatcttgtgtcatgagaaggatacgagggaaagaggatatccagggcagcatggcagctgctttcggttctggtgctcttttctccatagtgagcggaatgggaactcctaatccagtagcaaatgcagttacaactggtgttgcttttgcagtatttcaaggtggctttttcatgatcgggcagaaattctcaaagccaccaagtgaagatacatactactctcggacaagaagcatgctgcacaaactgggtcttgaaaagtatgagaagaatttcaagaggggtctcctcaatgatcaaacattaccactccttacggacagtgctctgagagatgtgaagatccctcctggacccagacttctcatactcgaccaaattaaaagggaccccgagctggttcgagcaaagtagcagtcacaattgtcgacagctggttctttctgggttgcatagggtttgaaagcgatgccgtctctagtttcttaataaactttctaggcaagcaagcaagaatttagttgtgctgtagttaattgttttttggccgatcagtttgcatcgatcctattaaattctgaacaacaggtatttatatgcatcttattcaaatttaaaaaaaaaaaaaaaaaattatgcaaatatgttggaaacaaggggggcccggtaccc

SEQ ID NO: 15891 - DNA, 4764 bp, Zea mays
  misc_feature (90)..(90): n is a, c, g, or t
ggtgattattatgctaatatgaactaaaacataattgattctgagtccgaagcaatcaacaactacacttgtgtcgcatgccaacgtgtnagcattaggaatggaactaaaacaatctccaatcccagtaaaaccaacaaactttagtttctatacaaaacgaaatgccattaactctactgcgaatccgtaagtgacgtacttgggttctgattctgataagatttgtgagcatgtatcatgacaggctacaaagaacatggctgcgatacctaagccctagtttcttgcagattgtatccaaagcctctggcagcgttctatcagcaaaatataggataagagttctatacaagatgcaaccactatattagtgccatgaagaggacaaaacaactagaaatttgttacttgttagctctttcgagtagttctttacctccacatattatgcaaccactatgttagtgccatgtttccagggacgggcccacttcaattcataggcattcaaatgaatacctaagtttttgtcaaaaaataagtatatgtagtatataataaacacatattggttaattgcccatacttcatatgacacatatagacataagctctagtggtggagacaactagggttctaatccccacacctttttttttacctgcgcgtgaaattttccatttttttgcctatgctcgatttgtggatgattgttttagcttgacatttagtccttcgctttttcgtttgtgagtctcatatttaattcagctttcttaaaaactagaattcatcttacagacttatacgatatacgattagggtcgatcagcaatctcataggaatgtttgtttatttcacatgttgctatttgtgtcaatattttctgaaattatataaatagaaacaatgtaattctattattttattctcccattacttatgaacattgttgactggttgctttgttatatttattaaagaaaattcttcttgcaagccaaagataaaacatcatcgctccttttcaaaatatgaaggataaaaaaacttgtcatgtaatgtaactttccatattatttaaatattattatcttttatatatttcaagtgttggctctgataactagtattgaagaattataatttttaatcattttttatgctcatgtaagaattaattttgtttaatatatatcagatgtatactataaaattattgttatgtagtaatatatttcggtagtattgctaggctttatatggtattatatatatatatatatttttgctacttactaatttcaactcgccactgcatgtatcagaccccaccctgttcgtccacggccggtcctgccctactttattgaagaatgaaaaaaatggcaatcatttatatgtaggtctgttctagaaacaaaagagaataatcaaactaaaataatcttgtataaaattgaagctaccgcgtagatcaaacgctttagtgacagatctttagattgactgatagagctgctatatgctatacagtacagattcaatttgtcaagctcttgcaaacaagcctctaaaatcttgcaacgtgcccccggccccgagaatgtctattcggtagcgtacaaagaggcgaccccaccgagcaagcagtgactgaggcagtgccccacctcccctgtttctcgtataaaggtgcccgccggcccccccgcggccttttctgcattcgacgccgccgcaggcccgcagccagctcgagcccaaaggagagaacccaggttggcggcggcgctccggcggcgatggactccccctacgctctccacctcgccatcgccgcgctcgtcggcgcctccttcgccgccgcctccgcctactacatgcaccgcaagaccctcgaccagcttctccgtttcgcccgcgaccagcagcgccgccgcaaccgcctcctccccgaaggcgacgaactggaggacggcgaagaggaccctccgccgcactgggatcatgatcgccgcaccctgcccatcccgccgggcctcccgccgctccacaccggccgagagggtaggccagttgtttctccaggttcgactaaaagagttggacctattgttagaccgactacacccaaatcctctgtccccactatcagtgcatttgatagaattgaagattcagatgacgaggaggatcttgtcccagatgccaagaatgatactgcttacttgaccccaaatggtgctattggatcagatctcacagataaagcgagccagaatggggaattaacatcagcaccatcaacgcagatgattagatcccatagtgcaactggcagcctgcatgtaccccagcttaacccaatagcagctgacgttcctgtcgccgttgctgaacacgtaaccttcagtaaaatcaatatcacagctgttgagactccttctcctgatgaaattgaggcatacaaagttcttcagaaatgccttgagctgcgtcagaggtacatattcagagaagaagttgctccttgggaaaaagagatcataactgatcctagtactccaaagcctaatccaaatccgttcagttatgaacatcaggctaaaaccgatcaccatttcgaaatggttgatggcgtcattcatgtgtaccccaataaagattctaaagaaagactctatccagttgccgatgcaactaccttctttactgatatgcactacgtccttcgtgtgttggctgctggggatatccgaaccgtgtgtcatcaccgtttaaatcttctagagcaaaaatttaatcttcacttgatggtcaatacggatagagaactgcttgctcagaaagctgcacctcaccgggacttctacaatgttaggaaggttgatactcatgttcatcactcagcatgcatgaaccagaagcacctgttgagatttatcaagtctaagttgaggaaggaacctgatgaggttgtaatctttagagatgggacctatttgactcttaaggaggtttttgagagtttggatttgacagggtatgacctcaatgttgatctcttagatgttcatgctgataagagtacatttcatcgttttgacaagttcaatctgaaatataatccatgtggtcaatctcgcctgagggagatatttttaaagcaggataatcttattcaaggtcgcttccttgctgagctgacaaaagaagtattttctgaccttgaagcaagtaaatatcagatggctgagtatcggatatctatttatgggaggaagaaaagcgaatgggaccaaatggcaagttggatagtgaacaatgaattatatagcgagaatgttgtttggttaattcagattcctcggatatacaatgtatacagggagatgggcacaatcaattctttccaaaacctccttgacaatatttttctccctctttatgaagtaactgttgacccagcttcacatcctcagctccatgttttcttaaaacaggttgttgggttggatttggtggatgatgaaagcaaacctgaaagacgcccaacaaaacacatgccaacacctgagcaatggactaatattttcaatccagcctatgcgtattatgtgtactattgctatgccaatctgtatacactgaacaagcttcgtgagtccaagggcatgacaacaatcaaacttcgtccacactgtggggaggctggtgatatcgatcaccttgctgcagcatttcttacttcacataacattgctcatggggtgaacctaaagaaatcccctgtacttcagtacctgtattatcttgctcagattggtctagcaatgtctcccttaagtaacaactcactgtttatcgactatcatcggaaccctttcccaacatttttcttaaggggtcttaacgtgtctctttcgactgacgaccctctacaaattcacctgacgaaggaacctttggttgaagaatacagtgttgctgcttcactttggaagctgagctcatgtgacttgtgtgaaatcgctagaaattctgtctaccagtccggattctctcacaggctcaagtctcactggatcgggagaaactactacagaaggggtccggagggcaatgacatccaccagacaaatgttcctcacatcagggttgaatttcgacacactatctggaaagaagaaatggagctgatacattttggaaatgttaacctacccgaagaagttgacaggtgaagagcaggggaattgcagtgaagtctggcggtggcggcaaggggacgagagaatgtgtcaacacgagagactcgtttgcttgcagaggaggtatcatgacaatggatgtcgccaagtcctccgtgtcgaccatatatatatgaagaataataagaaaacacaaatacccaagtatttagaagcgttgaatccagatgtggcatgaggtcggagccaacgtgtacttgcatacgttacgtttatatacatgtactgctctgctgtaatggtgtttcgacgaatgtgtcttgtcattaatgttttgttaggctcgttccaggcttctgctgatatatacgttacgttcaggcccgaactaggtttgggttttcgctttcgctactcgtaggaaatgtttaagtaccggacttcatgctatagggatactagctcagatggctcagattttatgtccagccctattatttatagatcagattctagtttttctttttttaaaaaaaccacacaac

SEQ ID NO: 15892 - DNA, 1086 bp, Zea mays
  misc_feature (1032)..(1032): n is a, c, g, or t
cattgggtacctcccggccggccctgcattcgacgccgccgcaggcccgcagccagctcgagcccaaaggagagaacccaggttggcggcggcgctccgcggcgatggactccccctacgctctccacctcgccatcgccgcgctcgtcggcgcctccttcgccgccgcctccgcctactacatgcatcgcaagaccctcgaccagcttctccgtttcgcccgcgaccagcagcgccgccgcaaccgcctcctccccgaaggcgacgaactggaggacggcgaagaggaccctccgccgcactgggatcatgatcgccgcaccctgcccatcccgccgggcctcccgccgctccacaccggccgagagggtaggccagttgtttctccaggttcgactaaaagagttggacctattgttagaccgactacacccaaatcctctgtccccactatcagtgcatttgatagaattgaagattcagatgacgaggaggatcttgtcccagatgccaagaatgatactgcttacttgaccccaaatggtgctattggatcagatctcacagataaagcgagccagaacggggaattaacatcagcaccatcaacgcagatgattagatcccatagtgcaactggcagcctgcatgtaccccagcttaacccaatagcagctgatatacttcgaaaggagcctgaacatgaaaccttcagtaaaatcaacatcacagctgttgagactccttctcctgatgaaattgaggcatacaaagttcttcagaaatgccttgagctgcgtcagaggtacatattcagagaagaagttgctccttgggaaaaagagatcataactgatcctagtactccaaagcctaatccaaatccgttcagttatgaacatcaggcttaaaccgatcaccatttcgaaatggttgatggccgtcattcatgtgtaccccaataaagattctaaagaaagactctatccaggtgccgatgcaactaccttctttactgatatgcactacgtncttcgtggggtggctgctggggatatccgaaccgtgtgtcatcaccgtttaaat

SEQ ID NO: 15893 - DNA, 4186 bp, Zea mays
cgtcaaattaattaaaatgaaaccttatcggctttgctggcgagtgtgcgccacaggacacttttggctgtctttcttttgcgtggttgcatcttattccacaagccaaagcgtacgtacgtgcccgccaagaaagcatagacaccaactgcagatagaaacgaagtagccaaaacatgtgatgccaacggatcgcaccaatcagtggccgtgccgctgtgcggaggcctaccaccaccactactacaaataccgtcgctctcgtctctctcggtaaaagcgcacacacacacaagacacaacaacgctgtgggcttgtacgtggctgtcgatcgcagcacacgtacgtaaactcgaaagcagctaggccggaagcaaaatggacgacgacgtcgtcgtagcagctgcagctgcagctgcagccgcggcggcttcgtcttcgccatcgccgccgtggagcctgctccaggggctccttgcgctgctcgtcgcgtggggggcctaccgggcggcgcagacgttctggctgcggccgcggcggctcggccgggcgctccgcgcgcaggggctcaccggcacggcgtaccgcttcccggcgggcgacctcaaggagaacgcccgcctcaacgacgaggcgcggtccaggcccatgcagccgccgtgtagccatgacgtcgttccccgcgtcatgccgcatctcttcaacaccgtcaaggaccacggtacgtcgtcgtccaaactcccaagtagtctcccgtaattaagctagctatatatgtagctttgtcgtttatctccacacgtgtccatcaacagcttgcttagcacagactgtactagtatactcgccgcgcgcctaagatcttccggacgacggatggtatggtccaaccgagaattcattcgttggatgcttccttcttatatatatatggtccgactccgacgtgaacgctgaggttgacgttcgcttgactagtgtgttgtggattactattggccgcccgacagccatgcatgtatgttcacgtggcaagtttgaattcttcccagaagctgtatcatatccatttgacaccggccagtaggcggccactccggtcaccggacctatgatacacatccattgtgttgtcccatttgcaaaagaatttttcacgatagtaatagtttcagttacctattttttttcctggaaaaacctatgatactttttgtttcatttgcgaaagctcatttccccacttatacaaactcggttataatatctgcccattccttttactaattactccctatgtttctttttatttgtcgctgaatagtgcaattttacaaaagttccctaaatttcaaagatggagttggatttgtcgtttggacttaacggcgcagacgctgaactgcaggcaacatctgtattacctggttcggaccgattcccagggtggtgatcacggaggcagagttagtcagagacatcctatcgaacaagtttggccacttcgagaagttcacgaacaagagtctcgggaagatgatcgccctcggggtggcgagctacgacggcgagaaatgggccaaacacaggaggatcctgaaccccgcgttccatctcgagaagctcaaggttggttggtttggttgtccaacttccttcagttcaaggcgtatagacgatgtgtgcgtgcttactactagagtgggtttttgcagcgcatgcagccggcgttcttgacgtgctgcaccgagctcattgatcgctgggacaaggaggtcgctggtggttccgacgggtcattcgagctggacgtctggccggagttccagagcctcaccggcgacgtgatctcccgcacggcgttcggcagcagcttcatggaagggcggaggatcttccagctccaggccgagcaagcggagcgagtgatcaaggctttccagtacatatacatcccaggcttcgtgtaagcactttctcatctgatctgtaacatatagtacagtgattccagcgggcagcggcatcatgcacactcatatgcgcgtgctcgatcgtgcaggttcttcccgacacccaacaaccggaggatgaaggagatcaacagggagatcgaagggactctgagaggcatgatcgagaagagggagcgcgcgatcgagaacggcgaagcgagcggcgacgacctgctcggcctgctgctgcagtccaacatggagagcgggaaaggcggcctgaggatgagcacggaggacgtggtcgaggagtgcaagctcttctacttcgccggcatggagaccacgtcggtgctgctcacctggacgctcgtcatcctaggcatgcaccccgagtggcaggaccgcgccagggaggaggtcttcagcgtcttcggcagggacaagcgccccgatttcgacggcatcagtcggctcaaaacggcaagtgttgttctgcaatactactgctttaaaatattaagcccggccattcctcgtcactgactgctaacgttggctgctacatgctgcctgtgttgctgctgctattcaggttacgatgatactgtacgaggtgctcaggctgtacccgccggcggtgacgctgaaccgaagaacgttcaaagacatgcagatcggaggcatcacgtaccctgcgggggtgatcctggagctccccgtgatcgtcgtccaccacgaccccgacgtctggggcaaggacgcgcacgagttcaggccggagaggttcgccgaggggatctccaaggcgaccaaggaccagcagccggcgttcttcccgttcggctgggggcccgaggatctgcatcggccagaacttcgcgctgctcgaggccaagatggccctcagcatgatcctccagcgcttccagttccggctgtccccttcctacacgcatgcgccgtacaccgtccttctgctgcatcctcagcatggcgctccaattattttcgacaggatctgactgcccttgcatgacatcgtcgatcgttgtcagcatgtcacagtgcaaataaactcgtatgaataatattgtgttagggagaagtctagttctgtgtatccgattttgaaggtggaaccaaaacataagggtgtaaggctatgtcccggaaaatgagtcacatgcgagctcgcaaacaccaacagagtccacatgcggatatacatatagaactgtgaagaagaataatgtgctttggaagaaactttacatcaacatgatcttgttattatcacttaaaaccctaattgttagaactaaattaaagttgatcaacaagaaataagaagatcacttagaaccaatgtaaaccataactaccaagcaacttttgttaaggttttatttgtaagttgctaggagaaaacatgagaaaatgagtaaaaataaagattggtattaatgcctaaggttgtctacagtagttcgtgtgaattagaggatttgcaccgtagattagactatttaaagagtggaatttgaaatagatgatgcgataaaggatgggataggatagctgttggagatatcttttttaacgaaggggttttccccctagttcattataaaataggcaaacgagtttttttacattcaatgcaccatacttaggacccatcaaggtccacaagataaatctcacaggagctatcctatctagaccaagtttttgaaaggtaaaacgctcctaaggctagctccaataggccaggcattcggccagccaaagctaatttagcttgcaactggtactgtagcgcatccaatggaccagctatctagcccaggcaaattgcatgcgaggagagagaacaggcaaattggcttgtctttggcacagcagccatttattttggaccaatagcatactttgtttctttggcgcaaaaacagattgtaccaatggtcacagccagtttgcctgttctgttgcaaacaggaggtccatcgttgaccaggtaaaatacagggagcaggtaaaccatgaaatagctgggcaatatagctgtttgttgttggagccagcctaagaagacgagatatctaagggccataaaaggacacagacgatgttttagcgaaaccacaccaactacgcctgaagaaggctattacagcacaggaagacatcaaaaatacatcaacaactagataaccacaacaca

SEQ ID NO: 15894 - DNA, 2195 bp, Zea mays
aattcggcacgaggcacacacaagacacaacaacgctgtgggcttgtacgtggctgtcgatcgcagcacacgtacgtaaactcgaaagcagctaggccggaagcaaaatggacgacgacgtcgtcgtagcagctgcagctgcagctgcagccgcggcggcttcgtcttcgccatcgccgccgtggagcctgctccaggggctccttgcgctgctcgtcgcgtggggggcctaccgggccgcgcagacgttctggctgcggccgcggcggctcggccgggcgctccgcgcgcaggggctcaccggcacggcgtaccgcttcccggcgggcgacctcaaggagaacgcccgcctcaacgacgaggcgcggtccaggcccgtgcagccgccgtgtagccatgacgtcgttccccgcgtcatgccgcatctcttcaacaccgtcaaggaccacgggcaacatctgtatctacctggctcggtccgattcccagggtggtcatcacggaggcagagttagtcagagacatcctatcgaacaagtttggccacttcgaggagttcacgaacaagcgtctcgggaagatgatcgccctccgggtcgcgagctacgacggcgagaaatgggccaaacacaggaggatcctgaaccccgcgttccatctcgagaagctcaaggttggttggtttggttgtccaacttccttcagttcaaggcgtatagagatgtgtgcgtgcttactactagagtgggtttttgcagcgcatgcagccggcgttcttgacgtgctgcaccgagctcattgatcggtgggacaaggaggtcgctggttccgacgggtcattcgagctggacgtctggccggagttccagagcctcaccggcgacgtgatctcccgcacggcgttcggcagcagcttcatggaagggcggaggatcttccagctccaggccgagcaagcggagcgagtgatcaaggctttccagtacatatacatcccaggcttcgtgtaagcactttctcatctgatctgtaacagatagtacaggtacagtgactctagcgggcagcggcatcatgcacactcatatgcgcgtgctcgatcgtgtgcaggttcttcccgacacccaacaaccggaggatgaaggagggcaccaggagagatcgaagcgactctgagaggcatgatcgacaagagggagcgcgcgatcgagaacggcgaagcgagcggcgacgacctgctcggcctgctgctgcagtccacccgggcggccgggattcgccgcctgaggatgagcacggaggacgtggtcgaggagtgcaagctcttctacttcgccggcatggagaccacgtcggtgctgctcacctggacgctcgtcatcctaggcatgcaccccgagtggcaggaccgcgccagggaggaggtcttcagcgtcttcggcagggacaagcgccccgatttcgacggcatcagtcggctcaaaacggttacgatgatactgtacgaggtgctcaggctgtacccgccggcggtgacgctgaaccgaagaacgttcaaagacatgcagatcggaggcatcacgtaccctgcgggggtgatcctggagctccccgtgatcgtcgtccaccacgaccccgacgtctggggcaaggacgcgcacgagttcaggccggagaggttcgccgaggggatctccaaggcgaccaaggaccagcagccggcgttcttcccgttcggctgggggcccgaggatctgcatcggccagaacttcgcgctgctcgaggccaagatggccctcagcatgatcctccagcgcttccagttccgcctgtccccttcctacacgcatgcgccgtacaccgtccttctgctgcatcctcagcatggcgcgccaattattttcgacaggatctgactgcccttgcatgacatcgtcgatcgttgtcagcatgtcacagtgcaaataaactcgtatgaataatattgtgttagggcggacgcgcgggttctgtgtatctgattttgaaggtagaaccaaaacatcagggtgtaaggctatgtcccggaaaataagtcgcatgcgagctcgcaaacgccaacagagtccacatgcggatatacatataatatagaactgtgaggaagagataaatcatggatttgtggtgtaaaaaaaaaaaaaaaaaaaaaaaa

SEQ ID NO: 15895 - DNA, 791 bp, Zea mays
gggtacctcgaggccggccgggttttacaaagttccctaaatttcaaagatggagttggatttgtcgtttggacttaacggcgcagacgctgaactgcaggcaacatctgtattacctggttcggaccgattcccagggtggtgatcacggaggcagagttagtcagagacatcctatcgaacaagtttggccacttcgagaagttcacgaacaagagtctcgggaagatgatcgccctcggggtggcgagctacgacggcgagaaatgggccaaacacaggaggatcctgaaccccgcgttccatctcgagaagctcaagcgcatgcagccggcgttcttgacgtgctgcaccgagctcattgatcgctgggacaaggaggtcgctggttccgacgggtcattcgagctggacgtctggcccgagttccagagcctcaccggcgacgtgatctcccgcacggcgttcggcagcagcttcatggaagggcggaggatcttccagctccaggccgagcaagcggagcgagtgatcaaggctttccagtacatatacatcccaggcttcgtgttcttcccgacacccaacaaccggaggatgaaggagatcaacagggagatcgaagcgactctgagaggcatgatcgacaagagggagcgcgcgatcgagaacggcgaagcgagcggcgacgacctgctcggcctgctgctgcagtccaacttggagagcgggaaaggcggcctgaggatgagcacggccgacgcccgcggagtgcgagctcttctacttcg

SEQ ID NO: 15896 - DNA, 1524 bp, Zea mays
ctgaaggcaatctcctgcagtaagtaagctttctttcacgcgctcgtagctgtattgtatacatgtacattctgttgggtgacgttgcaactaataaaaactgattttgtctagtatgacgcaatcaaatgtcttattattttgttttgataaagaattaatgattgtatcatgccagactaccagctcacatgtttggctttcgagcacactttctccagaccccaaggaaatataagatccgattagatatatgtcgatactcatcccagcgtatttccgttgcaacgcacgggcacatacctagtatagaaataaggattctaaccatgattacacttacctagacaataaaatatatacatgtttttctgttttatattttatggcgaatataaatggaaaggtagcaaagtaggagcgctttggtagtaaataataacccatgctcaagggaaagtgggaaacgctcgaagaggggagaggagacagcggtcctatgtccgtgtggtcgtgcggactgcggacttctcttcctcattccatccccgctgccccatccggccatcccacagcgaatctcccaaaccccggctccctcgattcccaatcccacccctgccacgaagagatcagatgacggcgagctgctgctgatcgagtgcagtggaatcggaggcgatgcgggctagccggccggcggtgcaccctgtggaagcggcccctccgccgccggccgcggcggcggaggggccggaggcccaggtggagggtgccgcgcacccgcgcggggtgcggatgaaggatccgcctggggcaccagggacacctgcggggcttggtctacgccttgcgcaggccttcttcgcagccgctgcgctcgccgtcatggcgtccaccaacgacttcccgtccgtctctgccttcagctaccttgtcgcagcagccattttgcagtgcttgtggagccttttgctagcctttgtcgacatttatgcacttcttgtcaagcgatcgttgagaaatgcccgagctgtatgtatatttactatcggagatgggatcacaggtacaataaccttgggcgcggcatgtgcttcagcaggaatcactgttctcatcggtaatgatctcaacatatgtgcagagaatcactgtgcaagtttcgagaccgccacagcattggcttttataagctggtttgcgctggcgccatcctgtatcttgaatttctggtcgatggcctccagatgataaatataggatgttataaaacatagtatttttgaatggtttctggacaaggtcgctgcttatggtagcagcaaagcaacgcggtgccgtaaagctaattgtaatacccagaaattgttgaatggctgtggaatgtagcacgtggtcgaattgtctgtacaaaatacggagaggccttctttggatctgaaaaaggcttctgaatcttgccagtccttcctttttacgttaacatgtttctcctgtgtggtttgttgaaaaaaaaaaaaa

SEQ ID NO: 15897 - DNA, 848 bp, Zea mays
tttttttttttttttttgtcttttgcgccctaaatagtccactctattaagtatattccaataactctaaaatgagtgatccaaacggtctcttagtgtaaattccactcgttattactttatacaattacaaaaataccaatccctttggaaaccacataaatgtagatggattgagagatcacacaaaactgcagaacaaaaacagatgcaaaactaaagttgttaggaggagctaaggatgcagaaatatgggcgcgagtttctcgctcagtagcttgctgacacgagaggtcagaaatagccatgggagaattccaaccacaacacggcctgtagaagcatctacacctctccaggaaaacatcctcccgaagggctggagaaggtgcttagggacagtagttactggagtactccaaaaccacagaacgagcacaccatagactacaacctttgcggccagcagaacttttcggtatttttcatataaagactgtttccctctaatgtccacatcttgcatttttgccagctccttctctttagcaccagccaaccgcttcagttttgcggcttgcgcaaacgtcgagggcgttgacaaagcactggcctccttgagaagttgcgtgatctctacacgcagtctgagctgatcatcagaaatggatcccctcctcctcttgaggtcgaggatgcactccagcatatgcaccgcagagacgaggaggaagacgaagatggcagaaggggacattgttgccggcgacgacctagggcggcgtggtggtgatagattggtccggtcgggggccggggggtaactttcggcctcgaggtacccaatg

SEQ ID NO: 15898 - DNA, 1577 bp, Zea mays
acccttactcagcatggaacaggttctctgtcctcataactccaaccaaacaacggcagctagcgagctcccgcggtcccgccgccgccccctggtcctccaaaaaacggctgaaccctaaaccctccctagctcccgccgcctcgcttaaccgcgcccatggccgccgccgctcgcgccgccctcccgcggccccacctctctcttttttcgtcctcccaccgcagcccccatctgtccctcacgccctcctccgcccctcgcctgcgcagcggcgctgccacctcccctgcgctgcagcagcaccaccaggtcaccacgcgcctgggcgacgtgatcgaggcgcagcagttcgaccgggacgcgctgaacgagatcttcgaggtggcgcgggagatggaggccgtggagaggggttcccacggcgcccccagccgcgtcctcgaggggtacctcatggccacgcttttctacgagccctccacgcgcacgcgcctctccttcgaggctgctatgcggaggctcggcggggaggtcctcaccaccgagaatgcgcgcgagttctcttccgccgccaagggggagacactcgaagataccataagaaccgttgagggttattccgatattattgtactgagacattttgaaagtggagctgcaaggaaagcagcagatactgcaaatattcctgttattaatgcaggtgatggaccagggcaacatccaacccaggctttgttggatgtgtacacaataaagagagaaattggcacactagatggaattaaacttggtttggttggtgaccttgctaatgggaggacagttcgttctctggcttacttgattgctaagtaccagaacattaagatatactttgtatctcctgatgttgttaaaatgaaggatgatatcaagaactacttaaattccaaaggtgttgaatgggaagaaagttcagatttgttggaggtggcatccaagtgtgatgttatttatcaaacacgtattcaaaaagaaagatttggtgagaggattgacctttatgaagctgctcgtggcaagtacatcgtggataaaaaggtcttagatgtgctgccaaaacatgctgtcatcatgcatccccttccaaggcttgatgagatcacagtagaagttgatagtgatccaagagctgcatattttaggcaggctaagaatggcctctacataaggatggcattgctcaaacttctgcttgttggtcactgacatttcggctagtgctttagcttgtgctgcgtcaagggattagaaggtattattcttaatataatgatcgaggctgtcttacccacgcaggtcgagtttttagaaacatgtactaataatcagcagcttgtgtcaaaattcaatgttcgctgttgcaggtaataaaagtctgcatccatgcgaatgtgcagcgatgtttggcagagtttggtgttctcatgtgctgtgagaacatggaacataattaattttgcctgcacaaaaaaaaaaaaaaaaaaaaaaactagagactagttctctctctctctctcctcgggccccta

SEQ ID NO: 15899 - DNA, 1494 bp, Zea mays
aaaaaccccccggcggcagtggcactcgcagactcgcttctccccgaaaaacggctgaaccctgaaccctcactacgtcccgccgcctgcttcacagttcaccccggccatggtctccaccgctcgcgccgccctcccgacgccccacctctctctcgcttcctcctcccgccgcaggccccatctgtttttcacgccctcctccgcacctcgcctgcgcggcggcgctgccacctccatcaccgccggcagctccgcctcgccgcagcagcaccaggtcaccacgcgcctgggcgacgtgatagaggcgcagcagttcgatcgggactcgcttaacgagatctttgaggtggcgcgggagatggaggccgtggagcggagctcccacggcgctcccagtcgcgtcctcgaggggtacctcatggccactctcttctacgagccctccacgcgcacgcgcctctccttcgaggccgctatgcggaggctcggcggggaggtgctcaccaccgagaacgcgcgcgagttctcttccgccgccaagggggagacactcgaagataccataagaaccgttgagggttattctgatattattgttctgagacattttgaaagtggagctgcaaggagagcagcatatactgcgaatattcctgttattaatgcaggtgatgggccagggcaacatccaacccaggctttgttggatgtttatacaataaagagagaaattggcacactagatggaataaaacttggtttggttggtgaccttgctaatgggaggacagttcgttctctggcttacttgattgctaagtaccagaacattaagatatactttgtatctccagatgttgttaaaatgaaggatgatatcaaggactacttaaattcccaaggtgttgaatgggaagaatgttcagatttgttggaggtggcatccaagtgtgatgttatttatcaaacacgtattcaaaaagaaagatttggtgagaggattgatctttataaagctgctcgtggtaagtacattgtggataagaaggtcttagatgtgctgccaaagcatgctgtgatcatgcatccccttccaaggcttgatgagatcacggcagaagtcgatagtgatccaagagctgcatattttaggcaggctaagaatggcctctacataaggatggcattgctcaaacttctgcttgttggtcactgacatatctgctagtgtgtgagcttgtgctgcgtcaagggatgaggaaatgtactaataatcagcagctcctgtcaaaattcaacgttcctgcgctgtcagggtaataaaagtctggatccatgctggagtgcagcaaagtttggcatggccatgttaatgtacaaatggtgttcgaaatagagttttgctgttctcatgtgatgtgagaacatggaacgtcgttgatttgcttgcacaaattcatttgccggcttcagttgatgattatctgatac

SEQ ID NO: 15900 - DNA, 610 bp, Zea mays
  misc_feature (585)..(585): n is a, c, g, or t
  misc_feature (600)..(600): n is a, c, g, or t
gcgcgaccccctgccggaaaaagtcccacttagacaatacgagtggagtggtctcatagatagcgctagcagcagtagaaaccgccgccactaggctaggagtggaagcctcgggcccgcggcagcagccatggcggcgttcctggcgcctccctgcacttccttctatcgctcgtccgcattccttaccccctgttcctcgaatcgccggagtacagcgctaagggcggcggccgttcgtgggtcggcggtgacgcgggcccagcggacggtctccgctaggtgggtcccatccaggttagcggtggcgaggccggcggccaggaaggcgtgcctagaggagcttgatacaaccaacatgctccttcgccagcgcatcgtcttcctgggttccccggtggatgatacaagtgctgatctcattatcagccaactcctactattggatgcagaggaccagactaaagatattaaattgtttatcaactcacctggaggctctataacagcagggatgggagtatatgatgctatgaaattttgcaaagctgatgtgtcaactgtttgctttggattggcggcttnaatgggtgcatttanttgccgctgg

SEQ ID NO: 15901 - DNA, 2247 bp, Zea mays
aaaaagctttgtttgctcaacctggacgcctcggcctcggcgatccaccggcacggcaccgaaacacctcgtctcgatttcgaaccaaaccctccagtgtccagccccgtctcgttcgccgcggcaggagcgagcgagcgaccgagcgagcagccatggcgccggtcgatccccactcctacaccgacggcgcgcacccggtggtctcgcgcgcggcgctcgccttctacctcgacttcgccgcctccaccatacacgcctccgcggtgctcaccctctccgcgccgcactccggcgacctcctcctcgacacccgcgctctcgccgtccactccgcctccaccgacgccgacccgccggagcccatccccttctccctcgccgcggcgcccgacccggtcctcggcacggcgctgaccctcgccctgccccgcgacaccgcctccttccggctcaccttctcaacctcccccgccgcctccgcgctgcagtggctggccccgccgcagaccgcctccgcgcagcccttcgtcttctcgcagtgccagtccatccacgcccgctccgtcttcccctgccacgacacccccgccgcgcgcatcaccttctcgctcctcctcaacgtccccgagcagctctccgccgtcgccgccgcgcgccacgtcgcgcgccgggacccgctgccctccgaccaccgcggggcgtgcgacgacgggctctggtgcgcgcccggccgcatcgtcgaggagttccagatggaccagtccgtgccgccctacctcttcgcgttcgccgccggcagcatcgggttcagggacctcggcccgaggacgcgggtgtacgcggagggaggggacacggtgttggacgaggcggccagggagttcgcgggggtggaggagatggtcaaggttggggaggggctctttgggccgtatgaatgggagaggttcgatctgctcgtgctgccaccgagcttcccctatggaggtatggagaaccccaggatggtgttcctcactcccacggtcatcaaaggggatgctgcaggggctcaggttgtggcccatgagctcgcacatagctggactggcaatctgattactaacaaaaccaatgaagatttctggctaaacgagggattcacaacatatgctgagaggaggattgttgaggttgtgcaaggggaggagcgggcagccttaaacatggggattggatggaggggattgaacaggatgatggagaggtttaaggataacatggagttcaccaagttgaagccgaagatggcagggattgaccctgatgatgtttactctgaagtgccctatgagaaaggtttccagttcctttggagaattgagcgtgagattggcaggcctgctttcgacgagtttttaaagaagtacattgcaaccttcaagttccaatcgatagatacagagacatttcttgaattcctcaaaaccaatgtacctgggatagaaaacaaaattgaccttcacctgtgggttgaggggactggtatccctcctgatgccatggaaccagattcagctacttacaaaaagatctgctccttagctgcagaattcaaatctggaaaacttccaagtgaagatgaggtagcaaagtggagtgggcaagaatgggaactttacttagaaaatctaccagcagatgttgaagcctcacaggtcactgctctcgacgagcggtacaagctatctgaaagccgtgactacgaggtcaaagtggcgttcctccagctggcgatccccaccgggtgcaagtgctacttcaacgaggttgagaaatgcttgaagcaggtgggaaggatgaagtacctccgcccgctctacagctcgctggccaagtgctccagcgaggagaagatgctggcccagaggatattctcggaggctcaagagttctaccacccaatagctcgaagtgttgcggaggccattttgtcgaagcatagctaagcaagccaagactcttgcttggcgattcacgcttgatctggtgactgctgctcagtttgcttctttcgcataaaattatcgtctgctctggaaaagaaacttaggaaaaacttgaggcttgtattgcatctttgataacataatattataactagatgtagtgccccgtgcgttgcaaccgtagtacctgaggtatgtaagtcctgggtttgcaaggccaaaaaaaaaaaaaaaaaactcgaaaaggggccggtac

SEQ ID NO: 15902 - DNA, 1529 bp, Zea mays
ccacgcgtccgcgccctacctcttcgcgttcgccgccggcagcatcgggttcagggacctcggcccgaggacgcgggtgtacgcggagggaggggacacggtgttggacgaggcggccagggagttcgcgggggtggaggagatggtcaaggttggggaggggctctttgggccgtatgaatgggagaggttcgatctgctcgtgctgccaccgagcttcccctatggaggtatggagaaccccaggatggtgttcctcactcccacggtcatcaaaggggatgctgcaggggctcaggttgtggcccatgagctcgcacatagctggactggcaatctgattactaacaaaaccaatgaagatttctggctaaatgagggattcacaacatatgctgagaggaggattgttgaggttgtgcaaggggaggagcgggcagccttaaacatggggattggatggaggggattgaacaggatgatggagaggtttaaggataacatggagttcaccaagttgaagccgaagatggcagggattgatcctgatgatgtttactctgaagtgccctatgagaaaggtttccagttcctttggagaattgagcgtgagattggcaggcctgctttcgacgagtttttaaagaagtacattgcaaccttcaagttccaatcgatagatacagaaacatttcttgaattcctcaaaaccaatgtacctgggatagaaaacaaaattgaccttcacctgtgggttgaggggactggtatccctcctgatgccatggacccagattcagctacttacaaaaagatctgctccttagctgcagaattcaaatctggaaaacttccaagtgaagatgaggtagcaaagtggagtgggcaagaatgggaactttacttagaaaatctaccagcagatgttgaagcctcacaggtcactgctctcgacgagcggtacaagctatctgaaagccgtgactacgaggtcaaagtggcgttcctccagctggcgatccccaccgggtgcaagtgctacttcaacgaggttgagaaatgcttgaagcaggtgggaaggatgaagtacctccgcccgctctacagctcgctggccaagtgctccagcgaggagaagatgctggcccagaggatattctcggaggctcaagagttctaccacccaatagctcgaagtgttgcggaggccattttgtcgaagcatagctaagcaagccaagactcttgcttagcgattcacggttgatctggtgactgctgctcagtttgcttctttcgcgtaaaattatcgtctgctctggaaaagaaacttgaggcttgtattgcatctttgataacataatattataatatatgtagagactcagaaaccgtagtacctgaggtatgtatgttctgggtttgcaaggccactcttaacatgcagcttgacattgaactgagcatgatcattgtgtactgcgtttcaacctgcaagggccagaaactgaaaaaaaaaaaaaaaaaag

SEQ ID NO: 15903 - DNA, 1322 bp, Zea mays
acctcgaggcggcgttggggaccccgccgccgggcgggaggtagcgcgtcaagcgagcagagcagcgaaaagcatggatgccgaagccgccgccgccgccgagggccaggtgcggcactggaccgcggacgtcaacggcatttccctccacgtcgccgagcgcggcgccgccgacgcgccggcggtcctcctcatccacggcttcccggagctctggctctcgtggcgccaccagatggccgcgctcgccgcccgcggcttccgcgcgctggcccccgacctccgtggctacggcgactcgtccgtgcccaccgaccccgccgcctactccatcctccacatcgtcggcgacttggtcgcgctccttgaccacctccaactcacaaaggtgttcgtggttgggcacgactggggcgcgatggtggcgtggcacctctgcctgttccggccggaccgggtgcgcgccgctgttgtcctggggatcccctacttcccccgcggccctcgcccgatgacggactcatttgccaagctcggcgatggattctacatcaatcagttccaggagccaggaagagccgagagggcatttgctcgctacgatgttgcgacggtcctaaagaagttctacgccttgaaaatcgccgagatgattgctcctcctggagtggagatcatagactttctccaggcaccttcttcgccgattccctggatgacagacgaagaactgggacagtacgccgagaagttcgagaagactggcttcacaggacccctcaactactaccgcatgcttgaaacaaactggagactgactgcaccttggagtggatcgaaaatcacagtgcctgcgaaattcatactcagcaagaacgacgtcggcctgcagtccttcggaaccgagaagtacgtcaagagtggcgctctgaaggagaacgttccagaccttgaggtttcgatcatcgaggggcaccatttcgtccagcaggaagaggccgggacagtgaattcggaaatactctccttccttggcaagtttcccagcgagggaggatcagcgtgattgttatttattgtttgcagccagtcccggactcctgagaggaagatggcctccgaatgatccgagggtttatgattgaataaagtgagagctcagatcgatagccgtctgttggcttgcattaaaaaaaataaagagcttgcatgtaaaactattcatgaacgaataaacttctgtcatatactcgcaagtctcaacattgtttacatgccagccaacgaacaactaagcagaagtgcagaacacatcatctgca

SEQ ID NO: 15904 - DNA, 1343 bp, Zea mays
ccggccgggcttcttgccccgggcgcgccgcatatttctcaacgtggatagcgagcacatttgactgaccgccatagcaacgagaggaaacaaagcggcgaccgacgagccaagcaagcagcagagcatggacgcgggcgaggtgcggcactggaacgcggacgtcaacggcgtctccatccacgtcgccgagcggggccccgaggatgggcccgcggtgctcctaatccacggcttcccggaactctggctctcgtggcgccaccagatggccgcgctcgccgcccgcgggttccgcgcgctggctcccgatctccgcggctacggcgactcctccgtgccgtccgaccccgccgcctacaccatcttccacatcgttggcgacatcgtcgcgctccttgagcacctccaactcacaaaggtgttcgtggtggggcacgactggggcgcgcaggtggcgtggcacctctgcctgttccggccggaccgggtgcgcgccgccgccgttctaggaataccgtactacgctcgacaagctcaccccatcatggaggtcttcgcggcgtttggcgatggcttttacataaatcagtttcaggagcccggaagagctgaagccgcattcgctcattacgatgttgcaactgtactaaagaagttctactccattgaaatagatgaactcactgctcctcctggagtggagatcatagactttctcgaggcatctccatcaccacttccttggatcagcgaggaagaactgggccagtacgccgaaaagtttcggaagtctgggttcactggacccctcaactactaccgcatgtgggagacgaattggagacttcttgcaccctggaacgaggccaagattacagtgcccgtcaagttcatagctggtgataaggacatcggtgtccagtcctttggggttgagaagtacatcaagagtggggaattcaagtccactgtcccagatcttgaagtcgccgtcattgaaggccaccattttctccagcaagaacaggccgagagggtgaattcggagataatttcctacctcgtcaggtttactagccaggaggcatcatcttgatgttttgctcccagttgaacctgaccagaaaaaaaatgatgtgcgatgggactccatttctttctgaactgaaaaggtcttgaattgccgaataaagtgtgagtagagttgaaaagggatgaaaaaaaactctgtcccgacccgtaccgttttccacatttgccctgtctgttttcgtatttgcgacataatctggaaatgagcgcggaaaccccaaaaaacaacaagttcatttttgtggaaa

SEQ ID NO: 15905 - DNA, 858 bp, Zea mays
cgcgcagaagacggggagtccggcaggggtagattagtccgaagaagaatacaacctgcagaaaaagcaatataaccggcgttaacagagcgcggggcattaactgtgccaatatggcgaggctgtgagctccagaataccaaaatgacgaggtccagctgcggagtaataaagtagcgaagccgcgcgacgagattattacaatctcaaataactccgcatcgatcaccctcctcgctcccggtcaacagcagcggcgcagagcacgacgccgacacgcgccatggcggcggtgaggcaccggcagctggaggccaacggcatcacgatgcacgtcgcggaggccggccccgtgaacgcctccgcgccggcggtgctgttcgtgcacggcttcccggagctctggtactcgtggcgccaccagatgggctacctcgccgcgcgcggctaccgctgcgtggcacccgacctccgaggctacggcggcaccaccgcgccgccggaaccgaactcctacaccgtcttccatatcgtcggcgacatcgtcgccctcctcgacgccctccacctcccgcaggtacctgcgcgcggctccgttccccgtcgaatcgaactccccaccgaagcctgcttgtcagaaattcctcacgcgtgttgcgctctctgcgggtgcaggtgttcgttgtcggccacgactggggcgccatcgtgtcgtggaacctctgcctgctgcggccggatcgggtgcgcgcgctcgtcaacctcagcgttgccttcatgccccggaggcccggcgtcaagcctcttgagtacttccgcgccgcatacggggatgagtactacgtctgccgattccag

SEQ ID NO: 15906 - DNA, 985 bp, Zea mays
  misc_feature (855)..(855): n is a, c, g, or t
  misc_feature (888)..(888): n is a, c, g, or t
gccggccgggccggggaatcgatcaccctcctcgctcccggtcaacagcagcggcgcagagcacgacgccgacacgcgccatggcggcggtgaggcaccggcagctggaggccaacggcatcacgatgcacgtcgcggaggccggccccgtgaacgcctccgcgccggcggtgctgttcgtgcacggcttcccggagctctggtactcgtggcgccaccagatgggctacctcgccgcgcgcggctaccgctgcgtggcacccgacctccgaggctacggcggcaccaccgcgccgccggaaccgacctcctacaccgtcttccatatcgtcggcgacatcgtcgcgctcctcgacgccctccacctcccgcaggtgttcgttgtcggccacgactggggcgccatcgtgtcgtggaacctctgcctgctgcggccggatcgggtgcgcgcgctcgtcaacctcagcgttgccttcatgccccggaggcccggcgtcaagcctcttgagtacttccgcgccgcatacggggatgagtactacgtctgccgattccaggaaccaggactcgaagcagaatttgctacgtttgacttgaagagtttcttcacattggcattgactcttcgggcaacaggttcttcagctatggaccttcgaaaaatgcaaacttacagtaagcaaatggtgctaccttcttggctatctgaggaagatgtcagttaaccttgcaagtgtgtactcaaaacctggatttgctggtggagtaaattactatcgctgcttggacctgaactgggaactgatggcgccatggacaggagcaaaggtgcaagttccaaccaagttcatcggntggggacggtgacctggcgtaccatcacctggnagtgaagagtactccacaaggcgggttcagagggactgccatgctgaagggatggggtcatcaaggcgctggcactcatcagcaggaagagcgcaga

SEQ ID NO: 15907 - DNA, 1748 bp, Zea mays
tatagtttttcatataactcacaggccaacagtagaattaagatacagtgtacatcttcaggttgcaacatattatttttagtggtaacatttattgttctaaaattagatgttgaatttcgtggagagaaacattaagctctggtttgaatagcttagccttttgatccacagaccattccggtgctagcttaggttaaatttgaactgttttgacatcactcattatcacagttgtaaattctccaacaagaatggttgattgcatcatcttcaggccacatcacgcattgtatcatgcatcatcttcacgccgcatcatgcatgcatgcatcggctggtggagtaaattactatcgctgcttggacctgaactgggaactgatggcgccatggacaggagcaaaggtgcaagttccaaccaagttcatcgttggggacggtgacctggcgtaccatcaccctggagtgaagaggtacatccacaagggcgggttcaagagggacgtgcccatgcttgaggaggtggtggtcatcaagggcgctgggcacttcatccagcaggaaagagcgcaggaaatcagtgagcacatccatgactacatcaagaagttcgaagcttgtggtctgccgccactgagagtttcaaagctatgagagacctgatggcttctgtacataactcaaatggtctgggagctattgtagttgtttgtagtgctgcagatctatatattatgaatggtatggagtactgacgatctattcaagggacccacgttgcgttgtgctgtgtggggggcacgggtccccacttaattttcttgtttcagtggacatcttattttatttgatgtagctacaaaggttcattagggcatgtacaatccaaaaaataatttgtatcttatgaaatctaagagggtaagtgaaaaaacaggatatgtatattggttaaaggacgtttttggcacggttctctaagagcaactctaaaagactgctaaaaatttattcctaaaaactatgtattaaaaactatgtattgggagctccagtaaattttctttccctaaaacattatctccacacaacagttccctgataattaacttcccaatagtttaaacttgtgacaaatcgtgggtttaccttgcatcggtggtattgtgttttctattttacggagttgaaacttcgccagttaaatgttaactaaaggatcaaatagcactacattctttaagtagcaacacaatttcaaaagcattctttgctgtgactatgagtacacacgcaggcatgcagcttcattgtccagttagcgctctcgcacgctgctcctgtcgccctcaagtctgtaggccaccgtgtccaggaatgattggggaaagacccgcctcccgctaatatacgtgagatggagcagtagatgcgggatgttgtaaatattgggagaagacgtgggatccgttggagtgagaaaagtctagttttcttcctaaaatgatttttcggatttgtttgcgtggtttcttagagttgctctaattccaagatacggttccacctatacaagccatataaataagccgtattttaagggtatctagtgaataagccccacaaaactcaaatatattgagttatatgaacaagtacttttagatgtatctagtgtttagagaaccacaatatagtatttaggttgtatatctataatataacactatataatccatcaaata

SEQ ID NO: 15908 - DNA, 612 bp, Zea mays
  misc_feature (562)..(562): n is a, c, g, or t
acccgataagtagcaggggcagggagaacgaagacgacgacgacgtacgccggccgtaagtgagccgagagcccccgatataccagctagctagataaccagccagcgcgagcatggaggcggcggcggcggcggtccggcaccggacggtggaggcgaacggcatctcgatgcacgtggcggagtccggccccgacggcggcgacggcgcgcccgcggtggtgttcctgcacggcttcccggagctctggtactcgtggcgccaccagatggcgcacctggccgcgcggggctaccgctgcgtggcgccggacctccgcggctacggcggcaccgccgcgccgcccgacgtcgcgtcctactccgccttccacgtcgtcggcgacgtcgtcgccctgctcgacgcgctcggcatccacaacaaggtgttcgtggtgggtcacgactggggcgccatcatcgcgtggtacctctgcctgttccggccggaccgggtggcggcgcttgtcaacaccagcgtcgccttcatgcgccacatcttcgtccgcgccgacggcgacgncgtcacgcccatcgactacttccaccgtacctactggcccacctactaca

SEQ ID NO: 15909 - DNA, 1442 bp, Zea mays
  misc_feature (1350)..(1350): n is a, c, g, or t
acgcatcgatcaccctcctcgctcccggtcaacagcagcggcgcagagcacgacgccgacacgcgccatggcggcggtgaggcaccggcagctggaggccaacggcatcaccattgggtacctcgaggccggccccgtgaacgcctccgcgccggcggtgctgttcgtgcacggcttcccggagctctggtactcgtggcgccaccagatgggctacctcgccgcgcgcggctaccgctgcgtggcacccgacctccgaggctacggcggcaccaccgcgccgccggaaccgaactcctacaccgtcttccatatcgtcggcgacatcgtcgcgctcctcgacgccctccacctcccgcaggtgttcgttgtcggccacgactggggcgccatcgtgtcgtggaacctctgcctgctgcggccggatcgggtgcgcgcgctcgtcaacctcagcgttgccttcatgccccggaggcccggcgtcaagcctcttgagtacttccgcgccgcatacggggatgagtactacgtctgccgattccaggaaccaggactcgaagcagaatttgctacgtttgacttgaagagtttcttcacattggcattgactcttcgggcaacaggttcttcagctatggaccttcgaaaaatgcaaacttacagtaagcaaatggtgctaccttcttggctatctgaggaagatgtcagttaccttgcaagtgtgtactcaaaaactggatttgctggtggagtaaattactatcgctgcttggacctgaactgggaactgatggcgccatggacaggagcaaaggtgcaagttccaaccaagttcatcgttggggacggtgacctggcgtaccatcaccctggagtgaagaggtacatccacaagggcgggttcaagagggacgtgcccatgcttgaggaggtggtggtcatcaagggcgctgggcacttcatccagcaggaaagagcgcaggaaatcagtgagcacatccatgactacatcaagaagttcgaagcttgtggtctgccgccactgagagtttcaaagctatgagagacctgatggcttctgtacataactcaaatggtctgggagctattgtagttgtttgtagtgctgcagatctatatattatgaatggtatggagtactgacgatctattcaatggacccacgttgcgttgtgctgtgtggggggcacgggtccccacttaattttcttgtttcagtggacatcttattttatttgatgtagctacaaaggttcattagggcatgtacaatccaaaaaataatttgtatcttatgaaatctaagagggtaagtgaaaaaaccaggantatgtatattggttaaagaacgtttttagcacggttctctgagagcaaaaaaaaaaaaaaaaaaactcgagggggggcccggtacccaatcg

SEQ ID NO: 15910 - DNA, 1074 bp, Zea mays
acgtatcgatcaccctcctcgctcccggtcaacagcagcggcgcggagcacgacgccgacacgcaccatggcggcggtgaggcaccggcagctggaggccaacggcatctcgatgcacgtcgcggaggccggccccgtggacgcctccgcgccggcggtgctgttcgtgcacggcttcccggagctctggtactcgtggcgccaccagatgggctacctcgccgcgcgcggctaccgctgcgtggcacccgacctccgaggctacggcggcaccaccgcgccgccggaaccgacctcctacaccgtcttccatatcgtcggcgacatcgtcgcgctcctcgacgccctccacctcccgcaggtgttcgttgtcggccacgactggggcgccatcgtgtcgtggaacctctgcctgctgcggccggatcgggtgcgcgcgctcgtcaacctcagcgttgccttcatgccccggaggcccggcgtcaagcctcttgagtacttccgcgccgcatacggggatgagtactacgtctgccgattccaggaaccaggacccgaagcagaatttgctacgtttgacttgaagagtttcttcacattggcattgactcttcgggcaacaggttcttcagctatggaccttcgaaaaatgcaaacttacagaactgggaactgatggcgccatggacaggagcaaaggtgcaagttccaaccaagttcatcgttggggacggtgacctggcgtaccatcaccctggagtgaagaggtatatccacaagggcgggttcaagagggacgtgcccatgcttgaggaggtggtggtcatcaagggcgctgggcacttcatccagcaggaaagagcgcaggaaatcagtgagcacatccatgactacatcaagaagttcgaagcttgtggtctgccgccactgagagtttcaaagctatgagagacctgatggcttctgtacataactcaaatggtctgggagctattgtagttgtttgtagtgctgcagatctatatattatgaatggtatgaagtactgacgatctactaaaaaaaaaaaaaaaa

SEQ ID NO: 15911 - DNA, 2164 bp, Zea mays
  misc_feature (5)..(5): n is a, c, g, or t
gctcnaaactaagtggtgcccccgcccctcacccccccccccccccccccccgcgctcttgtcttcggaagtttcagatcctcgcatcgtccgcaccttatcctctcgactttacagtacctgctctcagctcctccctatctcaatggcatccgcgaatgccatctccaccgcctccctcctccggcccctctctcagggcagggcgacgaggtcacagcggttcgtggtgcgtgcgaacgccaaagacattgcctttgaccagaaatccagggcagcgctgcaggccggcgtcgagaagctggcaaacgccgtcggtgtcaccctcgggccacgagggaggaatgtggtgctcgatgagtacggcaaccccaaagttgtgaatgatggagtcactattgcccgtgctattgagctgtatgatccaatggaaaatgctggtgcagcattgattcgtgaggttgctagcaagaccaatgattcagctggtgatgggactacaactgcatccgtccttgctcgtgaaatcatcaagctaggccttctgagtgtaacatctggtgcaaatcctgtatcactaaagaaaggaatagacaaaactgtgcagggcctaattcaggagcttgagaataagtctagaccaatcaagggtggtggtgatatcaaagctgttgcatctatctctgctggcaatgatgaatttatcggatccatgattgctgaagcaattgacaaagtggggcctgatggtgttctatcaattgaatcctcctcgtcttttgagaccactgttgaagttgaagaaggaatggagattgaccgcggttatatttccccacaatttgtgacaaaccttgagaaatcaattgtggagtttgagaattgtaaggttcttattactgatcagaagatcacaagcataaaggaaatccttccgattttggagaagaccacacagctgagagcccctctgttcattattgctgaggacattactggtgaagctttggcaactcttgttgttaacaagcttcgaggaattctcaatgttgcagcgattaaggctccaagttttggtgagcggcggaaggctgtacttcaggacattgccatcgtcacaggtgctgagttcctagcaaaagatcttggtttgttggttgaaaatgctacagaggaacaacttggcacagcaaggaaagtcacgatacatcagactacaacaaccctcatagcagatgcagccagtaaagatgagatccaggcgaggattgcacaactgaagaaggagcttgctgagactgattcagtttatgatactgagaaattggctgagagaattgctaagcttgccggtggtgttgctgttatcaaggttggagctgcaactgagactgagcttgaggaccgccaactaagaattgaggatgcaaaaaatgccacttttgcagctatagaggagggcattgttccaggaggtggtgcggcatatgtgcacctatctacggttgtccctaagatcaaagaagcaattgaggaccctgatgagcgtcttggcgctgatattattcaaaaggcattggtagcacctgcttcattgattgcacacaatgctggagtagagggtgaagtggttgtcgagaagatcaaggagagcgattgggaggtgggctacaatgcaatgactgacaagtacgagaacctgatggaggctggtgtgatcgaccctgccaaggtgaccaggtgtgcgctccagaatgcggcctcagtagctggaatggtcctaaccacacaggccattgttgttgagaagccaaagccgaagcctcaagtggcagagccaccggagggagcccttaccgtttaaaacttaacgttcttgaggctgctgtccagacggttcagatcagttgagagggtagaactttggtttgagaattttggttcagatccactgggagttgtagagtaggattgctattttgcagacgaagagtaattttactctggtctgaacttatccgaatcgaagacatttgcatcaccattttttaaaaataagctcatggcgatgctggattgtacgagcaagtacagtatgtttttagcctctcaaaaaaaaaaaaaaaaaaaacaagaagaaattaaagggcggccggacgcgtgg

SEQ ID NO: 15912 - DNA, 849 bp, Zea mays
gtggaacttatcctctcattcccttcattctcttgctttgaagggtggggggctagggcgggccgcactgcgcaccgagcgggcgccgggcggacgacgaagcggcgaggcagtgactggggagagatgtcgggcggcaggaggagggggcttgtgtggagcctccccgtggcgaggtcggatgcgctcggcaaactgggccctgccttcggcatcggcgctggctgcggcgtgggtcttggcttcggcctcatcggaggtgcaggcatcggagctggattccctggtttacaattggggtttggagctggagctggatgtggaataggaataggttttggttacggctttggaaaaggcgttgcatatgatgaaagtggaaggtattcgaacatcaggagaccgttccagagctccagaagcattgctttcgatgagaagttcgatatcatgtttgacgaactgatggagagcaccaggaagctgatcaaagcaacatcaaaggagatcgacaaatggaggcgaatgtagaagcgagcaggggcagcacgtataggatgaactgcgtagcgagagaaagcgatgccatcagaatctaaggtattaatgtgtgattggataaagtggcctagaagcttctacttgtgtgtaagaaagaaagaaagactaataaaagcgagttctccagagtacgaagccaaaagttgtcgaggcactctacacgtgcttcttctgtgtgtccgtgggaaccaaactgactaaaaagcaagttgctcgcttgctgttccatggaatatttttcagcgattcatgaggatgatactctggcctgccgatgctgatgctccc

SEQ ID NO: 15913 - DNA, 415 bp, Zea mays
cggacgcgtgggctggcacatgagtatttttgttcaaactttaacggtggctgtctgttatcagaaatgcgtcaagagagttgagaatgatgatactggtcacaaacactgcactgggcaatactttgattactggtcatgcatcgacaaatgtgtagcatcaaagctctttaagaagctcaaatgatttgtgcgatgtgatgcgacttctgacaaagtgaatcgaatttgcataccttacacctttggaaagtgtatgagctcgtacatcttggaataaaacatcaatttttctttgctaaaatgtggactggactgtgcataaatttcatgtgcatgcatctggtgtcaatcttgctcatttacgtgctgttttgtgagaaaacatattatcaaatagtttctcagtccggag

SEQ ID NO: 15914 - DNA, 645 bp, Zea mays
  misc_feature (629)..(629): n is a, c, g, or t
tacccccgaggccggccgggaaccgcccacttccccaaaacctgccacgcttgaacggctctcaatcccaaccctaacagcaccgtctctcggatctgatctgatctgatcctccaattcgttcgtccacgtctcgccatggaggacgaggaacttgttgatcagaagaaatatcttgaggaacgatgcaagccgcaatgtgtaaaatcactttacgaatatgagaaatgcgtcaagagagttgagaatgatgatactggtcacaaacactgcactgggcaatactttgattactggtcatgcatcgacaaatgtgtagcatcaaagctctttaagaagctcaaatgatttgtgcgatgtgatgcgacttctgacaaagtgaatcgaatttgcataccttacacctttggaaagtgtatgagctcgtacatcttggaataaaacatcaatttttctttgctagcatgtggactggactgtgcataaatttcatgtgcatgcatctggtgtcaatcttgctcatttacgtgctgttttgtgagaaaacatattatcaaatggtttttcagtaaggaaaaaaaaaaaaaaaaaaccgaccgacaaaaaaaaaaaaaaaaaaaaaaaaaaantaaaaaaaaaaaaaaa

SEQ ID NO: 15915 - DNA, 3475 bp, Zea mays
  misc_feature (2685)..(2685): n is a, c, g, or t
gccgccggctggtgccctcgcggcaacgctccgcccctcgcagccagcaggacaccactcatcttcttctcccccgcctcgtttccatcgccaccaccctcttctcctgcggtcctcccccgtcccactcccacccccctcgcctccgcctccactgcagctgccgccatgcagagcctcctcctgcccaccgctgccgtggccccggtggcgcctccgtgcggaaggcggaatctcccgggacgcctctccgtccgcgcctccgcgacggtggtagcggcaccgcggcgggagacggatcccaagaagcgggtggtgatcacggggatggggctggtctccgttttcgggaacgatgtagacgcttactacgaccgcctgctagtcggggagagcggcatcgggcccatcgaccgcttcgacgcttctaagttccccacccgctttgccggtcagatccggggcttctcctccgagggatacatcgacggaaagaacgaccgccgccttgatgattgcctccgatactgcatcgtcagtggcaagaaggctctcgaggcctccggtatcgcccacggctccaagcccatggaaaagattgacaagacccgggccggtgtgcttgtgggcactggtatgggtggcctcacggtggttttcggatggtgtccagaatctcattgggaccttcggatacagatagaaacaaacagtctctggtattgcgcttttgataaatctggggacgttggttggttcattgtgtgatgctgactacaatttacttgtttttggattggaatgtgactccggggatggtgagattcgtgacctttgatggcttagacgcagagacgctaaatagtggcaggatatgccatcttagcttggcccgaggagtaacacttgtgttcagtctagactctgaaattaacgatctctatgacacatttagatatcatgtggaaaggaataaaatgtgctatcccggatgatcgattgtagtttgaagttgatagggttcttctggttcttcaactctttggtgcataacagggaaacaaggtgaaacttttttaatattagtattggtttctgtagtgctagatacttcaataaggtttttgctgtaaagggtctctgaatgcattcatgtccgcatcataggaactcctgaacttggcagaattgcttaatctaaagagcattatgccgtaaattttcagcagcaaattgctcgtcaggatttgtgcagcagtgtagatatatagtacagtctctatttttgagtagtaagcacaatgctacagttgtctatttggctaaattagcgcatcgatttccattgcaaaccgtggtgtagggcaaaaacgacaagtgtcttacaattagaacagtattaacataggcacaacaggtttaattcgtattaacatagctctgcgaaaatctgttgtttcgtttgatgattcacttgcattatggtgatttttctagcaaagtactacctttttccaggcatattgtggacggatagtgtcattagaagcatattttaaccattattgttttataatattgctagtctctgcaaaatcaatgtcgcattaaaagttgtttgagtataaatctgttgatatagcttttgtactccaaacacacataatttgactaattgttggttgggtttacgagtttggtttcttcaaaataaacacgccctacaggtcagagggagtagcatttttggattaaatcaaattgtcttctagcacatcaaactatggtttgtactgtattgatagtagtttcatctggtagtttgatatttttactagtactataagattttttcactgttaatgctacatttgatgctaattggtaaaatattctctctggcagattgacaagacccgggccggtgtgcttgtgggcactggtatgggtggcctcacggtgttttcggatggtgtccagaatctcattgagaagggatacagaaagataactcctttcttcatcccatatgctatcacaaacatgggttctgccctgcttggaatggacattggtttcatgggtccaaattactccatctcaactgcctgtgctacctcgaactactgtttctatgctgcagcaaaccatatccgtagaggcgaagctgatataatgatagctggtggcactgaagctgcaattattccaattggtgttggtggctttgttgcatgtagagcactgtcacagaggaatgatgaccctaaaacagcatccaggccttgggacaaggatcgtgatggttttgtcatgggtgaaggagctggagtcctggtatgatatattaacattatttgttatattgttaaacacttaaacctataaactgcaaaagaaattattttttatttaacagtttgttagagacttagagtaacttccactcagctttgatgcacccagggtctatctctagctgctccaaaacttcagttacaatggatgttttctgtagtctatattcaattgatcattcatcttttgccatgtatattcttatgccatgatgataagatatttcatgcttgtcattcctttttgccatggaattatgatttttctatccattaatcaatattctaatccctagttctttttatttgacaaaggtcatggagagcntagagcatgcaatgaaacgtgatgcaccaataattgcggagtatttaggaggtgctgtgaactgtgatgcttaccatatgactgatccgagatctgatggtcttggtgtttcatcttgcatcaagcaaagccttaaagatgctggtgtggcgcctgaggaggtattttgaattttagatgttaaaaataccgcttaatttcatatttgttccattatgcttaaccttgtctgtaactctgtgttttctagagtgacagctcgtaattcttaaatagtgaaactatagttatgcaatttggcatggttgccacactttgggttcagatatggttcactcatctagctggtgtctaactatacactgtaaatggaaattccttacacatttcacagctatatgtttttccttgataagctggaagggcaggtctagtgcacttgtgagagttgtctcattgagttatcaggtcatggctttgaaggcttgtctcggtttacctctaccctagaccctactcatgtgggagcctctggcactatgtctgcttccctaaagttggattgacttcattaattcttcgaggaatcttaagtaaatgggacacttacgaactatttgcaggtcaactatattaatgctcatgcaacatcaacccttgatggtgatctggcagaggtgaatgccatcaagcaagtcttcaaggacccatctgggattaaaataaatgcaaccaaggtatttcaacctatcaatattatttcagtatattgattcattgccccttcctg

SEQ ID NO: 15916 - DNA, 1994 bp, Zea mays
cctcgaggccggcctccatatacacaggggtaacgctccgcctcgcagccagcaggacaccactcatcttccttcccccccgcctcgtttccatcgccgccactctcttgctcccccgtaccatccctcgccaccgccaccgccgtcgctatgcagagcctcctcgtgcccactgctgcatcggccccggtggcggctccgcgggctcggcggaatctccctatgcgcctctccgtccgcgcctccgcgacggcggcagcggcaccgcggcgggagacggatcccaagaagcgggtggtgatcacggggatggggttggtctccgtgttcgggaacgacgtagacgcttactacgaccgcctgctagccggggagagcggcatcgggcccatcgaccgcttcgacgcctctaagttccccacccgcttcgccggccagatccggggcttctcgtccgagggctacatcgacggaaagaacgaccgccgcctcgacgactgcctccgatactgcatcgtcagtggcaagaaggctctcgaggctgccggtattgcccacggctccaagcccatggaaaagattgacaaaacccgggctggtgtgcttgtgggcactggtatgggtggcctcacggtgttttctgatggtgttcagaatctcattgagaagggctacagaaaaataactcctttcttcatcccatatgctataacaaacatgggttctgccctgcttggaatggatattggtttcatgggtccaaactactccatctcaactgcctgtgctacctcgaactactgtttctatgctgcagcaaaccatatccgtagaggcgaagcggatataatgatagctggaggcactgaagctgcaattattccaattggtgttggtggctttgttgcatgtagagcactgtcacagaggaatgatgaccctaaaacagcatccaggccttgggacaaggatcgtgatggttttgtcatgggtgaaggagctggagtcctgatcatggagagcctagagcatgcaattaaacgtgatgcaccaataattgcggagtatttaggaggtgctgtgaactgtgatgcttaccatatgactgacccgagatctgatggtcttggtgtttcatcttgcatcaagcaaagtctcgaagatgctggtgtggctcctgaggaggtcaactatattaatgctcatgcaacatcaacccttgctggtgatctggcagaggtgaatgccatcaagcaagtcttcaaggacccatctgggatcaaaataaatgcaaccaagtccatgataggacactgccttggtgcagcaggtggtttggaagccattgctactgtcaaagcgataactactggatgggtgcatccaagcataaaccaatttaacccagaggaagcggttgaattcgacacagtacctaatgtaaaaaagcagcatgaagtgaacgttggcatctcaaattcttttggatttggaggtcacaattctgtcgtagtatttgcgccatttaagccataaggtgttcctggcctcacaaaccttggtcagaacaacgaggatctttaggagtttctgcgttcaattttcatgtgttctctttaggggaagttatgtcagatctgagccggcaacgttacaaatgaactaaagctgagatacattgctttttagataactccaggttcacttaggttgtgcgcggctgtacaacgttgctttgaatcatttgtaattgattgtactgttttttcatgtaatggaagaggggttctgtagaagaagcacatttggaccttctagagttctagttcaataccacacaaatgaatttggagggtaggaattgtgtccctgctgctggatctggacgctttatggaaacttttttttttgaaatggcaatatatataatttacacgcgcgcttgagagaaacgtgcgctatctcaaaaaaaaaaaaaaaaaaaaaaaaaaaaa

SEQ ID NO: 15917 - DNA, 1916 bp, Zea mays
cattgggtacctcgaggccggccggggctcgcagccagcaggacaccactcatcttcttctcccccgcctcgtttccatcgccaccaccctcttctcctgcggtcctcccccgtcccactcccacccccctcgcctccgcctccactgcagctgccgccatgcagagcctcctcctgcccaccgctgccgtggccccggtggcgcctccgtgcggaaggcggaatctcccgggacgcctctccgtccgcgcctccgcgacggtggtagcggcaccgcggcgggagacggatcccaagaagcgggtggtgatcacggggatggggctggtctccgttttcgggaacgatgtagacgcttactacgaccgcctgctagtcggggagagcggcatcgggcccatcgaccgcttcgacgcttctaagttccccacccgctttgccggtcagatccggggcttctcctccgagggatacatcgacggaaagaacgaccgccgccttgatgattgcctccgatactgcatcgtcagtggcaagaaggctctcgaggcctccggtatcgcccacggctccaagcccatggaaaagattgacaagacccgggccggtgtgcttgtgggcactggtatgggtggcctcacggtgttttcggatggtgtccagaatctcattgagaagggatacagaaagataactcctttcttcatcccatatgctatcacaaacatgggttctgccctgcttggaatggacattggtttcatgggtccaaattactccatctcaactgcctgtgctacctcgaactactgtttctatgctgcagcaaaccatatccgtagaggcgaagctgatataatgatagctggtggcactgaagctgcaattattccaattggtgttggtggctttgttgcatgtagagcactgtcacagaggaatgatgaccctaaaacagcatccaggccttgggacaaggatcgtgatggttttgtcatgggtgaaggagctggagtcctggtcatggagagcctagagcatgcaatgaaacgtgatgcaccaataattgcggagtatttaggaggtgctgtgaactgtgatgcttaccatatgactgatccgagatctgatggtcttggtgtttcatcttgcatcaagcaaagccttaaagatgctggtgtggcgcctgaggaggtcaactatattaatgctcatgcaacatcaacccttgctggtgatctggcagaggtgaatgccatcaagcaagtcttcaaggacccatctgggattaaaataaatgcaaccaagtccatgataggacattgccttggcgcagcaggcggtttggaagccattgctactattaaagcgataactactggatgggtgcatccaagcataaaccaatttaacccagaggaagcagttgaatttgacactgtacctaatgtaaaaaagcagcatgaagtgaatgttggtatctcaaattcctttggatttggaggtcacaattctgtcgtagtatttgcaccatttaagccataaggtgttccttgcctcacaaatcttggtcagaacagtgagatctgatttctgcgttcaattttcatgtgttctcttcgggggggaagtaatgtcagatttgaaccagcaacgttaaaaatgaactaaagatgagatacattgcgttttagatgactccatgttcacttagattgagcgcggctgtacaacattcctttgaaccatttgtaattgattgtactgtttttcatgtaatggaagaggagtcttgtagatgcacatctggaccttctagttaaatagcatacaaatgaatttggaaggcaggaattctgtccctattgctggatctggactcttttatgcattttttataaaatggctatatatac

SEQ ID NO: 15918 - DNA, 5061 bp, Zea mays
  misc_feature (1773)..(1773): n is a, c, g, or t
  misc_feature (4340)..(4340): n is a, c, g, or t
  misc_feature (5034)..(5034): n is a, c, g, or t
ccgattaatggagttgatccgtccactacctgcaacgcgcaacaccaaatatttagccattcaaagtttactttagtcaatcaatgtttacttcaacgtacaacaggaacaaatatttagtcattcaaggttcttcaaccgtttaaggtttacttcaacgtataataggaacaaatattcagtcattcaaggaggcttcattcaagattcaagatcaataatttaaggtgctgagtcaaggactcaaggatgtgcttttttcgttaggggtgggtcgcttgggtgtggaatgggtgagcgggattaacagtgtggccgatggggggttgggttcgatcgtgattaagcaggactatcacccgaagcagcccaccgaaccaccctgcacgccgaggcgcttaattgattctggcattctgctgatccctcgctcgtgcctcactcgcctagtccaccacccaacatctgcaatttttcactgtcgcgtctccactcatccccctgcagctagggatggcaatgagaaggatatggtggatttttatatccgcaggtatgggtatggatactataaagtatccacagataaatattttgcgggtatggatatacaatattcatatccgttacccgttggacatatgacatgtgggtcccaattttcccttgcttctcatgcagtcatgcggtcctcgggtcttgccttgagccccacacggcctggcggcccacaccactcaccaccactacgtcactaccacacggagtcacaaacagatcacaaacggactcgtcgatcactcactcgtttaccctagtagccgtgtgctagccgccctaaatcacatcgagccaccgtcgtacgaccggttggcgctgcctagcgcgagcggtcgtcgttccttgccctccatactccgtcgagcggccaacgtcctattcggttgttccttgcatcagtcatcgagtggccgtcgtctcgctgcctgcaccctccgtcgagtgaccaccgttgtggcattgcctcgcctccgtcgagcgccctctgtcacgcccccactgtccggtgccccgtgacctctgtcgagcagtcgcgagtctacgtcgcacgcccaatacaacaactggtaattttttgtttcgatttggattggactgattgcttattatatgtatttggacagattgctgaagtagtgaaatggtttcataagtttggatagatcaatttgtatagaatacagattgattgttgaatgttggaatatagtgggtgggcgggtaacggatatctgttggatagcggataaccggcgggtacgggtacggatatagatccgtacccacgagcgtaaatgggtatggatatgggttgggttttatctcgtgggtatggatacacgaaccatatatacgcgttatacccgcccgattgccatccctacccgcagcagccgcctgccgtcctcgactcatcaccttgaattgtcgaccttgaatggctgaagtaattcttgaatggctccttgatttgttgaatatttgttcatgttgtacactgaagtaaactttgaatggctgaatatttgttctcgctatacgttgaagcaaatcttgaatgactgaagtcaaacttaaaatgctgaatatgtggtggcccgcgctacgggcggatcaaccctattaagcgtgggcggacctgatcgactggtgtggttggttccgtggtgcacttagtttcctggtgcgattggttcctggtgggctggtccngttataccttttggtccaggtgatggaccatgcgtcccatcaccctaagtgatgattagcgtttagataatacccttgcgatctgtcaaaaaaaactaattggttggagccaaattatttgtatgcaaatacaaaatgtttgggctccagactgtgcacaatacgcaaaattcaaccaagaatgaagcatggtgtgctgcatgtttttgaaatgaaaggctgtagaggaggcccctacaacacaaatttgtttattaaataaacgggacagatcgagaaaagaatacagaaggaggaagagaaagggaggataaggatcagctatctagagtttagccataaggatacatgaagcttaagagtagggctaaatctaaacatctgaagcttcaacatgtcgttgaaacagatccttcaagaagagaaagagggggtgatgttcctgaaaatggaatcatttctttcttccagacagtgctaagtcaccacaaccaccatttccatggagaagcgcctgccaaaacattctttgtgtcttctaacattctgaagaaatcaagctcaaggttccactggatacccacgtattgccagcagttccagctgaagggggactcaaacagcagatggaagttttgtctccttgtagttggaatcacaaagcacactgtgcggatcgctagctgcattcataaagcctttcctcttgagcaagtttttcgagatgattctgtctctgaagacaagccagataaaaaccttgatctttttacaaactttggactgccaccacaggaacggaggtggtggttcgatggatgtaaagctgaggctgtagaactttgaggaactgaacttgctattcccccaagggtagatccacctgtctgcgtcctccctggccaccatcatttgctcaacgatctcagaaaaggtctcatattcctgagcagcttgcaaggagagaggggtatgaaaattatcctccatggacatattgttgaggaaggtctgcacagaggtctctttattcttgacgaaggagaagagacagcggaaagcagtcatggagagagattgttccgaacatcttgccagagaagaatagtgcttccatctcccacacgaggcatacgtagcctctaaaataagtaaataacctgataacatccttccaccagaaagaacctttctcgggggagcaatgagggatccgacccaaaagcatagtacgactgtacgacccccaaagtcccaaaccaagttgacccagggtatgtccaatctgttatagaacttgtgaacaaatttcatcagaagggccacgttctggattcttaaattaagcacaccaaggactcctttgctctttggacaggtgacacagctcatttgtttggtccattgatctgttgctgcatccactaatccacctggaccactccagtcgttctgctcaaaagtatttttcactgaaatgcacctggtgtccttttcctaaattctcaaccagtcccacaacaaactctcaaactgaggatctgtgcccttatacctttttttaagtagtttgctccaaatgacaatccatgtccatgattcaatagtggttatgttgttttgtctctgacgtctttttataatgacagagctgcggttgattttgaaaagaaggcacactctgataacctcgaacaaagtaaagcaatggagaaaaatatgattgctgtggctagtgagattgagaggcttcgaggagagcttgcaaatgctgaaaaaggggccactgctgtcaacccagcagcagctgttggtaactctggtaccatactgaatctgctgagtatactgtcactttcctttaagtagaatttatgtattttagaagaatgggcataggaagttagcataatgaccataattcattgcaggctgttaaacacaaagccaattgctttcagcagcttagatcatctttgtggttgcggctagttttgtgaaatatgtacagatttgaatgagtttttcctgttgtttatagccccaaaaaaaagcttccggatagttttagtatcctgaagtactgtagaaacttgtaagtgtatttgaaagcccgacatggtactgaatatagaaccatttgtcccttgagcttactacgttatctaaaatgctagcttttgggatcaatggtgaagggtgggcagactaggttcacgtaggaatcaaagaaagtttgataatagtagcactaggctgctatcttattcgagaggtgattgtttgggtgggccttgggttctgttcaggagatgatccctacatcttctggcttctttaaatagggcagctttagcatatttagataccaggtgaagaagcatttcatttagctcccactttctgttagcctggattatttagttgaagctagatctaacttaaattgcattaaatttcttgtgtaattgttctatttgcccggtctctgcgccgggtgctcccctacggcagggtatgctgcgccttacggcaattctgcgtcaacatatactggaatgtatggncaatcctgatgcaacgtataccgcgcaggcttatcctgacgcttatagcactaatcaggtctgtttacttgctttatgactgttatcttatttgcttttaatgtaactacaacaattgttcttggatgcatctaaaagctgtagtctattgagtcacactaggggcatgtacagtgagtgtcttgagccgtgtcttcagctgtgtctaaggaggtaaatgtaaaaaacttaaaacatgtctcttaacgaagacacttgtcttggctctttgctcgaggtagaggtcagttgattggtccattgaatttattgaatactctgaatgggtgcaataaatatagtaatatacaggttttagacacatccaccgtatcctaccgtgttttagctgtatcttatacctggagtaccgtggttgtgcatgccctaatgaaaataaaaaataccgttccagaattaatttctcatttctgtttgaatctcaattatttattttgcatgattaatgatcaacccttctcatcttatttcttttctacgttgtttcccattctgaataatttgtttacttttttagttgccttatgcaagtcatctttaaaataagtaccacacaatgcaacaagcagctcagcctgaatctaatgttgacatctctgtgttctaaattacaggctcacatgcacaccgtcgncaatccgcattacatgagtcaacctgt

SEQ ID NO: 15919 - DNA, 1480 bp, Zea mays
aaaaaacagagcagcaccgtccggttttcccgggtccccccagctggcccctcctttcccctttcccctctcgcctctgctgccctcgccgagtccacccaatcccccgcgcggcgacgctagtcgcctccgatggcagcccggcgcgggccccacgtcatcaagcttcacgatcccaacccgcccctcctcggacgggcgccgggggccgcgccggccgccgtccccgcgtcctcgcgcgatgagggcctcctcgcgcagcacctgcgcgcctccgcggcgcacccggccttcgccctcatcgaggagcgcctcgccgcccgggaccaggatatccaggagctcctcgtcgacaaccagcggttcgctgccacccacgtcgcactccagcagcagctcatagcggcgcaacacgagctccgggcggtctccgtcgccgccaccagggcgcgcgccgagcgggagggcgaggtgcgctccctggccgaccaggcggcgcatatggaggctgaggcgcgggccatcgccgctgcgcgcgcggagatcgaccaggtccacgccgacgtccaggtgctcgccgcggcgcgcaccgacctcgtcaacaggctccaggtcctacgggagaagctcgcgcacaagaaggctgaggcgagtaagaccgattccgtccgtccccagattgaaaccatgcgccgggagatccagaacggcagagctgcggttgattttgaaaagaaggcacactctgataacctcgaacaaagtaaagcaatggagaaaaatatgattgctgtggctagtgagattgagaggcttcgaggagagcttgcaaatgctgaaaaaggggccactgctgtcaacccagcagcagctgttggtaactctgggtatgctgcgccttatggcaattctgcgtcaacatatactggaatgtatggcaatcctgatgcaacgtataccgcgcaggcttatcctgacgcttatagcactaatcagggtcacatgcacaccgtcgccaatccgcattacatgagtcaacctgttccctatggacaatacgagagccagcacaccaatgttcaaagatgactggctgcaagagatagctttgactcgcctgccatctcattgtaacaggatagtcgcagaatccaccatgttacattgaaagtgctgaagtcctcatgttcatgattttttttttatttatttggctaatttgttccagaatcgatgggttgaattttggagcaaaaacctctcgcgcctctccatttactaccctgatgattcctcagttagtgatggtgttattcagggacgatgatgcctctagccttttacgaatgcgaccgtccatgctcgccgagatcaagcttagggcatatttgggagtaaagtatttttatagtttcttgataccgctatgtttttaataatattttagtattttatatcataaaaaaaaaaaaaaaaaaaa

SEQ ID NO: 15920 - DNA, 3307 bp, Zea mays
  misc_feature (2902)..(2902): n is a, c, g, or t
gatccaatccaactaataatttgttagctggctaacaattatttctaggtgtttcaaacatgtcttaaagatgacagcaaaggggcccgggcccaggacggtggccatacatgctttggttctacttccctgtagactatttttctttcagcgatggaagtgaggtgattcatttttttaacgtatgggatatgggaggaggatattgaagaaatgtattcgtccgcgtttatacagttaaccttctttaaagaagaatattgtaagttcagggagacagagggcgaatgagcgatgcattcacggttgcataaatagtgtaatgttttttttgttttttttgaataaggaaatattccggcctccagcataaatagcataatggttcttgcgttacatacttaattacaaatagcattacattttggataaaaagagcaaagtgcattcatcatactgaaagatcaaaataaatacactgacgatcatattacgtacatgtactagctactcatttgacataatttggcctgcttcacagaacatatatactaataacgcgagtagcgcattggagcagtcgaatggaccgggttaataataaggtatagcatgagattagtatgtttttttcttaatggttataaataaatatacgtgtatatatatatatatatatatatatatatatatatatatatatatatatatatatatatatatacgctctcaaccgatccatcgtacattactacgtactggtacgatggatcggttgagagctggcaggcacatgtcgacatattcaggcagatgtgcgtccggtgacggcagcggcggcgtacggcggggtgtagggcgggccgggcggcttgggcgtgggcggcttgggtgctggtggtttgggcgtgggcggcgacggtgatggcggtgacggcgcaaggccgcagctgaccatgcacacgacgctcttctggtcgcagctgatgatgcagagcggcaggtcagcgccctgcttgcccatgcatccgaacgaacagccgaacacctgcgtgaagcagcccataaggcactggatgatgccgttcagctgccccggggacgccgatgctggcgtcgtcagcagcgccgccgcgttgctgtcgccgctgctgaaggcaacggtggcactcgccccggcggccgcgccggccagcgcgacgaagagaagcacgagcaaggagccggtgctggcgcgagcactgccggtcatcgccgcggccatggtcgtgtgtgcgggagggcgtcgtcgaatgacggtgagcgagcttcactgatgctggggaggctgtgggcctgttacgtgttgttggagggtttatatacaggaacaagggggcttaagattgagcgtggcgtatgatgccgcgacgatcgtgtttttggtgtgcggttgcttttcctcgcacgcgcacacacgatacgggtgatcaagaatcacgtcggaagtatggctttgcaaattattattggttttaacttactataagcattcggaataaaattatagatacagctaataagatggtccatctaataagatagcccggttggtctaaggtgctagactttttaaaaaaatactctctccattattatttgtcgcgttatgaactaacagatgataaatattcgagaacgaagttagtacatcattataaacctattgtcatcagctttatgtttattcttattgtattattttttattataatataattttgcattacctaagcatgttgtcatcatctttattttaaaactcttattattattattattattattattattattattattattattattattattattattattattattattattattattattattattatatatctttactacttattaaggcggcaagggtagactgtcattcctgattctgccattcccattccgatgtcctggtcgtggcatttctcattcccacccacacacactgttgtctgacaggtggccgtccaacacccataacatttcccattcccatcctgtcttgtcgtcgtttgacaattgggacaggtgggtcccacaaccatggcatcttctccattctcattcccacacctgtgcaccaacgccaaaaaagctagttgtgtggggtgacaaccatgaccaaccaagactacacaagttgttccacactggaacttataaacaggtgtgtgcgcaatttagtggtcgatgtggtactaagtttagcttccaaatacgaagtacacacgtgctgggagtcccatctgctttttgtggcctagacctaggcccactatcggacaaccgctctccccacgaaatcctcccccgagtcagcggactccccctcccccacccccgcgctccacttacgtgactcgcgcgcgacacgcgagtaggaggttgagacgaagacccaccgccaccgaggatggcccaagcgccgccgcgacctagggagcgaggatgaggagctcgaggaggtgcgccgcatgcggaggattcctgcaaggaggagaacatggaggtggtgcccgtagtagtaggggaaccggtcaagagcactggcgaggggaagaaatagaagaagcactatgcttccttggagtaccacgtcaacatcttggagctggtaagcatcattctcctccgttccctccccttcctgctctgtttatctaacttctctcgttaagagatccacacttttgctttcttgggattttttggggtttcgggaggaacaggtgagcccatggtttgttcctccggcccttccctcccctccctgctcccccgactctgcgcggatctggtactatctagcccatagagccgtgctggacaacacagccacgaccanaaggcatcgctgtggagcagtcggagccatttgtgatgccccctcccggtaagagatccacacttttgctcgtctggtgatgagataagcaagtacgagtactaagttacctactcttctctccaaaatgagggccccaaaatgttgaggaaaaatgtctccagttcacacaaactaccaatccagataagccctctactccatggtgctccaaacaatcggcctctgataatggagtttagcatgcttgagtttgaccacttaggtgtaaggatgcattttcagctatattgtgtatgcaataacttaagactatattgtattattataagtgcagttctgtttatctaacttctcggtcttatagtgtcataaagtgttgattaactgaggataaattattct

SEQ ID NO: 15921 - DNA, 895 bp, Zea mays
ctcgaggccggccgggacattccttagctctgccctccgcccctcccaaatccattcactaccgccggcgccggatccaataggaggaggaggaagatgactgtgggcatgatcaacgcaaacccggtggtgcacgagcggccggagcgcgcctcgcacccccacgccgccgatgtgctcgaccctctcgatgtctttggcgggctttcgtggtgcggtgcgtcagatacggtgcgggacatcaaggacccggagcacccgtactccctggagcagctcagcgtgctgtcggaggagtccgtctccgttgacgagacgctcggacgcatccagataaccttcactccaactgtgcagcactgcagtatggccacagtcattggcctgtgcctccgacttaagttgatgcagaacttccctccacatttcaaggttgacatcaaagttgctccaggatctcttgctaatgaagaatcagtaaacaagcaactgaacgacaaggagagggttgcagcagccttggagaaccccaacctacgccagctggtcgatgaatgcttatgcttcaatgatccatactcacgttaacttgttccatgctgcttcacaagtcgcaaccctgcctgctgtacagtagtaaccatgcatgctgtagtctgccctatatgttgacgctgtcgttgtacctggcaacgtgtaattaactgccccggagacatctgtttttgccatctttaaaacgtatggatctcaataatatgacaagagttgcctgcttatgtgacattagcatccaaaagcaagtgtcatttaatgtaaaatcttggtctttgttggtcatctgcatcggacgtcaattctgatccttgaaaaatataaaaaaaaaggcccctag

SEQ ID NO: 15922 - DNA, 933 bp, Zea mays
  misc_feature (878)..(879): n is a, c, g, or t
actcctatgggcgattgggtccctcgaggcgcaactcgggaaagtgcaccaatgattgagacccgactcgtcgtcgtcggtcctctccccacattccttagctctgccctccgcccctcccaaatccattcactaccgccggcgccggatccaataggaggaggaggaagatgactgtgggcatgatcaacgcaaacccggtggtgcacgagcggccggagcgcgcctcgcacccccacgccgccgatgtgctcgaccctctcgatgtctttgatacggtgcgggacatcaaggacccggagcacccgtactccctggagcagctcagcgtgctgtcggaggagtccgtctccgttgacgagacgctcggacgcatccagataaccttcactccaactgtgcagcactgcagtatggccacagtcattggcctgtgcctccgacttaagttgatgcagaacttccctccacatttcaaggttgacatcaaagttgctccaggatctcttgctaatgaagaatcagtaaacaagcaactgaacgacaaggagagggttgcagcagccttggagaaccccaacctacgccagctggtcgatgaatgcttatgcttcaatgatccatactcacgttaacttgttccatgctgcttcacaagtcgcaaccctgcctgctgtacagtagtaaccatgcatgctgtagtctgccctatatgttgacgctgtcgttgtacctggcaacgtgtaattaactgccccggagacatctgtttttgccatctttaaaacgtatggatctcaataatatgacaagagttgcctgcttatgtgacattagcatccaaaagcaagtgtcatttaatgtactcaaatctgggnncttgtgggctctggatcggacgtgtcaatctgatcttggataggtcggttctgg

SEQ ID NO: 15923 - DNA, 5372 bp, Zea mays
ctccctcttttccccaaaaatcttcgtgtcccgcatacatctcctcccctcccgtattttgttgagtgaggaaatttttccccaactcagcacctattctacccgtatttttcttgtcgcgcgcgtgcagtttgtgccagcagcttctttttgcgtagtgagtcacgctggcccaataaaacgaatgtagggatgtatactccttattttttatccacttttcaattttcactttttatttagaagaactgttagtgtacacatcataatccactcctgaaactttttaacctgctcctaataaccaatttttggagaaaattttcaacatgtaactcttatatccagtttgttgtgaatatgtttaaatttctgcatcctagattcgtagtagtagacaagcggaggaaaaatgactaattagattatacgagaatacaaacctatgtttagctgtgtcttttactctattttattcaacttagaccccctttaaaatacagctttacggaatgctacagtgatcatctcatttcaaataaaaaccgaaggaaaacataaaaaactcacatgtcgaagtgggccttattggctgattctagagtaagaaaatttagtaaagactagtttggtaactttatttttaagatttttttaaaaataaactaatttctctttagaaaatagaaattctttgaaaaaataaggtcgtcaaattagccctaataagtaaacttttcggacatcatttgaatatttaaatcttggtccggcccattttaacaatgtatctgtccattgagaactgtatctgatccgatacaaaggctgctgatggctgatattttttctggtaagttttttttattgatgataatataccgcaaaaccttgaggccattgaaggagacaaaggactacgatgcaaatctaaatttttcgcaggctgtcatacaaaacaacaaccaaaagaaaacgaatggaaaacaacacactctctctctataacccacgctgtccccccccctccgccggacacccactccactcaccacaccatccatggcgatggcgccctccacggcggccgcatccacccttctccccgtcctcctcctcatcgccaccgccacccagtgcaccgcagccgattcattctcttccccgaacgctgccgccctcctcaacctctctgcggcggtagcagacccctcgggctacctctccacgcactggactccggacaccgcggtctgctcgtggccgcgcgtgtcctgcgacgccaccgacacacgagtcatctccctcgacctctccggcctcaacctatctggccccatccccgccgccgcgctctcctctttcccgtacctccagtcgctcaacctctccaacaacatactcaactccaccgccttccccgacgagatcatcgcgtcgctcaagagccttcgcgttctcgacctctacaacaacaacctcaccggttcgctgccggcagcgctccccaacctcaccgacctcgtccacgtccacctcggcggcaatttcttctccggcagcatcccgaggtcctacggccagtggagccgcatccggtacctggccctctccgggaacgagctcaccggcgagataccggaggagctcggcaacctgacgacattgagggagctgtacctcggctactacaacaacttcaccggcggtataccacccgagctcgggaggctgcgggcgctcgtccggctcgacatggctaactgcggcatctccgaggagatcccgccggaactggcgaacttgacgtcgctcgacactctgtttcttcagatcaacgctctgtctgggaggctcccgacggagataggcgcaatggggtcgctcaaatcgctcgacctgtcgaacaacttgttcgtcggggagatccccgcgagcttcgcgtcgctcaagaacctgaccctgctgaacctcttccggaatcgcctcgccggtgagattcccgagttcatcggcgacttgccgaacctcgcgggcctgcagctgtgggagaacaacttcacaggcgggatacccacgaacctcggcgtggcggcgaccaggctgaggatcgttgacgtgagcacgaacaagctcaccggcgttctgccatccgagctgtgcgccggccagcggctggagacgttcatcgctctgggaaattcgctattcggcgacgttccggacgggctcgcggggtgcccgtcgctgacgaggattcggctgggagagaattttctcaacgggacgatacctgcaaagctgttcacgttgccgaacctgacgcaggtagagctgcacaacaatttgctctccggcgagctccggctggacggagggaaggtgtcttcttcgatcggagagctgagtctgttcaacaaccgactgaccggccaggtgcctaccgggatcggtggactcctgggattacagaagctgttgctcgccgggaacatgttgtccggcgagctcccgccggaggtcgggaagcttcagcagctctcgaaggcggacctttctgggaacctgctctccggagcggtacccccggcgatcggcagatgccgtctgctcaccttcctcgatatctcgagcaacaagctctccggcagcatcccgccggagctcggcagcctccgcatcctcaactacctcaacgtttcccacaacgcgctccaaggggagattccgcctgccatcgccggaatgcagagcctgacagccgtggacttctcctacaacaacctctcgggcgaggtcccgtccaccggtcagtttggctacttcaacgccacttccttcgcaggcaacgctggcctctgcggggcgttcctctccccgtgccgctccgtgggcgtggcgacttcggccctgggctccctctcttcgacgtccaaactcctgctcgtgctcggcctcctcgcgctgtccgtcgtcttcgcgggcgcggccgtgctgaaggcgcggtcgctgaagcggtccgccgaggcgcgcgcgtggcggctgacggcgttccagcggctggacttcgccgtggacgacgtgctggactgcctcaaggaggagaacgtgatcggcaagggcgggtccgggatcgtgtacaagggcgcgatgccgggcggcgccgtggtggccgtgaagcggctgccggccatcgggcgcgcgggcgcggcgcacgacgactacgggttctcggcggagatacagacgctggggcgcatcaggcaccgccacatcgtgcggctgctcggcttcgcggccaaccgggagaccaacctgctggtgtacgagtacatgccgaacggcagcctcggcgaggtgctccacggcaagaagggcggccacctgcagtgggcgacgcggttcaagatcgccgtggaggcggccaagggcctctgctacctgcaccacgactgctcgccgccgatcctgcaccgcgacgtcaagtccaacaacatcctcctcgacgccgacttcgaggcccacgtcgcggacttcggcctcgccaagttcctccggggcaacgctggcggttcggagtgcatgtcccctatcgccggctcgtacggctacattgctcctggtacattttcttcccaaatcactccctgcccttgtataattagttaacatctgctcccctgcttgtatagtctggtcgctgccctgtatattcactgctgaaatctgccgccccaactgaaaaggttttttttgtttacaatgttgtgctggttttgatagaattcatttgcggtcctaagtaccccccagcattaatgcttactagtacgaacatgtagactggctctgttcgtcctgtggaaatttgaacaacagagtggcttccccgcatgcatatgcattgattggtttttactgtgtcccgcacaaccagatgcatcgtacatcccctgcaacatctgatggcagcgtttcgtcgcgtttgtcgttttaatggatcatcattgggaattgttggctgcgatctcatgtggcctcgcttcctctgtcccccctccccagagtacgcctccgcgctgagggtggacgagaagagcgacgtgtacagcttcggcgtggtgctgctggagctcatcgccgggcgcaagcccgtcggggagttcggcgacggcgtggacatcgtgcactgggtgcggacggtgaccgggtcgagcaaggagggcgtgatgaagatcgccgacccacggctctcgacggtgcctctgtacgagctaacccacgtcttctacgtcgccatgctgtgcgtggcggagcagagcgtggagcggcccacgatgcgcgaggtcgtgcagatactggccgacatgcccggctcgacatccacgacgtccatagacgtgccccttgtcatcgagccgaaggaggaggacgggggcccggagaagaagcagcagcagcagcaggaagggccacacgactcgccgccgcagcaggatcttcttagtatctagaagcgcagttgcgagagttggtcgtactgatggtacttggtagcatccctgcctgccctgttctttgagtgaagcgttggaacgtggcgtgtgtgtagtgtaactgtgtatgcaggcggtgatttatatgcatgcttcctttaagtagattgccagtagtatttgcgtatggtgagctggtcggtccttaatgtctgtccccatgtacaaaaccagatcaagatgcttgggcttccggttgagtttaaaaaaaaaaaaaaaacgccttaggtgctgtttgtttaccctcgacattatataatccagcttaaataaatcaagagttaaacaaacaacacagattatatattaggtggattatatagtctagatgtctagattatgataatttataagcatgtcattagatgcagatatggattagaattgctagtttgtttgtttgtttgttttcgagaaaaaagaagaatcgttcctttgaaaaaaaaaaactaccggaattactacttcttcgaagaatcgttccctctgaaaaccctaccagaaatagctccgtccactggtccgatcctgtacaaagtgcagccgggggacgcctcaggtaaggggctcaaaggggcgcgaccgtacgagctccgcccgctgttgctatcccctacaggctacagtccagaggttcagcactgccgctggtcggctgctgggtgctggccacaggtgcacgtgaactgtcaattccgctccgctgttgcgctgtgcccttctttcgtgtggagggggggaggtgtgggttgggttgggctgggttcgaaacatgtcactacactgttgccggcctcgtttcatctgatactgcag

SEQ ID NO: 15924 - DNA, 809 bp, Zea mays
ggcacgactattatcgatccaccagcaggcggcctcagctacaattatatattgccaccaccccgcggccggccccgacacgacctcacgcagtgaaagcaaggcagcatgcatgtcgtcgttgaccacaaaagtgtttggagtgccccagccagggtggtacagggtttattacatcattaataatattcaagagttagtaaccgctctgacccaagagcatccggtggtgctgatgttctgggcggactggaaccagccaagcaaggccacgtactgggatctggccatcgctaaaaaggatgaggccgtattctgccagctggactttgataagtttaaagatgtcgtagagaagttcagagtgaaggctctgccgacgttcctcctgatcaaggagggcgaggagcagcgcagggtcgtcggtgccaaggtcgaggagctcaacatggcattatcagatatcggataatctaggcagctatagcgctcacattctaacttcatcaaattattctaataaattaataagctggaaataagtcttaaaaatacaaatggctaattaatgcattttcgatttacaaagattgaaattcaagaaaaggtgtattaattatatcatatacaactactacacatgcatgcaagccatggttggattttgttacaaaatattgtgtacaaagtgatcaacccctatctgacagttttctcccaaaggacacaccccttgggagacactgcatccattgtatataagagatcctatttgcaataaagttgacaactgtcattccctctgtgcg

SEQ ID NO: 15925 - DNA, 1479 bp, Zea mays
  misc_feature (1469)..(1469): n is a, c, g, or t
aacgaacaggtctagcccatagcaacaccctggccccctcccttctcagcctcaggcggtcaggcccactggccgtacccgcgacgtcttcctcctcggctccgccgccttctgccgatcgcctccgccgaatcgaatagaagaatcgagcgccgctgctggcgaggggctcggcgcacagcgcgggatggcgagcggcagcagcaacggggagccaagcacggcgccgcaggcgaaccggtggtacgacctccggctgggctcctcctgccgtgacccatcccccaccgccaagttctgcactctccgctatgaatttaagccagcatcaattgacaagactcaagctgggtctctgctgagtaccaaagataaccgggttactgtggaattctataataatcagcctggcaaaccaaaggtgacatttgagggaagccaagaagagtacaaggataatgatggtgtcttattttttgatggtgagacctttcgcctagagaggttgcatagggctgtcaagaggttaaggcatgtccgagttccaggagagtctgcagcagttaatttggcagctacaactactggaatgggtgcagaatcacagtctcctccattacctaaagtcaacaagtcacagagcatgaacaaacctgctgttcactcagttccagttgaggttgagcgtattgacattggtgaaccagaaaatccaggcccaaaatacaacaacaggagtacatatcaatctgttaccgtagacccatttgccctttcacctgatccaaatgagcaagagaaccttgacatacttggtgacgatgatggcaatgcttcaccaaacaacttggctgcaggacaagaggcatctgttcgtggttttgacatcaacttaccaaatcaggacgatatggatgatgaaattgctgatgtagatgtaaatgatgacacggatctgtggatcaatgcagccgatgcgctgcgagctcaagtgaacgcagaggagcatcaggagcagcaggacagctcaagctctagtgggagcagcagcagcagcagcggaagtgagagcggcagtggaagtggaagcagcagcagtggtagcgatggtagtgatgctgattcggcaagttccggaggtgatgttgatatatgagcttgatacgcaagcttttgttttgacacatgccttgcttcacaagttttcattcacaaggtaggtgtagggtatgtatatgttcagctaatattgctccagtgagtgcattaaattttcactaacaatggcggcctgggtccgtttttatgtttgctagacctggcttggaagaatagaatctgtaaacatatctgtacaactatttgcttatgggaccatgaatgttacaattgttcggttgaaatgacaaaaggtatactgctatgcttgcctattactcttaaaaaaaaaaagggcggacgcccgcgtnctagaactag

SEQ ID NO: 15926 - DNA, 1667 bp, Zea mays
gactccacgcgtccgggcctacaaactcaaataactcccacctccgcctccgccgatcccctccgctgaatcgaatagaagaatcgagcgccgctactggcgaggggctcgcggtcggcgcacagcgcggtatggcgagcggcagcagcaacggggagccaagcacggcaccgcaggcgaaccggtggtacgacctccggctgggctcttcctgccgtgacccctcccccaccgccaagttctgcaccctccgttatgaatttaagccagcatcaattgacaagacacaagctgggtctctgcaaagcaccaaagataaccgggttactgtggaattccataataatcaacctggcaagccaaaggtgacatttgagggaagccaagaagagtacaaggataatgatggtgtcttattttttgatggtgagacctttcgcctagagaggttgcatagggctgttaagaggttaaggcatgtccgagttccaggagagtctgcagcacttaatttggctgctacaactactggagtgggtgcagaatcacagtctcctccactacctaaagtcagcaagtcacagaccatgagcaaacctgctgttcactcagttccagtgagttctgttactacttcaatgccttagataatggtttgccatttttatttgttagattttcacttttaaattgagtaacatgataacagctgcaatatagtattaactaataaactttgaagatttctaacaggttccatttctaaaatacatgatatccttctccagatattttgtgttcattgatttatcatctgatggacattgaagtcatcaagaatcttccttgagataatcttaacctagatagattatgggaaatttaggatgttgtaaaatatgctaccctattacttctctttagaaaggtgaaatgttttactaagaattgtgatccacaagttatatgtttgcctaccttctgatctatctagtttgaaagttcatctgaattaaataagctgcagctataccctgttgcttcacaagattagtgttataggtggtagacaaagtaattattaattaatttctgatttaattttagttttattggtgtacaaaaacattagtcttcaaacttataaagttacaattgaaacttcaactgagtattgaaatgctaatgttgctgattactgtgcattgtcatgctcttaatttataataattgaacagatttgtaatttataagcaacacattggatagcaagtattcttagcactgattacctatgaaggtttcttaaggtgtgaatcttagcaacttgttaataaatgactgtgtgctactcttcttcttcttcttcttcttttttgtggaaaccttatttctggttgccatgtgaaacttaatttgctatttgcggaaacctctcattgtgatcatttttaggcctatagtacgcacttggtcactgaatatgatttttttgttagaatgctactgagtcatttttcaattgaataatgggccataacattatttttttctttcaaactgtggtcatacctctgaagggtgaaccatggcagctgatgcagctctaactttagcatcaaaagggaatgtggccctgtgttgtgatttagatggaaacaaaattc

SEQ ID NO: 15927 - DNA, 1464 bp, Zea mays
agctccgtcctcggtggccgtccttttttttttttttttttctcaaaaggatagtatctcgggactgtatttccaaacaagccaacattgtttttgttacatcgtgaacagctcgtgggtggcctacgaacaggtctagcggtctagcccatactccgcatgcaaacaacctctcggcctcatcaggcccgctgccctccgcctccgcctccgccgatcccctccgctgaatcgaatagaagaatcgagcgccgctactggcgaggggctagcggtcggcgcacagcgcggtatggcgagcggcagcagcaacggggagccaagcacggcaccgcaggcgaaccggtggtacgacctccggctgggctcttcctgccgtgacccctcccccaccgccaagttctgcaccctccgttatgaatttaagccagcatcaattgacaagacacaagctgggtctctgcaaagcaccaaagataaccgggttactgtggaattccataataatcagcctggcaagccaaaggtgacatttgagggaagccaagaagagtacaaggataatgatggtgtcttattttttgatggtgagacctttcgcttagagaggttgcatagggctgtcaagaggttaaggcatgtccgagttccaggagagtctgcagcacttaatttggctggtacaactactggagtgggtgcagaatcacagtctcctccattacctaaagtcagcaagtcacagaccatgagcaaacctgctgttcactcagttccagttgaggttgagcgtattgacattggtgaaccagaaaatccaggcccgaaatacaacagcaggagtacatatcaacctgttagcatagacccatttgccctttcacctgatccaaatgagcaagagaaccttgacatatttggtgatgatgatggcaatgcttcaccgaataacttggcctccggagaaggggcacctgctcgtggttttgacgtcaacttaccaaatcaagacaatatggatgatgaaattgctgatgtagatgtaaatgatgaggcagatgaggggctcaatgcagccgatgcgctgcgagctcaagtgaacgcagaggggcagcaggggcaggacagctcaagctctagtggaaccagcagtagcagcagcagcggaagtgggagcggcagtggaagtgggagcagcagcagtgacagcgatggtagtgatgctgattcagcaagctccggaggtgatgttgatatatgagcttgataatgcaagcttttgttttgacagatgccttgcttcacaatttttggttcacaagggaggtgtagggtatgtatatgttcagctaatattgttccggtcagtgagtgcattaaatttccgcaattcatggcgggcttggtctgttttatgtttgttaaaacctgggctggaagaatagaatctgtaaacatatctgt

SEQ ID NO: 15928 - DNA, 1629 bp, Zea mays
atgctacgccaagcgcgcaattaaccctcactaaagggaacaaaagctggagctccaccgcggtggcggccgctctagaactagtggatcccccgggctgcaggaatcggctcgggaccagtacttattactccttaattaaccagatcgaaacgaaaaggcagagagggagggatctccgtctccacgccgcgtcctcccgcacgaatccgcgctccggccaacgggccaagccctagccacccccgcccattcatggtgggcgggccgtgagatctctagggaggcttgtcggcttcgtcgggcgggaggggaggagatgggcgcccggaacagcgctgccgccacgccggtgctgctcaacgtgtacgaccttacggccgcgaacgattacctctactggctcggcttcggcgtcttccactccggaatcgaagtccatggcacggaatatgggtttggagcccacgactacccatccagtggtgtgtttgaggtggaatcaaagagttgccctggctttatctacagaagaacagtgtggctaggcacaacagacatgtctcaggaagaattccgctcgtttattgaaaaacttgcaggtgattatcatggcgacacatatcatttaattaacaagaactgcaatcacttcacagatgatgtctgccagaacttaactgggaaacccatcccttcctgggtgaataggcttgcaagagtagggtcagttttcgattgccttcttccagaaagcgtacaagtttctcctgtaggtcgtgtcccaacgagtcggcgaatatctgatgatgatttgtattcaatacattcaccaatggccgacaaagatgacaatgatgaggacgaggccaaacacctgctgccagctccatccaacgaccagctttctgtagatgtaccgccaaagctagcgaaagatcttctctgaaccactccatgttcataggcgcctaccatacttcaactcatatagccattggtgctaaagtgatcctcaagatggcttgacacagatagggattgggcatatttgattaaagatgaagctctaatttcttgtggcttaccagtttgcagtttcaccttgctgtctcatctcagcaaacagttgtcatctatggtagtagtggcatgattgttaccctgccatttagcacatctggaaattgccaatttggaatgtggggttccggtacctgttaggaatcaggactgtcgatgcttgttgagccccagtgttgaaggcacatactgtaacatgttactatcaaaaacagtgtacatgtacatggctaccgagtatttgccacgaatccaaatgagcgaatctctgttgggctgcttaagcgcctgtagtgacatggaacatctttttgttccgggctattgaacatcgaacattcgaacccaaccatgtggttctgtcgctgatgcctgttatgctgtaataatgtgagattactttttgctgtcgctgacgcctgttatgctgtaataatgtgagattattttttgctatcgctgatgcttgttatgaaatgatgtatctggttcatctctgtatccaaagacctgggcttatattatagaactagccagttactcgtg

SEQ ID NO: 15929 - DNA, 2012 bp, Zea mays
  misc_feature (134)..(134): n is a, c, g, or t
  misc_feature (168)..(168): n is a, c, g, or t
atttcggcacgaggctcggggaacatgggggacatttctcgcacgcccagcgaatcgctatgccaatctctacagccgattcaaatctggggactctgttcaccccgcaggccgcacgtccgggtgagggccanaatcgaagtgatgcggggggacagatgtgcgccncgagggggggcggcccgcgccagcctcccggcatcagctcatcgcatcggccgctttgctttgctcgttgctctcttctctccgctttccgccgcggtgcaaggccagcgaattccatttccttccgcgtctatccccaaaagcgagaggcccgccgccggaacgagccagcaaagccaagcaagcatattgacggaggaggcggaacggcggaagcgtgaatccggaggctctgcagcggttctccagaagcagccgactgggcgtccgtccgcggaccggtcggtgtataaatggttggcgaggagagcggctgcggcgtcgagggagggacaggaggaggagaagcgccggtggcctctgctcccaacggggaccgctcagggaatagccgcctcgccgtgccgtcatcctccgcagatgatagaggcttccatagatcaagcaccatgccaggggtgattaagaatgatgaaattaccaatgaatctactggaccatcaaatttggaaaggtccagaactgagcgtcgtcggcaaaataatccagctattgatcctgctaaacagttacttgatgaaaggattccaataaaaaagaagctcaaaatgctaaatcggattgctacagtaaaagatgatggaaccgtggttgttgatgtgccaagtggtctggaaccaactatagttggtggaactgaggatatttatactgaagctgttgaagaagcattagatggaacggagatactatacaggcctcctatgcaaatagttatacttattgtgggtacacgaggagatgtgcagccatttgttgctatcgggaaatgtttacaggactatgggcatcgtgtgagattggccactcatgccaactttaaggagtttgtactaacagctggcctggagttttttccgcttggtggagatcccaaaattcttgctgaatacatggtgaagaataaaggattcctaccttcgggaccatcagaaattcctattcaaaggaaacagatgaaagaaattattttttctttgctgcctgcatgcaaggaacctgatcctgacactggcattccttttaatgttgatgcaattattgcgaacccacccgcgtatggacatacacatgtggcagaagcactaaaagtaccaattcatatattctttaccatgccatggacgcctactaatgaatttcctcatcctctttctcgcgtgaagcagcctgctggatatcgactttcttatcaaattgtggactccatgatttggcttggaataagggatatgataaatgagttcagaaagaaaaagctgaagctgcgtccagtaacatatctaagtggttctcagggttctggcaatgacattccgcatggatacatttggagtcctcatctagttccgaaaccaaaagattggggcccaaagatcgatgttgttggattttgcttccttgatcttgcttccaattacgtacctcctgaaccacttgtggaatggcttgaagctggtgacaagcccatatatgttggttttggtagtcttccagttcaagatccacaaaagatgactgaaattattgtcaaagcactggaaattactggacagagaggtatcattaacaaaggctggggtggccttggaaccttggcagaaccaaaagattttgtgtatctactagacaactgccctcatgactggctttttctgcactgcaaagcagtggtgcatcatggtggtgctggaacgacagccgcaggtcttaaagcagcgtctccctcgtgctgtgtcctacgactattgtacctttctttggtgaccaacctttctggggcg

SEQ ID NO: 15930 - DNA, 872 bp, Zea mays
  misc_feature (851)..(851): n is a, c, g, or t
ggtaccctcgggtgccgccgggactttgctttgctcgctcgtctcttcgctcgcggccgtggtgcatggccagtgaattccaattcgttctccctctccggctctccccaccaaaaacgtgaggcccgccggaacgagcaagcatattcacggaggcgtagatccagaggctcccccgcagcgcttgtccagaagcagccgacgcggcgtctgtccgcgggccgacggtcggtcgggcggtctgtcgtgtataaatggcggacgaggaggggggcagcggcgttgcgggagggagaggaggagaagcgctggcggcatctgctcccaacggggaccgctcagggaatagccccctcgccgtgccgtcgtcctctgcagatgacagaggcttccatagatcaagcaccatgccgttgccggtggtgattaagaatgatgaaattgccaatgaaactgctggaccatcaagttcggaaaggtccagaactgagcgtcgtcggcaaaataatccagctgatgatcctgctaaacagttacttgatgaaaggattccaataaaaaagaagctcaaaatgctagatcggattgctacagtaaaagatgatggaaccgtggttgttgatgtgccaagtctggaaccaactatagttggtggaagtggaactgaggatatttatactgaagttgctgttgaagacacattagatggaacagagataccatacaggccccctatgcaaatagttatacttattgtgggtacacgaggagatgtgcagccatttgttgctatagggaaacgcttacaggactatgggcaccgtgtgagattggctactcatgccaacttntaaggagtttgtactaacagc

SEQ ID NO: 15931 - DNA, 1730 bp, Zea mays
aattcggcagtttcccgtctcccgcatagagaggttcccaaaccattctctttcgctttcgtctccgcaccctagggtttctgtgcctcgccagcgaagcgatgcagccgccgcaccaaccgccgatgaacgggcaacactcccagcctccgccgcaaggacccggggtgcccatgcctccgcagcagcaggcgcccccgctgccgtactaccagcagcagcaggcgccgcagtactaccaacaggccctcccgcagccgtgggggcagcagcagcagtacgctgcaccgccgccgcagtacccgcctccgcctcagacgcagcagtacgcgacaccaccgcagcagtacgcccctctgccgcagcagcagtacgctcctccaccgcagcagcagtacgctccttcgccatatggtaccacgccgggaagcggtgaagtcaggacgctgtggatcggagatcttcagcactggatggacgagaactacctccactacaacgcctttgcggccgtggcccagcagattgcttctgtgaaaattatacggaacaagcaaactgggcactcagaaggctatggttttattgagttttactctcgagctgctgcagaacatactctgatgaacttcaatgggcagatgatgccgaatgttgagatgacttttaagctgaactgggcttctgctagcactggtgataagcgtggagatagtggttctgatcacacaatatttgttggtgatttggctcatgatgttactgactccatgttggaagatgtgttcagagctaagtacccttcagttagaggagctaatgttgttgttgataggatgactggatggcccaaaggatttggtttcgtgcgatttggagatctgaatgagcaggcacgtgctatgactgagatgaatggaatgttgttatctacaaggcaaatgaggattggtgctgcagctaacaagaagaatagggatgctcagcagacatatgcaactgacggagcataccagagctctcaaggaaattcttcagagaattatcccaacaatacaacagtctttgtaggtgggttagattccaatgtaaatgaggagtatctaaggcaaatttttactccgtatggagaaatttcctatgtgaagattcctgtaggcaagcattgtggatttgttcaatttaccagcaggtcatgtgctgaggaagccatccgaatgctgaatgggagtcaggttggtgggcagaaagttcggctttcatggggccgtagtcctcaaaacagacaggcttctcagcatgatgccaacaaccagtataatgggaacagctattatggataccaacagccgggttatgaaggttatggctatggtgcttccagtgcacaagacccaagcatgcaaaactactacggatactctggttgtggtaactatgagcagcagcagccaacacaggaacagcagctgcagcagcctccaccaccacaacagcagtgacgattgcttgcacacctctggagtgctatcggattagagtgacggtggagtcacggggcgctgcaatgagacatcctatatagatatgaaggtcatatagtcgcataggagttgttggactttcttggggaccagtgttaatcgatgatggcactccggatgtttcttctgtttgtcgttgagatcttgactgttgaagtgtgctctgttgattttaatgtcttcgtc

SEQ ID NO: 15932 - DNA, 1827 bp, Zea mays
attctctttcgctttcgtctccgcaccctagggtttctgtgcctcgccagcgaagcgatgcagccgccgcaccaaccgccgatgaacgggcaacactcccagcctccgccgcaaggacccgtggtgcccatgcctccgcagcagcaggcgcccccgctgccgtactaccagcagcagcaggcgccgcagtactaccaacaggccctcccgcagccgtgggggcagcagcagcagtacgctgcaccgccgccgcagtacccgcctccgcctcagacgcagcattacgcgacaccaccgcagcagtacgcccctctgccgcagcagcagtacgctcctccaccgcagcagcagtacgctccttcgccatatggtaccacgccgggaagcggtgaagtcaggacgctgtggatcggagatcttcagcactggatggacgagaactacctccactacaacgcctttgcggccgtggcccagcagattgcttctgtgaaaattatacggaacaagcaaactgggcactcagaaggctatggttttattgagttttactctcgagctgctgcagaacatactctgatgaacttcaatgggcagatgatgccgaatgttgagatgacttttaagctgaactgggcttctgctagcactggtgataagcgtggagatagtggttctgatcgcacaatatttgttggtgatttggctcatgatgttactgactccatgttggaagatgtgttcagagctaagtacccttcagttagaggagctaatgttgttgttgataggatgactggatggcccaaaggatttggtttcgtgcgttttggagatctgaatgagcaggcacgtgctatgactgagatgaatggaatgttgttatctacaaggcaaatgaggattggtgctgcagctaacaagaagaatagggatgctcagcagacatatgcaactgacggatgtcatgccatctgcatttaaggcctggaattgtcttcagatgtctatgtaaccagtgcctcggttaggagcataccagagctctaaaggaaattcttcagagaatgatcctaacaatacaacagtctttgtccgggccccccctcccgtcggctacgtcggccatccccgccccctttttactccgtatggagaaatttcctatgtgaagattcctgtaggcaaacattgtggatttgttcaatttaccagcaggtcatgtgcagaggaagccatccgaatgctgaatgggagtcaggttggtgggcagaaagttcggctttcatggggccgtagtcctcaaaacagacaggcttctcagcatgatgccaacaaccagtataatgggaacagctattatggataccaacagccgggttatgaaggttatggctatggtgcttccagtgcacaagacccaagcatgcaaaactactacggatactctggttgtggtaactatgagcagcagcagccaacacaggaacagcagctgcagcagcctccaccaccacagcactgacgattgcttgcacacctctggagtgctatcggattagagtgatggtggagtcacggggcgctgcaatgagacatcctatatagatatgaaggtcatatagtcgcataggagtggttagactttcttggggaccagtgttaatcgatgatggcactccggatgtttcttctgtttgtcgttgagatcttgactgttgaagtgtgctctgttgatattaatgtcttcgtcagattgttaatttgcttgtttcagatgtcccaaaaaaaaaaaaaaacaaagaacaatacaatacaaaacataat

SEQ ID NO: 15933 - DNA, 7951 bp, Zea mays
gaccggatccaattatatgtaccttttcgaatattgatttgtcgatctactcgaagtgtagggccatcggggaaggaggcggggtcaggcaacctttccggcagagaatcaatgctcgcttgtttgctaaactcgtcatctgtcggagatgaggcgtcgggaaggggtcaggatcgaaggggtcagggtcggacgacaacgcacgtcgagaagatgacaacgacgggcagcgccaggaacggggcatcggagcagattggttcaagtggttgttggaaataatgggatcacacaaatagatgtaagaactggactgaaaaggaggacaagaattaggagatttgaactgatctgaataagagacctaggataaacctgatttgatctacataaaacttttattttttctgtacttaacaataaatgaacattagatataagaggggggccacggacccccttgcctcccatgtgaatcggccactgcctttgccaatcattcatgaacccaaaatatagcaatttgaactgggaaatcactggtcatataaggaaaatggagtttccaaactagtccataagtttgaaacggtgagagaaaatctgacttctaaataagaacagaacaacttatcttggaaaatttcgaggaatgtacagtttgcgtcatgatagatcggaagtagcatggtaaaaattaagctcgagaaaccaaagaatataaacgtgaaatataatacaaatctatacaatgtatctcacaagctatacaagtctgaaactggaaggtctacttaggcttgacctcgaagtacggcatgtagtccgacgcgttgtccccgtacgagcctctcgtgatctcgacgtcgctgtacgggtgcgacctcgctccggcgccggcgccgtcgaagtcgttggcggaggagccggcggagctggtggtcccgtcgggcccggagacctcgttctgcagcatggcctcgatgtccttcaccacctcgcccatggccggccgcgccgccgccgactcgtccacgcacagcatcgccagctgcacgaaccgcctgaacccggcggtgcgcgcgttgtcccggatcgccgggtccaggaggccccgcagcccgtagtggtcgcggtcgttggggtcgatggccagcttgacctcgcgcacgatgtacttgccgctctcgatcggctgccgcccgctcaccagctccagcatcaccaccccgaagctgtacacgtcgctcttctccgacagctgctgcgtcatgtagtactccggatccaagtaaccctgcataaatacaccacatgcttagttaagtttatatttgatgataattttgatcgttcaggttcctgctagtagtatggtgttgtgtttccgttgtgatgactcaccagcgttcctttcacttgcgtggagacgtggcccttctgggtgtccgcgacgagcttggagaggccgaagtcggcgaccttggctttgaggtggtcgtcgaggaggatattggtggacttgacgtcccggtggatgataggcggatcggcgagctcgtgaaggtacgcaagtcccctcgctgacccgagcgcgatcctgagcctcttcttccagtccaggtacgttcctctcactgcatggcggccgttcatgcatgcgtacacagattgttgagtgaacaactgatgctacgattacaactgaactgggagatggaaattctgtgaaatgttgtatatatatgcggtggacgggtggttttgtccatgtacctagtaagttctctctcagcgttccgctggagacgtactcgtacaccagcatctgctccccttgttcgtagcagaagccaatcaggctcaccaggttcctgtgatgaaccctggacagcagctcgatctcgttcttgaactccaccacaccttgcattgatccgcgctctgctctctttatggcaacccgcgttccatcaacgagtgttcccttgtacaccttttaaaatttgccagttttgatatatatgtgagttgcctgaatatatttgaataataggcagtttacctaacactggatttcttttatccaatggttttaactatttgtgcaggtgcaggccctctttaagaaggccaaaacagcttgtttttttgttggatacctttccatagcctcctgagcctatctcatgggtgtccgaaaaattgttggtgcagttcttcagctcattcagagagaacaaccttgctcctttaagctgtggagcccctccactgtctttctgggaaactccccatgaaactgtcgttttggagcaaaattcagttcagatttgacgttagtattattcttgccaccgtttgtttgggttactactgtttgcaaactgtggcatgcccttggctattatgaaaaagtaacaacgaaaatcatggttactttctaaataaaaagctccttgcattgaatctctcgcacaacactgtcagtgaacatagcaggaattgaaaggaacacgaagttttcaagtccttaccgaaagggtcggttcgtcctgtcacttccttgacccttcttttctgtcgcaacgcaaataataccatgccaatgagggcaatcacaagaattccaccggctaccgcaattccagcgatagcgccagtgctgatatgtgattttttactgccacgagaagaagcacctgacacagaaagtcacagtgaatttccataccacgccatatactagttctccaaaaaaaaacatcatactgcttgaatacagattggtttttttgagggtggaactaaagtacctgccaaaagagcgtatggatctgcaatgaagtaatagggtccaaaattcgacggtggtttgtaagtctggttgctcagatcgaagcctatccgtatcagatccgccacgctgaaggacaccccagacgacgggaaaagcgccacctgaatctggaggtagttgtcgctattgaagtggatgtcggagaggaacacggagccatcgcggagagacaactgcgtcgtgaagctcgcctccagctgctgaaaggtggcgctgttcgtcaggtccgtgaagagcggcgctctgaataccatcttcccggcgtaggggtatgcgcagccgcagtttgcagggttcaggcgctggtcactggaacacgaggccgtagaggagcacttggccaggctggtgttgtacgctatcattctctcctgcttgaggctgcagaagactttcaactctgggtccacgcagcccgggttccctagtagcctggatacaggtttggcaagcaagaaatggaagtgtgtttctcagttgtttgggtggagaaaagaagcagcttttatggatcttggggctgagtgtttcttacactagagtcttgttgtagcttggggtgacattggcagcagcaatgccgttattcatgagattgatagcctgaagctgactgctgatgttgcctgtgacctcaagtgtcccgttgaactcgttgttgctcagcacactgtctggtcagttacaaaaggaggtcaacatgataaaaaaaattcttccttgtttaaacttattctttttagtttataaaagttgccagaacattacacttgctgcagctggggcaacctgaagagacccttagggacagcgccagaaagctttccagaagatattgatctgtgacatcagaagaagataacaaggtgagttcactactgacatctgatgatgactgaaaagagcaaccagtcttaagataactcacacggaggttagagatgttaaagttgtgaaccagtttggggctgctgaaacggcgaaggagttgttgcttaaatccctggttatgaagcaaccgatttttcatcagtaatcatacacgataaaaaaagattggtatgatcggacaaagaagcatggtgtcactacagttagtttcttacacgacattcaatttggtcatgctgcttagatctggcaacggtccagtgagctggttgctggccaagttcctgcaggaggttacatttctttaattgaataatggtgcttggtaccagctaagacagctggttgtttaaagatcatgggccacttacagctcgttcagattgaccaagttgctgatgttaggaggaatcgttcccttaaggctgttcctatctagtcggctgccaaagatgcgaaacaagttaataaagagggaaaaatacaataaaccaacgtttgtgaagaagaaaaaaaaattctcatgtttccgtagaacctgtgagttacttacagaacttggagcgatgaaatgccccctagctcctctggtatcgggccagtcagttgattgctgtcgaacagtctaacaagtgtagcagcaagacgagttagcagggcgagggcgtgttttatccatgcctcgtgaactgtatatatagacagaaagtctcgcggtcgcttacatgtggatcaggctcatgttggagttgaagaggcctgtgagtgttccagacagctggttcttgttgaagtggctgctcatacatcagaagttcagaacttagaagtatttacagcaaatgaaaacggtggcattgggtacattttggatacgaaaagcacaaaccaagattggcttacaagtgcttcgtgtgggtaagttggtcgagccccggcgttgttgctgtggagaccgggatagatccagtgagctgattgtcagccagatccagccagaagaggttcgagagtagacccagcgtagggggtattgtgccggtaaacttgttcgaattcaacgccctagagagaatgtgcggcaaaacaaccagttcagacgttcagtctatgctccaacaaatcacaaggactgaagacagaacagatcttttttttttctccctatagattttccatcggaacaaataagcagggtagtagttagttgattacaggaacgagagctgctgcaggttgccgagttgctgtgggatggctccggtgaagctacagcctgccaggatcctgagaagtatatagttcagttttaagctctgtacgtcggacaaggaaaagcagggtcggaaaaaaaatggagagtagtgtagtaggcgccatacagcgtggtgagctgcgccaggttcccgattgtagcgggcattcggccgttgagaccgaggttgaaggaaacgtccctgcaggtggttatgctgtgagatagaacacctttttccttcctcgcttagaaacttagcatatcatttctgtcgcattatattattatagaatatagtacgttcgtgtatatcttgtttcattttttttaacataagctagaccgatgaagcctgaagaaagcagagtttgcaaggtactagctacaagcctagatgatgcagaagtgtacatgagctctgaccagttctaaatctttgtaccctacaccgtctgaaaggcaacagccatggtgccttgcagcagctgggtgattcggaggttgggggaagcaggtgaggtgacttacaggtacatgagctgggtgagctgtccgacgctgtcgctgagcgtgccctggatgttgacacttgacagccgcctgcatgcaaacaaggcacgcacgaagcatgaagacccgttcagttcagtctggtggatcgaatcgatcggtgaacaaaggaaggaaggaagctgcgcggcagcacggccgtggcctgcctgccttggcgcctggcactcacagcgacgtgaccctgccgttgctgcacatgattccgtcccagcccccgtcgcaggggtcgctcgccgaggaccagctcaagggggcgttcgtccattggctctggatggcgttgagagcagaagctgcgaaaaacaagctttttttcattcagttcatacttgagaagaaagggccgcagagaccaatttatttttcttggaccaaaatcgtcctgtctggtttataggttctggatactggcatggcatgcccgacgagaacgggaacggaacgggaggaaggatgaaccagcagcacgccgcggtacaaagcaaggagcagagttgatcttgatcgccgtactaaccgtcctgagggttgatggcgcagaagccggcgggaacgctcgccgccagcaccgccagggccagcagcagcgtcgtcgtcggcgtgatacggcgccgcgtggcctcctccatcctgctgccaagcaatcacgccgacggcgggcgacgagatgcacgctggagcaccctcttctgtctgcgatgactcttctttcctcctctcgctctctctctctctgtcgtggaaactggcaaggctaggaaacggaggacgagagctatgtcccgcaggacgcaacttgtactaaaggcgacgaggtcgagtccacgcgaccgagccgcgctgtgattcatcaatctaagccggcggggcaccacaccaaccgcctccccagcgcggcttccgcggccggagtgctgggtggtggtgggaagaggtcaacgcaagcaaatgggcgggcgcgcgcgcgagcccatgcgttcagaaccccaagcatgtcgcgccgcttcagatagccgccggtcaaaggggggaggggcgctagctaggaaaacaaccgcagccagcaagcccaatttgcgctgatgccagcgcgttttccttttgttttttgttctttattaattaaatccttgctcgacgactgctggtggcaggtagctttcgcggccggaccaggcttcattgttgtgattggcgcgtcgacctctctcggtcgctttttttcatacaccgccttcagctacgctgtaattgtaatgatatccttgtgatgggttcttgcttggatgctgccttgagccacgtcgtccaaccaaccaacgcccgctagcgtgttgtttagaggagcaagcagtagcttacgttatcattaacctatccatacttgaaggatcggaattcggatccatgcgcggcagtccggctgacttttttttttttttttttttgctgacggcggcagctgattgagaattactccatgtgtctcaaaaccgaatgcaactttgataaccgcgtgaataatagtgcggggaggccggagagtctagcttcgttttaatagaagtttcctagaatatatcaggccggagagtctaactttgatacaggggctgcaggttgacaacgaaagttgtcaatattaaagttgttcaggttatacatccgcagtactataacacaagaaagactcggtgtatgtttggttcagtttttttttttttttgacctgcctctacttcggaaaacgaatgagttaaatcaaagtgggttcgactttttcagccttttctctagtacaaatttggaatcagtttggaccctacttttgctgcttatccacgctcgttatgtataataaagagatgtggcaaatagaaaatgaataattaggtgttctaataaatgaaataaaaaatgtttttaataaaaatatcagaaattgaattgtaaaactgatttactaactcgatatattaatggaaagatacggcaaatagaaaataaaaataagattaaaatagttaattagatttatttattaagaggtatatttaaatacagtgcaaatgtacgctatatggtctgttcacgatatacaactcacgacggtttgaactaatgacttccaccgttttttacacagacaacttacttcagtttttttccatagcaaacaatagaaaacaacttttctcgcggcagacaccataaccaaatgcactctcaatggattgataataattgcattttaaaacgttgttctatagaagattaaatataaatacgtaattaaaagtttttattttaaagaacaccataaacggaatcatctttagtataagttaaaaatatatcaacaagtgcga

SEQ ID NO: 15934 - DNA, 915 bp, Zea mays
cgccccagcgctccgggctccgcggcctccgcctcgtttctaccgcataaaaattcgagggccctccgcgcccgcccgggtctccacgcctagggtttctctgcctcgccggggaagcgatgcagccgctgcaccaaccgccgatgaacgggcaacacggcccgcctcctccgcagggatccggggttcccacgccttcgcagcagcaggcgccacctccgtcgtactaccagcagcagcagcagcaggcgccaccgcctcagtactaccagcagggtcccccacagccgtgggcgcagcagcaacagtacgctccaccgccgccgcagtacccgcctcagatgcagcagtacgctccaccaccgcagcagtacgctcctccgccgccgcagcagtacgcccctccgccgcagcagcagtccgctactccgccgccgcagtacgctactccgccgccgcagtacgcgcagccgccgcagtacgcgcagccaccgcagtatgggacaacgccgggaagcggtgaggtcagaaccctgtggattggaggtcttcagtactggatggacgagaactatctccactacaacgccttcgcgcctgtggcccagcagattgcctctgtgaaaattatacggaacaagcagactgggcactcagaaggttatggttttattgagttttactctcaagccgctgcagaacatactctgatgaacttcaatgggcagatgatgccgaatattgagatggcttttaagctgaattgggcttctgctagcactggggataagcgtggagataatggttctgaccacgcaatatttgttggtgatttggcccctgatgttacgcactagacgaagtgtgtgatgtgtcaaacgtataagcatgccttaaccaaaaaaaaaaaaaaaa

SEQ ID NO: 15935 - DNA, 922 bp, Zea mays
gctcctttcccccctcccgttccaactttattgtgtctagaatgatagattgcttctgtgaaaattatacggaacaagcagactgggcactcagaaggctatggttttattgagttttcctctcgagctgctgcagaacatactctggtgaacttcaatgggcagatgatgccaaatgttgagatgacttttaagctgaactgagcttctgctagcactggtgataagcgtggagatagtggttctgatcacacaatatttgttggtgatttggctcatggtgttactgactccatgttgaaagatgtgttcagagctaagtacccttcagttagaggagctaatgttgttgttgataggatgactggatggcccaaaggatatggtttcgtgcgttttggaaatctgaatgagcaggcacgtgctatgactgagatgaatggaatgttgttatctacaaggcaaatgaggattggtgctgcagttaacaagaagaatagggatgctcagtagacatatgcaactaacgctcggacggcgcgaggggcctcaccagcgtcggcctgtccaattccgagtctaggccagacagtgtggcacagcgtggcttcgaccacgacactgaagagagggtggaggagctcacattgaagaattgcatcaacaatggtatccagcctgaggtttctgctggtgggagcacaagcagcagggataggcctacccgtattaatggcttgtggggtaattttacacggagaactagcaatttggccagcagggaaaacgccgcactgagttctggtgacattgcaaacttgagggttggtgatgcttcagcaaaggcttcaatgggcttacggactccctgcatactcaagggttcatgggcatcccagactcccagcaatggaatctgcaa

SEQ ID NO: 15936 - DNA, 1819 bp, Zea mays
agatcgattcggacgacgggtttctctgcctcgccggggaagcgatgcagccgctgcaccaaccgccgatgaacgggcaacacggcccgcctcctccgcagggatccggggttcccacggcttcgcagcagcaggcgccaccgccgtcgtactaccagcagcagcagcaggggccaccgcctcagtactaccagcagggtcccccacagccgtgggcgcagcagcaacagtacgctccaccgccgccgcagtacccgcctcagatgcagcagtacgctccaccaccgcagcagtacgccgctccgccgcagcagcagtacgccgctccgccgcagcagcagtacgccgctccgccgccgcagtacgctaccccgccgcagcagtacgcgcagctgcagcagtacgcgcagccaccgcagtatgggacaacgccgggaagcggtgaggtcaggaccctgtggattggagatcttcagtactggatggacgagaactatctccactacaacgccttcgcgcctgtggcccagcagattgcctctgtgaaaattatacggaacaagcagactgggcactcagaaggttatggttttattgagttttactctcaagccgctgcagaacatactctgatgaacttcaatgggcagatgatgccgaatattgagatggcttttaagctgaattgggcttctgctagcactggggataagcgtggagataatggttctgaccatgcaatatttgttggtgatttggcccctgatgttacggactccatgttggaagatgtgttcagagctaactatccttcagttagaggagctaaagttgttgttgataggatcactggacggcctaaaggatatgggttcgtgcattttggagatctgaatgagcaggcacgtgctatgaccgagatgaatggaatgatgttatctacaaggaaaatgaggattggggctgcagctagcaagaagaatacagatgctcagcagacatatgcaactaatggtgcataccagagttctcaaggcaattgttcagagaatgatcccaacaatacaacagtctttgtgggtgggttagattccaatgtagacgaggagtatctaagggaaatttttactccgtacggagaaatttcctatgtgaagattcctgtaggcaagcattgtggatttgttcaatttaccagcaggtcatgtgctgaggaagccatccaaatgctgaatgggagtcagattggtggacagaaagctcggctttcatggggccgtagtactcaaaacagacaggcttctcagcatgatgccaacagccagtataatgggaacaactattatcgataccaacagccgggtaatgaaggttatagctatggtgcacccaatgcacaagacccaagcattcaaaactactatggataccctggttatggtaactatgagcagcagtcaacacaggaacagcagcagcagcagcctccaccagcacaggagcagcctccaccggcaccacagtaacaatcatcgtggtgacgattgcttgggcacttctggaatgctatcagattagagggactacagtcagagcagtgccgtgccgaatgagacgtcctgaagatatggagggcatatagtctcatgggtgttcttgggccggtgttaatctacgatgacactcctgatgtctcttttgtttgtcattgagatcttgacggctgaagtatgcaccgttgaaattgatgtattcgtcgtcgtcggattgtttatttgctcggaaccattttttgcactttagaaaaaaaaaaaaaaaa

SEQ ID NO: 15937 - DNA, 3265 bp, Zea mays
ccggccgggccggggtttcgagaggcggccatccggctgccaaacgagccgagccggtgtgggttctcgttcctttcttccccactacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacatcgaccgcatgctccacgacatccctggcatgaaggtcctcgtcctcgacccccaaaccgttgggatggtgagcgtggtgtacagccagtcggatctgctgcggaaggaggtcttcctcgtcgagaccatggacaacgcctccagctccagggagtccatggcgcacctcaaggccgtctacttcctccgaccctccgctaacaacgtccagaagctccgcaggcacctcgccatgccgcgcttcgccgagtaccacctattcttctccagtatattgaaggtcccgcagattcaaatacttgctgactcggatgaacaggaggttgtgcagcaagttcaggagttctatgctgatttttgtgccattgacccataccatttcactctcaacatacaaaataaccacatgtatatgctcccaacagtggtcgaccctcctggtatgcaaggcttctgtgatcgagccgttgacggcattgcttctgtcttcttggctttgaagcgccgccctgttattagatatcagaggacatcagatgttgcaaaaaggattgcacaagaaactgcgagattgatgtatgagcaggaaagtggcctgtttgattttagacgaacagaaaactcttctttgttgttggtgatcgacagaagggatgatcctgttacgcctttacttaaccagtggacataccaggctatggttcatgagcttattggaatcgagaacaacaaggtggaccttatgggatttgctaatattcctaaagaccagcaggaggttgttctatcatcggttcaagacgatttttttagagctaacatgtttgagaactttggggaccttggtatgaacctcaaaagaatggtagatgattttcaacatctttccaagagcagccttaatctccagagcataggtgacatggcaaagtttgtgagcaactatcctgaatatcgaaagacacatggaaatgtaacgaaacatgtaaatttggtgagcgagctgagcagaattgtggaggaaaggaaacttatgctagtttcacagacagaacaagagctagcatgtactagtggacaagcagcagcctttgaggctgtcacttccttgctaaacaatgaaagcgtatctgatattgaccgcttacgattagtaatgctctatgctttgcggtatgaaaaagagagtccagttcaattgatgcaacttttcaacaaattagcttctcattctgcgaaatacaagtcagggcttgttcaattcctccttaagcaagctggcattgataagagaacaggcgacttgtatgggaaccgtgatctgttaaatattgctcgcaatatggctcgtgggcttaagggagttgagaatgtctacacccaacaccagcctcttttgttccaaacgatggaaggaattgttaaagggagattgcgagatgctgactatccacttgttggcaatcatttccagcagggcaggcctcaagatgttgtcatattcattgttggagggacaacttacgaggaagcaaggtcggtagccctttataatgcggcaaatcctggagtccgttttttccttggaggttccgtggttctaagttcaaagagatttcttgaagatttgggagaggcacaaaggatatcaaaatcaagcactataatatgagctgaatggttttatctcccatttgaagagtatcatagtatgatttgacagtgttgactcaattttgcatagaataaaatttgtgataaatctgtaacatagttctaggtgcataggatcaaatttcttgaagatatgtagctgctccagcttctaacaccttctcttggtgtattgtctgcaaaagcaagagaatatcagtgtacaaattgattgttagcgcttgtgaagtcctgctagcgtcacagataaacaaatggcaagggcaggtgcactaaacaaaagtttcctcctaatctttctttttgttgattgttctaaactgcagagccacatcacttgatgcatactgtcagatagaatgaaatcagcgttctactagtgcttttgctctgttttcgatcatgtcctagttctagtttttgcaacaagggcagctacttcactttcagctggtctttcagttgcactttgcagcagtaagtcttcattttgtgaagtgtcgctatcatattgatctctgaaatgcgtaacatatccaccgtattattttctgaaattcgtatgccattattctcaaatctgctgtttgatgtggtggttgtgccaatcaaaaaacatttttgccgtcaccaacagagcagctgcaattcagcaggcgctgcatggtgctactgcaaccatgacgtcctccattttcatattatttgttgttgtttctagactgggggttctttgggatggcacaagttacttcatttgccaggttactcatatagaaagtcttcaggagttgctgttgctgggagtttttattttttcattcagaccagggagaggaacacacttgacttcacatctgtcttggtggggaggagtatgatccaagcagcattcatcaatggcagatgggtcgatctctcctcctagaaatgggagaccaacccatttgtcctctctccaatccaccagccagttctccactccacctccaatctttctcatctcttctcccagctgttgctgtactagcccaaaagaccctgtctccaactgcattcatttcaaatacatgttgaactacctgtttagatagcgagattgggttgtttataatctgaaccttgtcgattgtttagaatctgaaacaaatgatttttagaaatgtctttacctttttagtcgtcatttaactgtggagattgatgaagttaatatgcttttggagtagttatctgaccactgctacctttgcgcacagcgaaggttttttttaaaaaaactgctatactggaggcttattagaattcaagatttgatacttattccattaacagtctca

SEQ ID NO: 15938 - DNA, 688 bp, Zea mays
  misc_feature (637)..(637): n is a, c, g, or t
  misc_feature (646)..(646): n is a, c, g, or t
agagtccggattggtgttcaactccagtggtatccggtaagcacaagtctcaaaagaatagtgcttggtcaaggaaatccagcggtggaaggaggattagcgcagtaaaccctgcggatgatcgtagggcgcagatggttagaatgaatcaggcggtgcagacgacgttcgattggacgctcgatccatccaagctgcttgttgggcacaggtttgctagtggagcgtgtagccggctgtacaaggggttctatgatgagaagccagttgcaattaaatttatccgccaacctgatgacgacgacaatgggaagacggctgcaaagcttgagaagcagtataacagtgagatcaattcgttgtctcacctgtaccataggaacgtgatcaagcttgtagcagcctacaaatgcccaccggttttctacatcatcaccgagttccttcccggaggctcgttaaggtcatacctaaacaacacggagaaccacccgatccctctggagaagaccatatccatcgctctcgacatcgctcgaggtctggagtacgtacactctcaagggatcgttcaccgcgacatcaagcccgagaacatcctcttcgacgaggactcgtgcgtgaaggtcgctgattnccgttttgnctgcgaggagaccttgtgtgacgtgcttgtggaggatgaagg

SEQ ID NO: 15939 - DNA, 1217 bp, Zea mays
ttcgccactcaccagcgctctccagttccacttcacttcatccctgatcggcgatcacgccgagcgagcagcgctataacgcacaatgaacttggcgtccgtcgttccctgcgggcaggcattcaccgtgttaatgactcccgccgctggctcccaccgtcgggtccacacgcatgcggcggcctccaagagcggattggcctgccgcgtcgcgcgcagcgggggcgcccggtggctgccggtctcctgtgcagccgggggcggtgcaggttggtcgtaccacagtcaaatctacagaagacctgattcttggcgttcccttgataactgtcaatctgttggacttgtacttaagtctcatgtatacacaattatacatatgaatatgttttggtgacgcttttgttactgaggacactacaaatgtgaagtttcctcgggaagtaacagttccaggctatacacacccattggtgccagttggcacagattactcacttcgccttgatactgagcaatggaaagcaaagactggtattgagagctttgacagttcctctgttttcgactccatttttaaggcaccggttgtgaaatcattgagtataattcttgttagagccgttgatggcaagacctttgtgaatgctctaaatgatgtcattgcccgccaaataaaaaacccaaacgccgaggaagaatcttccctgtcaaccttgcagaatacctttcttgggcgcaatctcaaacagggaacaagcatatacttaacttggcttgaacccaaaagaatgctgatctccatttcggaagatgaagatccacgccaagttgatgcagagatcaaatctgctactgttaattatgctctatatgatggcttctttggtaaatccacagtgtgcccttctttaagatcatctacagcccagttgctggacgcgcttctgcttgcgaagtgacaaaccagtcgtggttccatatcagttacgattacgagtggttattcccttctcccttgttttcccgagggaacacaggacggactaggtgtccataatcataagtcccataaaggaaattaatttaattattatagagttcatatgtaacatttttgtcgtccctgatgaaatatggtgaatttgtcacgcccctattctgatattatgattggcagattgctttacattttcattaaaaaaaaaaaaaagaaa

SEQ ID NO: 15940 - DNA, 1306 bp, Zea mays
  misc_feature (1303)..(1303): n is a, c, g, or t
ctcgaggccggccgggacgaaacgacagataaggccatgtgcatcgaccttcgccactcaccagcgctctccagttccacttcacttcatccctgatcggcgatcgcgccgagcgagcagcgctataacgcacaatgaacttggcgtccgtcgttccctgcgcgcaggcattcaccgtgttaatgactcccgccgctggctcccaccgtcgggtccacacgcatgcggcggcctccaagagcggattggcctgccgcgtcgcgcgcagcgggggcgcccggtggctgccggtctcctgtgcagccgggggcggtgcagttggtgacacttttgttactgaggacactacaaatgtgaagtttcctcgggaagtaacagttccaggctatacacacccattggttgcagttggcacaggttacagagaaaagttttttgtcaaagtatatgctgccgcgttctatgtagattactcacttcgccttgatactgagcaatggaaagcaaagactggtattgagagctttgacagttcctctgttttcgactccatttttaaggcaccggttgtgaaatcattgagtataattcttgttagagccgttgatggcaagacctttgtgaatgctctaaatgatgtcattgcccgccaaataaaaaacccaaacgccgaggaagaatcttccctgtcaaccttgcagaatacctttcttgggcgcaatctcaaacagggaacaagcatatacttaacttggcttgaacccaaaagaatgctgatctccatttcggaagatgaagatccacgtcaagttgatgcagagatcaaatctgctactgttaattatgctctatatgatggcttctttggtaaatccacagtgtgcccttctttaagatcatctacagcccagttgctggacgcgcttctgcttgcgaagtgacaaaccagtcgtggttccatatcagttacgattacgagtggttattcccttctcccttgttttcccgagggaacacaggacggactaggtgtccataatcataagtcccataagggctgatttggtgattagggatccctaggggatccatgggggaggaatccccttgcaattcaattttgaatagcaagaggatttcttcccctcgggatccccggtcaccaaatcagctctaaaggaaattaatttaattattatagagttcatatgtaacatttttgtcgtccctgatgaaatatggtgaatttgtcacgcccctattctgatattatgattggcagattgctttaaaaaaaaaaaanaaa

SEQ ID NO: 15941 - DNA, 1248 bp, Zea mays
cattgggtaccccggccgccggaaattccagttgctcgctcgctccactcccctcccccggtcccgttccgtcggcggccggacaaaaccgccagactctctcgtcccccggcccggccctcccagacccagttccatccttttgcttgcttgcggttgcgggcaaccgctgtgatagagcgagcgagcgacctgtagtacgggagagggttggaaggagcgaaaggagagagaggttggtggttgtttggtggaggagaatagttggttgtcttcagggagggagagagggaaagatggagcgcaaggcggtggtggtgtgcgcggtggtcggcttcctcggcgtcctctcggcggcgctcggcttcgcggcggaggccacccgcgtcaaggtttcggacgttcaaacaagcggcagtcctggtgaatgcatatacccaagaaccccagccttggcactgggtttaatatctgccgcctctcttatgctcgcccagtccatcataaacgcagtggctggttgcatctgttgtaagaagcatcctgttccctcagacactaactggagcatagccctgatttcgttcatcgtatcttggtgcactttcataatctcgttccttctcctactgactggggcctgccctgaacgaccagagaggcgaggagaacatgtacttcggtagcttctgctacgtggtgaagccgggtgtcttctccgggggagcggtgctggccctcgccagcgtggcgctagccatagtctactacgtcgcgctgtcatcatccaagggccctccgccggcgttcgcagccccgcagaaccagggcatcgcgatgggccagcccgtgatcatcccgcagcagagcagcgagccggtgttcgtccacgaggacacgtacaatcggcggcaacaggtcccgtgacctgacctgaccacacagaggtctgtggttggttgtgcttggtctgtataggttgcaggttagaacagtagccgtcgccattgctgttatagctagatcctgttcttcttttttgttttcgttctacttgtacccccctcgtgtttgtcgagcatggaatgtttggttctgaatgaactgggtaatgttgaagagagcttgtttcgtgttctgcaaaaaaaaaaaaaaaatatgatgggatgaattgagatcgcgtcgcattcagaaaataggtcaagaaggggacgggcgacgacagcgtggacctgcaggcatgcaagc

SEQ ID NO: 15942 - DNA, 1138 bp, Zea mays
gccggccgggccgggaaatccagttgctcgctcgctccactcccctcccccggtcccgttgcgtcggcggccggacaaaaccgccagactctctcgtcccccggcccggccctcccagacccagttccatccttttgcttgcttgcggttgcgggcaaccgctgtgatagagcgagcgagcgacctgtagtacgggagagggttggaaggagcgaaaggagagagaggttggtggttgtttggtggaggacaatagttggttgtcttcagggagggagagagggaaagatggagcgcaaggcggtggtggtgtgcgcggtggtcggcttcctcggcgtcctcgcggcggcgctcggcttcgcggcggaggccacccgcgtcaaggtttcggacgttcaaacaagcggcagtcctggtgaatgcatatacccaagaaccccagccttggcactgggtttaatatctgccgcctctcttatgctcgcccagtccatcataaacgcagtggctggttgcatctgttgcaagaagcatcctgttccctcagacactaactggagcatagccctgatttcgttcatcgtatcttggtgcactttcataatctcgttccttctcctactgactggggctgccctgaacgaccagagaggcgaggagaacatgtacttcggtagcttctgctacgtggtgaagccgggggtcttctccgggggagcggtgctggccctcgccagcgtggcgctagccatagtctactacgtcgcgctgtcatcatccaagggccctccgccggcgttcgcagccccgcagaaccagggcatcgcgatgggccagcccgtgatcatcccgcagcagagcagcgagccggtgttcgtccacgaggacacgtacaatcggcggcaacaggtcccgtgacctgaccacacagaggtctatggttggttcggttggttgtgcttggtctgtataggttgcaggttagaacagtagccgtcgccattgctgttatagctagatcctgttctttttgtttttgttctacttgtaccctcgtgtttgtcgagcatggaatgtttggttctgaatgaactgggtaatgttgaagagagcaaaaaaaaaaaaaaaaaaaagctgt

SEQ ID NO: 15943 - DNA, 2286 bp, Zea mays
gcacgagaccattacctagaacatcctaatcgaaaagaaaaaaaagaaggaaaattttagataccctgccgcacgccgcgaccttcggccccgtctccggtctccgccttcccccacctattggggagcgctcctgattcgcgggagccagcgggcgagacaaagagaatcccccgctcctgcgccgccgcggatcagcgccgtcgccgatcggaggctctcgcttcccccggcgggcggcgcgcgccgggagatggacggcggcgcgggcgcgggcgccggccggaggaacgtctcatcgtcctccggatccaggaggagggtcctgcccgccgagaacgggcacggccatgacgccccgccgccctccaggcggtcctccgtctccctctcccgcggccactccacgtcactgaccggcgagaggaccgtgaaaaggctgaggctgtccaaggcgctgacgataccggatcacacaaccgtgcacgaggcttgtcggaggatggcgtcacgcagggttgacgccgtgctgctgactgactccaacgctttgctctgtgggatcctcaccgacaaggacataaccacaagggtgattgctcgtgagttgaagatggaagagacaccggtctccaaggtcatgacccgaaaccctgtatttgttctcgcggacacgcttgcagtcgaggcgttgcaaaagatggtgcaaggtaagttcaggcatctgcctgtcgtggagaatggcgaggtcattgcaattctggacatagccaagtgcctatatgatgctattgcacggatggaaagggcggcggagaaaggaaaagcaattgccgctgccgtcgagggcgttgaaaagcattggggagcagctgtgcctggtcctaacaattttattgagacgcttcgagaacggatgtttaggccatcgctgtctactattatctctgagaatccaaaagttgtcactgttgcaccatcagacatggtgttgacagcatcaaagaagatgctggaattaaaagtgagttcagcagttgtagcaattgaaaacaaacctggaggaattctgacatctagagatatattgatgcgtgttatcgcccaaaatcttcctcctgagtccaccacggtcgagaaggtcatgactcagagtcctgaatgtgccacagtggacaccccaattcttgatgctcttcacacaatgcatgatgggaaatttttacatttgcctgtcctggacagggatggaaatgttgtgactgttgttgatgttcttcacataactcatgctgcaattgctacggttggaaacagcggggcagctggatccgaggcaacatctgccatgatgcagaggttctgggattcagcaatgtccattggacctattgatgatgacgatgactcgagaagtgaagggtcgactagagtggtatctgaggcaacagatataggaagagcagccttctttccagcttctggcttatcaaacacttttgggttcaagattcaggataagcaagggaggatgcacagatttaactgtgaaacaagcggtctggcagagctgataaccagcattcttcagagggtcggcgacgacattgacagaaaacacctcccgcaaattttgtacgaagacgaggaccgtgataaggtcgtgctttcgtcggacagtgaccttgtagccgctgtggaccatgcgagaaagatcggttggaagagcataaggttgcatctggattacgccggcgttggccggcggaagggagggggtggtccttcggacttggagtacgctggcaaggacgcagcatgggcttctgcgtacagcgcggtcgcggcaggggcggctctggttgctgggctcggtgtgatggcctacctgaaacggtcggggtaaaagcttggaggcggagagcacgacggcagagggagcacacgcttctcatcggatctgtgtgatacaaatgatactgcgtcggaacgagcagaatggctgtgtaagtaattcttgtgaaaaagagagagagagagggagattttaataatactactgtcaaggcagtgaatggccgcctgcatacgagggagtacacggaactggtcgagcctttttggtgggttcagagtctccacgactaatttaccacggctgttagcgtcgtcacgattgtatttgtatcataaatcacacgatcattatacaagaagagtcttgttgagcctcaaaaaaaaaaaaaaaaaaaaaaaaaaaaaaaaaaaaccaaaaaaaaaaaaaaa

SEQ ID NO: 15944 - DNA, 2375 bp, Zea mays
gaaaaggaatttttggagaaaattcccattggcccagcccagaatactcagccgcgcgccgcgaccttcgctcccgtctccggtctccgcctgccccccgtccccaacctatcgggagcgctcccgattcgcgggagcgagagaaatagagtgccccccgctctccgctctccgccgcggatcagcgccgtcgccgatcggaggccctcgcttccgccggcgggcggcgcgagccgggagatggacggcggcgcgggtgccggtcggaggagcgtcccctcctcctccggattcaggaggagggtcccgcccgccgagaacgggcacggccatgacgccccgccgccctccaggcggtcctccgcctccctctcccgcggccactccacgccgctgactggcgagaggaccgtgaaaaggctgaggttgtccaaggcactgacgataccggatcacacgaccgtgcacgaggcttgtcggaggatggcatcacgcagggtagatgccgtgttactgaccgactccaatgctttgctctgtgggatccttaccgacaaggacataaccacaagagtgattgctcgtgagttgaagatggaagagacactggtctccaaggtcatgactagaaaccctgtatttgttctcgcggacacgcttgccgttgaggcgttgcaaaagatggtgcaaggtaagttcagacatctgcctgttgttgagaatggtgaagtcattgcaattctggacatagccaagtgcctatatgatgctattgcacggatggaaagggcggcggagaaaggaaaagcgatcgccgctgctgttgagggcgttgaaaagcattggggaacagctgtatctggtcctaacaattttattgagactcttcgagaacggatgtttaggccatcactgtctaccattatctctgagaattcaaagtagggtggtcactgttgtaccatcagacacggtgttgacagcatcaaagaagatgctggaactaaaaatgagttcagcagttgtagcaatcgaaagcaaacctgggggaattctgacatctagagatatcctgatgcgtgttatcgcccaaaatcttcctcctgagtccactacagtcgagaaggtcatgactcagtgtcctgaatgtgcctcggtagacaccccaattcttgatgctcttcacacaatgcatgatggaaaatttttacatttgcctgttctggacagggatggaaatgttgtgactgttgttgatgttcttcacataacgcatgctgcaattgctacggttggaaacagcggggcagctggatctgagtcaacgtctgccatgatgcagaggttctgggattcagcaatgtccattggacctcttgatgatgatgatgactccaccagaagcgaaggatcgacaaaggtggcatctgaggcagcagatataggaagatcagccttgtttccagcttctgctttatcaaacacttttgggttcaagattcaggacaagcaagggagaatgcacagatttaactgtgaaacgagcagcttgacagacctgataactagcattcttcagagggtcggcgatgacattgacagaaaacacctgccacaaattttgtatgaagatgaggaccatgataaggtcatattgtcgtcggacagtgaccttatagctgccgtagaccacgcaagacaaatcggttggaagagcctaaggctgcacttggactacgcccgccggaagagaggggacggttcctcagacttcgagtacgctggcaaggatgcatgggcttctgcatacagtgctgtcgcggcaggggcggctctggttgctgggctcggcgtgatggcttacttgaaacggtcagggtaatagcttgaggcaagcacggcagggactagggagcacggttttgatcgtctttgtgatacaagtgccacttcatcggaattggcagaatggctgtgtaagtaattcttgtgagagaggaaaaaaatgaagattttaataatactactgtcaaggcagtgaatggtcccttcatacaagtacacggaactgatcgagttttttttggtgggttgagacttgagagtcaccatggctgtcagcttcgtcacgattgtatttattatcataaaaacacatgattcattgtacaagaagagtcttgatagaccttcttcatgcagcgtctggctgattagaatttatccaaggcgatttttgtccatagttacaagctcttgctgcaacctgcaatgtactaagctccttgttccagcagacaccagattttttgtatgatactgtgactaaaattttgctctccccaaaaaaaaaaaaaaaaaaaactcgctcgtgc

SEQ ID NO: 15945 - DNA, 2530 bp, Zea mays
ccgaccgaccaccctctcctctcctctcttcctcttcctcttcctcttcgtcgcaccaccaccaccaccaccctccctctcctcgcctcccaaaaaaggcgcggcaccaaaaggcgcgagagagaggcacggggaccgcccgcctcgctcgcctgcgcaccggattcgtcgctgcggcggtggttgcagcggcggcggcctggcggggagatgtcttcgcgctcggggtccacgggcggagggagcaccggcggcggcagcagcgcggggggaggcggcgcggtgccgctggccgtgctgctcaggcgggaggtggccagcgagcgcaccgcgtcggagcgcccggagctgcactggggcctcttcagccaggccaagaagggcgaggacttcaccttcctcaagcccgaatgcgagcgcgtccctgacgtcccgtcctcctccttctccgccttcggcctgtttgatgggcataatgggaacggagccgcaatttacaccaaggagaatctcttgaacaacatcttgagtgcggtcccagccgatctgaacagggaagactggcttgctgcactcccaagagcgctggttgctgcattcgtcaaaaccgataaggatttccagactaaagcacgttcttcagggacaactgtgacatttgtcataatagatggattggtcatcactgttgcatcagttggtgattcccgttgtgtactacaagctgaaggttcaatttatcatctatcctctgatcatcggttcgatgcaagcaaagaggaggttgatcgtgtaacagaatgcggaggtgatgttggaaggctaaatgttgttggtggtgctgagattggcccccttagatgttggcctggaggtttgtgcctatcaaggtcaattggagatcaagatgttggtgaatttatcgttccagttcctcttgtgaagcaagttaagctatctccggcgggtgcttcacatcagcttcgcaggactgcacttattttgctttgaaatcttatgccttaccctttcctcttgatctccaatattactaataaagttacagtttctccaagtctctcctaatatgtgtagctattcagcattatgtcaatatcttcagcattcagaccgtattctgcctcataatatgtgtagctatctactgcgggtggccgactcattattgcaagtgatggtgtttgggatgtcttgtctccagaagtagcttttaactgttcacgtgaacttcctccagtgcctgcagctgagcaaatcgttaaagtaacctcctttctatgtgcagccataaatcttgaacgatactcttatttacatatctgaaacttttgcagactgctgtgcaatcaaaagggctgagggatgataccacctgtattgttgttgatataatagtagaaaaaaacaactcttccatgccacttgctaaaaggcaaccaggaattggtgtcttcaaaaatatgttcggcaagaaaaaatcatcggattcatcatcccattcccattcagatagagaatatatggatccagataacgtggaggaaatatttgaggatgggtgtgcgcttctttctagacggctggattctgaataccctgttcgaaatatgttcaaactgttcatatgtgccatttgtcaagtagagttaaagccaaaccaaggtatatctgtacatgaagattcatcacaacctgggagcttgcgtcgctgggatggtccattcctttgccagagctgtcaggaaaagaaagaagcaatggagggaaagcgtcgttcacgagattcatcaagaaacagtgggtaagtgaatagttgacatgtgtagagtgatcaggtaactactgaccagcaacaccccagcaccaccattttgcagcatttcttctgttgtggcacttccttgatcacattcacatgtaatatctgggagttctgatctagaactagattgaagtattgaattgctactgtggaggtggctgctgcttatagctctcatcccaagtgaggagcatgccttgtcctcagcaaggtccttgcccaggaatgtaggcagctttactcagccctttgaccttgatggcacatacaggttgaaagattaacgatgccaaaatgatatggcttgtacattctaaggtccattgctgcgacgatcttcttatagagttctgacaaatagctatggcactgtttctgaattagaactaggcgcttacatcaattcttccccgttcgagctagccttaatttatggctagagaccttagtattatcagtcctgctgaggtccagccttcgctgacaccaatgtaattgtcatctaaaatattctttcaagcagctgtgattcatcagcaagacattagttgtcatgtacaatgtacaaaatcttgctaacaagacagagtcctacaatgtacaaaatcttgctaaaatattctgtttcgtcattacttggatgaaaatcaattggtgtctcaattggaggaaagaaattgttctaat

SEQ ID NO: 15946 - DNA, 769 bp, Zea mays
gttatacatcactggttcaagtgactgaaagctctagccagtagaaaactttggcaacagttgttccatacagtgtggtgctcaatctccaaacagggaccaaaaaaagcaatttccatatacatttgcgcccttttttttttttttttttcgcagatgtgtgcgccactaaatgcattgaaaaaagatagaaaacctcttgcaaactggcaatgttcatgggatttcctccttccagtatagaaataaaactgcgagttgttcctatcactctaccagaagtccttattcatcacactgttcatgatcaaaatcagattactgcagaaacaggtgtgtggagttactatgatggagcaccacgtcagacgctgaacccttcggctctcaggcatttcaggtgggcttcgatgaactttccgcaggcatcctcgccattctgcacgatgcagtcgtccctcagcttcttcgtatctgggcaagcacagcagatctttttcggctttgacccaggtgcaggagatgttgtggcaggtttctgcgctgaatctgaagcctcagcttgcacagatgtagtgttccccatatctgaagccgaacagggcgggcgcaacctcgaatctgttacccggatctggctctagaataatcaacaatctctcgaagtcgaagggagaagcaaagaaatcgcgccgccgcacgcggagaccagagggttctggaaaggacggtgcggcgtggaattaacgctccccggccggcctcgagg

SEQ ID NO: 15947 - DNA, 1450 bp, Zea mays
aactccagcccagaccaccgacggacagaccagagcactgagcacaccaccactggccactgccaggcgcggaagcccaaccggagctcgagccaggcagaagacgcgccgccgtggcagtctcactaccaccaaaagaggcggcgccttctcccgcggcgagcgacggcagcggtgggagaggggaggggagatggtggggtggatgaaagcactggtgtacggcgtcggaggcgtggcggtggtcggcctagcagcgctggttgcgctgcaggagcgcctcgtttacgtgcccgtgctcccgggcctggcgcgcgcgtactccatcacgcccacccgccttggcctcatctacgacgatgtctggctccgcgccgcggacggcgtgcgcctccactcctggttcatctaccactcccccgcctacagaggaccaaccattctgttcttccaagaaaatgctggcaacatcgctcaccgtttggaatttgttcgactaatgatgcagcgtctacagtgcaatgcttttatgctttcttatagagggtatggtgagagtgatggttatccttctcagaaagggatcacatatgatgcacaggctgcacttgatcatctagctcagaggaaggacattgacacaaccaggatagttatctttggaagatctttaggaggtgctgttggagcagttcttgccaaaaacaatcctgacaaggtggccgctctaatactggaaaatacatttacatccatactggatatggctggtattatgcttcccttcttaagatggttcataggtgggagctcttctagaggtccaaaacttctgaactgtgttcttcgctctccatggaatacacttgatatcattggagagatttgttgattttcctagtggtatgcatatgaatacctggatgtctggaggggaccgctactggaggacaatccaactgttcttggatcaatatgctcctggagtacaaaatcgtgatgccagcttcaaaagtgaaattactgaggatgatgaagctgctgattgacgggaacatctggatcagacttctttttccaaatttctgtttcctgatgttgctgcaatttatgtcaccaatgaactgaagctcaccgcaaacaattaattcaggcaattattctgccccattatacgtgaagcaaccgaagtgaatagttttcgaggatattctccaccatgctctgctgctacatttgtccctggaacttaatagtaatttacttatttgtccacgaactgaatatatcctcatgattgaatgtacagtggcaatttttttttctttgctagtatccgggacattcctggaaatgtggctgtacaacagcccgaaatataggttgtaagttcgttggctcaactatttggttttgtgattttgattgtttgctaaaaaaaaaaaaaaaa

SEQ ID NO: 15948 - DNA, 1132 bp, Zea mays
  misc_feature (1057)..(1057): n is a, c, g, or t
  misc_feature (1129)..(1129): n is a, c, g, or t
cttctcagaaagggatcacatatgatgcacaggctgcacttgaccatctagctcagaggaatgacatcgacacaaccaggatagttatctttggaagatctttaggaggtgctgttggagcagttcttgccaaaaacaatcctgacaaggtggccactctaatactggaaaatacatttacatccatactggatatggctggtattatgcttcccttcttaagatggttcataggcgggagctcttctaaaggtccaaaacttttaaactgtgttgttcgctctccatggaatacacttgatattgttggagaggtcaaacaacccattctcttcctttctggattgcaagatgaactagtcccccctccacacatgaagatgttatatgacaaagcttctgatcataacagaaattgcagatttgttgattttcctagtggtatgcatatggatacctggatgtctggaggggaccgctactggaggacaatccaattgttcttggatcaatacgctcctggagtgcagaatcatgatgccagcttcaaaagtgaaattaccgaggatgatgaagctgctgattgactggaaaatctggatcggactttttccaaatttctgtttcctgatgttgctgcaatttgtcaccaatgaactgaaactcaccgcaaacaattaattcaggcaattattctgctccattgtacctgaagcaaccgaagttgtgaatatttttcgaggatattctccaccatgctctgccgctacatttgcccctggaacttaagttatttgcccatgaaccgaatatatatcctcttgattgaatgtatgaatgatattttttttctcctttgctagtatttggaacattcctaaaaatgtggctgtatgacagcccgatagataggctgtaagctcattggctgaactatttggttttgtgattttgattgtttcctttttcgatgttaaagcatctagacctttaatatgtttggatgacacaagattattgtgattaatgtatgttttgcagaagtgttgaagttaanaaaaaaaaaaaaaaaaaaaaaaaaaaaaaaaaaaaaaaaaaaaaaaaaaaaaaaaaaaaaaaaaaaaaaaanagg

SEQ ID NO: 15949 - DNA, 1105 bp, Zea mays
ccgggcgggtctcggccgcgccgtcgcgctcaccaggtctccaccatcaccagagtggcggcgctctctcctatcgcggcgagcgacggcggcgatgggaggaggggagatggcggggtggctgaaggcactggcgtacagcgccgggggcgtagcggtggccggcctagcggcgttggttgcgctgcaggagcgcctcgtctacgtgcccgtgctcccgggtctggcgcgctcgtaccccatcacgcccgcccgcctcggcctcatctacgaggatgtctggctccgtgccgcggacggcgtgcggctccactcctggttcatccgtcactcccccagctaccgaggtccaaccattctgttcttccaagaaaatgctggcaacatcgctcaccgtttggaatttgttcgactaatgatgcagcgactacagtgcaatgtttttatgctttcttatagagggtatggtgagagtgatggttatccttctcagaaagggatcacatatgatgcacaggctgcacttgaccatctagctcagaggaatgacatcgacacaaccaggatagttatctttggaagatctttaggaggtgctgttggagcagttcttgccaaaaacaatcctgacaaggtggccactctaatactggaaaatacatttacatccatactggatatggctggtattatgcttcccttcttaagatggttcataggcgggagctcttctaaaggtccaaaacttttaaactgtgttgttcgctctccatggaatacacttgatattggttggagaggtcaaacaacccattctcttcctttctggattgcaagatgaactagtcccccctccacacatgaagatgttatatgacaaagcttctgatcataacagaaattgcagatttgttgattttcctagtggtatgcatatggatacctggatgtctggaggggaccgctactggaggacaatccaattgttcttggatcaatacgctcctggagtgcagaatcatgatgccagcttgaaaagtgaaattaccgaggatggcaattattctgctccattgtacctgaagcaaccgaagttgggaatatt

SEQ ID NO: 15950 - DNA, 1121 bp, Zea mays
gaacattcctaaaaatgtggctgtatgacagcccgatagataggctgtaagctcattggctgaactatttggttttgtgattttgattgtttcctttttcgatgttaaaaaaaaaaaaaaagggcggccgcccttttttttttttttttaaagggggggccccccttctttctttcttctctggtttaagtgactgaaagctctagccagtagaaaacttttgcaacagttgttccatacagtgtggtgctcaatctccaaacagtggaccaaaaaaaagcaatttccatatacatatgctccataaagtattatccagaattgcagatatgtgtggcactaaatgcattgaaaaaagatagaaaaactcttgcaaactggcaatgttcaggggatttcctccttccagtctagaaataaaactgcgagttgtttctatcactctaccagaagtccttattcatcacactgttcatgatcaaaatcagattactgcagaaacaggtgtgtggagttgccatgatggagcaccacgtcagacgctgaacccttcggctctcaggcatttcaggtgggcttcgatgagctttccgcaggcatcctcgccattctgcacgatgcaatcgtccctcagcttctttgtatctgggcaagcacagcagatctttttcggctttgacccaggtgcaggagctgttgtggcaggtttctgcgctgaatctgaagcctcagcttgcacagatgtagtgttccccatatccagtgtcagaggttcccacacgagggaggtttggggaagggataaaccaagatgagcgttcccccgcaaatgcgaaaaggctgctttgaaacctggtgactcagtgagaccctcaccgctgcaccacctggagggcggaggacggccgacggcggcagcgtctgtctctggcggctccgcggctgtgcgtctggcagtttggcggctgaagccgaacagggcgggcgcaaactcgaatctgttacccggatctggctctagaataatcaacaatctctcgaagtggaagggagaagcaaagaaatcgcgccgccgcacgcggagaccagagggttctggaaaggacggtgcggcgtggaat

SEQ ID NO: 15951 - DNA, 2072 bp, Zea mays
tcggctcattagagaaagcagaaggttcacaaaagaaattctagactatggcgagaatgttcctcaataaataaaaaccaatagtccaacatataaaaatatgagcaacatcaaaaccttctaaagcccaccgtataatcttgagacgatctaggggttagggttatagtctaaattttagtcactctattttatttcattttacagtatgcttatttggttttaattcataccgtcttctactacttttacagagttttatctcaatagattgcagcaatccaaatagctaaaatagaataaaacagaggacctaaaaatagtccataaaaatcaaacactcaattattatatacaatttgagttatcgtcgtaataactcgtaacttcttattttgtgcatagaacaaaaaaacattgaataaactagggatttgcgataatatataacccatcttattagttcgctacgacgatagaaatgatcatggtcgattacgtaatgatgatacggatcgtcataaagaaacaagcagtccacaacaccagcacaaaaatctttttgggaaacaaaaagatgggtaacaagagagaaaaagagagctgcaggcttcagattcgcgccaaggtcagtgcttacattccacgcaatcctgaagcaagaaaagaaggaatttgtgtgcagaaccaacacaatgttggctgctggcatccacacgatatgagcaccggcaccagccaccactgtaccgtgcgtggctgagtggtgctggtaagtggatctatagagataacactgtaacagccattggcaacgaaactacaaaggtgtagagggtaatatcttcttcattcatacatcactggattaagtgactgaaagctctagccagtagaaaacttttgcaacagttgttccatacagtgtggtgcttttttttttttttttggaccaaaaaaaagcaatttccatatacatatgctccataaagtattatccagaattgcagatatgtgtggcactaaatgcattgaaaaaagatagaaaaactcttgcaaactggcaatgttcaggggatttcctccttccagtctagaaataaaactgcgagttgtttctatcactctaccagaagtccttattcatcacactgttcatgatcaaaatcagattactgcagaaacaggtgtgtggagttgccatgatggagcaccacgtcagacgctgaacccttcggctctcaggcatttcaggtgggcttcgatgagctttccgcaggcatcctcgccattctgcacgatgcaatcgtccctcagcttctttgtatctgggcaagcacagcagatctttttcggctttgacccaggtgcaggagctgttgtggcaggtttctgcgctgaatctgaagcctcagcttgcacagatgtagtgttccccatatctggaatgaattgaaacagcaatggatgaatgaatgcatcagtcaggacggcaacggttggattgtcaacatgagagtttgatgaatggaaactttataccatgcatgtcttaaagaattgaaatttctagagagtttttatatgattacccagttggatactggattgacacaccagaattgacctaatacattaacatggacccttttagggacagaagccttttcgagggcattaaaaaatggtcaccaaacaggaatactggtaaaacatatctaatttggctgtgtcaatagtgtccagataactcaagtagttgaacacttgaactagacaagttatggacttaagacaactaaaaagttacaacgaagggtgtgctcagcagtgatttgtaaacagctgtagcggctgttgctgctacttttcttctgtcaacaacagtagatgcaagtatgcttgcttgctgcagccagccgtaccaaactaccgattgagctgaaagcaaggaaaacaatgacagtttaagtaaccaggcaaagaagacacaaaataataataataataataataataataatgcatttgtatcgtatccaactacactttgttcaggaaagtcttttgtg

SEQ ID NO: 15952 - DNA, 1064 bp, Zea mays
gagctacctagcaacgcgcagtaagcagcgtgggcaaagctacgagcgcccggctagcttcgccatgaacatgggtggggtgtccccgtcgacagtccggtgcaagcactgcagcacgcagctcaccgtgtgccccggcgagcgcgccatccagtgcacgcaatgctgcggcgtgacgcgtatccggcggcggcgggtccagcggccggcggcggcgccgcccaccacgggcttcccgcgcgcccgcggcaagaagcgggccctcctgatcggcatcacgtacgccggcacgcgccggggctgcggccagctgaggggggccctcaacgacgtcaagtgcatgaggcaactcctctgccagcgcttcgccttccccagcgactgcatcatcatgctcactgatgaccagaaggacccgttcaggctgcccaccaaggacaacatccggttggggatgcagtggctggtggaggggagcagcgagggcgactccctcgtgttccacttctccggcctgggcgcgcaggtcgccgacgacgacggcgacgagctggacgggtacgacgaggccatctgcccgatggactcgttccagaagggccccatcctggacgacgagatcaacgagactatggtccgcccgctggtccacggtgtcaagctgcacgccgtcgtcgacgcctgccacagcgccaccgtcctcgacctcccgttctgctgcaacatgtccagaagcgggagctggcagtggaaggacgagagccccccgtccggcgcctacaggggcacgagcggcggcaaggcgatgctcatcagcggctacagtgacggcaaagccaagtccagcgtggccagtgcgcagaaaccggaggcctgcgcgaccatgggggccatgacgcacagcttcatcacggcggtggaacgcgagccgcagggtgtcacctacggccgcctgctcacctccatgaaggccatcatgaccaactccggcggctgcgccgtgcagggtcctattggcgccggcgcggccgccctgaaggccgcctactccacccgccttgcga

SEQ ID NO: 15953 - DNA, 1506 bp, Zea mays
  misc_feature (1503)..(1503): n is a, c, g, or t
tccacgcgtccgcaagctaaccgaggagctagctagccagcaacgcgtagcaagcagcgcaagcaaagctccgagcgcccggccggctagcttcgccatgaacatgggtggaaggtccccggcggcgacgacgatccggtgcaagtactgcagcgcgagcctgaccgtgtgcgccggcgagcgcgccatccagtgcgcgcaatgctgcggcgtgactcgcatccggcggtcgctgtcctcgcggctcccgctgccggcgctgacgaggccggcttcggtcgcgggcttcccgccgtgcggcggccgcggcaagaagcgcgccgtcctgatcggcatcacgtacggcggcgcgcgccggggctgcggcgagctgcggggccccatcaacgacgtcaagtgcatgaggcagctcctctgccagcgcttcgccttccccagcgacggcatcatcatgctcactgacgaccagaaggacccgttccgggtgcccaccaaggacaacatccggatggcgatgcagtggctggtgcaggggtgcagcagcggcgactccctggtgttccacttctctgggctgggcgcgcaggtcgccgacgcggactgcgacgagcaggacgggtacgacgaggccatctgcccggtggactcgttccagaagggccccatcctggacgacgagatcaacgagaccatcgtccggccgctggtgcccggcgccaagctccacgccgtcgtcgacgcgtgccacagcgattccgtcctcgacctccccttcctctgcaacatgtccaggaccgggaactggcagtgggaggatcaccgtccaccgtcgggcgtctgcaagggcacgagcggcggccaggcggtgcttatcagcggctacagcgacggcaaaagcaagttcagcatgacgccggaggcctgcgcggcggtgggggccatgacccacagcttcatcaaggcggtggaatgcgagccccagggggtcacctacggccgcctgctcacctccatgaaagccatcatgaccaacgccggcggctgcaaccagcagctgcagggcgcctgcgcacccgcccgcaaggtcgtcaacttcagcggcgtgcaggaacctaacctgtcttgctcggagatgttcgacgtctaccgcaagccctttgcgctgtgaacctcctctgcattgccattgcctttgcagactaccacagattcccgtctggactctatatataaattaccgtgacggaataataaaccagacggatttatattatatatgatgatatgtcataatgtgtgccttaattgtcttgcggccaataatgtgtgtccatgtgtcgatcggttaccggccctgagccaagcttatagcctgtggaccgacgactttgttgaccattataaatacaatgttgataatgtttatacgtgtcgagtttattatgagtgattaaaaaaaaaaaaaaaaaaaaaaaaaaaaaacccacgcgtccgcccacgcgnccg

SEQ ID NO: 15954 - DNA, 1685 bp, Zea mays
gcgttcgccgggctccttttataccactgccccgcggccggctcgcctcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcggcggagagggaagcggtgagggcggcagctgcggaggcggcggccaagggcggtgagggggaatcggggaaggaggaggtgagggagtatgagagcgacatgaggaagctggaggagctgctttctaagctgaacccctcggcggaggagttcgtgccgcagtcccgccgccgcgtggacggcggcgctccccgcctttcggccgacgcgcccgtgttcgtgtcgccggcgatcgactactacgcgcgccaccaccagctcccgccgccgccgcttctgcagcagcagcagccgatgcacgtgctgcagtttgtgggtggcgtcggcggggttggcatgggtggcggcggggggatggactccagcagcgacggatccgccaatggtcagccgaatcgacggagaaggaacggtttcatccaggggaggagaaggatgatgggtgcccggcctcgtcgagctgacagggaggatagtgtgcggcggacagtctatgtctctgacgttgatcagcatgtaactgaacagaaacttgctgaagttttttcaacctgtggacaggtggtagattgccgtatctgtggtgatcctaactcagtgcttcgttttgcttttatcgagtttgctgatgacgttgctgcacaagcagcactagcacttggtggaaccgtgcttggcttttatcctgtcaaggttctgccatcaaagacagcaattttacctgtgaaccctaaatttcttcctcacactgatgatgagaaagaaatggtatccaggactgtgtattgtactaacattgacaagaagatcgcagaagatgaagtgaagcaattctttgagggaacatgtggtgaagtttctcgtctgaggctacttggtgattatgtgcactccacatgcatcgcttttgttgagtttgtccaagcagatagtgctattctcgctctgaactgcagtggcattgttcttggaacgcttcctgttagggtgagcccatcaaagacaccagtccgctcgcgatcgccccgtgtgacgtcatactgaattcggctcatctgaagccgtcgtccagggcagcaaatttctgggcaacaaagccctagtcgtgtggccttagagactgccgcatcgcggataagtaattgtcgttgagcagagttctcgttggttaaagtccagtctagtaggaggcgcagagacccgtctgtatggtcgctgggagatctatcttgacctcctttttctgttctttttggtcttagttatcgtggttggattctatagcagccttgacaggcattcgaacaacaatgtttatggttatcctatccgctttggactcttaagcatgttttcccagtctttaaatattaagagatagtttggtaactaaagaaaaaaaaaaaaaaaaaaaaaaaacccgggccccggaactaatttctattgg

SEQ ID NO: 15955 - DNA, 2090 bp, Zea mays
  misc_feature (21)..(21): n is a, c, g, or t
gagagagagagagagaactcnctagtccccccccccccccccccttaattacggttgggagtgaatatatatagtggagtgttgtgggccaaggcccattacaatggaggtatacacagagacgtaaacaacactctaacactaacatcaacgactatccttaaggcttttgtcgatcaagatacctacaccattcctacccaaacttgctcccgtgttccaacgcttgaaaccagtatcctccacctccttcgccttatagccctttcatttagtcttctggacgcatagaatatttacacgcctcttaatcgctacatccactagctcccctaacttacctgttagggaccctatgttccaactgcctacacgaaatctagttggttcgactagcttccttacccttcacacccgtcgagagagatgtgaagacccttgttcatttttcactacatcctggcgttgatgtagcacatcactaaggaaatgacgacctggtccttgctcacttaagcaagcatctattttgtattcatctgagaaaagtagaacaaaaatttcctcttgggtaaccaatggccactgagcatgtaaatcctgtgtaatcagcccatgaaatgatgatggtgaggtctacttgtgtgctcacgtaggccatagtcttgaggcacattgtgtgaaaccttgtgctcactgtgctcaaatctatctgatccaacgaggcagcaaggtcttcagacactgaagctgcaggtgcagccaagccattttccagggtttcctgtttcatttgttatgcttgggtgttgaggagggttttttttatccctggccacatttcccccctgattgcttgatgtgtattccctccttgcccagaaggaatcaagttgtacactaatccctagtttctacctaaggttagttagaaatattaaggaaagatggaagttctcaaggcattgtgttcagattgataagcatgaatgattactcctttggcatttcaaaagggatagtaacataaaactggggtagatggattatattgttttgtaaaacatgagtactacctatatgcagagtttaaatttaaatccatattatgtaaacaggtagctcaaacatggtcgtttcactgcagcctgtccactgcagtttcaaaatggttcacaatgtgggcgatgttgtgtggttacattttatctttctatgtttgacttactacgacccatctttttcccatgtaggtggtagattgccgtatctgtggtgatcctaactcagtgcttcgttttgcttttatcgaggttgctgatgacgttgctgcacaatcagcactagcacttggtggaaccgtgcttggcttttatcctgtcaaggttctgccatcaaagacagcaattttacctgtgaaccctaaatttcttcctcacactgatgatgagaaagaaatggtatccaggactgtgtattgtactaacattgacaagaagatcgcagaagatgaagtgaagcaattctttgagggaacatgtggtgaagtttctcgtctgaggctacttggtgattatgtgcactccacatgcatcgcttttgttgagtttgtccaagcagatagtgctattctcgctctgaactgcagtggcattgttcttggaacgcttcctgttagggtgagcccatcaaagacaccagtccgctcgcgatcgccccgtgtgacgtcatactgaattcggctcatctgaagccgtcgtccagggcagcaaatttctgggcaacaaagccctagtcgtgtggccttagagactgccgcatcgcggataagtaattgtcgttgagcagagttctcgttggttaaagtccagtctagtaggaggcgcagagacccgtctgtatggtcgctgggagatctatcttgacctcctttttctgttctttttggtcttagttatcgtggttggattctatagcagccttgacaggcattcgaacaataatgtttatggttctcctatccgctttggactcttaagcatgttttcccagactttaaacaaaaaaaaaaaaaaaaaactcgagcccgg

SEQ ID NO: 15956 - DNA, 1776 bp, Zea mays
ccggccgggatcattgggtacctcgacgccgggcgggactctaaatctctcccgtgcggcagtccacatggccgcaccgcctagacacgggtcgcgcgcaataacccaccgatcgagctgagcacgcacgacctggcgctcgctttaaactctcgctctcaatcgtcgtcgcctcgggctctcggcagacagctgcggcggcgtgcctggcagtgaagcggtagcaggtagagccagccagtctagcttagccaccacactagtgtgatggcgaccaccggcggcggcaaggcggcactggtgctggggcggcttctgcttctgctgtgcgtgctcggccatggagctgcgcagcggtacaacgccatctggagcttcggcgactccatctccgacaccggcaacctctgcgtggggggcgggtgcccttcctggctcaccacggggcagccgccctacggggagaccttcttcggccgccccaccggacgctgctccgacggccgcgtcatcgtcgacttcctggccgagcactttgggctgcccctgctgccggcttcgaaagccggcggcgacttgaagaagggggcgaacatggcgatcatcggcgccaccaccatggactttgacttcttcaagtccatcggcctcagcgacaagatctggaacaacgggccgctggacacccaaatccagtggttcaggcagctgctcccctccgtgtgcgggaaggattgcaagaactacctgtccaagtccctgttcgtggtgggcgagttcggcggcaacgactacaacgcggcgctcttctcggggcggtccatggcggaggtgagagggtacgtgcccatggtggtgagcaagctcgtccgcggcctggaggcgatcgtgaggagcggagccgtggacgtggtggtgcccggggtgctccccatcggctgcttccccatctacctcaccctctacggcacctccaacgccgccgactacgaccgcgacggctgcctccgcggctacaacggcctctcctcctaccacaacgcgctgctgcggcggagcctgtccggcctgcggaggacgtacccgcacgcccggatcatgtacgccgacttctacacccaggtcacccacatgatccgggcccctcacaacttcgggctcaagtacggcctcaaggtctgctgcggcgccggcgggcagggccagtacggctacaacaacaaggcgcggtgcggcatggccggggccagcgcctgcgccgacccgggcaactacctcatctgggacggcatccacctcaccgaggcggcctaccgctccattgccgacggctggctcaagggcccctactgcagccctcccatccagcactgatcgagctagctgggccgggggactgaatagctaattaagctagcagcatattattcatgagtgacatcatcgtgctttgtttgtttacggctaattgccatgtgcatcatcctagcgctctagcaggttcatcaatgatgggtttgctatttggtttgtcaattagttgttcaattggtgaggaaggggtagctggtgtttcggcggtgtggtgggaacagtgatgaataaacgtgtaatggactgtttacaattagctacgacgtacgtgaacaataagctcatatcacagcaaacaacaatatatgacgggaaggagcacaaaaaaaaaaaaaaaaaaaaaaaaaaaaaaaaaaaaaaaaaaaggggggcaaaaaaaaaaaaataaaaaaaaaaaaaaaa

SEQ ID NO: 15957 - DNA, 2853 bp, Zea mays
gattcgcaaaagggcccccctcccccccacagcgcatcaaatttattgcactgctctgctgcctctcatgaatggcgtttatttaagtctccaccctccgccccggggaactcttttctgtgtatcgcggaattttttgggttctcgggctccgccgcgatcccatccccatccccgccttgccgttgccgttgccggcccccccggttctcccggagctttctttctggccggcgcagtagagaagcaagacagaattgcggcggcgcctgcccgcgcaaaggaaataatcagcactgtttgccaaaggcagctcctgacgcatggctagtacttaaggatactttatgtgcagaccatgaagatagatgacgaaaggccttaccaaactcatatttttcatgatcttgcatctaacggcagtcctaaattagactgtgaggctgaaagacaaagtaatcacaaggttgaggcagataaaatggttgagcaaaccaatcaatctgaagttagctttgtgaaggctgagcatctgaatggaggtaaaattcggaagacacgcattgaggattactcctatgacaaggatgttgtagagatcaaactgccagacacagatctttcttctgattacggtgtccattttgtcaaggatgtctgcattgatgaaggagttcttccagatcaaaagatttcatcagaaaagcaagtagaccaaaaggtgtctataaactttgattcctcggaatatacaaacggggacctaagggaagatataagtgctgactctacaaaaactgcacatgaattaaaatcagaaatagttgtcctacctgtcctgtgtgatactcataacaataatactgtggaacagaactcctcatgcaaaaagcaggatcttgaagataacaatactatagatgtatctaccgattctcacgatgagggattaaatcccaaacaattaccatttcatgaagttgcacaagattaccaggaggttgacagtgtcattccggagagcaatgaaaatcaggaccggcttttcactggagatgcaacccatcaggtttcatcgaatgattgttatgaagctggaattggtatcgcgtcagaggccagtaacatcattcacaatgatttagcagtagaatcagccgctgctgatttcccggtggtgatacctgaggaagttgctgtcactgcaacattgggtatggaaggatccaaccaagttaatcactataacccttttattgcctatggatcgctagacgagacatgggaacccaatctctctctcgctactactgtggatgccgcttctatagcacccatctgtcctgtcgaaaagacagatagttttagtgatcttgtcaacaggccactggaaggatttgatcctattgaactagacgaagctataattgaagagaacaggtcagattcagttgaagaaagctcgagcacattggacgtccaagcatctgaacaacgcgatgatcagagagagagtctcactaataatgacgtgaaaactgatgcagcacatgaaacgggcactgctatatctctatccaccagcaatggagagcacagtggcgtcaagggtgagaaatgtcagaaacatgagactgatggtcgagatacagatgatttcaacccaagagatgtggagcctggcacaaaagtaagcgaggacacaacggatgttaagagctcagctcatgtgcagacagaatctgtggttcaacaaaacggacctgatagcgcgaaagtgactactgcacagactgttattcgcaaccccttcgagtccagcttctctggacctagcattacgtcaggtccactaacgccctctggtcacataccatattctggcaacatttctcttcgatcagagagcagcacaacgagtactcgatccttcgcgtttccagtactacagaacgagtggaacagcagccccgtgaagatggccaaggccgaccgcaggcgtcagaaggaagaccgaggctggggttacagaatcctttgctgtaaattctgaatggcgcttgcctcccctgcatcctttttgcctgtcgagttgagcccttcgtctctgtcatgcttgagccccgtggaggtccatgttaaattcattcatcaaatgtttctctcctctcctctcctcttgtctttctgctcccctgctgttcttatttatctctagcaggttaatggcttgtcggattcggtagtggcttgtaatttacagaacactatgaagagtgaggactcaagtcatagctttggtatagaatttgcggatacttgttcgagtattattccggatgaatgaacatccattcatgtggggtgaatggcggccatttgagccgtgagcccgtgatacaggcatatgcagtaaaatggtgcgcatacatgtaaatcactgaaactattacaagcaaataagcacatctgcgacctgatactaaagcagatgtatatactacatggcatctatcctcaagcatgaacaccagtgacaaaattgcccgtctgcactgcacatgaacggtccatgctgttgcagtctgggctaaacaggatgtccagcttgaaggctagattaaggctgggcacaagccaggacattattccatatgggcgattaagtgtataaaccttcctaatctaccaggactagcaactaaagccggcctctagctatatgtaccgaactactcatgccatgacatgccatgccatgcccgagactgagagctcgccgggggaagctagctattaaaaacaggatacagctcacagtggtagctaatctctaggcagctagggcttctt

SEQ ID NO: 15958 - DNA, 811 bp, Zea mays
tttttttttttttttttttttttaggcgccccgagggtaccccttattctgggccccaaaactgatcttcatataaatttcaaaagcatacatcatcattttcctcaaaacagacacatcacttaacaattacacacacaaaatgaaatctcaaatacagtaccatagtgacatcatctactcaaatatagaagtcttccctaaccaaacaactccaagcccaaaaatttctgcaacacaggatgggcacggatcactgtccatctgagtagaacatgctcgggtacacctagaatggctgaagctggatgtaccagtctctcttgaacccaaggccagggtcagtggaatcatcccaaatgacatctgcatcgtcacccagcccatgcaagacccagcgttgacagattcaaacaatagttgtactgaaaacttggccagaatgacatgcttaatactgatacaatgatggcccctgtccacgctcttgtacctaggaatggaacgacaataaacagcaccaaaccaagccattggaattcctcaacaggagcagtggggccgtcgtgcccgctcaaagaggtccataattcgagtcgcatatgcgcttttctgagacagaaatgtcgcaagttttttcaggtagaggatgataaatggtacatgcaccatgttcctgggcaagacaggagagagatcaaattctacttagtgaacctttttagaaactaaacggtgcattttgtgctaactgagacttgtgagttgtgacagcaggcacttttctctttaacaggttattagattgaga

SEQ ID NO: 15959 - DNA, 1469 bp, Zea mays
ttttttttttttttttggattaaccaagtccacaacagcaatggataaaataattaacacaatacataatcattataacagggtgttgagtgcaaagccccaaacttattcagaacacatcttgaatcaacgctaaggcggtggtgggcatatacacccttgatttatgaggaattatttggagtttaagtttccctttgctgccatctccactgccactactaacgtcattaccagtgagattgtcaaaatgaggaacgatctccacaccggtcaataaaacatatccactcccgtatggatcaaacatctcattcaagaaccttgcgacgcagaacctgcctgagcccaggttgacaagctgagttcttcctttctgctcccatccctctggcagggtcagctccatccaagagcccaggacctctggttggaaacccgtggctgagtcaacagtgctgctcaaataagagaggtcagtggcagccaacttctgccgatcggcagaggcgccaaaccagagcttcagctccggtacatactcaaccttgccgtcgaagggtagtgtccacgtgccgactttgctccatgtgtgtctggttgtgtccaggcaataggtgccttcattcttgactgataagcagatgtgggaaccaccaccgatcacagcataggagctaatcttggtgtaaagggggtacggtgctggtgggaggagttgagcctgccaggagtaggaggtgtaaagggggtacggtgctggtgggaggagttgagcctgccaggagtaggtgttgctgaagcttgccttgcggtacactaaggactcaaattccacccttgtagcagtgatgccgggtgacctatccacaaggaagaggctgccaccgccttcgacatcagtgctggggatgaagatggagaggggcatcatcttacgtttgtggaggctgggcatggttacaagacaacgtgcgataccatcaaccacaaagttgtgtccacactgatccgagcagaacaccacgcgatcggaaagcggtaagcagttaatgtaccagctgcgatcttgtgcagtggaagtttcgaattggaagctcggacggggaaggcgaagtctctccaacaccaaggattcagttggctgtgtctgagagaaagcgtcttgtgtttcaaatctgtctccgtctgtagatgccgtaggtggcagtggtgtcttaaatagtggctgccgcttcaggtccacgaagtgcagggacttggcgccgttgtaaagattggtcatgatcagattcacaaactgccgagattgcctcattgtcgattcgatggcccgagacatacttccgaggtccggccgggggagggaaacaagggccagcgccgtgctctacggcgccggggcagggtggcggcggggagagacaggggcgtagcgagaacggggatcggcctcgaggtacccaatg

SEQ ID NO: 15960 - DNA, 496 bp, Zea mays
attccattccctgttcactgttcggtcgggccaggaggtccctggccgccgaactcgccgactccagaacccaagccactctccatccccaatccgctatgcaaccggctcctcctcctcctcctactgctcgcttccttcctcctcccgccggcggcggccagcacggcaggctgctggcccaagtcatgcggggggctcaacatcacctacccgttctggctggaggagcccgggcagccgccgtccttccgactccggtgcagcagcggcggcggcggcgcgttcctgagcatcttccccggcaaccgctccttccacgttgtggaccacaacctcccgctcgccaccaaatggcttcatgcatagtgaatcttcattgcaatcatacagcaaagaccttgagttgggtggctctccacagattttcacttatgaggagcttgaagaagctactgatggatttagtgactcgagggaacttggtgatggtggt

SEQ ID NO: 15961 - DNA, 2818 bp, Zea mays
  misc_feature (1649)..(1649): n is a, c, g, or t
acacgatttgctaaagacggtgttagactattgggtggaaagtataggcatggacaaaaaaataatagaaattaaaataagaactaaccaaaggtgtgtttcagaaataaagtaaagtgcaaataggtcggactaattaagcaaaggtacttgcatgcagtggtggacctagaatttttatatagggtgtgccgcaacaaaattttcacgtagaattctatctaatatacataaatttcatagtaaatttggtaaacaatttgatatatagatataaagtttgatactcaacaaataagcatgaaaattgtatatattaaacataaagattacaataatactacttatctggcatgcacttactcaacgtcataaaaataatttcttatttcttcatattttagttactacaaaaatagtggtaatgaatcaataatcaataaaaaatcaacagcagggctgaggggcgcgatgttcctgcgcgcacctgtacgcggtaggccgtaggcgtgcttgcctgcaggatcttgttgcaacttgcaagatgtcgttggccgtcgcagaccgagcagagcaagatgtcgttgcagccttgctccttgcaggcttgcaggacctccggagccgaccgagtgaccgacggaccgagcaagatgccaagtcgccaagatgtcgttgcagcatagccttgcggccttgcgggacgccggtccggcggtccggcgtgggagcgtcagcggacagcggctcagcgtgtggcgtactagcgtgtccctgtcgcgtgtcgccgctgtcggccaggtcgccagacgccagtccccagccgcccggaattgaggaacagttgttgtcgcgtgtcgccgctgtcggccaggtagccagacgtcagtccccagccgcccggaattgaggaacagttgcgcagcgcacactcgccaggaaccgggagtctgggaagccgaacgatcgagaagttggaacggccgtccggcgtcgggcgaacaggatggccgagtggggtcctcggtaggcctggcttagagtgtgtcagggcctacctggactccccttgggtccgcccctgcttgcatgttgtgttgtcgtcggttaatcgctatttcaatgctcgatagcatgctcagctaatcgtttctgctgtctttacttaggactagtttgggaacattattttctcaagtgattactatttttctaaaggaaaatgaactaattttacttaggaaaatgaaaatccatcgagaaaatagtgttttcaagctagcccttatagtctagatcagtcagccaatattttaatatttttatagggttgagtataaatgcgtaaaaaacattatgttatatccgtatgagtaacaaataaagcggtagttggtcacagaaactggcaaagaaaagggcggggacgagcaccttcgtccacgaaaggacatcacagtttcgtccatgatcttggtagctgcggctgctacctttcctgggtcgagcaaggtgtgacgaccatgctggcgaaatcgataaagcgaccaaaagttccagtcaccggagcggcggagccacaacattgaacatacccgtcaagatgaccaggtacagatgcaatcgagagccctgtgcaaatctcaaangaagcttcccaattcccatgtttataaagcattgggaccccgccggccggccgggagaacagaaccgaaacctcagacactctacatatatcctctgcgcgtgtatctcgtcgtacagagccgaaagctggagcttccaatggcgggagacaacgacctgaaggtgctcggcgtgtggacgagcccgttcgtgatccgggtccgcatcgtgctcaacctgaagggcctggcgtacgagtacgtggaggaggacctcagcaacaagagcgcgctcctcctggggtccaacccggtgcacaagagcgtgccggtgctcctccacgccgggcgcgccataaacgagtcccaggtcatcctgcagtacatcgacgaggtgtgggcggggacggggccggacgtgctgccggccgacccctacgagcgcgcggtggcgcggttctggggcgcgtacatcgacgacaaggtggagtcggcgtggctggggatgctgttcaggtgcgcgaacgaggaggagagggcggcggcggtggcgcgcgcccgcgaggcgctcgacgcgctggagggcgcgttccgggactgctccagggggaggccgttcttcggcggcgacgacatcgggttcgtggacgccgttctcggcgggtacctcggctggttcggggccgtcggcaggatcatcgggagcaggctcatcgacccggcccggacgccgctgctggccgcgtgggaggaccggttccgcgccgccgacgtggccaagggcgtcgtgcccgacgacctcgacaagatgctcgcgttcctgcagaccctgcgcgctatgaactacgccaagtgagagtgtttcgtcgcatgaacgtgtgccgtgccgtgcacgacctatgatcagttcatgtcgatacgtctatcactcagttttgcttcttccgtcaataatcggtgtgctgaatacatgtacaacagctgcctataattttgcttctttcttctaatacctccgtttttaatttgatagttcaactttataataacaaatgtcaaatttaaaaaaaaaatcggaaggagtatttttttaatacatccaagtccatccaataaaagtgctcgtggggctttctattaaaaaaaaaaaaaaaaaaaaaaaaaaaaaaaaaaaaaaaaaaaaaaaaaaa

SEQ ID NO: 15962 - DNA, 1419 bp, Zea mays
cattgggtacctcgaggccggccgggaaaattcaaaaaaaaaaaaaaaaaaacagaaccgaaacctcagacaccctacatatatcctctgcgcgtgtatctcgtcgtacagagccgaaagctggagcttccaatggcgggagacaacgacctgaaggtgctcggcgtgtggacgagcccgttcgtgatccgggtccgcatcgtgctcaacctgaagggcctggcgtacgagtacgtggaggaggacctcagcaacaagagcgcgctcctcctggggtccaacccggtgcacaagagcgtgccggtgctcctccacgccgggcgcgccataaacgagtcccaggtcatcctgcagtacatcgacgaggtgtgggcggggacggggccggacgtgctgccggccgacccctacgagcgcgcggtggcgcggttctggggcgcgtacatcgacgacaaggtggagtcggcgtggctggggatgctgttcaggtgcgcgaacgaggaggagagggcggcggcggtggcgcgcgcccgcgaggcgctcgacgcgctggagggcgcgttccgggactgctccagggggaggcccttcttcggcggcgacggcatcgggttcgtggacgccgtgctcggcgggtacctcggctggttcggggccgtcggcaggatcatcgggcgcaggctcatcgacccggcccggacgccgctgctggccgcgtgggaggaccggttccgcgccgccgacgtggccaagggcgtcgtgcccgacgacctcgacaggatgctcgcgttcctgcagaccctgcgcgctatgaactacgccaagtgagagtgtttcgtcgcatgaacgtgtgccgtgccgtgcacgacctatgatcagttcatgccgatacgtctatcactcagttttgcttcttccgtcaataatcggtgtgctatgtacaacagctgcctataattttgcttctttcttctactacctccgtttttttatttgatagttcaactttataataacaaatgtcaaattaaaaaaaatatcggaaggagtatttttttaatattttttaatacatccaagatgctgtttggtttatatgtttgtaatgtaataggtaaccaataacgttaaatcatatttgtttaagtcaaccgtaatcgaataccacactagaaattgatatcagtctattcaaacttgttaccgcgggtaatcgaatgcaaaccattatcattaccatttacgttacattttggaaaccaaacagcaccttaatcgagtccaataaaagtgctcgtggggctttctattactcatctgtttcagctaaatcgcttgactccatcttccaagttttaacagtttcactaggacttgtacaagcaaacaatgctagtacatgcgctactttattagttt

SEQ ID NO: 15963 - DNA, 1197 bp, Zea mays
cttgctagctgtggctgctgcccctcgagacgaaggcgaacaaaggttacagacgaaggcgatcatatgttcgagtgcagagccacaacctacccgtcaagacggccaagtacagatgcacaaatctggagagagagaaaaaaacaaaacaaaacaggtcaccagacactgctcacatctatatctatctatatataaagcccattggactgtggacgagagagagagagagagcgcgcgcgcgctggcaatggcgggagccgacgacctgaaggtgctgggcctgtggacgagcccgttcgtgatccgggtccgcatcgtgctcaacctcaagggcctggcgtacgagtacgtggaggacgacctcggcaacaagagcgcgctcctgctcagctccaacccggtgcacaagaccgtgcccgtgctgctccacgcgggtcgccccgtaaacgagtcccagatcatcctgcagtacatcgacgaggtctgggcggggaccgggccggccgtgctgccgcgcgacccctacgagcgcgcggcggcgcggttctgggcggcctacatcgacgacaaggtgaaatccgcgtggctgggcatgctgttcgagtgcagggacgagggggagcgggcggaggcggtggcgcgggccggcgaggcgctcgggactctggagggcgcgctcagggggaagcccttcttcggcggcgacggcgtcggctttgtggacgccgtgctcggcgggtacctcggctggttcggggccgtcggcaggatcatcggccgcaggctgatcgacccgactaagacgccctgctggccgcgtgggaggaccggttccgcgccgccgacgtggccaagggcgtcgtaccggacgacgtcgacaagatgctcgcgttcctggagaccctgctcgcgaactactactccaagtgactgtactgagagcgaactactgctccaagtgactaaataagaagggctgcttaattaataattacagtatataattgtgcaaaaaaaaaaaaaaaatacgagtatagatggcaaatgggtcatgctaaatggaccggcagtaagcacaacatggccccgtagtgctttggcatgggcacgattcatataccacgtgattcttatgttcgtctccttgccaaaagaagcgtatctgaagtaatctaattttttcatcacaccttt

SEQ ID NO: 15964 - DNA, 1631 bp, Zea mays
cggcacgacgtcattccgacaatggtttatggcttcttttataggtgggccttgaatccctaaatctgggaatttgtccaaaattaagtattctgtgcattgaggccccaaatatgtctataatggagctgaagggttgtggtgtgctttccgaggcttccatcaattgccctcgcttgacatctttagatgcctctttctgcaggcagcttgtggggcactcccggcccggccggaccgaggcatgtcctctgattgaacatcttatcctgtcatcatgcctatccattggcatcgatggattgtcttcattgcattgccttcataagttgaccttgcttgacctgtcttatacatttttgatcaacttgaagcctatttttgacagttgtccacagttgaaggtgttaaaactttcagcttgcaagtacctcagtgactcatcattggatgccctttacagagagggtgctcttccattgcttgttgagctagatctgtcctactcacccatcgaacagaatgcaatagaaggtcttcttgcttgttgtagtaatttggttaatgtgaacttcaacggatgtacaaattttcaagaattggtgtgcgaatctggggatagcggttctgtggatatgccagttgactcttgtccacctagttcaccaatcaagaatgaagagatcagtgagcaacctggccgtctgcttgaagttctcaattgtactgggtgccctaatattaagaaagttgttattccttcgatagcaaacttttcacatttgtccaaaattaatcttaatctttcaaccaacttgaaggaagtggatttgacatgctccaatcttttaacgttaaacttgagcaattgtagctcactggaggtgctgaagcttgattgcccaagattgaccaacctccaacttttggcatgcaccatgttgcaagaggaggaattagaatctgcaatatccctttgttgtgcgttggaggtccttaatgtgcattcttgtccaaagatcaatgctctggattttggccgactccgtttggtttatcccagtctgaagcgcatccagagcagcctcatttcataatgcggaggctactaccatattaaggagtgcaattcatgcaataagcctctgttcaggtttgatgaaagaagcaagtcgggaaaagctctccttgatgctctttgtacatattacccaagcattgccggtatattgcaagccaggggcaacgtggtcctatttatccagttcattcatggttctgtaataagtactttttttttgcaaatttgttttgttgccggagatagcaaaatatctgttcatgtctgtttgtctttgttccttggagtgtaccaatggagctatcagatgtatatgcatcaataatcttgttttgatctaggatcttggaatcgctttgctagggcgggcccgggtcccgttttgtacaactttaattgttcgcagattttagcgagtgttatgaagcttaactgatctaaggtgtagttttgtacgactatgtttaattgttcgcagattttagcgccagtgttatgaagcttaaccaaaaaaaaaaaagaaaaagcggccctcgacgctccttctgga

SEQ ID NO: 15965 - DNA, 1349 bp, Zea mays
  misc_feature (50)..(50): n is a, c, g, or t
agggcatggcggatgggggccggatgaagggcgtacagagcgctggcggnggcgccggtgacgacgaagaggggaatgaggaggtgcgagaggagccggaactcgcgctgtcgctggggcggcgagtctggcacctcccgccgcggcaggaggccgctccccgctcacttaactggactccggttctgccgccgcgcgtccccgacgccgctgggagctcgcagggtgtggaaagggccttgggcggacaatccatctcttctcttgggttccatgacatgtttggtggtatcctagacgatccccaagcgggtggcagtatggaggttgggtggggcaagctgaacgaagaggatgaagacagagacctgcagaataaacggctcagagtacgacactttggcgaagaaaacccactgcattctggtgccagtgctactccctttggctctgaatcgtcatttttgcccatttctgatgaatgtgttcatttaaagctgtctcgtttcccagaacatgaattggaatttgggttgccacttttcgcaaatgatggtagtgagagcccaagggatgccaataatgagcaagtcgatgatgcagaaaactccggtggaagaaattctgtggatgttggaataagaatggatctctccgatgatttcctgcacatgattttctctttcttggaccagaaggatttatgcagagcaggtgtgacctgtaaacagtggcgatctgctagtgtgcatgatgatttttggaagtgtttgaaatttgagaacactagcgtatcactggagaactttgttaatatttgccgtcattaccagagtgtcacagaactcaatttgcatggtgtcataaatgcagaaacactagttctggaagcaataatgtcttgtacgcatctgaagacattaacaatgggcaagggacaactgggagaatcattttttcaagctttggctgagtgcccattattgactgctttaacagtcaacgatgcttctcttgggagtggcattcaagaagtcactgttaatcatgatggactgcgtgagcttcatattttgaagtgccgtgcacttagaatatctgtcagatgttcccaacttcaaatactgtctttgaggcgaacaggcatggctcatgtatcactgaactgtcctcagttgcttgagttggacttccaatcctgccataagctttctgacaatgcgattcgccaagctgctacagcttgcccattgttggcaaaactagacatgtcatcttgttcttgtgttactgatgagacattgcgtgacatagctagctcatgttcgagtctttctggtcctgatgca

SEQ ID NO: 15966 - DNA, 1142 bp, Zea mays
  misc_feature (1085)..(1085): n is a, c, g, or t
  misc_feature (1089)..(1089): n is a, c, g, or t
gcacgagggttgtgtcgatatgccagttgacttttgtgcacctagttcagcaatcaagagtgaagagatcagtgagcgatctggtcgcctccttgaagttctcaattgtactgggtgccctaatatcaagaaagttgttattccttcaatagcgaactttctacatttgtccaaaattaatcttaatctttcgaccaacttgaaggaagtggatttgacatgtcccaatcttttaacgttaaacttgagcaactgtagctcactggaggtgctgaagcttgattgcccaagattgtccaatctccagcttctggcatgcatcatgttgcaagaggaggaattagaatctgcaatatccctttgtagtgcgttggagttccttaatgtgcattcttgtccaaagatcaatgctttggattttggcagactccgtttgggttgccccagtctgaagcgcatccagagcagcctcatctcataatacagaggctgctaccatataaaggagggcaattcatgcaataagccgctgctcagatttgaagaaaaaaacaaggggatgtttggtttctagggactaatttttagtccctacattttattctaatttagtctctaaattgctaaatatggaaactaaaactctattttagttttcgtatttggcaatttaggaactaaaatggaataaaaatatagggactaaaaattagtccctagaatccaaacaccaagtcaggaaagctctctccttagagctcttgtacatagtacccaagcattgccggtatattgcaaggcatggtatattaggagccaggggcaatgatatcctatttttccagtccattcatgttgctgtaataagtatttttgtgaatctgttttgttgccggaggtaacaaaatatctgttcatgttttttttttctgtattcgttggaagtgtaccgatggagctatatgctggtttatatgcatcaataatcttgtttggatataaaattttgaaaaaactttgataaatgacatttgagggggggcttttaaacaaaaaacaatataaataaacaacaaaaataaaanagantaaagggtggacgctatcaggattaggcgaggcagcgaggtaagctctttaag

SEQ ID NO: 15967 - DNA, 3562 bp, Zea mays
gactagttctaggaaattggtgcttcaaaaacaagagagcttatccagtttgtcattgcaatgccacaacttgattgatgtggatcttactgagtgcgagtcattaacaaatgcggtttgtgaagtatttagtgatggaggtggttgccctatgctaagatcattgatccttgacaattgcgagaatttgagcattgtagaactgaacagcagttctttgtcctgcctctctcttgctggttgccgctcgatgacattgttaagactctcatgcccaaatctgcaacatgtcaatcttgatggctgtgatcaccttcaaagtgcagcattctgtccagtgggtctcgaatccctaaatctgggaatttgtccaaaactgagtgttcttcacattgaggctccaaatatgtctatattggagctgaagggttgtggtgtgctttccaaggcttccatcaattgccctcgcttgacttcgttggatgcctctttctgcaggcagcttgtggatgattctctgacttgtatgtcagaggcatgtcctatgattgaacatcttattctgtcatcatgcctatccattggcatcgatggattgtcctcattgcattgccttcataagctgaccttgcttgacctgtcttatacctttttggacaacttgaagcctgttttcaacagttgtctgcagttgaaggtgttaaaactttcagcttgcaagtacctcagtgactcatcattagatgccctctacagagagggtgctcttccattgcttgttgagctagatctgtcctactcgtccattggacagaatgcgatagaagatcttcttgcttgttgtactaatttggttaatgtgaacttgaatggatgtacaaactttcaagaattggtgtgtgggtcagatgatagcagttgtgtcgatatgccagttgactttggtgcacctagttcagcaatcaagagtgaagagatcagtgagcgatctggtcgcctccttgaagttctcaattgtactgggtgccctaatatcaagaaagttgttattccttcaatagcaaactttctacatttgtccaaaattaatcttaatctttcgaccaacttgaaggaagtggatttaacatgtcccaatcttttaacgttaaacttgaggtaacatcaatgtgcatttgtgcattttccattgttgttatgcagtattggttttgtttttatgacgattaggtgaatttcatatctggactttcaggcattcctcctagcaattgtagcatgtttaaagttatgtatgtagtccacttaaaagtcaaacaaactagcaaaaaaaaatgcaatgtcacattttttgagatgtcaaggatcaaaatagacaatcatagggctggacaaaatactcgtggctcgtgagctcgctcgactcgtggtcagctcggctcggctcgtttcaattttatcacgagctgagctaacgtcttagctcggttcattaacgagccagctcgacacgagctcgagccagctcgttagctcgaatgagctagcatttatatataaaacaaagcctatacttgtattggatgaattaataagtgatgaactatgttagtttagtgtttcaatgatgtgatatataaaattatgagtattgttagccttttctagtattaaattaatataaaattaactagcaattgattatattgttgtatatatacatgtatactattttttgttgtggctcgcgagctaaacgagccagctcgagctcgcaaacgagccgagctgagctggttctctggctcggtttttaacgagtcgaaccgagccagcttgttcccttaacgagccagctcgagctcggtcgagccctggctcgatatccacccctagacaatcactcaattttgtttatcatgtgccaatggtaccaccagtgtttttttaatattggtatcaaagataaatatgaaaatgattttttttatattaatgtgtactaagcgcatgcctctttattgatttttttttttaaaaaacattgaaatattttcatgttatgactttttttgctaatgggatgccagaactcccttgtaaccaaagaatctcttacaactgttctttcgttctttctttcagcaactgtagctcactggaggtgctgaagcttgattgcccaagattgtccaatctccagcttctggtacgagatgaatgattcagtgcgtgttgtgttttaatctcacgtttatagtgttaatattaggtgtattaggtgccgtttggttcacatatttgtacggtaaccgataacgttacatgatgtttgtttaagtccaactgtaatcagataccacactaggaactaatatcgacctattcaaacttgttaccactggtactcgggtgtgaatcattactattaccatttactttacacttcgtggagctagagcgggtgggtagcaaagacatttttcaacaaaatcttgatttcttggagctggagctgggttacaagccaaacacatcaaaatattggtagactctggagtagaactgctctatggtggagttgatagagcagagctggagttggtggagtggagcagttccaaacacacacttatatttaaactttggaaagtggtggaatgttaaattccaagctaaataacctactctattagatagattccaattcctccaaaatctagggacccaaacagctcataagtgctgggcatgtagtttcaggttttgctgagtatatgtagtgcgaaattttatcttctattattgcatctacctgattgatgcaatctcattttttcataggcatgcatcatgttgcaagaggaggaattagaatctgcaatatccctttgtagtgcgttggagttccttaatgtgcattcttgtccaaaggtaagttaacatattttgtgcagaagtccaatcctgtgtcctgtgttttatgttagccttataagggcttgtttggttcgcgttctcaatccatgtggattgagtggaattgggtgattttaaatcccaagcaactcaaacttcttaatttttgccaatctcattcaatccatgtgtaatgggaataaccgaacaaggtctaatcaaatctttttgtgcacagatcaatgctttggattttggcagactccgtttgggttgccccagtctgaagcgcatccagagcagcctcatctcataatacagaggctgctaccatataaaggagggcaattcatgcaataagccaggcgccctaggtgaaggagcatacccgacggggtgtttggtttctagggactaatttttagtccctacattttattctaatttagtctctaaattgctaaatatgaaaactaaaactctattttagttttcgcatttggcaatttaggaactaaaatggaataaaaatatagggactaaaaattagtgcctagaaaccaaacaccaccggtcaggaaagctatctccttagagatcttggtacctcggccgccgacccaccgatagagggcgaatgtcc

SEQ ID NO: 15968 - DNA, 561 bp, Zea mays
cgagaccattccctagaacatcctaatcgaaaacttttttcgtctgggctgccaacatgccatccagactgaggaagacccggaaacttaggggccacgtgagccacggccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagacgggggctgctcccatcattgatgtggtgcgatcgggctactacaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactactttttcaaaaaaaaaaaaaaaa

SEQ ID NO: 15969 - DNA, 1197 bp, Zea mays
tgggtccctcgggccgccgtcgagtgagtcctcctcatcgccgtccatggccgccaccgccctgagcatgagcatcctccgcgcgccgccgccctgcttctcgtccctactcaggctcagggtcgcggttgccaagccgctggcggcccccagcgccagcgagccaccagcaccctcagcctccgtcctccggcccaccgggcctcctaaaaacccaaccaggccggcgtccaggtgtccacagaaagaggagagcagagagagcgggagatcatggagctctgcgtctctaccactgcctccgtccgcgccaccgccgcgcccatatccttcgccccgccccggcgaggcgcgtctgcttccaccgccctcccgctccaccgccgaatcccaactcgaggctggtgttgcgccagcgcggccgtgcctgacccggcgccctccgaagagctcgcatccgcctcctacaccgtcgtcgtcgcggacaagcccgattcgcctgccgatgacaaggtcgacgaggttagcgccgcgcctagtggctccgcggaggcgcccgtagcagaaccggtgtcatcagaggcgtccccgtccccgtccacggatgacggcggtctggatgagatactaagcaagttgaacattgaagtgactccgattttaatcctcactggatctggtgcctttgttgctttatggatcctatcttctgttgtttctgcagttgattcagtccccctgctcccaaaattgctggaattagtaggaactggttactcaatttggttcaccgcacggcatctccttttcaaggaaagcagagatggcatgtttgcaaagttcaaggatatcaaagagaggatcatttgatctaccatcgatatctggtcacgtgtttaggctttacagcctgcttattattaggttttctcccctttcaaatattactgaaggggtaaagaaggtcgtatatctaatttttcttctcacggggtctgtcattaggcttctcaagtttggctagtgtgcttcttcaggtcactctggatgttttttactcaatcctatgtgtatgctgccgaataaagctttaaaaagatgaatgcaattagtatgttctcgctcctatacaaaaaaaaaaaaccaccctccagtaaacatttcagataccatatgttaagctcgagccttctgtga

SEQ ID NO: 15970 - DNA, 680 bp, Zea mays
atcctgactgtagtttttataagtgtgatagtcaagatactgaagattcaagctcattatcgtcatctttctcaaagttgaccatgtcatcatatgttgcttgcatgaacggtggtaacataaaaagtagcgagtcttatgatgatacagatgaaataccactatatgtaaccaataaggagtttgacaaggctaaaacaaaagttagaccgagtgcgatgcgcgaggttattcttgagcttccgaaggtacgttgggaagatgttggtggccagtgcagggtcaaggagcaactgattgaagctatccaattaccacaaaaatgcccagaagcatttgaacgtttagggatccgaccccctagaggattgctaatgataggaccgccaggttgcagcaagactttgatggctcgtgctgcagcttctgaagcaaaattgaatttcctggctgttaagggtcctgaacttttcagcaagtgggtcggtgactcagaaaaggcagtgagatcgctatttgcaaaggcgcgggctaatgcaccagcaatattattttttgatgaaatagatgggcttgcagtaactcgtgggcaagaaaatgatggcacgtctgttgctgatagggtcctcagtcagttgcttgtggaaatggatggtttggaccagagagttggtgttact

SEQ ID NO: 15971 - DNA, 1524 bp, Zea mays
tagaacatcctaatcgaaaagtggatgcgcggagaggccggcagcggtggcagcggcagcggaggaggaagctgagcagggcggcggcggcggtggaacctgcggggctggggcgcgcgccatgggccgcctgcactgcactgaggacccggtgccggaggccgtgggcggcgacatgcagcagctgaaccagctgggcgcgcagcagttctcagccctgacagaggtgcttttctacttcctaactgagccaaaagaggtggaaagatttctggctcagctctctgaatttgccaccaccaatcagatcagtcttggctccctcagaagcatcgtgaaaagcctccttctggttccaaatggtgctttgaagaagagtctcacagccaagcaggtccaggcggatttcataactctgggtcttagtgaggagaaagccacttacttttctgaaaagtggaagcagaatgctcccacccttgctcgatgggccataggtcagactctgatgattaaccagctcatagatatggagtggaaatttggagtgacatctgggagcagcgaattggagaaagtgggaagtatatttttacaactaaagttggtggttaagaaaggaaatcaaaccgaaaatgtgtatatagaattaaccttgcctcagttctacagcttcctgcacgagatggagcgagtcagaaccagcatggagtgtttctgctgatttctgtccctgcatctcccctagccccgttccctgccctcctcccttccctgggtgactgctctgagaggcacttcactcacaggcctgtgggatgctccatggggccctgctggctccatggggcccaggtgcaaagggtttctgaaaaacagcaggattaagtactgaaagagcccaacacaattaccctgtaaactctctgttagggcaaccaccaccacctgtcttccaggacacatttttagatactctgacaggccactgcatctcagattcaggggagaaaataagttgtcacctcctcttcaaagttccagagtaaacaaatggtgccatcattcaagataacatgctgatcaccctcctcccaaaaagcaagagcttgtttatggctgaggaatcggcggattgtctgaatgacacatatacagagcccccacggatttctgcacactctgggtctgtgctggtggaacattgccaatcagttcttaatgaggcacctgtgtgtaaatacatgcttggtcttctctgcagagaactgaggctaaactctgtccctacttctggttttgccctgtcatgtcgtaacgaggtgggccttttgaggccattttagtttgagttcgagccaaccacctctgttggttagatgatgaataaaaaggttctgaagaaaaaaaaaaaaaaaaaaaaaaaaaaaaaaaaaaaaaaaacccaaaaaaaaaaaaaaaagcttatcgaaccgtccaacccttcgaggggggggcccggaacccaattcgcccttatagtga

SEQ ID NO: 15972 - DNA, 2987 bp, Zea mays
ttctcgtcccagtcgacgaaaacgaacagcccctcgctttagattgccgcaagttcccccattcctgtagatcgccggcccctcgctcggctcggccatgtcggccggctccacggcgtccctcctcgcggccgtcatctgccttgccctcgccgtgcttgctcccgtcgttcctggagatggtgccacattggaatcagttccagaccttgtgaaggcaatgtacctaaacgttgaaagcttcccttgtgtgaggctgttgaatctttctggtgaaattggctgttctaatcctggaagtgagaaggtcattgcaccaattgtaagacttagaaaaggcagtgatcaattggttcaaccatctactattctcctttccttagatcagatgtcagatttctttctgagggtatccaatgatccagaacttcaccagaaggtggcaggtgtattggttgagtcaaatggtgtcaacaatgacttacaagagctgtctcctgatagaaaatttccacaagatgattttgcaccctactcaaatcacagccatgattggaatcctgctggatcaggtatcatgtggaacaaatataattttcctgtatttctactttcagaagagagtacaaacactcttcaaaagatttcagaaaaaaatgagaagactggcaatggatataaagcaaatgttgcagaattcgaccttgttatgcagacaaccaaagctcaaacacatgattcagcatcctgcctcaaagaacaatcatgcttgcccttaggtggacacagtgtatggacttcattaccgccacttaataacggatctacagagcatccgaaacctttaatattggctattgcgtctcaagactctgcatcattttttcgggaccgtagtcttggttcagattctcccatatctggattgattgctttgctcactgctgttgatgctctttctcacattcatggtctaagcaagcttaagaaacagcttgtgttcgctgtttttaatggtgaggcctggggttatcttggtagtcggaaattcttacaggaattagatgaaggcgctgcttctgtgaatggaattagtagcttaaagattgaccaggtactggagattggttctgttggcaaggctatacttgaggaatatccatcattttatgtgcatgctgaagggaatccatcagcttcaaaggaaatattagatgcactgcaaagtgccagcaagtctcttggttctgataatgttaaagtaaaacaagcagcttcatcaaatcctggtgttccaccatcttcattaatgtcattcataaggaagaacatgtcaacttctggagttgtgttggaggattttgattcccacttctccaatagattttatcatagctatctggataaccctgtaaacatcaattcctcgtcaatagctgcagccgccgctttggttgcgaggtcgctgtatattcttgctagtgatgactcagttgttgaccttataacactaaacactataaaagtgaacgtttcattggtcgaagaacttattggatgcctgcttacttgcaatcctggtctttcgtgcggccttgtgaaaagattcatttctccaagcaatccctgcccaagtcattatgttggtgtttttctggatgacccatctggcacgcagcttccttcatatgcagatgacacgtctcggtttgtatggaactttttggcagacagaactaattcagcaggcaataaaagctcatgtactggaaagtgtggtgatgaaggtgaagtatgtgtaggggcagaggtggagggtggaggtagatgtgttgtatctacaaccaggtatgttcctgcttattcaactcgggtgaagtttgaggacaatgcatggcacgttcttccagcgaactcgtcagatccaatgggtgctgcagatcccgtgtggactgaaagcttctggaacactattggcctcagggtctacgccgtgcaagatccagcttacgattggcttattcttcttgccgggctcggaatcactgctgcatcttattgcgctgtacactttggcagagcatacatttcaaaggtggcgaagcttgactgaagcgtcagtgagctgccccactgataatgggtatctagagctggaaatagaactaattaggctggcaattcgtagaacattagcagcgcatgagacagggtgattaagctgcgagaaagccgcaataaattatgagaaccaagcacacccgaagcaagtcctccatcattatgcggacgtccaggtcgatgtaatattaatgaaattgtgaccgtgttacgttttgtgttgaactggtactggtaggtaggttatgacacgcctctagctctagttggtggatgtttccggtaacgtgtttttctgtttgtggatcctgcctactcagttttggttgcgtataagcctgcccctcatgaatcctatgagtttgtgaacaccaactattatactggtgtcctgcttccgcatgatgattggatcttgtatcgtgtttggtttcgccgctccagttgccactgtttgggctttccagctacagcccgaactgcatccggaccagcccatacgattgctactctcatccgttcggctgattgaacccggcccaaaacaagcaaagcctggaattggtattggtagagaagcgaaactcgtgcggactgcggagagtggagctggcagctgaagagagggagagagtgaccgagtgtccggtgtggtgacccaaatggagacggccaccacgtcgccggagcacccgctgctccgccgctcatcaccgtcgtccaataccaacgccgacgctgattctgtcaacctgtcttcgcctcctccctccgcggcgaggccaagccgtctcgcggcactcatcgggcgcgtggggtggccgcgcgggccctcgatgatggtgcacgaggcgacgacgctgcag

SEQ ID NO: 15973 - DNA, 1708 bp, Zea mays
ttgggtacctcgggcggcccggcctcgtaataaaaaaaaaaccccaccgaagccgaaaaagaaaaatcctcgccgacgttcctcaccacggcgacggccaccgcgacctcggccccgacgttgcctacggcagccaccatgtcggcgagctccgttgtccccatgctgctgccagatgagcggcccgacatcctctcgctgctcgacgccgccgcccgcccgctcgccgacgtcgtcgccgacttccttgctcggttcccccgcgagcgccgcctccgtgtctgcggcgccctctgcttcctcctcgaggacaagatgatgctccatcctactggccggttaattgcatttgcaattcttcatcagagttattcgccgcagacagcaaatccatatattcctatattgttaaatgcagcctgtgatgaaacgtcagagaaatcagaacgggcgtttgtccaactattattgacttcatctagtggaaatagtaataacgaggtcctgaatcagtctgcccttgattacataaatggatctgtttcagcatctcaggtctttttgcctcgggaacaacttgagaagcaatactgcagtactggtgtacattcctcgcctcagactagtagtttcacagctcctgcagttagaagtgctataccagatccagacgtccgtcaaagttgtgcaaattcatcagagtcttcgatatcaccacctggaagcaaacagaaatctgcgtctgatgatagagatactactatttctgttttactcgaagacataccgggggggaggttgggtccgcaatggattcggcccacacccccaagacttcctttatttgatggggagctacaatggctgaaccctgacaataaccacgagctattatgggattatagcatgtgtgctgacacgaatcgaggggctgctatccgagatttgattgcaagagccttaaaaggtccacttgcacctattcaacaggagtttcttgcagcaagtcgtagtagaactggcaaaggatcctaaactggtttattattgtgggatgactccacagaagcttcctgatcttgttgaacacaacccactcattgctgttgaggttctttcaaagctaattcactctcctgacatttcaggttactttgatgttcttgtgcacatggaaatgagcctgcattctatggaagttgtgaacagactcactactgccgttgaccttccaacagaatttgtccatgagtacatcacaaattgtatccaatcatgtcaaaacataaaggataaatacatgcaaaacagacttgtgagactagtttgtgtttttctgcagagtcttatccgaaacaagattataaacgttcaagaccttttcatcgaggtacaagcgttctgtattgaattttcacggataagggaagcagctggtttgttccggctactcaagtcgttggagtgaaagaattcgtgtgttttttacttgccgtctctgtaccatactgcatcgtgtatgtttctacttacattctctggaccatactgcatcttttttcccccctaatatatgtacatcttcattgtcatggttaagtcagatgcctcaagggcattggatgcgaggatcatgtgttgtattgaaaattttccatggaaccatttttggaactttatgggctgattgctactctaaaaaaaaaag

SEQ ID NO: 15974 - DNA, 913 bp, Zea mays
ccgccacgcccccgcggggcgggccctgattcacgtggagcgagtgctgctcctgctcggcatcggctgctctgctgccgtggcccgtgcgtgggatttagctcaggaacccacgcctgacatcccctcttcctccccggccggcgatgtcgtcttcgtcttccgcgctggccaaaggcaagtcggcaatcggatccgcagccggatctgccaaattcgaggccaaggggaaattctcctcctcctcctccccagctgcggcagctaccaagcgtggaaccaccaccagcagcagcagaggtagaggtagagggaaggccgacaagaaggtctactccttgcccggccagaagttcgatcctccggaggagagggagcctctcaggattttctacgagtcactgtccaagcagatcccctccagtgagatggctgaattctggttgatggagcatggtatgttgtctcctgagagagcaaggaaggcatatgaaaggaagcaaaagcggcagcagcaagtgaggatgggtaccccaatcaagtcttgtgcagtgagaaaagataataaacctgaaagttccaagaagccaggcattatggattccaaggcaaagagaagagttgattacagtgacgacgacgacgatgacttcattgtgaaaatgaagagatccaggggatgacatttacttgtaatttttttattaattatatcaagtacagataccaaaaagacatgctttatataagctagggtcctaattaattaaaccctgcaactgtacccgcatgcatcttgaatagatatactgaggtttgcaagtttatgctgttgaattgaattgtaatactatgtatgtgcagaatttaatttgtctacaaatgtatctgctaggccaaaaaaaaaaaaaaa

SEQ ID NO: 15975 - DNA, 2014 bp, Zea mays
tggcgcaactattgaactacaacctagccaggaggacaaagtcacgtggaaactaacaccaaacggtgagtacacgatgtcatcggcatacaaagctcagttgttgggaacatgcatcgaaccaaatatggcttctatttggaaggcgtggggtccaccaaaatgcaagttttttcttgtggctcatcctacagaaccaagtgtgggcgacggacaggctagcaagaagaggatgacagcatagtctgatatgtcctttatgtcgaagatagcggaatgcacatacacgaggacaatatgagctcaaatcacaacttggacaaaagcagcaggatctacacccaacaggatgacacgcggacatcgacacctttagaatggtgtgcatccaccacgaccacggcgcacgatgtaaaattagtccgatctctagccctaatgatatcttaggaaatttggaacgaaaggaacggtcaaatttccagaaacaaggaaacattagtcatgagcatagaacgaaactacgccaggagatgggctcctgaattaacgtcggggctaagagtttagacagattatctaaatgcgattagcggtacgagacgccggatgtaacgaacctccttctattttaatgaaatatatgcacactctcgtgcctctattctttcaaaaaaggtaagaatactctcgattcgaaagacgagattaaacaagaacctttaatctgttcgcagcctcgacgacgagttggttacgcgccttcaactttgaaccacgctccagcatgttctgatcccctgccgatctatttttttttatttttattttttcagcgataaaactgctgcagagagtcccaaacaacgccgcgtcacgctctctcgaggacgggacgtgtgagtgagcatggcccagggcatgcggctcggattgtctgtgtctctgttgtccaccagtataccgtccgtcggtgggccgtgggcggtgcgcggtgggccaaggcatcgggttcctgacggctgccgtactctactctagtctagtctctcctccgcagatccataaaccactccacactccccctctcctagtctcctctccacactcccgctctcctgctactctgctccgtgatctggtctggtgagatcggggatcggaccgtcgactcgacaaacatggcggactggggccccgtggtggtgggcgtggtgctgttcgtgctgctctcgccgggcctgctctgcgagctgccgggcacccaccgccacgtcgacttcggcggcttccacaccaacggcaaggccatcttcgtccacaccctcgtcttcttcgccgccttcaccatcctcacgctcgcgctccacatccacatctacaccggctagctagctagtgcggagcatatgttgcgtcggtctggactcgcggaggtctcagatcagaaaggaacgccggccggcggcgcgtcctgtgttgctgctcttgttcctctgcagttcgatcgattcgaccaagtgcttgtaactgcctagcttcctcgttgctatgctagttactctctgctatctatcatgtaaaggccgccatggtcgtccatctgtagctgggcttgcagcaacaggaactagtgcgtgccctttaattaatggaatctgttcgttggttgcttaattaaaaaaaaaaaaaaacgtcccgatttcaaaaaaaaaaaaaaaaacagcccccgcgatcggactacgagggagggacgaccagtcaaaagtgttctttgtcgcttcactcctcaggaagtgctaaagccgcagacgacggtggtatcctttaatcggactgatgagttatgcatgaaccagagcgtgtaaacgtgtagtgttgggtgactcactcatcgtcggaccagttgcatggtttgtatttaaccggtgtggtgtcggatcagtgtcacggtttaggttaggtcgggttttagataaatgacggtttaggttaggtcggcttttagataaat

SEQ ID NO: 15976 - DNA, 845 bp, Zea mays
gcacgcgttgaggacgggacgtgtgagtgtgcccatgcccatgccctgggcatgcggctcggattggtctgtgtctagttgtctaccagtataccatccgtcggtaggccgtgggcggtgcgcggtgggccaaggcatcgggttcctgacggctgccgtactctactctagtcttagtctctcctccgcagatccataaaccactccacgctccccctctcctagtctcctctccacactcccgctctcctgctactctgctccgtgatctggtctggtgagatcggggatcggaccgtcgactcggcgagacatggcggactggggccccgtggtggtgggcgtggtgctgttcgtgctgctctcgccgggcctgctctgcgagctgccgggcacccaccgccacgtcgacttcggcggcttccacaccaacggcaaggccatcttcgtccacaccctcgtcttcttcgccgccttcaccatcctcacgctcgcgctccacatccacatctacaccggctagctagctagctagtgcggagcacatgccgccggtctggactcgcggaggtctcagatcagaaaggaacgccggccggcggcgcgtcctgtgttgctgctcttgttcctctgcagttcgatcgattcgacgaagtgcttgtaactgcctaagcttcctccttgctatgctagttactctctatctatcatgtaaaggccgccatggtcgtccatctgtagctgggcttgcagcaacaggaactagtgcgtgccctttaattaatcgaatctgttggttggttgcttaattaattcgcactctgttcatcccacaaaaaaaaaaa

SEQ ID NO: 15977 - DNA, 1130 bp, Zea mays
gggtgcctcccgcccggccgggccgggaattccttgcactatcccctaccagccagccatcgcaagatgtttgtttccattccatcggtggcacgagacaggagacgccaaggccatagctagagcctagagcagcagcagaggcttgacctgaagctccacccgccatggcattcacgcccgctacggcctgctgcaaggcttccctggcgctggcaccgcgggcgtcgccccgcggcccggcggcctgcgcgcaggcggcgctcctctgcacgccctccacctccgtgttccgcggcctccgggcgcccgcatccgccgcgccggccccgcgccggcgccgctcggcggcgtccacgggcatagtctgcggcaaggtcgccaagggcagcgtgccgccgaacttcaccctcaaggaccagaacggcaagcccgtgtcgctgaacaagttcaagggcaagcccgtcgtggtttacttctaccccgccgacgagacgcccggatgcacaaagcaggcgtgcgcgttcagggactcgtacgagaagttcaagaaggccggggcggaggtgatcggcatcagcggcgacgacgcggcgtcgcacaaggcgttcgcgcagaagtaccggctgccgttcacgctgctgagcgacgaggggaaccgcgtgcgcaaggagtggggcgtcccctcggacctgttcgggacgctgccggggcgccagacgtacgtgctggacaagcagggcgtcgtgcagtacgtctacaacaaccagttccagcccgagaagcacatcggcgagacgctcaagatcctgcagaccctctgatccgatcaacctcctcactgttctgggccatgctctgcattcgtcgctgtaaaagtaccggactatgtagtagtgtagtgtatgtaaccaagagctgatgacctgatgttttgttccatccttcagtgagtctatctatcacacgattctggctcgtttgatcgaccagcatcttcctgtttgtcatggtcagtttcacttgtattacaactgtacttttggtcgacagtctcagatgttgtagctcgttcaacccggggccggaacccaattccgccctatgggggggcgtatttaacattcccg

SEQ ID NO: 15978 - DNA, 788 bp, Zea mays
caccggccgccgcccgcccggccgggatcgtcaccctccttccttccccagcctctcatcctatgcaagaacccataatccagacccacgaactcgcagcagccattagcgtgcgctagccggccgcagccatggccgcccccgcaacgacctctctactgagcaccctgctgaatctgccgctcgccccgttgtcggggaagagctcgccgccgtccgtggtgcatgtggcgcggcgggggccgatggtggtggtggccgccaaggggtacaatgtgcagatcctggtggacgagaacgagggggaggagtccatcttccggcggttccggcgggaggtgatgcgggccggcgtgctgcaggagatcaagcgccgtcggaggtatgagagcaagacggacgagaagaagcgcaaggcgcgcgaggccgggcgccgcaaccgccgcaggcgtatgatggatgagccgaggttcccagaagaagacgccgacgctaccgcaaaggctcgggacgaggacgatgacaactgggagatcgatggcatcctgtgaaagagaagcaacggagtccatgatttcacaacgtccagacacacagaccccgacagctaatctgagttctttttggcccccggtgagacgcaaaccgtatgagttttggccgtgcccatttccgctttgaatggttacagttgcgatgtacaactaattaaatgttagcaaatgcagcatcccccatgcatgcatccctttcattcaaaaaaaaaaaaaaaaaagccacctgcggcc

SEQ ID NO: 15979 - DNA, 5928 bp, Zea mays
  misc_feature (2604)..(2605): n is a, c, g, or t
ggtctgcatatgctattttgcgtatagcatagataataaattaacattaaagacttgcaccatataattgtatattaattaactctaacagaaatcaaaataatttgcatctacgatgatcagccaaattaaaagctttgattatatgatgagacctgatcatagttgccaattctatatcaatatagatgatcaagtaacttcacataaaatcatctcccattttatttcgtagatgtattttgataagttttgtagataaaggttcttttagtggttgtagttaagactggaagggtgactattaatcttaataattcgtaaaccatttgaaacatggaacttttacacaatttgacacgtcttttttaccaaatcagtaggtgattgtaatgtatttggctttagataattgtatacttaagatgaagcatcaaatttgtcacgtagacaacaactatccggtgacaactttggactcaaattcatcgatgttgttattagcgacgaatttaatgcttcaaaattgtgacaattttttacgagaaatttattttgaccaaaaaattatatgtttcatattgtgtgtacgggagggttaggggggccaaggccctcatccgcccccttagctccacccctacgcgtgaaagttagcaatggtccacacagtcacaccactgtgcaagtgtcgccgtgttagagaagagcatcatgaatccacagttgtgcctgtcaccgagaaagttgttgagaaggattgagatatgttcagcctagagaaagctattgagaaggagcgatggcgccatcatcgctgcacgcatagaaagtacccaactaagttttgtaacaatttaactagattgactaatttttttagaagccaagttttcttagaattgagctaagctgactagttttattaaattaactaagtttacatagaattgagcagataatctattttttactagaattaagctaagttaactaatgtttattagaattaacctaagttgggtaaaacatgattacatgaggtctaaacatcaatggagaatgttatatataaatattttaatataaaatacttatactaattactaataaaatatttaatctaattaacttaaaatactaaccatttaatattttagagtaattagatttaccaaactaacatactaaaaatttatactaaatattaaattgatcacacattaactaatatttgttagcttaataaacataaatattttgggttgtcaacttagattatagtcactttgaacagtgtaattgtggaccgtcgaggtggagatggtagggaacacgtggttggggcacctagggtggaggtggaggtggacgcgtacggggcagacacgacacgacgtagttgggctgggtgacatggacaaatgcaggcgacacaacctagtggggtggctcgagccagcgagtgtggcacgaccgggcggggtggcacaactagagataacaataggtacccgtgatccgatatccgatggttatttactctattaagatatgtatatgggctaaatattctacatatgagtgttttattgggcaaaaatcttcacccaatgggtaaatgggtattagaatgttctgcactcatcgatacccattaatccatgggtataaaatacccagtataaacttggataaaaaacataaacttgaacatttggcctagcccgaaacaaatgaaactctagctatataatctctttctactctagaagtctacataatgtcgtaatcatgttcatcctagtcgtaacctcgtccaatcaactatgtaagtattgttttcgagcagatttttagttgtttcttgtgcaactatgtaattagacattatttctacaaatctaagcacaatcctactcatgtagtttgatttttatagcctcgtgtgtttataatgttaaaaatcaaatggtgtgatgcttaattatggcacatgatttatttaaatttgatgtttactaagtgttaatttttatagtttcattatatttgttgaataatgcttactgtatgtatctttatggatatgggtgacctaatgagtgacctatacccacatgggtataggtatgaagggtaaatctatacgcaccagtgaatttgggtgatccgataaggttattttttttgtcgtgggaatgagtgtgtgatagtaatacttggtgcgcattacccattgccatatgtagacacgaccataaatggcactggtggcccgatcgaaagtgatagcaacaacggacggactagaagagatacaagcacagggaaacatgtatgtataaaagacttgtgggactatttggttctatacctaaggtgccacacagttttatgtcacacttgtctaatgtgcctaaggttagttgctcaaattctgcatcacaatttgccacgtctaatttacaagtcattgacgagtgcgacctacgtaagagtaggaggagaaaaatcttaccatatttgtggctcaaaccaaacacatatctaaattggtcatacttgcctaactttagacgtgacaaattgtgatatgtgagnnagcaaactaaacagcctatcattaaattaagagcttttatggaaacaaccagtttttaaaaaactgatttatgaaaactgacgtagttctaaacatattaatatgttgggttcccttttttctaaaaggaaagaaagaaaaacacggctaaggagttagcggtggttccctccaaatccacgaataaataagaggataagccaaaccttcgctgtccatcgtcaccctccttccttccccagcctctcatcctatgcaagaacccataatccagacccacgaactcgcagcagccattagcgtgcgctagccggccgcagccatggccgcccccgcaacgacctctctactgagcaccctgctgaatctgccgctcgccccgttgtcggggaagagctcgccgccgtccgtggtgcatgtggcgcggcgggggccgatggtggtggtggccgccaaggggtacaatgtgcagatcctggtggacgagaacgagggggaggagtccatcttccggcggttccggcgggaggtgatgcgggccggcgtgctgcaggagatcaagcgccgtcggaggtatgagagcaagacggacgagaagaagcgcaaggcgcgcgaggccgggcgccccacccgccgcaggagtatgagcatggctgcgctccggttcgctgtccctctattggataggagagtacggaacccgttcaggatgatgtgcgcactgcccctgtgctttcttgtagttggtgtagttgcagttggaacctgttattcttgaagtcaatatgcctgctaccagttacgtttttggttttgtccacagtccacacatgctttggaatgcagacatgcagttgcaattgaaactggggctcgcaatttgatttttgatgtagctgatagtatgaattatgggaaggtttcgatcggggggtttgccgatttcacagaagttgatgcgtgccttgaacccttgacactgtttagtgggcaagtaaaaattccaaatccaagaactcgactacaaagtcttgttgttggctatttgcacgaaacagagtagtccctgttttccttgcttgttttgtagcgcactggtgcagtcatatatttgcgccaaatagagagaaagttgtttcctgccttgttttcagtactgatgcagtcatttgctgcaatgcaaatttcttactggttttgttggtgtcgtaatcgttggatctgtggatgagtcatgagtggattccagttctgataacaaatagttttttcttacagaaatgaattgggtagtctgattctcatccacacatcaaaccttgcaggcgtatgatggatgagccgaggttcccagaagaagacgccgacgctaccgcaaaggctcgggacgaggacgatgacaactgggagatcgatggcatcctgtgaaagagaagcaacggagtccatgatttcacaacgtccagacacacagaccccgacagctaatctgagttctttttggcccccggtgagacgcaaaccgtatgagttttggccgtgcccatttccgctttgaatggttacagttgcgatgtacaactaattaaatgttagcaaatgcagcatcccccatgcatgcatccctttcattccctctaacgtccttgtttagcttgccaggttggcaggttcactgtcccaaaaatagcacagtgacacccggccaggtggttgctcgcgagaggcgcctccgtgacacccggtccatgcaaccgcggaggccgcgcgcagccactccattgccccttttggccgtttcgctcccgagccccggccgggaaaaatccacaagccacttcagtgcttgcgatcgcgtcggccacgatctcttgcgaaaaagcttaccctgtgtctgtctgtccgaccgtcagtccgtctaacaatcgatttccatgacgacgtccccgcgcgtgtggctgctcgccatggcactggcgctcgcctgcgtgctgctcgtgaggtccgccgacgctgctgccgaggcgtccccgactccaggcggctccacctacgggtgcaacccggccacggacaagtcgtgcaagcccgagggcgtgggggtggtgctgccgggcggcggcatcgacctcgacggcgacggtgacgaggacgagctgccgcagttccagccccacctcatgatcctcggccatggccactgatgagtgtaaatggttggttggttggtcgtcctcagccgatctactggacgacacgatggcggtcacatttgcgtccgaatttctcttgttaaattgaggccagagtgattaaatgagcatatgatggtaatttattcaccgtgtattgcctgttcaaacatgaaagtgcactgatacaattttaaaaaacttatgcaaaaaaaaaaaaaaaaagcgacgacccgggtcattatatcgcacttttcctacgtttcttcaaccctatcgtgattcatgaacgtcctaatctccggccgatccgattgtcttgcttacggctggcaggacggcagatgtgaagatctatcaatcaccagtcggtcggtcgattcgcacgtgcctatcttccttttttttccctttagtcctcttggcgtccttttagggtgcatttggttggggaggcaactgagatggagcggctccaatccagtttctaagaattgaggcattttattctgtgtttggcaagtagaacaaaaccgcttcattttttgtttggttgaagagtagaatagagcggaaccgctcagtttattgtttggttggagagccatatgactattgagtggagtagagagaggagagtgctcacgtccgcgagagcgctcgcatctgatcgttttggtggagtgagagtatcccaaatatttaccatttatagactccaagagccgctctgctctcctccatggaaaccaaacatcgaaaaaaataagaatggagccgttccattccccttcgttcctcaaccaaacacacccttagaccaatcatctagcacactctcgtcccactcgcatggagccaggatctagggtgctctttgtgagcgtgaaccttccgcgctagaccgttcgtggcttgtgcagagggctacgctcctctctacatggcgacgcatcgtccactagctcggggcatttggatcgttcgcgtgtgcgcagaggtaacgatgatttgctacataacctagacctcaccccttaggaggaaccccgtcaagaaaggaaagatcatagggttgacttggaatcagcagatcacctaagacgcctctaaacaatgttgagccgagag

SEQ ID NO: 15980 - DNA, 2259 bp, Zea mays
gttgtctcttttatcagtgctaactatgataatgaaactacaggtgttctcatcatttggtacagtccagaaaattgctatttttgagaagaatgggggaacacaagctttgattcagtaccctggtatgtgtctacaaattgatcatgccaggctttaaatcactaagctttactggaagatgtttaagtagctgtagttgggttggtgtttgctggcggactttgtttgttttgctatcttgcttgttgtgttcagaagggttagtgcctgctgaccccttggtgatcagaggcaggagcgtgggaagcttgtgatgggaggttaatcattgaacttgtgaaaatgtgaagtctgtaatttcgttgctttggtattgaagctcggttttatcatgttggaaaaaaatcagtaggctttgatatagtgggtcaatcttgtctagaaaaatagcaaattgccccttgataccttgaacatcttacttcttttttgcagtaatcgtttaccatctgccaactctgaagtgcttggatctccctaaaaagaaaagattttccttatcagatgatgttttgccaaaacccaatgtgaaagtgattttcctgtgttataacaaaaacaagaggctttcacatatttaggaatggcatctcctgggaccctggagcccttgattaatctgcttatagtaacattgactttctcactaaacatgcagctgattatttcattttcccatgtgcttttctatagaaattattcatctgaatctgattaagtctttctttacactttagatgtaaatactgccgctgtagcgaaggaagcattggaagggcattgcatctacgatggcggctactgtaagcttcacctgtcatactcccgtcatactgatctgaatgtgaaggtataataggtgcattttgtttagtattctttgctcataaaacccttctagatgatacatatacccctttcacaaaaccctcagttatagtacaggaacaggacaccctgtattgttttttttgacatacgaagttatgccccttcatatttcaggcacatggtgacaagagcagagattatacaattccagctggcgtaatccaaggggcgccacaaccacctggtatacaagccacgtcccctgggtggcaaggtaaccttcaagcagcagggccatatgccccacccggtgcccctcctcaaaatcacagtgccaatggacaagtgccgaactggactcctggcaattcagggtattccccagccccaggagcgtgttcgggccagatgtactcatctccggcacagtatgtagcatcagggagcttccttaatacctcagcggccactccgcctcagtatgcaacctcagggggcttccctaataccccatccaccgctccgtcacagtatgcagcatcaaggggcttccctaacaccacacctgccgcccctcctggtgctccatcacaaacgccgcacgcttcccagcagatgccgcatcagcatggaaatcattcaggaggaggcacgcccggaactagccaaccgccactgccagcatcatactaccgttaagttggatcttcttttgctattgtacttgacctgtgttttgaactgagtaatcatgtaatactgcaataacctgcgatctgtaactgtgtttagatgtgatagcagatggatacgagtgaggaatacatgaatatgtttggggttttcattcattttaaaaaacggatcagtgttggctcatggcgattactggcaagatcatgattgatgttggattggtggtaatgttctgaacagccgacctcagtaagtacctcttgggtaacacggtttcctttttctttagtgaaatacacatgcgaaggtttcttgagtggagctcacaagcaggtaggtactgtgggcactgcttgattgtcgtctcggctcccttgtccggtttgctggaaggccctgagctgccgctgctagctgttcctatctcgttttgtcactgagcagttctccacggaagacggaacctctgaatgctgtgctggcatacatattcatcggaataatgctgatcactgggataaggaaaaataaatactgtacgcaagagataaggaaatgagcaggaccagatagaaagcggatgtggttaagcgatgggctgagttcaacaaaaggacgaaacatttacctgctaaattgtcaacttttttctcaaaaaaaaaaaaaaaa

SEQ ID NO: 15981 - DNA, 1159 bp, Zea mays
ggggaaccatgtacaacaaaaaaaatctgtgtgcatcgagtcattgtactgatctacagctacggcgtcccgcgaggccggccgccgtacctgtacgtcttctctatagagggagcaattggagagagagaaaagaaagaaagaaacaaagaacggcgaaaaatggtcgatgccggcgacataacggccggagggccgccacgcgctcacgaggaggagcaagcgggaactccggcatacggttcggtggtcctcggcggcacttttgaccgcctccacgacggccaccgccgccttctcaaggcctccgcggatttggggagagaccggatcgtggtgggcgtctgcacgggacctatgctcgccaagaaggagtatgcggagcttattgagcccgtcgacaagcgcatcaagggtgtggaggattacatcaagtctataaagccagaactgatagtacaagtggagcctattgaggacccttatggcccatccataactgatgagaagttggatgccattattgtcagtaaggagacattaaatggtggactggctgtaaataggaaaagagaagagaaagggttcccactgttgaaggttgaggttgttgatctcctttccggcggtgtggagggggaaaaattgagttcttctgctttaaggaaacttgaggcagaacaagctcaacaaagtgaaacaaaatctggtagccttgaagcttcttagggaggaaattgaatactttgatctggttagctgaatgcacaaatacgggggtgatctgctccaagctcagtgtgaacaaaaaatatgatcagagctgacagtttggttacctttctagaggaataatcttcgaacactggcccatggccctgtaacagtattgctctaaccttctaaaatcaacctggcaacatagactctcccctactaaccaaatttacaaattttgtattggcaatgccatctgaatgttaaaaggacaaaaaaaaaaaaaaaatcttgttgggtttataaatatctacaattgtgacaaagctacaaacgaatatggttccccttcgcaagaacccatgcaatgtagcttgtcattataatctttgttctcttgaaacatattgtataattatgtgtatatacgcattggttgatc

SEQ ID NO: 15982 - DNA, 2070 bp, Zea mays
aacacctccctcttttcctcgagcggtctaaccccaaaccctaaaccatggcgccgccggccccatccgtcggtccccgcctcctactccgccgcctcctctctacggctaccgaagcggcggcggagacacctgcgcccaccgcccccagctccgccgccgccgcgaagccggcgaaacaggacccgaggctgctctaccgtcgtttgtcggcgcttggaagcgccggggaggggagcgtgtcgcgggttttgaacaagtgggtgcgggagggcggcgcgacgcgaagcgacgacctcgtcaagcatgtcaaggagctccgcaagtacaagcgtcacgcccacgccctcgagttgatggattggatggtcaatgcaaggggtatgaacatgtcacacactaaccatgcaatacgtctggaactcatctataaagtgcgtggtcttgaggcagctgagaattattttgctaaccttcctgatccagcgaaaaatcatcgaacttacggctcccttcttagttgttattgctcagcaaaaatggaagagaaagcaacaaatctctaccgccagatggatgaacttggcatctggtccagtacactacccatcaacaatcttatgtccctttacatgaagttagaccagtataggaaggttgttagtctctttgaggagatgaaactgaagaatgttaaaccgaatagcctcacatgctgcattttaatgaccagctatgcagcattgaacaagatagatgacattgaagaacttctaaaagaaatggtagaaaaagatgtgactcttgggtggtctgcatacagcacacttgcttctatctatgtaaatgctggacaatttggaaaagcagaatctgctctgaagaaacttgagggccttatcagtgctcatgatgacagacagccttttgatttccttctgagcctatacgcttcactaggaaatttgagcgaggtcaatagggtatggaatgtgataaagtccaaattctcgaaggtaactaacacaagctaccttggcatgcttcacgctctttacaagctcaatgatattgaccgtatgaagcagatctatatggagtgggaatctaattatgaaacctttgatgtaaagctgacgaatatgatgattcgcagccatctgaaggttggcatgaccgaggaagcagaaatgttggtggagaaggtcaaggaaaatggtgcagagtttgacaccaaaacatgtgagttgtttcttgatcactacatgggcactgaggacatgaactcagcactgaactggttagagaatatgactaaactctccaagaaagcagagaagctcgatcaggacaggatctacaagttccagaagtatttcgaagaacacaaggatgctgacggtgcagagaggttctgcaactgcctgaggacgctagggtgcattgacgggaaagcatacgagtctctcttacgcacatacttggcagccggtaagaaaagctgttcactccgccaacagataaaaaacgataaggttgagatctgctatgacattgggaagctactcaagaggttgggcgacaaggggcgatgagatacatatttatcttcgtttttaatttgagagagattagttctgttgatcctgtacgtccatgagcatcagaaaccaaatgtcggtccaacggttgaaaatgtatcagttctttcgttgttcatgaaaaggatagctcatggctgggctggtatcgttccggcttttgcgttcttacaagaagcagtggggaacaataagattcttgtaagtgcaacgtgaggtcttgtctagctaggcttttttgagatacacttttcttctgaaatgaaattgctgttacaacacgaatcctgctacagagccgcttcactttccatgtctaaagtcagtgtgccgtcaggacatcaggtttatgtcgtgacaacgatatgtgcacgctcgcgaggagtgtagtgtggataggtctttgtgaacagagcagcaattcgtgctggaaataattggctgcaggccggcagtccaaagctgtccg

SEQ ID NO: 15983 - DNA, 3264 bp, Zea mays
tttagtttcctactaaactttagctatatgaattgaaatgctaaagtttagctccttggggtgtttagactactctaataaagtttagcatattgaaataaaaagacactcatgctcctaatgcggagagagaatgaggttagagggtattggtggaaaatggggttccctggtccacatttagctcctttaagcaccccttgagcagcatatgagataatatgtgctaaattttatcacaccatcattagctctcatgtttagatcaccaaatggctaaaagtagctaaaaaagctgctaaagtttatctcttgagattgaaatagagccttatatcatataatttatttatatatatatatatatatatatatagtaaaattataaatttaattggaaccattgattttagtttttttaggaaatgtatttgcacccttacctaccacctatatcattgaatgtgtatatatagtaatagtaaaaaaatgaaatcattggttttagttttttaagggaagcatatgcacccctacctctacctacctgcccctgtagtaaaccatccatcaccatttgggcggttactttgtcaatgtcaaaaaaggtaacgacgatgaaatcaatacctgagggtgtgcaacgcaagctcctcctccacctccaccctctaaaataagacgttgcagccaaccaggggaggccctccgcggtccgtggctccgtgccatcctctcctgggcagcgagcagtggtggccgcgggttcccccgcctcgtcctcccggatccggcgacgaaggtgcgtacccttgccaaatctgaccccgtgcgttggcccgcgccattcgcgcgatccggtagaaatttatttcgaatttctaggcgcggagtccagcagttccgtgtctaactaggacggcctgcctggtgctgcggcacagtgcgcgggttctcgctgttgtggatcgggggaatgggggtaggatcttcgcctgaatgtgttgctcgaggtctacggaatgtgtcggccttggagcatcgcctctgcctagacgctgtgatctgggctcgcagtacgcggattcagatcccaaacctgaagatttggcggggatctgttgatggctttgccatagttacctgtcgtggattcgggattaggctcagagattcgctgaatctgtttctgaatttgtgtagtacaccgcatattgagttgctttttgtgtgtaaggttttctcttgtcggtgtcacggcgaatggaattcatgttggaacagtgccgttgcccaattggccttgcgtgtgtcactatagatgggaaattctataggtcatcatttgttgtttgctgcagctatcagtgacttacctacccatcaggagggagttgaggtggatacatcattaggacccgaccagtttctttagctgcgcagcacttctctcttaaccaataattgaacaaagcttgtgtggcactagtttattattccctgtaggtggttcaacgacattgcttaaaatatgtgcctacccatatgcaatcattgtatgtgtattatgttattgcagacgtgcctcttagctttggtcacgagcaatgcaagctaacagcgtttttagcctcaatttgagttcattctccacttagatagatgaggacactcgtttgacaccactggactcgcgacgcggacagataggctgctctcgactccatatacaacgcgagcacggcccggccagtaccttttttcttggtcccaccatacatattgctttcccccattgcagttgcagcttcccatgctcttgcaagctttagatcagcaccaatccccaccaaattccagtcaaatctgccccaccgacaccttcaatcaatcatgcagccacttaattaggcttctaacatgtaaaatatgtctatcccttcatatcctctccggtagatactactccaattatcctctgcggagctggctcactgctggccattgggtccttgacctgcgcacctcgctgggattgaccttgttgagtcgacgaactgctctagccctttcttccaaattctggtggttatcgttgccgacatgtacgatttgctggcatcgttggccggaagccatggatggagactgatttgctgttagttgctgctccatgtccaccatctccttggtttgctgttgttctcttcttgacgtggtcccacgacgcgagccctggctggtgcttcggccttctgtcagttgaggcctatgctgcttctgcaggtccttcttacaccctgcaacactaccgtttggtgtgctgacatggaaattggggcagcaggacagctagatgaaatcaatacctgagggtgtgcaacgcaagctcctcctccacctccaccctctaaaataagacgttgcagccaaccaggggaggccctccgcggtccgtggctccgtgccatcctctcctgggcagcgagcagtggtggccgcgggttcccccgcctcgtcctcccggatccggcgacgaagattaattgaataacttcgataagatgggtcgtggtattagcagtgggggtggtcagagttccttgggctatctctttggcagtgacgaagctccaaaatcatttgagaagcctgcaccagttcaaaagccaactcctccatcctctgcagagagactaaaagatatcgctgctggtattcaaagtagtaaatcaaacaattacaaaagatctgaaggccagaactgtggaaatttccttacggaccgtccgtcgaccaaggtgcaagcagctccaggtggcgactcttcactcggttatctttttagtggcagcaaagatggcaagtgatgtacacctgctgttagtgttcgccatgatcatgggagaaggtttctgcttaacaaaggaaaaagggaaaagaatcttgtattcccatgagtaaatatcaaactgctcatggtatctatgttgttgggattgcttgtatgtgtgtacatgttcgtgtgtgtcgtgtgttgatccacagctactggtagcaagagcttctatccctgctgatggaattgtgcgcaatgccaatgttgacattatcgtgggtgatgctattatgttgtggtgtattattggatatgtttgctgtttaatacacattgttgtagaaaaaaaaaaacaaaagtccgcttcagcttcacagtgtcctgtgcaattttcactgaaaaaaaaaaaaaaaaaaggcccctaa

SEQ ID NO: 15984 - DNA, 5642 bp, Zea mays
  misc_feature (948)..(948): n is a, c, g, or t
tggagacttaggaatatttcttttagtatttgaggtttcttttatgcttatctcaattcgtagaaaaagagtgaatatttgggtgctaatcttaatttcctcacatgctaaacaaggagagtgtgaggagagggagacaagtactcgagaacttgggtcgggggtgaatacataatatccgtcagtcgagagaagagacgatggaaatagtaatttccgtcggttgagcggtttaagttgatataaattaccttgtttccattggttaagctatgatcgatataaattgttcatttttgcgggctgacctaaaagtccatgaaaattattttagctcatagaaattctccatttttatgttgggggcatatagataaatagagcttagagcgttgtgtgatcacctatcagaagacattgtaggtcatatctttagaagcacggtacaatcatcatatggatggagtggtggagcattgtagatcatatagtaaagtactagatatatatgacacatttctgttgtgtacaaaaagaatgtaataattttcaatagaacaaatataatagtggcatgcaggagcatgagagagggttggagcagtgtacaatcgcctagaaaataatgctttgatatttgtcacaaatgactaatgtaacacttaatggcaagcaattaaacatgtcacaccatactcgatttaacttgaactaaaaaccaacattgagggtatgagataaaaggattctagtgaaacatggtatgatggaacaatggagagttggggcgtgattagtacacacgtcggccgtatctaggcttgtttgattcgttgactttgaacacacgtgtgattggttggttatataggatgaagtgagcccgcaggttggttatataggatgaagtgagcccgcacatacgcgtgcaaccagcgattttttcantcccgcctacatgtgtggagaagctagggagagagattccctaatagcataggtcaacacacgtccgatactcgagggcacaccaaccgatcactcccttgtatgccaaaatatacatagtgtgatacaaccccaccatgttagccgcctcccacatagatttagggggtgtttggtttatagagactaaacattagtcccttcactttattccattttagttcataaattgttaaatagggaaactaaaatagagttttagtttctatatttagtaatttagggactaaaatagaataaaattgagggactaaaaattagtccctagaaaccaaacaccccctttatctagcaatcttttcgccatcgcggaataaaatgaagggactaaatattagtctctagaaaccaaacacccccttagtgccaccaagagatataccaaaatttccctccttgggtatatacctcgagtgcatccactgttggatacttggatgcatacgaggatgcatgtgagcaggaaagagaaattttgagggaacctctctcctgcagtcctgctatagaagcatccaacgtcatccaatggtgacacacatggggcataactcactggaaaaaaaaacttttgcggttgttctctgttgcttatcttgatcaagcgtgacattattaatatccattccatagaaaatgtgaggtgttaatctgccgcagtttcatattacagcaagtgctcccttgtaaattaagcattgatgtagaattgctgagttgttttagtccttgaaagttgtcgtaacatgcagacaaccgtctcaaaatggagggaaaaaacatgtacacgcattattgcgatgcttctataaacttgttgtacttgtattagtcaaaggtgacttgtggttttccacttggtttcagggccgtccttgtgggcgtgcgaaccgtgcgggcccccccaaaattatagggccccaaaatctataataatccatatagatattatagataaaaatattattttgcataaaatatttgttaaaatataccctagaattgcaaaaacgttgaaatcaatatgttcttattgttaatcaaactatttcttcgcttgtaagaagatttaaatggtatcaaggttatcaaaaaatatttggtttcttatttatctccagtgcattgcagtcactagataaaaagtgtttgaaatcttgttgtcaccatcttaagatgcaactgaaagaggcagacaataggatttaatgcaagtgaccaatccgtggagttgagttttctttaagattttattctaaaaaaaactgccttgtgacattctaaattttgtaaagtggaagggcaaaaataagtaaaaatcgtgagtaagggtaaaaatgagaaaagccacaggactaaggatattattttaaatactactatattttttgctaccatttgcgcagggcctctcaacttgacgggacacccctgcttggtttgatctgattctttacagctatttgtattcttctaaataaaattttgtatgcatggaattcattatacttggctcatcattcggcaccagaattaactcttgatgctaaaatcatttgttacctttggcatatatgggttaaaaactccagaagttttagctcgtgatcggcttctaggctcgttttctgtaagttgttcttattggcttctttaaatatcacgttcttttgggatcaattagctctttggcttctattgtcaactccatgccatgaagcttattgaatgaaaactgaactgtacatgcacatgtcatgagctgtgatacctctcagggaatatggccatattatgaacttggctgtctgtgctctggatctacatccgagtctgggtgttatctggtgcattagttttctgaaacattagaaattgcaatacccaaaaaaaaacatcgtagcatcattgggaaaaaaatatcttttacactgctactaaacactgttttcctttttttatgctccaggtcaagcctgtggtaaacagagtgaagttcaccttggtgggtctggcaggctccctcatcctttgcattcttctttacttgggatgcgtaccggtggaaggtctatcccgggagtgtacagtgacgttgccgcaaggtcatttgggcctgatgcgttctgtggagaagctgatctgtcgtagcatcgcaaagcgtggagcatgggaagtttttagatggtggtatatggtctcatagggtatatacaagttcccctttgtcttgccttgtggttggtggatggttccatttctgtacggggttttttatccatcagttactgcatcagggtaatgttaatacgtaatatttgatagcacgtagtgccgttatttttatagtggcaagctccttacgaaagtttatatgctgctggggcaaggtgaaacggtaaggaaaacttttgttcttccggtggaaagttctcatgacggtaaagctggcctctcccaaacagccaaagcagtcccggaagctgcaggcatcccggcaacaggaagcaaagaccaaagcatttaacccggtaaaatccggtctacaaattgtgtggtagaaatggagcagtcacactgtgggacgaaagtcattattgcttccttcttgctactttccctgtctgtgacaaaaaaaactctggaaaaaaaaatcaaaagagaaccatgtttgaaaccgcggagagaaaaaaaaggaaatcgatgtccgtgctgcatccggtcaaacatgccgtcgccggccggcgtccctgttggaaaacccctccggcctccactcctcggtccaaccccataattctccataacaagtccaagggggtagcgagcgctagcgcggcatccagatcacaccgtgccggcccgtccgcccgctttggtcgtctgtcgtcacaccccacctccccaacaaaacatctcgccgctaggatagcgaggcagctctgccttattgcaagctaagcttccgatttactgattaattgtgcgttaatttcccactaaaccactgtcggtcgccgccgcttcacatccagctcggtgggcggccttagagagagagagagagagagagagagagagagagagagagagaccgaggcagcctgggatccggtcgggcggtcgatgctacggccggtgtcgggtgtcgccggggcatggctagccaggctgcgcggcgaggaggagtgatgaggccaccgagcagcggcgtgcgcgcggcggccgcgcggtcgccggccgcctcgttcctgctggccgctgcggccgtggccgcgctcgtcggcgggttctacttctggctggtggtctcgtcgttccggctccccgactcgggcgacgccgggtgtcgccccgacggcgaggggtcgtgggcggtcgggatgttctacggcagcagtcccctcgcgctccgccccatcgagctggtgagtggcgtgcggcgctcagcttaaaaggctcctctcgtgcgttgttattgttgcgggtaggttgacgcctgaagcgcttctgttactgtacttttggtgggcaggaagggagaagcaatggcaacagctcggcgtggccggtagcaaaccccgtgctgacatgcgcgaccgcgacggaggcggggtacccgagcaacttcgttgctgacccgttcctctacatcgaggtgaggcactactgctgcttattctgccgctcttccccagggtggacactgggtggcaagatacttcaaggacaagccaaaaagatcaaacttgtcagtagtaaactgacgataacatgttctggataatattggtggcaacaagaatgttattgagtaggaaggaaccagaaaatcgaattgcctctaaggtgactgaaagaatgttgccatttctgacaatgatagaaaaagggtggaaatggtgggggtggaaggagaagagtatacctgcgtctagaatggtgtggtaggaggcaccggggtcggacacccaatcgatgagagcaggagtcagaggcatcatgagtcatcatgcaaaagactgctgatctcactcactaggccacacggagtccatggttgaacttggtggagcggtcatggaagtagtggaggctagtatggtgctggtggagtcgtaggaggtgatccaagacgacacctggagctaccgagggcggtgcgccagctgcgacagatgcccaggagggggcagcgcgctggacgggcacgctgaccatggtggtggcggcggcacggctctaaggagaacctgtgtactgtaatagaggaagaaaaatgcaacccactacagaggttggagatagggttacatagtaacatagcccagggttacaaccctaatggtcctcttgggccagcaaatacgtcgcactgccgatgtctacttgtcaatgacattttaccttggttgaatatgtatgaccaagcaggacaaagttcttacacaagctatttgtcaacctgaatgcattatttattattatttggtaggattcattcaataaatagcattcttaagttaagatactactttctagcttgcattttcacctgctagttctctcatgctaatatggtactatgcatctcctagggggatacaatatttcttttctttgaaacaaaaaca

SEQ ID NO: 15985 - DNA, 838 bp, Zea mays
gatccgttcattttctttgtagaaactgttcaagctttgcaggcatctgatcctgccaggttccagaaccttatgcagacattggatttccgttatcaggcgcttgctagtggcataggacaatatgccgagcaaagaaaaattgaaattgagagagagaaatctgagaaggcaaatgcacagtgacttaataaatcatttctggccgcccttgtttttgccattttgccagtataagccattggtggctggtcaatttcctgtgatttgcaggtcgagttttgcagccttagccaacctttaagggtaggacaattttaggctcgcaaaattctatccttgtgagaaagcatcttggataatctgtcacgtcggccatgttcttcgtggcctgttgttgccgtcttggttgcgcaagaaagtttctctcgaggacagttgctccgtcttgttgatttttttttgggggggcttgtaagagcatttgttatagaaactcacctcaggtggtggggttgcattctccgagttgtcaaagtttattactggttcggagtagattgtatatggtttcggttggtaagacaacggttgtacgagctgcggtatatgtttttttttgtcaacaggacattgtaattgggttttgttctttggtcggcgagagcaagaaaaattggcattgttctgcggagttaccctgtttggtttcattgtccacttgcctgtgttgcaaaattatataatgttatagaaattggatggtgtagcatatatatatatatacatataatgatacttgcagtgatattataatgttgaaaactgggcattgttc

SEQ ID NO: 15986 - DNA, 2805 bp, Zea mays
tggcatctccgatgccagatgtatatgcggcggttatggttgggaggggcagagggggtcagctggggccttgcccacgaccgagcaagaaacaaggcctttttcttctaattcttgcttgcctcttatccccacatgggcttacattataatatcctccctgactaatgactccctataatttctctgttctgtcctattatccctccaactttccaaactaacccaatcagctaactagggaaggctgaacagatttgactctaattgaggcgtgacccttgtgcttgataatttgatcgttcatttttatgatcctccaggctagaggcttccaaccagccgacgaggatgatgactcagatgatgatttcagtgacgatgaggagctacactcaccaatagatgaggtggatccgttcattttctttgtagaaactgttcaaggtaaactgtgttctttgctaatagatgttcgttctcacttggaaaaaaaaaatctggccgagttcctcataaatggcctgtccgtttgtcacagctttgcaggcatctgatcctgccaggttccagaaccttatgcagacattggatttccgttatcaggcgcttgctagtggcataggacaacatgccgagcaaagaaaaattgaaattgagagagagaaatctgagaaggcaaatgcacagtgacataataaatcatttctggccgcccttgtttttgccattttgccagtataagccattggtgtctggtcaattccctgtgatttgcaggtcgctggtatgagttttgcagccttagccaacctttaagggtaggacaattttaggctcgcaaaattctatccttgtgaggaagcatcttggataatctgtcacgtcggccatgttcttcgtggcctgttgttgccgtcttggttgcgcaagaaagtttctctcgaggacagttgctccgtcttgttgaatttttttttgggggggcttgtaagagcatttgttatagaaactcacctcaggtggtggggttgcattctccgagttgtcaaagtttattactggttcggagtagattgtatatggtttcggttggtaagacaacggttgtacgagctgcggtatatgtttttttttgtcaacaggacattgtaattgggttttgttctttggtcggcgagagcaagaaaaattggcattgttctgcggagttaccttgtttggtttcattgtccacatgccccccttgcccaattacataatgttatagaaattggatggtgtagcatatatatatacatataatgatacttgcagtgatattataatgttgaaaactgggcattgttcaaaatggcacggcaaccatattgttcattgcacaagtgtatatgtatagacaggatctgaatgtttgcaggacattgcacaagtgtatatgtatagacaggatctgaatgtttgcatcctgcaaagttcagtgcactgcacaagtcggttgagacctttatacatgctttagctttcatgatcgggcaacccctgcgctccaaaccggagctgtgcccaagcgtcgataagaaaaccgtagcggtgagcggtgttcaaaaaccgataagaccaagaacagcttctgctttcgggtttgtttgggtaatcttggattgaagtggattgatgtggtataaggtgtattgaagtataatatgaactaatttccctttcaatttctaaaatacacttcaatccttatttatccaaacaaggctttcatgagcgggtaaccccttcggctccgaatccgatcggtgctcatgtgtaatatgaacaaagtttcgaatacacatgtgcggagaaaggaaaggaaacgtgaagaaagctgaggcagacgttgcaagctacacggacacgcacctacatcgcatcaatcccacaaaagcaattttgctgacgcccacgccagccagactacaaaggaaaaggagaaattgccaatacatatagatcggtgccgtctggtcgtgtaccactgcaccggtctgcctgggcggagctgacggatgtcttgcggcgcagctattccaagagctgcatgcgcgcgtgtcgccgagggacacgaccgcagccaatggctttcaccttgtggtgtactcctaccggtcagtttgggaccaggggtccttctcgactgcatagcttgtccactcgttcccacagtagagtagagtagaccagggcctggtggcgccgcttgaggtgaaagagagcgtcagatcgcgagagacctaacgataggagcgagacgtgaccgctcgaggtgacgcagctcggcatagccatggttatctccagcaaattacatatattactatatatttaaaaatccactatctctatatttaaaactacactacgtaacactattgtttatagtaaaaaacaagaacgactttgataccacctatatcgtactcggtttcaaaagacaaatcaaatacaaactatatacgtgacaggatcaaaactcacatacacaaacgactacataaatacaggaccaaactcacatacacaacggctacataaatgacatatcattgtacaatgctcgaaataaaatagatattttacataacattatgcagcaacacttacgcgaaaacggaagcatagaaagacaagggagaacatgtcactccacatacatctgacttggggagatcgtagacctagccttcatgcttcacaaagtcttggaactcttggaaattgcttcagcaacttctcctaagcaaaggtgcaaaa

SEQ ID NO: 15987 - DNA, 890 bp, Zea mays
acatatttcgacggctcgccacctctcttctctcctcggccctcgccactctcactccgccacgccggagcacgccgctgcggcgcgcctgcgcccgccacacacgaggggactatggacacggtggctccccgcctgagtcgctcctcgacgcgatacgggcccatcagcagcagtgctgcctccttcagtgggcccgtccggaagtggcgcaaggcctgggtgcccctcaccggcaccggcaccggcaccgccgggtccgggggagggagctcacgaggagacaacaaggtggttctgtttagatggacgccggtgaatggttgctcaggaggagggggaggcaccgacgggggcatggagctcgctgctgcgggggcctccacctgcaggcggcgctacgtcccggctgcaggggaggcgcaaagcaccaccaaaaagggcaccagcagcgagctcaacttgaacctcgagctggaagacccagacgacgacactgatgccgacatgagcaccgacgagccacgcgatgtagaagataacagcgcccgtctagaaagccgcttgaagcggaaagcattttagccgctggtcacctagagatgcggatcggcctgaatcgtctgccctagctaggcggattttgtgtaacataatgtagcagcatgtaacttgtatccgccacctcgtcgtccttcgtctgttccagtttagaacaatggcattgtccatgactgttcaagtccaagtgctcatgttatatttcatagctgttggttatgacttgccactttgtcctgtacgaaatattgtcatggactttgttctagtgtgtaatgctacatggcaacgtctcaagcaagatgttataagttgtggttgaaggaaaa

SEQ ID NO: 15988 - DNA, 965 bp, Zea mays
atcgatttgttggagaatactgcatccctatctatctatctaggcctagcacagctatatcctgggttacgttcctcgcacggcggaggcaaacaaaccctagccgccaggcgcaggcggtcagggagcgagtaccgagcgccccagttcacacgtgagatgtcagaatacaagaacgtcgttggggggaggctaaagctgaagggtaaggcactggatgtgaaggaaggtggagtcaagaagaaaaaaaagaagcatcagcttgaagagtcgtctcagattgagcacgatgagctccacaaagggggaaactctggcttaccagctgatcacaacaatgagcttattgaagctggcaaggtgggagatgaagaaaggaatctacatccagactacgaccacctcacaccggcggagcgacgctatatagatcagaagcagaagatcgacatgcaaaagctggccaaagttgctaacaagtcacacagggaccgtatccaggacttcaaccagtatctggcgaacctcagcgagcactatgacatccctaaagttggccctggctaacaaacatagccaaactgctgtgtacgcacaaacaattgtatgctcggtgggcttcaagaacattaaaaatatataaatgtatgttgggtgattgggtctatccagctttttgttagcatgttatatatatcctagtattttccacttttcttttaaaaaacataattgatactcttatgtgtattgatttgaattgaattacgtctgcatatgttcaatttgaaagtagcaagactcaatttgcctttggaattagcttccgtcagggatatatcagcggtgtttcaaattgaacttctgagaacagcgcgctatcttgcgtatcacttttctaaacaacaattgactacgtttttttcttaatcatgttttgtacggctaccgtacggtggcaccag

SEQ ID NO: 15989 - DNA, 1854 bp, Zea mays
tcttgaaggacgtaccttcatcatcacggttataagataatgaaaggcgaaacatatgaaatgtgaaagataatatgaaaaaacacataatatcattcacatgttatcattatgtaaatttggctatttaaatatgatatttaattacatttataccttcggcttgacataaggcaaaaatccaagtgttgcgcgtgagcgaatacagaataacgtgaacagtacgggggtactgttcatctatttctaggcacaggatgcaacctgtgaggaattacattcatatcctttacaaaggtttacattcataatacaaattatcatgggccgattggtcatttcatctttaagtcggtgcatttggaaatgtacttcgaaaccttctgattgatagcttcggctttgtgtcaatcttccgaaggtatttttttatggtaccttcggcgccgaagcaaaccctcaacatatagtataggtaggactgagcattttatcccctacctgttacccaaatccgaaaaacccggacccgaacctaatttacatgaaccctggttcaatacctaaaatcttggggggcctcgaggccggccggcacgtgcgacggcccagcccatcaaggcgaggccccaaactcaagtctctgaccccgcgaccccgacgcctgcgttgccctacccctacctgacctccactgctccacacctccacctgcctgcgacaaaagcaaaacctagccgccgcggcgccgcccgccgacctgccgtgccgactgctgagtgccgaccgacgtgcgcccgctgtccgctcgacgttgttggcctccctcgacgccgctggcaggtggccgctcgacggagtcgacgcctcacagcctccctcgacgcgacgccgctggccactcgacggagtcggcgcctcacagtcacagtgagatgtcagaatacaagaacgtcgttggggggaggctaaagctgaagggtaaggcactggacgtgaaggaaggtggagtcaagaagaaaaagaagaagcatcaactcgaagagtcgtctcagattgagcacgatgagctccacaaagggggagactctggcttaccaactgatcacaacaatgagcttattgaagctggcaaggtgggagatgaagaagggaatccacatcccgactatgaccatctgacaccggcggagcgacgctatatagaacagaagcggaagatcgacatgcaaaagctggccaaagttgccaacaagtcacacagggaccgcatccaggacttcaaccagtatttggcgaacctcagcgagcactatgacatccctaaagttggccctggctaacatacatagccaaactgttgtgtaggcacaaacaattgtatgctaggtgggcttcaaggacattaaaaataaataaataaatgtatgtttggtctatccagctttttgttagtatgttatgtatgattttatatttgttgtataatgacatggtcgattcatgccgtcaactgtcgcggtatatatatgtggattgatttgaattgattttatatttgttagcatgttatctattttccacttttcttttaaaaaacataatttattactcttatgtggattgatttgaattgaattacgtccgcatatgttctcttttgaaagtaaacatgactcaatttgccttcgaaattagcttcccgcagggatatatcagcggtgtttcaaattgaacttctgagaacagcgcgctatctttgcgtcatgatagtatcacttttctaaacaacaattgactacgatttttttcttaatcatggtttgtacggctatcgtacggtggcaccagggg

SEQ ID NO: 15990 - DNA, 2162 bp, Zea mays
tttttgattttggccgcttttttttctgtttttttaggaattgatatcattctattcaaatttgttaccacccgtcctccagtataaatcattacacttacattacatttcatacatacgttacatttaatcaaccttagttcttactatactaaactccaaatcaacttaactattcccacaaatcatactaacgttcaatatgcacgaacttgcatatcggttagatgcactataaaactccagtatccttaaagacaaaggcaaagacaatgggatgtgcctgtaatagtttacacaggcagagacaaaggcccggatgaaatgagatacagaaatcgatgttgttttcccttcctcgtgaccttgttactcatccaacatgacggcattcttccttacctgggctagacgacgttccttgtttaatctcagagctctttctttttcctcttcggacctaaaaattttcttatcagtggacgacaaggtttcagttttgtcaaccttaatgtcaaagatatcctggagaagtccattctcctgcacatgcttcagaaagcctttccccaggaaccgctttaagaaattcaactggattaattcagaccacgatgacacccttaaaacatcacgttttccagcaatcttgattgattcttcagggcagtcaccatacttgacaaaatctaagattcgttgaaacaagtctctttggtcagtaaggttcttcttatctgcacctttccccccagcctcagcagagagattcgaggccagacctgatattttggcttttaatgcttgcatatccaggaaaagcttgttcttagaaccaccagttccccctgtgttaacatcaccatcctcacaagaagaaacatcaagcagatttagctcaaagcacaaaaccaatgcttcaccagcagccattctaacagcacgatcatctgcttccaaaagagtagagagaaatgcaatgggctctttccaactatcagtatttatcctccatgaaccaacagtagtcaaaagaaacgtccatgcagatacagcagctgctaacacaggaggtctaggtttccgaacagttcccacatttgaaccagattttggatgaatcacatcccacatggctttcaaagatgactctgtttcagccagatcagttgcgccaacaaaggtgatgacagccaaacaatcaagtgcaggtatcatctttgatgcatcggaccaagcttgaagcaccctacacagttggggatgtgactcctccattatttcatgtgaactgttcccagcaccaagtgtaatagccagtaacccaatggcatgagatgccagaaaaaactccttagtagatccctttttgacagaattattgaattgactcagcaaagtggcatacctgttctccacaaggccatggagcataaaactttcgaaggcatcaacgagtttaaccaatgctgcctctcttgtagatcccctcttctcgtagagcgcgtcgatgtacttgtcgaggacgaactcctgcgagttgacgtgctcggtggcgtacgagatggagagatccgacagcgcggtggacgacgagccgacgctgtcggcgtcgctgctgtcgatcaggtcgtccccgccgccgcgggccttgctcttcttgctcttccccatggcaacaccggttagggacggagccagaacccagaagctcccaggaacccgcgaccgcgagacaaacggcgggagcagaatcagagccgcggctgcaatctacggcgcgagaagggaggaagaagagagccggatcaggagcaggggcgatggacgcggagggacgagaagggcccggcggcgggggcggcgagatcgggacgggggcggcgcgtgttggcggcgcagggacaggggtcggagaagcaggaggaggggctgttcctctcgagtgactcgcggagacgcagcgctgccatgtgaggaaatcgcggcgaggggggagcgggttgggaagtggcttgagctttctctcgcgctcgccttcgcttgagccttgaggaggaggagagaggaggcgagcgggggaggcgtcgctgccgtataaacgagcggtagcgtggggttcgaaggatcaagcggccctcgtgccccgaagggtcccaatg

SEQ ID NO: 15991 - DNA, 921 bp, Zea mays
  misc_feature (911)..(911): n is a, c, g, or t
cgaagtaacttcttgcttttccctcttgtttttagctgaacttctaattaactttattattccaacataagtcatgctatctgacgttccatatgtacgaatagtaaatcgcttacgtgcactatatcagtataactcaagtgtctcagtactatgacggcacaacctccaatggaatgtgccagtaaatagtagtttacacagacaacggcccaacatgacagcccagtaaatagtagtttaaacagagacgcggaatggctgttgccttcccacccttgtgaccttgttagtcgtccaacatgacagcattcttccttacctgggctagacgacgttccttgttcaatttcagagctcttcctttttcctcttcagacctaaagattttcttgttagtggacgacagggtttcggttttgtcaaccttaatgtcaaatatatcctgaagaagtccattctcctgaacatgcttcagaaagcctttccccagaaacccctttaagaaattcaactggattaattcagaccatgacgacacccttaaaacatcacgttttccagcaatcttgattgattcttcagggcagtcaccatacttgacaaaatctaagatcctttgaaataagtctctttggtcagtaagttttttcttgtctgcaccttgccccccagcctcagcagagagattagtggccagacctgatatttttgcttttaatgcttgcatatccaagaaaagcttgttcttagaaccagctgttcctcctgtgttaacaccatcgtcctcacgagaagaaacatcaagcagatttaactcaaagcacaaaaccaatgcttcaccagcagccatccgaacagcacgatcatctgcttccaaaagagtagacagaaatgcaatgggcttcttnccagataccc

SEQ ID NO: 15992 - DNA, 2086 bp, Zea mays
ttttgctgacattttgtttatccgataacgttaaaacatgtttgttttgtttagagtataaatcattacacttacattacatttcatacttacgttacatttaatgaaccaaacagcaccttagttcttactattactaaactccaaatcaacttaactattcccacaaattatgctgacgttcaaaatgcacgaacaacagcatatcggttaaatgcactataaaactccagtatccttaaagtacactatcatgaaggcacatcctccaatggatgtgcaaacagacaaaggcccggatgaaatgagatacagaaatcgatgttgtttccccttctcctcctgaccttgttactcatccaacatgacggcattcttccttacctgggctagacgacgttccttgtttaatctcagagctctttctttttcctcttcagacctaaaaattttcttatcagtggacgacaaggtttcagttttgtcaaccttaatgtcaaagatatcctgaagaagtccattctcctgcacatgcttcagaaagcctttccccaggaaccgttttaagaaattcaactggattaattcagaccacgatgacacccttaaaacatcacgttttccagcaatcttgattgattcttcagggcattcaccatacttgacaaaatctaagattcgttgaaacaagtctctttggtcagtaaggttcttcttatctgcacctttccccccagcctcagcagagagattcgaggccagacctgatattttggcttttaatgcttgcatatccaggaaaagcttgttcttagaactaccagttccccctgtgttaacatcaccatcctcacaagaagaaacatcaagcagatttagctcaaagcacaaaaccaatgcttcaccagcagccattcgaacagcacgatcatctgcttccaaaagagtagagagaaatgcaatgggctctttccaactatcagtatttatcctccatgaaccaatagtagtcaaaagaaacgtccatgcagatacagcagctgctaacacaggaggcctaggtttccgaacagttcccacatttgaaccagattttggatgaatcacatcccacatgactttcaaagatgactctgtttcagccagatcagttgcgccaacaaaggtgatgacagccaaacaatcaagtgcaggtatcatctttgatgcatcggaccaagcttgaagcaccctacacagttggggatgcgactcctccattatttcatgtgaactgttcccagcaccgagtgtaatagccaataacccaatggaatgagatgccagaaaaacctccttagtagatccccttttcacagaattattgaattgactcatcagagtggcatacttgtcctccacaaggccatggagcataaaactttcaaaggcatcaaccagtttacccaatgctgcctctcttgtagaccccctcttctcgtagagcgcgtcgatgtacttgtccaggacgaactcctgcgagttgacgtgctcggtagcgtacgagatggagagatccgacagtgcggtggacgaggagctgacgctgtcggcgtcgctgctgtcgagcaggtcgtccccgccgccgcgggccttgctcttcttgctcttccccatggcaagacaggctagagacagaaccagggctcaggagctcccaggacccgcgagacaaacggcggaagcagaaccagagcaagcaagcgggatcaggaacgggtgcgatggacgcggagggaggagaagggggcggcgagatcgggaccggggcaacgcgggtcggcgcagggacaagggccggataaatagaagcgggggccgttcctctcgagtgattcgcggaggcgcagcgctgccatgtgaggaaatcgcggcgagggagtagcgggtctgggaagttggttcaggtttctctcgcgctcgcctttgctttgccttcggccctgacccggccgcttcctaagggatatgcttatgttcctcgggattccttatcaaaagagaagctatggaatcgaaatacacagccacttaatccgcaggagcc

SEQ ID NO: 15993 - DNA, 1704 bp, Zea mays
agaaaatggtattccctttgcaccgtcattatccttatatgcgcctgaaacagagcaaagctcaagtgaccagatgaggcgagatactgtccatcaacatcatggggatttcaattctatgttctacaattcaaatgatcatagcaacatgcaaaacaacatggattccactgatgataattcactttcttcgaccatgagtaatgacaggattggcaaagattgtggttcaactagaagcattcagtcaaaagctgaggatctccctttctctccaagtaggtctgtagacaatggaagcccaaaggatatattgtgcgagagggacacagactgcaaggtggagccttctgtaggtggtccagttagcccacggtctccagctttagaggacaaacttgttgacccattgtgtgcccaagaaaaatgtaacgacgaggatgatcaaggcatggccatggcttacaaatcagacctaacttgcaaaggagaatatgatgttaatgatcagtatgatgggggcattagtacaagaagcaaacaggagagcaatgaagatgacaaagatgccactgaagatgaaatctcatgcagaagttatgaacagaagagcaaggaagataactcatgcaaccttgaagatagtagcaaaacatatgagcagaatagtggagaagatgacactagtagtctagtaaatggaagtgaaaagtaccagtgtatgaatattaaagatgaagatagcagccccggaggcgaggacacatgcaataaatatgagtcaaaggtaaaaagagatgaaaattatgttcttggagctgagagcattagaaaaaactgtgatgaaaataatgcagatgtcatggaaactggaagcataagtgagagacatgatgggctgaaaatcgaagaagataatgagaaattgcagcagccatttattgaagatgccaattctcaaacagggagtggttcatcagttaatgagcggacaaattctgggttttctcgtggttcatcagaggctgggttggatgaagatcagtcctctaccggtaagagtggggattcatcattttttgctggttttctgaagaagggttttaaggacctttctttattaaataagtccatggacaatgttaaggtttcaattaatggtcatccaatctctgaaaaagcccttaagaaggcagagaagaaagctggtcctgttgacctaggtacatattggtacgactaccatgctggtttttggggtgtcatgggacgggaatgtattggcattgtccctccatttattagagaatttaattatccgatggccaaaaattgtgccggtggggatacaggtgtttttgtcaatggcagagaactgcatcaaagagatttagatttacttgtaggaagaggactaccacggacatctggcatgtcatattctattgagatgtcaggcaatgtaattgatgaagcaactgggaaaaaactgcgcagtcttggaaaacttgctcctacgattgagaagttgaagcgtggttttggcatgcacgtccctgaagagttcagataagctgggtctagtgctgaatattggctttgcctttttccccttccacaagggctgaccatgggggggcaaaccaacgatttctgcgaatgggaaggtaaatcgcaggtttctctgaattggactggggctct

SEQ ID NO: 15994 - DNA, 791 bp, Zea mays
  misc_feature (623)..(623): n is a, c, g, or t
tttttttttttttttcaggcttcaaaatgggactctaacagggttcaggagagccgaaagccaatcatatcggccagagtttcaagaatcatgagcacatatatacatataaatgttaggggaagcatagctctaccaataaattacaagccgacaattgctcatacatctaacagtatgtctgtgcctgtgatggggcaatgtactgataaagacgacacatttgaggaatataacatgtacaggcagagcagtgaagttaagaactgcctggcaggctagagtcactagcaaacgtcgcttccattgaagtgatgaaattagcaggagggatactataatcggtggttaagtcactggaccacattatcttggctcgcagagccccagtccaattcagagaaacctgcgatttaacatcacaatcgcaggatttaacatcacaatcgcagaaatcgttggtttggcaccccatggtcagccttgtggagtggataattggcaaagccaatattcagcactagaaccagcttatctgaactcttcagggacgtgcatgccaaaaccacgcttcaacttctcaatcgtaggagcaagttttccaagactgcgcagttttttcnccagttgcttcatcgattacattgcctgacatctcaatagaatatgacatgccagatgtccgtggtagtcctcttcctacaagtaaatctaaatctctttgatgcagttctctgccattgacaaaaacacctgtatccccaccggcacaattttggcctcggataata

SEQ ID NO: 15995 - DNA, 1168 bp, Zea mays
  misc_feature (1166)..(1167): n is a, c, g, or t
cacgactgaagaagaaaatgagaaattgcagcaggcacccacgcgtccggccaattcccaagcagggagtggttcatcaattaatgagcggacgaattctgggttttctcgcggttcatcagaggctgggttagatgaagatcagtcctcaaccggtaagagtggggactcatcattttttgctggtttcttgaagaagggtttcaaggacctttctttattaaataagtccatggatagcgttaaggtttcaattaatggtcatccaatctctgaaagagcccttaagaaggcagagaagaaagctggtcctgttgacccaggttcatattggtacgactaccgtgctggtttttggggtgtcatgggacgagaatgtatcggcattgtccctccatttattagagaatttaattatccgatggccagaaattgtgccggtggggattctggtgtttttgtcaatggcagagaactgcatcaaagagatttagatctacttgtaggaagaggactaccacggacatctggaaaatcatactctcttgagatgtcaggaaatgtaattgatgaagacactggaaaaaaactacgcagtcttggaaaacttgctcctacgattgagaagttgaagcgtggttttggcatgcacgtccctgaagagtttagatagctggttctagtacaggatcttggttttgctaataatacactcttcaaagctgacaatggggtggcaaacgtgtggcttctgcgggacggtggtatcaaatctcagatttcttggactggagctctggaagcagcagtacttaagatccttggtgtgcggcgaaggttgtctggcactcaagaaaccaagataatctggtctaatgacttgactaccaatagtatccctcctgctaatttcaattgcttcaatggaagcgacgtgtgctgctagtgactctagactatcaggcagttcttaacttcactgctctgcctgtacgtgctattccttgaatgtgttatcattatcggtacattgccccatcacaggcatagaagtgttgtcagatgtaccatgagcaattgtcggcttgtaatatattggtagagctatgcttcccctaacatttatatgtatatatatgtgatcttgattcttgaatctcttgccnna

SEQ ID NO: 15996 - DNA, 2048 bp, Zea mays
cctcgaggccggccgggaaacaaaaaatcaatgagcaaatacatcgaattgcgcgaaggcaaagcgtccaagcaaccacttctgctctgcatcccgtctgggcctctgcatttgcttggctgctgctcccttctcccaccgaccaactcgatcccgcgccatggatcgcgccgaccccgcgcggggccgccttgccgtgctctcctcccacctccgtggtgcaggggccgaggaggcggcggggctggagaggtcgccggtatccgcgccggcgcccgggccccgcgccggcgcgcttgccgtggtggacgggaggaccgggaagcggcacgaggtcaaggtctccgaagacggcaccgtgcgcgccaccgacttcaagaagattaccactggaaaggacgacaagggtcttaagatttatgatcctggttaccttaacactgcccctgttcgctcgtccatctgctacatcgatggagatgagggaatccttcgctataggggttatccaatcgaagaattggctgaaagcagctcgtttgttgaggtggcctaccttttaatgtatgggaacttgcctactcagagtcaattggcaggctgggaatttgctatttctcagcattctgctgttccccaaggactgttggatatcatacaatcaatgccccatgatgctcaccccatgggtgttcttgccagtgcaatgagcaccctttctgtctttcatccagatgcaaaccctgctctacaaggtcaagatctttataaatcgaagcaggtgagggataaacaaattgtgcgagtacttgggaaggcaccaacaatagcagctgctgcctacttgagattagcaggaagacctcccgtccttcctttaaatactctatcttattcagagaacttcttgtacatgctggactctttgggtgacagaacatataaaccaaatcctcgacttgctcgagctctagatattctttttattctgcatgctgaacatgaaatgaactgctccactgctgctgttaggcaccttgcttcaagtggtgtggatgtatttactgctctttctggtggtgttggagctctatatggtcctctgcatggcggcgcaaacgaggcagtacttaaaatgttaaatgagattggaagcatggaaaatattccagatttcattgtaggagtgaagaacaggaagaggaagatgtccggttttgggcaccgtgtgtataaaaactatgaccctcgtgctaaagtcataaggaaattggcagatgaggtgttctcaattgttggacgggatccacttattgaggtggccattgccctagaaaaggcagcgctgtcagacgaatattttatcaagaggaagctgtatccaaatgtggatttctactctgggctaatttatagggcaatgggattccctacagaattttttcctgtgctgtttgctattcctcgcatgggtggctggctagcgcattggaaagagtcactcgatgatcctgacactaagattataaggccccaacaggtatacaccggcttctggcttaggcactatacccccgtcagagaacgagtgctatcaagccagagtgaggaacttggtcaggttgccacctcaaacgcaactaggcgccgccgtgctggttctgccctgtagaagctgcagcgtataaacgcaccggcatactcaataaacatcgaccacttttgtgcttgaaaaggccacaaatgctttttagcttggttggagttgtaggccttttgttgtcgagtatataggcaataatgcagtgagaacaccacaccgttacaatgtaaaactgtcacgaggcatcacttgctggtgtacaccccttgcgttctctatgacttaatcacttaacttcccaaaagatgaattaagaggtacgatcgagtacccgtgttcttgcgttgaaaaaaaaaaaaaaaaaaaatgagaggtggtggggcacccgccccgagattagtggaaacaaagattcgctgttggcgtaaaaaaaaaaaaaaaaaaa

SEQ ID NO: 15997 - DNA, 763 bp, Zea mays
  misc_feature (685)..(685): n is a, c, g, or t
cgtggccggttgcggcgtggagttcgacgtggaggagcagtccaccgtcggcgcgggcggggagtgcgtgcacgtgaaaacggccacgcaggcgctgccgcggggcggcgacgtggtgttcggcgtggcgcaccagcacgcgggcggcgccggcgcgtcgctgcacggcgccgacggccgcctgctgtgcgagtccgcggccacgtacgggggcgggcgggaggccggggacgaggcgggctacatcgtcggcatgtccacgtgctacccgcgcccgggcgccgtcacggtgcgcgacggcgagccgctcaccgtcgtgtccaggtacagcagcgaccggcgccacacgggcgtcatgggcctcttctacatcctcgtggccgaccacgcccggcagctgccgcagcaggagggcctgtgcttcagcttcccggtccaatggtgcctaccgtcatggctgtcgagcaacctgtgagatctttgttgcagttgaaagctgttagctgcttggttagggttcggggctggtcagcaaggaaggccgcgtgggtccttgcgttattactcatacagtagtagtaatgtaaaatatactagtagaagcagcggtcagtctactctgctgttgctgtatttttatacaataaccaccacgtcgctccgtttgacttctccccatgctgcncggtgttgcttagacggaatcgctgtcggtcagactcacatcgaacgtcgttaccaggttggcggggggggggaggaa

SEQ ID NO: 15998 - DNA, 2994 bp, Zea mays
  misc_feature (2292)..(2293): n is a, c, g, or t
gtaccctccggcttgcccgcacccccgaccggcgacgagcggaagccttcctccatcttcaggctgctagtactcagtagtcagtacagtacagtggtgccgacgacatgacgaagatctcccgctcgttgctcgtcgtcatcgcgctggtcctcctcggccctcacctcccgccatccgaggcgctgacgcccaagcagggcgtcaggtccaagaccttcctgtccccgcccatcctgcttcgcccgggcgacgtggccgacaagttctactacgacatccccttcccccggggccacctggcgctcaagagcttcaacggcgaggtggtggacgagcgcggcgcccccgtgccgctccacgagacgtacctccaccactgggtcgtgcagccctactacgccctggtagtatcggcggagggcggcagcagccggccgcggaccatcccggcgcgcaacgccggcgtgtgcagcggccacacgctgggccagtactacgggctggggtccgagacccggcgcacggccacgtgggtgcccgacccgtacggcatcgagatcggcgacccggccgcggcgcccgccagcgagggctacgagcagcgctggctgctcaacgtgcacgccatcgacacgcgcggcgccgccgaccggacgatggcgtgcaccgagtgccgctgcgacgtgtacaacgtgacggcggactggcgcgggcacgccatcgagcccgggtacgccggcggcctgcgctgctgctacgacggcacgcggtgcggcgccgcggcggagggggctgaggggaaggccaggactgtgttcctgcgctacacggtgatgtggcgcgactggagccccgcggcggtgctgcccgtgcggatctacatcttcgacgtggccggctgcggcgtggagtacgacgtggaggagcagtgcagcggcggcgcgggcggggagtgcgtgcacgtgaagacggccacgcaggcgctgccgcggggcggcgacgtggtgttcggcgtggcgcaccagcacgcgggcggcgccggcgcgtcgctgcacggcgccgacggccgcctgctgtgcgagtcggcggccacgtacgggggcgggcgggaggccggggacgaggcgggctacatcgtcggcatgtccacgtgctacccgcgcccgggcgccgtcacggtgcgcgacggcgagccgctcaccgtcgtgtccaggtacagcagcgaccggcgccacacgggcgtcatgggcctcttctacatcctcgtggccgaccacgcccggcagctgccgccgcaggagggcctgtgcttcagcttcccggtcccatgtgagcgaactaactgaataaattaaacgaactcttgcatttgcatttgcatgcgacaatatgtgatttcggacggtagttctcatcttctctcttgatttttttttccatcaaattttgttgcagggtgcctaccgtcatggctgtcgagcaacctgtgagatcttttggtgttgaaagctggtgctatgttctaattagctgcttggttagggttcggttcggggctggtgatggtagggcaaagcaaggaaggccgcgtgggtccttgcgttactcatacagtagtagtaatgtaaaaatatagaagcagcggtcagtctactctgctgttgctgtattatacaataaccacgtcgctccctccgtttgacttctccacgtgctgccgttgttgctcaggagtcaggagtctggacatgttcggttacatcggaactattctgaaactattctaaatgatcaattattatataaactaaattatcattctgaatcgctgtcggtcaaactcagcatcgacgtcgttaccatgttgacatgacatccggtggatttctctgtaaatccaacgcgcatcggacaagactagtagtaaaagcggcgtctgggttttgacatctttgtccccgttagtgcagagaattggacctggccgacccggttgggatccatcggaccaaataggggttgagaagggctaatttaaccctagaacaagtcaagcttttgtcgtgtcagtatataaaatttaatattacagccatataaaattcataatttattaaaattaaaaaaaaataaccacaacaggcttttcgtgtcggaccgatcgaagcccgacctatgtatataactcacaggttttaaccgtatttagatcgatccaaatttagggcttaatacgaagttatatgagtcagaatagcacggctcgacacggcttggatcggtccgatnncgaaaatttagatctgacctaactctgtatttagaccatgctattttgacttgtataacttcgtgttagaccttatttagggctttagtttcgagacgctgtgttcgtgctaacctagaaagcccgagatctatattctccgcagtagtagtcccgatccccccgcacatgcatgtcgccgtccgtgtgcacacgtagtcacgtaccctggaaattgctcccaatgcggcaaacgccgaggcgtacgtgtcttcgtgactcgtctccaaggctagttggtacttggtagacagagaccggctactcggcttcctccgctgggatgaaaataaaagaaaaaaaggattagtgctttggcacatagtagagatcgcaatggacccgatcctgatttcccgcggggaattctcctattagggaacgtgtataagactaatttagtcctcgcgaggatctaaatgggagaaattttatcctcgtcgggttcgcggggatggggacgggaatcatctccgttcccgttccccgtgtacccgcctcacgaaactattttatccaagttagttaatttacttgttaaaattatagtaagaactcagtgcatgtcatattataaaatagaaaactaaactctaaaatagatgtctcctggtattttcaatctgggttgtaaaatttgtataattgatacaataattaaa

SEQ ID NO: 15999 - DNA, 2005 bp, Zea mays
agacagggagggggagtggtccgaggtcaataggatataactcccaccccgcgcccggccgcgaagagtcagagacgagtcgagtggggggcagaggccacaaaacagaggtacccaaacgatcgatctgtgcatctcccccgtccgtcccgcaaccatctgattcagaagcagacatcaatggcgagcaacggctgcaacggcaacggcaacggcaaggcggcgccggcgggtgtggtggtgccggagatcaagttcaccaagctcttcatcaacggcgagttcgtcgacgccgcctccggcaagacattcgataccagggacccacggaccggcgacgtgctggcccacgtagcagaggcagacaaagctgatgtggacctggcggtgaagtccgcccgggacgccttcgagcacggcaagtggccccgcatgtcaggctacgagcgcgggcggatcatgagcaagctggcggacctggtggagcagcacacggaggagctggcggcgctggacggtgccgacgccgggaagctgctgctgctgggcaagatcatcgacatccccgcggccacgcagatgctgcgctactacgccggcgccgccgacaagatccacggcgacgtcctgcgcgtctccggcaggtaccagggctacacgctcaaggagcccatcggcgtcgtgggcgtcatcatcccctggaacttccccaccatgatgttcttcctcaaggtcagcccggcgctcgccgccggctgcaccgtcgtcgtcaagcccgccgagcagacgccgctctccgcgctctactacgcgcacctcgcaaagatggccggcgtccccgacggagtgatcaacgtcgtccccgggttcggccccaccgccggcgccgcgctcgcctcccacatggacgtcgacagcgtagccttcaccggctccacagaggtgggtcgcctcatcatggagtcggccgcgcggagcaacctcaagacggtctcgctggagctcggcggcaagtcgccgctcatcatcttcgacgacgccgacgtcgacatggccgtcaacctgtcgaggcttgccgtcttcttcaacaagggagaggtttgcgtggcgggatcgcgcgtgtacgtgcaggaagggatctatgacgagttcgtcaagaaggccgtgcaggccgcgcggagctggaaggttggagacccgttcgatgtcaccagcaacatgggccctcaggttgacaaggaccagtttgagagggtcctaaagtacattgagcatggcaagagcgagggagcgactctgctcaccggcggcaagcctgccgccgacaaagggtactacattgagcccaccatctttgtcgatgtcactgaggacatgaagatcgcgcaggaagagatcttcggccccgtcatgtccctcatgaagttcaagacggttgatgaggtgatcgagaaggccaactgcaccaggtacgggctcgccgccgggatcgtgaccaagagcctggacgtcgccaaccgggtgtcccggtcggtgcgcgccggcaccgtgtgggtgaactgctacttcgccttcgacccggacgcgcccttcggcgggtacaagatgagcggcttcggccgggaccaggggctggcagcaatggacaagtacctgcaggtcaagagcgtcatcaccgcgctcccggactcgccatggtattgagttgagccagggaccgaccgatggaaccccatcgatctcttcttgtgcagtgtacatgcgtcatgcgtgcgtgctcacacagctgggttgctgctttgtgcttgtgttcgtctctggtttgtggctcatgtgttagtctgcaccctatccttctgtacgtagctgccggacatgcatatagtatgttaagtacaccatataaactcttgttttataaattcaagtttagcttggagccttgactccttcaaaaaaaaaaaaaaaaaaataaactcgagggggggcccggcccccatttttt

SEQ ID NO: 16000 - DNA, 2001 bp, Zea mays
aagagacagagagggggagtggtccgaggtcaataggatataactccaggactcctctccatcagaatcagagacgagtcgagtgagggggcagaggccacaaaacagagagtacccaaacgatcgatctgtgcatctccccgtccgtcccgcaaccatctaattcagaagcagacatcaatggcgagcaacggctgcaacggcaacggcaacggcaacggcaacggcaaggcggctccggcgggtgtggtggtaccggagatcaagttcaccaagctcttcatcaacggcgagttcgtcgacgccgcctccggcaagacattcgataccagggacccacggaccggcgacgtgctggcccacgtagcagaggcagacaaagctgatgtggacctggcggtgaagtccgcccgggacgccttcgagcacggcaagtggccccgcatgtcaggctacgagcgcgggcggatcatgagcaagctggcggacctggtggagcagcacacggaggagctggcggcgctggacggtgccgacgccgggaagctgctgctgctgggcaagatcatcgacatccccgcggccacgcagatgctgcgctactacgccggcgccgccgacaagatccacggcgacgtcctgcgcgtctccggcaggtaccagggctacacgctcaaggagcctatcggcgtcgtgggcgtcatcatcccctggaacttccccaccatgatgttcttcctcaaggtcagcccggcgctcgccgcgggctgcaccgtcgtcgtcaagcccgccgagcagacgccgctttccgcgctctactacgcgcacctcgcaaagatggccggcgtccccgacggagtgatcaacgtcgtccccgggttcggccccaccgccggcgccgcgctcgcctcccacatggacgtcgacagcgtggccttcaccggctccacagaggtgggtcgcctcatcatggagtcggccgcgcggagcaacctcaagacggtctcgctggagctcggcggcaagtcgccgctcatcatcttcgacgacgccgacgtcgacatggccgttaacctgtcgaggcttgccgtcttcttcaacaagggagaggtttgcgtggcgggatcgcgcgtgtacgtgcaggaagggatctatgacgagttcgtcaagaaggccgtggaggccgcgcggagctggaaggttggagacccgttcgatgtcaccagcaacatgggccctcaggttgacaaggaccagtttgagagggtcctaaagtacattgagcatggcaagagcgagggagcgactctgctcaccggcggcaagcctgccgccgacaaagggtactacattgagcccaccatctttgtcgatgtcactgaggacatgaagatcgcgcaggaagagatcttcggccccgtcatgtccctcatgaagttcaagacggttgatgaggtgatcgagaaggccaactgcaccaggtacgggctcgccgccgggatcgtgaccaagagcctggacgtcgccaaccgggtgtcccggtcggtgcgcgccggcaccgtgtgggtgaactgctacttcgccttcgacccggacgcgcccttcggcgggtacaagatgagcggcttcggccgggaccaggggctggcagccatggacaagtacctgcaggtcaagagcgtcatcaccgcgctcccggactcgccatggtactgagttgagccagggaccgatggaaccccatcgatctcttcttgtgcagtgtacatgcgtcatgcgtgcgtgctcacacagctgggttgctgctttgtgcttgtgttcgtctctggtttgtggctcatgtgtgttagtctgcaccctatccttctgtacgtagctgccggacatgcaaatagtatgttaagtacaccatataaactcttgttttataaattcaagtttagcttggagccttcactccttcagccttggacaaaaaaaaaaacaaataagcggaaaacc

SEQ ID NO: 16001 - DNA, 1247 bp, Zea mays
  misc_feature (1241)..(1242): n is a, c, g, or t
cattgggtacctcgaggccggccgcggggccggccccgccacctggcctcaccgccgggaagagttgtggtacagttgtactgagctgagctgccggaggcagaataggagaggcaggcgatgacgatggcgacgaaggcggcgtgcgtgctggcggtgtgggtgctcgtcgcctcgggcctgtgcgacctgggctcagcgcgcgcgcccctgggcagcaagccgcagcgggagttcgactacttcgcgctctccctccagtggcccggcaccatctgcgcctccacccgccactgctgcgccaccaacggctgctgccgctcggagccgctccagacgttcacgatccacgggctatggccggactacgacgacgggacctggccgtcgtgctgccgccgcacccaattcgagatggacaagatattgccactgaaggaggtgcttgacaagtactggccgtccctctactgctccaaatctggaacatgcttcagcggcaagggactcttctgggctcacgagtgggagaaacatggaacctgctctgcccctgtggttcaggatgaattacagtatttcacccttgcccttgacctctactccaagtataacgttacggaaatgctgtcaagtggagggatacaggtttcaaatggtaaggaatatgcactgagcgatgtcatcgataccatcaaacatgcttttgggggatcgccacaaattgtttgcaagaggggttcaatcgaagaacttaggttatgcttcgacaaagaattgaagcctcgtgattgccttaccacttctttggcgaatggaagtgtatcaaaaagcaagcactgcccgcggtacatcaccttgccaacatatgatccccttgtgcttgccaattcaactgtagagatcatgacacagttcgatgaatttgaggtgcctgcagctctttatacagcttaaaatgcaattgttgcaatagcagaaggtgctcgcgtgagcacctagaaccaggcacatttatcctgggatattcaatcatttgtacatgtacacttgaaagagaactgacatcttttcaacctgaaaatttataagctttatgtaaccgtgaaggtcggatattgcacatgtaattcgctaaatcaaaactgtatcttgaggtagaattttcaagtagtaataatagagatataagaaacttatcgcccaaaaaaaaaaaaaaaaagccctcgagctcagggcgnngccgc

SEQ ID NO: 16002 - DNA, 728 bp, Zea mays
cccgcggctccggccacgaggaggggaaggaacaagatgagttccaagaaagcaacaaaccggggtttggtacttgtccttctgctcgttgttttgcctgcgctttcggtcgccacgcacgcaggagaaagagagttgccagatgaaaaggatcacaagggccattccactgttgcttctggaaaggggggaacggcttcaggagatatggtgaagacgaatgactatgggcgctacgatccaactccggcgttctccaagcctcgctccaagcttatacccaactaattacactcacacttgctgcatctacatgcttactatatggatggcatgcatagaaatatagtcctgtagagaatataatgctcactttgtttttttttgtcgcgttctagttcaaaaataaactaatcggcgataaatatttaagaacggaggtagtatctagtatctagccttgacgcctctactgaatgtacctctactgaatgtactcggcttcagttcttaagtttggtgtgttggatctcacaaaaaaaaaaaaaaaccggccacatctttccactgctccgtccagcgcatccaccttcccaaacccttactcccccaggaagcaatggcttcccccacccagggccaggtcatcacctgcaaagcggcagtggcgtacgagccgaacaagccactcgtgatcgaggacgtgcaggtggcgccgccgcaggccg

SEQ ID NO: 16003 - DNA, 5095 bp, Zea mays
  misc_feature (2534)..(2534): n is a, c, g, or t
ctgcaggaagtagtatgctactatgctagaacaggttaataatacaatgtataatagactttataatgttgtcatgttatatgcaatcaactaaaaatctagtgtataataactctcttataatacaatgctcttaaaaagtgttttaaagtctgtgagcagtctacttttagatagcaatcggctattttgcttccattctatctctatttctctttcttttatgtcacctaaaatctgatacgatgcctcttaaatctcaactacgtgattttattatacttgctctttacatggcattaggacatgtacaaccccattagttcaatgatcttttgaggaatttttaggggattaagtgcaaaaattcaaaagacaggctctgcgaacagactgtctctttacgtctttctatttatattatctgttaactgcattaatattctagttgttctagtgactcaagattatatgatatattttcttctacttacaaaaccgagcaagatgctctaggtttagtgcgcgctcagaaataatggagccaaagtgctcagcattatctccagcttacctttgcctttttgttattatatggataatttaggcggaccaaaataatcgtgtgattgggcagcggggcatagccgagctgtataaatccggatgcactgttctgttgcagtgctcagggatacgaggaggggaaggaacaagatgagttccaagaaagcaacaaaccggggtttggtacttgtccttctgctcgttgttttgcctgcgctttcggtcgccacgcacgcaggagaaagagagttgccagatgaaaaggatcacaagggccattccactgttgcttctggaaaggggggaacggcttcaggagatatggtgaagacgaatgactatgggcgctacgatccgactccggcgttctccaagcctcgctccaagcttatacccaactaattacactcacacttgctgtatctacatgcttactatatggatggtatgcatatagaaatagtcatgtacagaatataatgtatatatgtaactactcacttcgttttcttttatcgcgttctagttcaaaaataaactaatcggcgataaatatttaagaacggaggtagtatctagtatctagccttgacgcctctactgaatgtacctctactgaatgtactcggcttcagttcttaagtttggtgtgttggatctctgtttcgtcttccttttattttctaacaacaccaggttaagaatccttatttctccaatttatgaaggcaagatacacattgctgaaatgcttttagctggagcccgacatgcatgcgaaacaaaacaaacgctagctagctagcctcgagcctctccgtcttggccatcagcgccagcttccagcgtcatgttctgcgtcgactcatggaagacgttagcgcagacgacgaggtagacgaggtcgacggcgccaagaaccgcgagcagcgcgtagtaggagtcgtaccggccctggtccaggtcgtccgagatccacggcgcgccacccccgccgcccttgccgctggtcaccacgttcacgagcttgacgatcaccgtcgacatgatgctggcgacgccgctcccgaagaagagcagcgccagcacgaagctgcccatggacttggggagcacggcgtagtagaactcgatctgcgcgatggcaccgaacgcgcccgacagccccatgagcacgtactggggcgccagccacagcgcggacatgaggggaggggcggctccgtctgcgtctccgtgcctcgccgccgtcgtcgcggcgtgctgcctccgatgggtctccaccgccgatgccaccgccatggaggcgacggccagggacacgccgactcccatgcgctgcttcagcgtcagcacgcgctgccgccccgtcatcctccggaggaccggcacgatgcaggcgtcgtagcagcttgaccacgccgtgaaggtcaggatctcgaagaccgagatcgagcccgcgggtatctggaaccttgttgcgccgacgcggcggtccatggtggctgcctgcaggaccccgaacgaggagctctgcagcaggaacgacatcaccatggctgaccacatgggcatcacgctcagagctgacttgaggttctctacttgctccactgtgcaggcgtttcctgcgcttgtgctgccgtagtcgtcgtcgcttgtgctgttgcctggacgaggcctcaccatgcatgctttgttcagaaacctgaatgatcgtatttgttttgcaacaaaaaaaaagttaaaaccctagtcatgatcggtaactgaaccctatgtgatgtcgcacagacttatttgaaaataaaatgctaatcgaaactatgcgtcatgcgggtaccaagaaactatgtgacagattggtggcttgatggaaagagcatagctgttttggcgccatccttattttcagcagttcccaaaagggcaattaagtgaaagactttcacaaaacatggggtgtncgacatcagtagtgtcctaactgtataagtgctgattgagtacctgttggtttgggacttggtggactttctattagagccttggacgtgctttataattttcgctggttatctgcatattagtgacatgtgttctaaggcctatatagtgtatacttgtactcagaagccacgagcccaagacaaattgagctatgctaaaattttagagaatttttgcctaaattctaggtataaaatacccatggatacacggctacgagtttaatgagtacgtacccatacctgttctacccattgggtcctctttttctcccgataacagacccgtgggtatataattgagactaaagtcgtaccctaatggagtcattacccgccaggtaacagataacgggtccctgttgccatctttacatatgacaaataaaatacttaatcaagtgaagacatagagatttacatgggaaactccttgcagagagaaaactcacgggcggaagtgagcaagaattccaatatgaagatgaagaatacaagaggtcggagccaacaagtgtggggagcctccaaatccccaaatcactctctcaaatgtgtggatttggtgactctcaatatcccctctcctttctctaaccctagctctctttctctggtttgcaaatgagttagcgcactagacaagccactcaaacagagaagccttgggttgtttatgaggagttatttttggtacctttgcagatgaccccctagatgacccccggggtggttgtgtccaatcgacctctggaaggatgcgaacaaccgacccccaaggggtaaatggaagctgttgaccacaattggagttagtgaccataattctccacctcagcgacaattgaaccatagagccaacaaaagtttaatcttcaaactcttcatctttaagtcaacaaattagcatgtaacaatctcactgcctacaaagctccacatgagagctagctcgggcaggcatgaacacccaccaagctcaagcagtgctcggacttggctcttgggaccaccttggttaacatatcagctggttgtcttttgtaccattcttcataacaaacaaagctttgtttttcacatgaagttgaacgaagaaattttgcacatcaatatgcttggttctctcatgaaacttctcatcttttgctcaatgcccaaatcaccaagaaaaccatgcaagcaaataagttccttcactgcctcagtcaaagacataaactcaacttttgtggtacataaggcaattgaatgctacatcgttgccttccaactaatgcatgacccacaaagctttaacacatagccagcgatggagcgcttgtaatcaagatccctagcaaaatcagaatcagaataaccaacaacttgtcccgaattgaccgcactttgatcaaacatcaaaccacatgtgcttttcgctctgagataacagagaatctactgcacatccttccaatgttctttgcttgactatgacataaaatggctcacaacactaactacatgttcaatatcaagatgtgtgcaaaccatagcatacatcaagctgccaacaacacaagcataagaaactttggaaatgtacatctcctcctctgcatccaagggtccagatgaagtagatagcttgaaatgtgcaggtaatggggtacaaatgagttctacttgtgacatgacatttgtgcagaaccttttcaatgtactgactatgtgaaagccaaagtctgtctcgagatctatcacgacaaatatccatacccaacaaactcttagctgcacccaaatgcttcatctcaaactcactcttgagcatgacctttgtttcatcaatagcataatgactctttcctactataaggatgtcatcaacataaagccacatatacatccttgtaccacctgcaagagtctgctaaaatgcagaagcatcatatggactcctctcaaatccatggctagagacataggaatcaaaccgatggtaccattgccttagagactatttcaagccatacaatgacttctttagcaaacaaacatggttttctttgccttcaaccacaaaaccttctagttgtgacataaagattctctcccgagctcaccatgaagaaacgatgtcttcacatccatttgctctagttccatttcaaatagagcaaccaaagccaataaagcccgagtagaagtatacttcacaactggggagaatacctcatggtaatcaattccctccttttgattggatccttttgcaactaatgtagctttataccttagagcatcaactcctggagaagaatctttgagtttgaacacccatttacagtcaataattttgcgccctttgggcggcaataccaagttccaagtatgattcttatgcaatgactccatcttctctatcatagcctaaatccaacaagcggcctaaggaactacctctttgtaagtgctaggctcatcatgctcaatatcatgtgcaaatgtctttgaactatcctcctttgtcatta

SEQ ID NO: 16004 - DNA, 796 bp, Zea mays
tgggtacccccccctggtccccgcccgctgcttcagctcccgcacgccatgcttcttcctggcggcgttccctccctgcttctctctccctctcgtgtcttcctcccagcgcacgcgccgcgccctggattcctctctctccctcgcgtcttcctccccctgccatggcgcccctctccgtggtgctttcccatggcgcgccccgagctcctcccagccatggagctcgtcggccgtgcagcttgcccagcccagccgctccttcctctgctcctccctgtttgccatcgctctagctcgcctggtcgccaaactccaagaacctatgctgctcgcctccctatgccgacgtcgtattctggtggccgcactccactcctgcacctccccttccatggctgccgctgcccccaagcctggggccttgtcgagctccctcagctcgcccccgaacacaacattatgccaaccttgccttggctccccagcgtcgctcgcccctgccgttcccaatcgagctcgccctgcttccgtgctcgtgcaacctgctggtggcccggccactcgccatcggctcccctgtccgatgcgtcgttagccaactcgctggccgacctcgctgtggtctggctcggtcgcgcgctcggctacttggtggccgaccgacgccgcccctggtgccgatccgggctgctggacatgcatcaaagctttctccatgtccgcgctatggtgttcaggctggctgttgttctgctactcaccgtagcgcccacagtctctgctcaccggtgct

SEQ ID NO: 16005 - DNA, 2447 bp, Zea mays
tttatagattttttcctatttaatgagttatggatagaatatatgtcttacataatttaaatttttttccaaatctttgtttataatttatgatgcgtttaaccgaagaaataaatttaaatagtcttagattactttaaagcataaattatgatatagatttaattttaaactatactaattcagaactggattgatgtaaaagaacaaggcccaatacccaatggtgtaggtggtcagtcgatccagccttatccggccacgtacccgtcgttagctttgttggcccaccgacaacgacctcgcggacagcgcacgtccgcaccgcgacgctctccgattctcactgctcctctggtcccacggtggctcacgccagcctcgagcattcgccactgaatccgatcggagagcgaaagcgaaaccggcgccgtctctccccaccctcgcggtcgtcgcccaccgtttttattacatcttcttcttggtttcagctgcgcacaaggaatccgtgaagctcctgtgccagacacagagagagcaaaccgtgcagcggtgcaggccagcgcgatccagctcccatcagtgggcgcgcccgccgtctcttgcgaccctgtcttcttggtttcttggcggggtcgtcctgctcgtgtcgcgctgcccacaacccgcgttctgtcgcggcatccgccgtggatcttggcccgggttgtccctatatcacgcagaaaaaagggccatccccccccccttcgccctcgggttcgttactgagtgtgccggagtggtattcgtgttccgccgggtgccgaggtggcctcgcggtcttctgccgtctcatcgtcgcctgctccccgtcgcgttcatcccgaggcatatcttggtcttgtaattgtataaaaagaaggtttggggaatcaggtttatctaaccagtggacatggtatcagttaatcttgggttagttcattatgtactggaccacatatatggaacacttcttcatcgcaccaaactaggaacaccatttttctcaaaaggatggggaggtaccaaacttgatttgctagagaagatggtgaagcagttgtttcccgaggcacgttgccaaaactggccaccaactgctgtgcagccaatgtggaaaacagtatgggagacaaacaattcttgtctgcgagaaggagttttcaggactacatgtgatgagcgactaatcgatgcattgccacctgagagtcacaatgcaagagttgcttttcttacccctaaaaatgttacacctgagaagatgtcatgtgtggtccatcttgcaggcactggtgatcacacatttgagcgcaggcttcggctgggtgggcctcttcttaagaacaatattgcaactatggttcttgagagcccctattatggacagcgacgtcctagcatgcagcgtggtgcaaagctccagtgtgttagtgatctgttacttctagggaaagccacaattgatgaagctcgcagtctcctgtactggctgcagaatgaggctggttacggcaagatgggcatatgtgggctcagcatgggtggagtacatgctgcgatggtgggatccctgcatcctactccagttgccacactgccatttctcgctccacactctgctgtggtacctttctgtgaaggggtctacaaatacgccacagcttgggacgctttgagaaaagatgctgcagtattaactcaagatgtaacacttttggcagaagatgctgcacagaaaagcgggatcaccatcgaacaagtcagggataggttacggtcagtgttgtctttgactgatgtcactcgatttccagtcccaaagaacccacaggcggtcatctttgttggtgcaacggacgatggttatattcccagacattcagtgatggagctccagaaggcatggccaggctcagaggtccggtgggtaacaggtggccatgtctcctctttcttcctccacaacgatgcattccgcaaggccatcgtcgacgcccttgatagattgtaacaccagaaggtgagagagaggccatccttgtgatggcactttatgttgtgtgacatttctgaacttggggttgcggcatgagctgaaccctctgtaactgccaacctaactgctcttagtgacgctgagattggaggtagggtggctgtacatgacaattgtagaatgtagcaccccattatttggcaattgttctgcaaaatatttgtttgtcaccatgtatcaatttgaatgctacatcttctgattgtctgacatgcatgtcaatcagctaggcaatttggcagtttcagttattattccttcctagtactattttatattcatattgatactgctggatcagcccctatttagtttatatactccccagttacatgggtcatcagaattcctgatcagtgat

SEQ ID NO: 16006 - DNA, 655 bp, Zea mays
attggttggctcctcgccggccgccggggcgggaaggaaaaaagaaagcaaatcaaagcacaacgagaggggggagaaagagagagagagagagccatggggcagtgttcgtcctcccagcacccagaagcagagcagcagaagcagcagaagcaggctgcctgtgttgacatccagaaaaggcaggagcagctgcggaagaaggcggctgcgcacatgaaccagccataccaggcatctagcaatgacgagctggtcctcctggtgtcgctggattcaatcaccaagattgggtgaattgttcatctgcggataatcatctctagcttgctgctgaccattacggtgaacacccacctcgtctctcctaaaatgaaggatgaagttgacaggccctctttctctttgcttgtgtcatcaatatgtaaacactcactagctaataaagctaaaaataagactgcctccatttgtcgatttacgaaattttatcacttaaacctgtctgtgtatttcagcaaatgttttttgtaaaccgtccatgtatatgttgagaaaataatcacggagaccgccctttcgtatcaaaaaaaaaaaaaaaaaaggcccctagggcccccccgaacccaaaaaaaacaaaaaggcccctagggcc

SEQ ID NO: 16007 - DNA, 607 bp, Zea mays
gccggccggccgggagccaaggaaaaaagcaaagcaaagcaaagcacaacgagaaggtgagaaagagagagagagagagagagagagctatggggcagtgttcgtcctcccagcacccagaagcagagcagcagaagcagcagcaggcggctgcctgtgttgacatccagaaaaggcaggagcagctgcggaagaaggcggctgcgcacatgaaccagccataccaggcatctagcaatgacgagctggtcctcctggtgtcgctggattcaatcaccaagattgggtgaattgttcatctgcggataatcatctctagcttgctgctgaccattacggtgaacacccacctcgtctctcctaaaatgaaggatgaagttgacaggccctctttctctttgcttgtgtcatcaatatgtaaacactcactagctaataaagctaaaaataagactgcctccatttgtcgatttacgaaattttatcacttaaacctgtctgtgtatttcagcaaatgttttttgtaaaccgtccatgtatatgttgagaaaataatcacggagaccgccctttcgtatcaaaaaaaaaaaaaaaaaagcggccccta

SEQ ID NO: 16008 - DNA, 2275 bp, Zea mays
  misc_feature (2248)..(2248): n is a, c, g, or t
gagctcactagtccccccccccccgtgacatcccttccttgcgactcatggtttgctggagctgtaggattctcccggcacaatggaggtgctattgtctgatttggagcaacaaggaaatataaccctctttatcgtgttcttcacgaaagataaacttttcagggtcattgaaaattatgagtcaaaacctagagcataatcttcagaatgccttgcttttaataagtgattacctattttgttacagagccgaagagcatttaccaaacacattgcgacaagctctaatttgcaaagtaatactctctaccttcttttatcttgttttttataatccatatccctgacacttcataaatattcttgttgtaatgttatgtacttctacacctggatttgcaatgtgtttttttgctcatgtttcacttattctagctcctgatagaagtaaactctctaaacgacatggagctacttctatggggcacgttacttatcgattgtttcctatcttaaaactctaccaacatatcttgttttattcaaggcataagaatgaaccatgatgtattttttcctgcacaatataaagaaatgggctatcagcctcacgcaatggtgaattatttagcactactgggctgggtgatggtactgaaaatgagttcttcactatcgatgacctaggtttgttcttaatagtattttcttttcgttttcactttagtttttgtatattaaatttaaaataaaactatcatattctcagctcagtgttatttctcactgcagtccagaaattcactacaaaccaagtcaataaaagtggagcagcctttgatccagtctgccaccagaagttgcttttatgctgaatttcggtacatcatgttgaccaggactactaatgactccagttttaatccacttagtttccacatttaataatctctacctggttctcttgtcattgcacttattgcttctaaaatttttctgcttcaaggagttcaacacggggcgcttcacttgtttgtaattgaggcaaattagtctgctttgatacctctactacttattaaggacgcaagagtaccctgtctctgactttgttctgccaccggccgttccgacatccgtgaatctgatagcccattttagggtcgctatgcacactttcttctgtgtaatgcaacttcattagtgttgctatgcacactttcttctgcaccaaccacaatattctcttgggatgctgtcaatgggatgaatgaattgcatattttagggtctttgctacactatagagtagatgggttataaatatacaaatctcagcttcctatccattctttctatctagagttgtagacaccacatagtatacagcagcaggagcagtgctttgctcagtccacctttgttgaagctgggctgagagtgtaggagtgaagccccaaggctctctggtaggcgatccaccacactacccgacccccaccctttttcctcaacttgtaaattgtcgccccgactactcactctaccaccgcaatcgcgtcatcattaacatttcttcttcgttcttttcagggccatcgaggatcgatcgggcggcggcgccgtcgggcagaagcggtcgtcaccggacaagatgcacaggtccaccatggacgtcgtctaccaccaccaccaccaccaagagtcgctgttgacgggcaacgtcgccgccaccgccagcgccggtaagaagctgggcgtggagcggttcgagttgccgctgatctacatctcgctgtcgcggaaggagaaggacgacaatttccttgcgatgaagggcaccaagctaccccagtggcccaagaaaagggccaagaacgtggagaccctccaagtattaaacacctggcctgagatcgatttgatcctctatttctaacccgatccaaatcgatctctgctctcaaaacttaaacatgtgccccttgctttttatcatgcagtttatcttcctggggatgtggtggggtaggggccataggatggatttgaattcatgatagtatctacacatgtacactgcttaaagatactatgtacgtatctatatctattacaattttgtataaatactttttgatagtttttaaatttgtatggcaaagcagggacacatacatatatatatatatcctttaatttatgcaaaaaaaaaaaaaaaaaactcgagggggggccggtaccnattcgccctatggggagcgtatttaca

SEQ ID NO: 16009 - DNA, 2150 bp, Zea mays
cgcattggggacctcgaccccggccgggaactggaaactcgtaagaggaaaaaaaaacacacccgccccgccgtccacctctccgcctcctccggtgccggcgctggagcggccgacccacgcaatctatgggcaacatgacccgctcaaactcgcccgtctcccgccgcatcgtcctctccttcctcgacttccttaactccgtcgaattagctcctggtgttgatcctgaagctctggaagttgctaaggattgtctggagtccatttttagtgttaactcaacagccactggtgacgcaatacaaccaggactgttgtttgagctatttgcttctctcgaagcaaatgaaagagaccaggcaagagctgctttgctgtcacaatctgtttcaaacaagccatctcaaactgcgggtacatcaaatgtcgaagaagactcaaacaaatgcacaacatcaaatagcgacagccaggtggaggatacatttgaactagatcattcaggagatgaactatttgcaaaattttatgctgcacttgatgaaatcaatttctttaagacatcacctgctggagctgaagatcctggtctactttcaaaagcaacacaatactttgatgatgcattactggcgatgcagaagttgggaaagaaaagggcaagcttagtagacattgcagagtcctttaaatcaagagggaatgaattcatgagatcaaaccaacaccttaaagcggtagagctgtacacctgtgccattgcattgaaccaacaaaatgccatttactattgcaacagggctgctgcatatacccttcttaatatgaacaacaaagctattgaggactgcctgaagtcaattgaaattgaccctcactacagcaaagcatatagccgactcggatctgcttattttgctatggggaattatcacgatgctctgtacaagggatacttgaaagccgccgagcttgatcccagtaatgaaaatgtcaggcagaatattgaggtcacaaaaaagaaactggctgaacaacgagtcccaccagaagagcagaacacacatgcaggccaagctcaaggaccacatccaatatttacaagtggtggtgttcctttcaatctgtttccaccaggtagttctccagttcaagaattcttcgctggctggtcgtccgatgttggtgcaccaccaccaggacattcgataagtataaatttgaatgatatttttggccaagcaaatgtcaatgctagcggtcaaggatcaagtcaaacagggaattcaaataaccatactccatctgcttctttctcaactggtgctgctgttcctcctccctttgccttctcgggctcaggaaatgaaggaacgcaggcacgccaagcttctaatggacttgaaggggaacatggtgaaccaggcatacacagggatgatgacgtccatataaatttggctggacccgagcaggctgcggaggctttgagagctgtgatgcagatgcttgggccacagatgggtcaacatgagggtgcacctagaggaccaggttaagcgtgggaggtaggaaaatgtgttacgtggcgtattgtggtctgcaggagtcttatacgggacattattttgtcttctccatcctgacgaagaatggagattctcgtgcgccttattattatagcagcttatctgtgtgctacaacaattccaccgtaatggttaccggcgttcaacttatctgccctgttcatattggcgtaggtgtgtcattagctgtgctggggcctgggtcttgttttgttgagacttgtctcgtaatggctgtcggtccatcatgtgatcttaaattaaagcctttttgcccccctcccctgcttttccgctgcttgtcggttcccagttgatacttggaaaatatttgcaaggttggtgaaaaaaaactgtcactggaatgaagttcatcatcgttattggctggctggcttgctggataaatcataaatgttgggatgggggggggcatatcctcttggactggagggaagttattattacgttactaagctgggtatatctaagatgcttggttcacatgtttataatgtgacgtttaaaatgcgatgggtaactgataacggtatatca

SEQ ID NO: 16010 - DNA, 1109 bp, Zea mays
  misc_feature (729)..(729): n is a, c, g, or t
  misc_feature (755)..(755): n is a, c, g, or t
  misc_feature (760)..(760): n is a, c, g, or t
  misc_feature (769)..(769): n is a, c, g, or t
  misc_feature (774)..(774): n is a, c, g, or t
  misc_feature (801)..(801): n is a, c, g, or t
  misc_feature (877)..(877): n is a, c, g, or t
  misc_feature (947)..(947): n is a, c, g, or t
  misc_feature (957)..(957): n is a, c, g, or t
  misc_feature (999)..(999): n is a, c, g, or t
  misc_feature (1033)..(1033): n is a, c, g, or t
aagctggagctccccgcggtggcggccgctctttttccccccggatcccccgggctgcagggagctcactagtccccccccccccgtgacatcccttccttgcgactcatggtttgctggagctgtaggattctcccggcacaatggaggtgctattgtctgatttggagcaacaaggaaatataaagtagtaaaacaatttctttacgaaagataaacttttcagggtcattgaaaattatgagtcaaaacctagagcataatcttcagaatgccttgcttttaataagtgattacctattttgttacagagccgaagagcatttaccaaacacattgcgacaagctctaatttgcaaagtaatactctctaccttcttttatcttgttttttataatccatatccctgacacttcataaatattcttgttgtaatgttatgtacttctacacctggatttgcaatgtgtttttttgctcatgtttcacttattctagctcctgatagaagtaaactctctaaacgacatggagctacttctatggggcacgttacttatcgattgtttcctatcttaaaactctaccaacatatcttgttttattcaaggcataagaatgaaccatgatgtattttttcctgcacaatataaagaaatgggctatcagcctcacgcaatggtgaattatttagcactactgggctgggtgatggtactgaaaatgangttcttcactatcgatgacctaggtnttgtntctaatagnatttntcttttcgttttcactttagtttttgnatattaaatttaaaataaactatcatattctcagctcaagtgtatttctcactgcagtccagaaaatcactacaanccaagttcataaaagtggagcagcctttgatccaagtctgccacagaagttgctttaatgctgaatttcngaacatcatngtgacccagactactaatgactccggttttaatccacttagntccaacattaaaaatcctcacctggttcccttgncattgccctaattgcttcaaaatttttccggctcaggaagtacaaccggggccttcccttggttgaaatgaagaaa

SEQ ID NO: 16011 - DNA, 7612 bp, Zea mays
  misc_feature (452)..(452): n is a, c, g, or t
  misc_feature (527)..(527): n is a, c, g, or t
tagtagactgttcttcttcccatctttttcttcttgtcgcctttcttcttgtgcgacttggtggagccgaaggattcctttttgtgctccttgtgcttgtgcttatcgctagatagcttcatccccccgacgacaccttgtcttcgggcttggatcccgatggctcgggtttcccgacgacatcttgttgttcttggcgtgttcacccaacatcacttcgagttgttatactttaatgaagtaccatgctctaataccaattgaaagtctcctagaggtggaagggggtgaatatgcgaaacctaaaaattacaaactttgaacacaaacttttctccgaggttagggctagaacgagtattaagaaaatcggagtgccaccacccccttcgcgtcatcgtcaccgtcgtcccctcccttcccttacgtgggattgtagcatttgcataaantatatgctagttttagtaaacacatgagagactacactgcgaacatctgctcgattgcggtctctactttgagcnacacacaatatcaacttgtgtaacgaagttacctatgcattgaacatggatccctatgttattgggcatatttcactctttgcttgtatgtttaatctaatatcacgagcagtaattgcatatacagacatatatgtcaccataaatttgttatgttgttgttttgattaaattaaacaaaaaatactccaatttccaacattcaagttatttatatcatatattagccctggtttttcttgaaaaacaccagacctaagaggctaagacacactgttttgatttgagtgcttgtgaatcaaagtttgcggcagccaaacccaaacccgggacaatcctgactctatggcagtccccggttccggatccgaagccgggccgaatagtccaattccaataggcacacctcctcctcacgtgccggtgccgccggctgcccccaagacaacaagcccaagcggtgggcagtacacgcgacgatcctgcccgttcctaaccatcggccacggagccgagagcacgtacagtaacacgtgtctctgactcgtggcccagtagtacctagaggccccggaagtcagtgggacagagttaggcgtgttcgtcaacacgacgggcggggcgttacgtggcgtgcagcatcgacgcggcgcggcagtacaccatccgtgtaaaacacgagcgacaggtacctcaccgaacgtgccttcactgacatcgtgggcgcccgagatccagacccacctgtcagagcacgtttggtgacgccacgcttgtttggaaaccgatcccctcccgctgccttgcagacttgcagtgcaagagagaaggccgcacgtaccgctcggatcttcaggtctacagattacaagtacgtaacagccccctaataaccaaattgccacgccccgcgccgggggcagtctggggaaaatgggagcggtggcagaagggtgattggtgagccacgctcgagggcacaacggggagagcgcaacagataaatcctctatttggacccgtcgctgcttcccgtcgccattgctgcctcttctcctccttcctccgtccctccctccctcgctctcccatcctcctctgttctcacaatttttgcttctgaatttcctgccggtgtgccggcatcttctttctactgaggcgtagaccaaggaggagagtaattggcgagcggttggagaacgaatacgagacggctccggcggccggaggcccattttttgatgcgtggtgccgtcgaggtccacacgattcgcagagacgtcgccacgccgagtcccctgaggctcagagaccctccggcattggacatgatgaggtagccggcagatctccggcctctcacctctccctctctgttcacttggttcctccggttatcacgcggtgggcctccctgcagatcgaagtgtaacatgtttctcaactcgggttgcgtctgtttctcgtttggcttcttctatccggcttcttgaaggatttggtttcttcgccgccggccggagctggacggccggcctgtcaattttacttcggtcgtcgaaggattcgctctcttcctccgcctgttatttccgcgctctgtcgttctggtatttggatttcatgttcctgtcgaagtttggttgatccgaaatatgcatctctacgctggtttcgcgaattccagccgccgttctttactctcctggactccgcgtttttaaggattctgcacgcaaacgtctcatgtttacctgtctcatgtttacctggccgtctcccaaattccgctgctttcccggcagtttctggaaaaagaacgagccatccatttgttgttgtttcagatttgccccctccgatccttttgtggcccagagatggccagtcatgtagtttatcgctctgccgccggagtcaaatttctgattggtctgcggccgccttctcttccgagttgcggagttcttagtgatttttgttcttccctccacgcctcgctttacttgatttcgtttcaacgagctggttcatgttggaattttgcggtcgttttgttctctctccctaaggcgctgggcctggtgatcgttctgttcgagtgctcgtttcatagccgtttccaacggagcgggcgatctgtcacttgcattttgcagccgatctccttgttcgatgtcacatagctaagactcgcctcgcctcttgattcgttgcaggtaccaaaggctgagcccggactgcctcccgctcggcaacggcggtggcggaggcggaggcgccgtgccccgcaagcaggcgtccagatcctcctacatcagagaggacgacgccccggccgtggccacggatggctcccgcctcgcatcgtacctggcggcctcctcgcacgagcccaagccgctgcgggcccgcgcgccgcagccggcgcctctctcctcggtggccggccggagcccagcgcgcgaccacgcacaccaccaccacacctccgactcctccgacaccgcctccccgagctccaccggcggcggcggcggcgccgtcgtcggcgacgtgctgctgcagggcggccacaagaagcggtcgagctgccggcgcgactcggccaccgccgcggcgccgtccgcgcagcgccgacagtctgccgtcggtggcggggtcaagatccagcggcgcgcgtcggcgccagcgcacgcggagaagctcatgccgccgccgccgccagccgccacgcgtggatctaacttgcggtcggcgtcctccttcccgtcccgcgcctccgcctccaccgctgccaccggcagccaccacccgccccaccaccacaggtaactgcgagatgccccccttacctcccttcgtttcctgcccgtcgtgtccgcggtccgcctatctattcccttctggttgcctcggcgacctttcttttcggtttccggttttgcccccgtggaaactactggtgcggtactatctggacgagtagttggttccgtagttgagtcgtggtcgcgttctttgggtgggttcgtgccttggcgtcgctgtattgttatttatttctctcgaactcggccggtctcctttggttttggtgtgagctgtaccgccacatctttcagcacctgtaagttggatggaagatattccttcctttcttttcctccgatcgcatcatttctttcttttattatatggtgtatatataaaaaaatcatttattcgtttattgcatgatataaaaaaaattcgaagtagggttttctcttaatatattttagtaccgatttgatctggatcgattccagtttttagctcatttttaggggtattttctagatatgtacttttattataagttttggaaaagttgtgtctctggtcagaaagcaaccagtagccgtatttgtcacgcattgtttgtatcatgatggggccatttgttatcttatttacaaatctcgtcgtcgagtgctttcagcagattgttttgattaatctggttttttcggtacttggggattgggatgttgtcaatctgatgaatgaattgcatattttaaggtctttactgcactagaagtagagtagatgggttataaatatacaaatctcagcttcctatccattctttctatttagagtcctaggcaccacatagtatatagcagcagtgctttgctcagtccactttgttgaggctgggttgagagtgtaggagtaaagcctcaagtctctttggtagacgatccaccacaccatccgaccctcaaccctttttcctcaacttgtcaaccgccgccccatctactcactccaccacggtcatcattaacatttcttctccattcttttcaggaccgtcgaggatcgatcaggcgggcagaagcggtcgtcgccggacaagacgcataggtccaccatggatggcgtctaccaccatcaccaccaccaagagtcgccgttgacgggcaacggcgtcgccaccgccggtgagaagctaggcgtggagcggttcgagctgccgctgatctacatctcgctgtcgcggaaggagaaggaagacgatttccttgcgatgaagggcaccaagctgccccagcggcccaagaaaagggctaagaacgtggacaagaccctccaagtattaaacgcctgccctgagatcgatttgatcctctatttctaacccgatttccaaatcgatctctgctctcaaaacttaacatgtgctcttcccccttgatttttatcatgcagtttgtcttcccgggtatgtggttgtccgatttgacgaggggacggtacgaggtgcgggagaagaaatgcgtgaagaaggtataaatcgaaaactatttttttcccctactactaccctgatctgatctggccaacaattccagtttttttttatgcagtttattcagcgacggtaattttccaaccttataataaacattataataagataataagaaaaataaaaaggcactgggaaaaaattgcttacaatgagggggtatgggggtgcgaacatttttgtttttttgggaatgcaaaataaagctgaaaagcggccggacctgttctttcgggatggaccctcctcacgcctcacgtgggccccacggcctgtgatgctccgtgtcctcattgatgacggcactggtttatttgctccgccgcggctttattgctgtcgatgacgtggaggggatagatgtgtgcccttaacctgaggagtcttgtacttcttctaggtttagcgtttcatttatcgtatattgtatatgtgcttagctttgccaagccaaaaaaaagaaaacacacacacacgctagaacacacctgtggcacactcgcacgaataatacaaacatcggaccaccgtgcctgaaatctggcttgtgaaccacacgtaagaagggtcacagaaggacatctcatcaattgcggcgtgctcgtatgggtcccacacgtcagccggctgttggggattgtcgagctggagccactgacaagtgggtccccgatggacacgtacgtatctgtcgctggcttaggttaggaccacatgattgtggcccggatagagctcatcgagggagaaaaaaaagaaaggagagaaaaaaaaaagaaaagaaaagaaaagaaaagaagaaaagggcggtgcgctcccgtctttgtatcacgtcgctggttccccccaccccctgtttattctgattggcaaattgcaacggccaatttgtcaacagcaaggaccagcgcgaatcttgtaacgtgaaaccctagttgttttgttaacctatacgcaatggctgtgtggctggttcgtgcctgggtttggtactgcatgccccgtgtggtcagccgggctctcctttaccactcacgcacacaaaaaagataatggtcttcgcttgcaactctacctactgatgttttttttttcttcctatcgctaagcacggtttgcagtgcactaactggaatgaaatgccctcgtatttggtctgcagaagcgaagagggctgaaagggatggagagcatggacagcgactcggagtaataaggtggaggcgcggcgcagccatcttccatgggggtgggagtcgaggaagaaggggccctagagaaggaggaaaggaggagacgttgagggcaagagtgagcggtcgcgcctgctcaccttgagccgccgccgcgctggaagcgtcggaggacggcggtgcttgccacacacagggctgtgtttctggcggtcgtgaggtttttttgttccttgatgctgagctgcgtctccgcggccgctgtttgcagcatgtaaccctgaaactctgcgatccgtctatctctgccttcttcattttttctcatgcgctttcgagcagcagtggtaacaacgctgagtacgcggggattgcaccggtgacggtaaggtgaaaacgacacaccaccggtggctagttgttggactgggcttgggttcctctgaagggaatgggccctggctcttttagtcgcattgcgcaagttgtgaagcccgggaaatgttagaatatttcaagtgcgccttctgactatcttgccctacttgctgcctccggctagataaataaaaaaaacggcaaacgcttgtcgctgactcgcagtggctgagatctcgatgagcacgcacgactagatccagccagagaggcatgtgggggtttttattttaggagcttgacaatgatctggcggatgccaactcaacgaacctctaacggcaccgccaagtctttcgttccgttcaaggccagattgccaccgcccgccgtcatgggtgctgctaccattggaggagctggccggcagccggcagcgactactgctcgcctccctgcttctgtcggtgactctccatcagaccagacgaagaggctcgttgcgcagcgttacgttcctcagcagacatgagccaggcccaggcggttgtatttgtaccagagaagcggccggtttttactttgagtgccggtagagttagatcgaccacatctaataacaacaccagtctcaggttctacggccgtgtggtttactagagacctttatttatacgtcatttcgaattaagtttatttgattatgtgcattgatataagaaataaatctgtaccgattagtcgaaaatgagtatccacccctttcgttactcttacagcttatttcatagtttacaagtagagaaatctgcgattttttttagattaagagtaatgactgagttctttcatttattcgtcatttgaacttagatttttgttcataacttgcatatgtacgtgtggtttatttttagttcatcaaaaaaaatatgagcataacatgtgggttcctcatgtttttatgttctattttgtttttgaaacatacctcatattaatattgatttgtagatttaattaccaggattaaaaaagattcagtctgatttataaattagatgtgtggtttaatacatattgtaatttaaagctttgtcctactaagaatggccacatttaaccctgtggcgggggggggggggggg

SEQ ID NO: 16012 - DNA, 1719 bp, Zea mays
aattgctgcctcttctcctccttcctccgtccctccctccctcgctctcccatcctcctctgttctcacaatttttgcttctgaatttcctgccggtgtgtgccggcatcttctttctactgaggcgtagaccaaggaggagagtaattggcgagcggttggagaacgaatacgagacggctccggcggccggaggcccattttttgatgcgtggtgccgtcgaggtccacacgattcgcagagacgtcgccacgccgagtcccctgaggctcagagaccctccggcattggacatgatgaggtaccaaaggctgagcccggactgcctcccgctcggcaacggcggtggcggaggcggaggcgccgtgccccgcaagcaggcgtccagatcctcctacatcagagaggacgacgccccggccgtggccacggatggctcccgcctcgcatcgtacctggcggcctcctcgcacgagcccaagccgctgcgggcccgcgcgccgcagccggcgcccctctcctcggtggccggccggagcccagcgcgcgaccacgcgcaccaccaccacacctccgactcctccgacaccgcctccccgagctccaccggcggcggcggcggcgccgtcgtcggcgacgtgctgctgcagtgggggcacaagaagcggtcgagctgccggcgcgactcggccaccgccgcggcgccgtccgcgcagcgccgacagtctgccgtcggtggcggggtcaagatccagcggcgcgcgtcggcgccagcgcacgcggagaagctcatgccgccgccgccgccagccgccacgcgtggatctaacttgcggtcggcgtcctccttcccgtcccgcgcctccgcctccaccgctgccaccggcagccaccacccgccccaccaccacaggaccgtcgaggatcgatcaggcgggcagaagcggtcgtcgccggacaagacgcataggtccaccatggatggcgtctaccaccatcaccaccaccaagagtcgccgttgacgggcaacggcgtcgccaccgccggtgagaagctaggcgtggagcggttcgagctgccgctgatctacatctcgctgtcgcggaaggagaaggaagacgatttccttgcgatgaagggcaccaagctgccccagcggcccaagaaaagggctaagaacgtggacaagaccctccaatttgtcttcccgggtatgtggttgtccgatttgacgaggggacggtacgaggtgcgggagaagaaatgcgtgaagaagaagcgaagagggctgaaagggatggagagcatggacagcgactcggagtaataaggtggaggcgcggcgcagccatcttccatgggggtgggagtcgaggaagaaggggccctagagaaggaggaaaggaggagacgttgagggcaagagtgagcggtcgcgcctgctcaccttgagccgccgccgcgctggaagcgtcggaggacggcggtgcttgccacacacagggctgtgtttctggcggtcgtgaggtttttttgttccttgatgctgagctgcgtctccgcggccgctgtttgcagcatgtaaccctgaaactctgcgatccgtctaaaaaaaaaaacaaaaaaaactcgaaggggcgcccgggccacctgaaacgagactgctctggtgacggtaatgtgaaaacgacacaccaccggtggctagttgtaaaaa

SEQ ID NO: 16013 - DNA, 1926 bp, Zea mays
gtttgttaaccaagcgtaatgacgtctgataatgtcgtcacgaacgtcaacgtgcaagcagacgctatgatgaagtcagaggggtcacccgggttgacagaaggatagtcgctgacgagattagtacaaaactataccgatacaatgcgatagcccctgacagaacgtgacaaccctaattgtagctcgaggttttgctcaaccaaatcccacgcgtccgtgagcgaaaacgcgggcgccgagggtccgccccttgtcctccgactcttccattccattctattcccgcttccacacgtcggtcggcgcccttcgcgatcgtgtcgtttcttcccgcagcctgcctgcgtgtggggtgatggctaggcacttcaagtacgtcatcctcggcggcggtgtcgcggcggggtacgcggcgagggagttcgccaagcagggcgtcaaccccggcgagctcgccatcatctccaaggaaccagtggccccttatgagcgccctgcactcagcaagggatacctcttccctcagaacgctgcaagactgccaggcttccacacgtgtgtgggcagcggtggagagagactacttcctgaatggtactctgagaaaggcattgaactgatcctgagtactgagattgtgaaggccgaccttgcttcaaagactctgaccagtgcagctgcggaaaccttcacatatgagaccttgctcattgctacgggctcctcggtcataaagctcactgattttggtgttcaaggagcagaatccaacaacatattgtatctaagggacattgcggatgccgacaagttggttgcagctatgcaggcaaagaagggtggaaaggctgtgattgttggaggtggttacatagggcttgagcttagcgctgccttgaaaatcaacaacttcgatgtgaccatggtgtatcctgaaccgtggtgcatgccccgtctcttcactgctggtattgctcatttctatgagggctactatgctaacaaaggaatcaaggttgtaaagggcacggttgctgttggtttcgacgctgatgccaacggagatgtcactacagtgaagttgaagaatggaagtgttctcgaagctgatattgttattgttggcgtcggcggcaggccattgacgcgtctcttcataggccaagctgctgacgagaaaggtggactcaagaccgatgcattcttcgaaacaagtgtagccggggtatacgcgatcggcgacgtggccaccttccctctgaagctctacaacgagcagaggagagttgagcacgtggaccacgcccggaagtccgccgagcaggccgtgagggcaatcaaggccaaggagtccggcgaatcggtggccgaatacgactacctgccctacttctactcccggtcgttcgacttggcgtggcagttctacggcgacaacgtcggcgacgacgtgctgttcggcgacaacgacccggcctcggccaagcccaagttcggcagctactgggtgaaggacggcaaggtcgtcggcgtgtttctcgagggcgggtcggccgaggagaaccaggccatcgccagggtcgccagggcgcagccgccggtggccgacgtccaggcgctgaagcaggaggggatcgatttcgcttccaaaatctgagctcttggaaaggtgtaaaaaaaagaaacattggtaccagttttagctgatttctttggcaattctactttgagccttttcagaccacttgggtgctttgttacacagtagttcagattagttgttagcccctccctaataatttggccttcgatgtgatgttgaaagaaccaccgtgggatgacgatcctattaataatgcatgtgatttgtagcgtcaaaaaaaaaaaaaaaaaagccgccaagggcccccggtaccccaagat

SEQ ID NO: 16014 - DNA, 1709 bp, Zea mays
ctgccttctttttttcccccgcgaagcagggcgaggcaggcagcgtgtataaaccattgggtacctcgaggccggccggggtcctccgactcttccattccattctattcccgcttccacacgtcggtcggcgcccttcgcgatcgtgtcgtttcttcccgcagcctgcctgcgtgtggggtgatggctaggcacttcaagtacgtcatcctcggcggcggtgtcgcggcggggtacgcggcgagggagttcgccaagcagggcgtcaaccccggcgagctcgccatcatctccaaggaaccagtggccccttatgagcgccctgcactcagcaagggatacctcttccctcagaacgctgcaagactgccaggcttccacacgtgtgtgggcagcggtggagagagactacttcctgaatggtactctgagaaaggcattgaactgatcctgagtactgagattgtgaaggccgaccttgcttcaaagactctgaccagtgcagctgcggaaaccttcacatatgagaccttgctcattgctacgggctcctcggtcataaagctcactgattttggtgttcaaggagcagaatccaacaacatattgtatctaagggacattgcggatgccgacaagttggttgcagctatgcaggcaaagaagggtggaaaggctgtgattgttggaggtggttacatagggcttgagcttagcgctgccttgaaaatcaacaacttcgatgtgaccatggtgtaccctgaaccgtggtgcatgccccgtctcttcactgctggtattgctcatttctatgagggctactatgctaacaaaggaatcaaggttgtaaagggcacggttgctggtggtttcgacgctgatgccaacggagatgtcactacactacagtgaagttgaagaatggaagtgttctcgaagctgatattgttattgttggcgtcggcggcaggccattgacgcgtctcttcataggccaagctgctgacgagaaaggtggactcaagaccgatgcattcttcgaaacaagtgtagccggggtatacgcgatcggcgacgtggccaccttccctctgaagctctacaacgagcagaggagagttgagcacgtggaccacgcccggaagtccgccgagcaggccgtgagggcaatcaaggccaaggagtccggcgaatcggtggccgaatacgactacctgccctacttctactcccggtcgttcgacttggcgtggcagttctacggcgacaacgtcggcgacgacgtgctgttcggcgacaacgacccggcctcggccaagcccaagttcggcagctactgggtgaaggacggcaaggtcgtcggcgtgtttctcgagggcgggtcggccgaggagaaccaggccatcgccagggtcgccagggcgcagccgccggtggccgacgtccaggcgctgaagcaggaggggatcgatttcgcttccaaaatctgagctcttggaaaggtgtaaaaaaaagaaacattggtaccagttttagctgatttctttggcaattctactttgagccttttcagaccacttgggtgctttgttacacagtagttcagattagttgttagcccctccctaataatttggccttcgatgtgatgttgaaagaaccaccgtgggatgacgatcctattaataatgcatgtgatttgtagcgtc

SEQ ID NO: 16015 - DNA, 1757 bp, Zea mays
gtgcgcggaaggccggccctgccttctttttttcccccgcgaagcagggcgaggcaggcagcgtgtataaactgacgcatgcattcggcaccgccgggccgggccttgtcctccgactcttccattccattctattcccgcttccacacgtcggtcggcgcccttcgcgatcgtgtcgtttctccccgcagcctgcctgccgcctgcctgcgtgtggggtgatggctaggcacttcaagtacgtcatcctcggcggcggtgtcgcggcggggtacgcggcgagggagttcgccaagcagggcgtcaaccccggcgagctcgccatcatctccaaggaaccagtggccccttatgagcgccctgcactcagcaagggatacctcttccctcagaacgctgcaagactgccaggcttccacacgtgtgtgggcagcggtggagagagactacttcctgaatggtactctgagaaaggcattgaactgatcctgagtactgagattgtgaaggccgatcttgcttcaaagactctgaccagtgcagctgcggaaaccttcacatatgagaccttgctcattgctacgggctcctcggtcataaagctcactgattttggtgttcaaggagcagaatccaacaacatattgtatctaagggacattgcagatgccgacaagttggttgcagctatgcaggcaaagaagggtggaaaggctgtgattgttggaggtggttacatagggcttgagcttagcgctgccttgaaaatcaacaacttcgatgtgaccatggtgtaccctgaaccgtggtgcatgccccgtctcttcactgctggtattgctcatttctacgagggctactatgctaacaaaggaatcaaggttgtaaagggcacggttgctggtggtttcgacgctgatgcccacggagatgtcactcactacagtgaagttgaagaatggaagtgttctcgaagctgatattgttattgttggcgtcggcggcaggccattgacgcgtctcttcataggccaagctgctgacgagaaaggtggactcaagaccgatgcattcttcgaaacaagcgtagccggggtatacgcgatcggcgacgtggccaccttccctctgaagctctacaacgagcagaggagagttgagcacgtggaccacgcccggaagtccgccgagcaggccgtgagggcaatcaaggccaaggagtccggcgaatcggtggccgagtacgactacctgccctacttctactcccggtcgttcgacttggcgtggcagttctacggcgacaacgtcggcgacgacgtgctgttcggcgacaacgacccggcctcggccaagcccaagttcggcagctactgggtgaaggacggcaaggtcgtcggcgtgtttctcgagggcgggtcggccgaggagaaccaggccatcgccagggtcgccagggcgcagccgccggtggccgacgtccaggcgctgaagcaggaggggatcgagttcgcttccaaaatctgagctcttgggaaggtgtaaaaaaaagaaaccttggtaccagttttagctgatttctttggcaattctactttgagccttttcagaccacttgggtgctttgttacacagtagttcagattagttgttagcccctccctaataatttggccttcgatgtgatgttgaaagaaccaccgtgggatgacgatcctattaataatgcatgtgatttgtagcgtcaaaaaaaaaaa

SEQ ID NO: 16016 - DNA, 1320 bp, Zea mays
tcgagggcctgccggcatgcgtaatgtaaaatttgtagtgtttgatgaagcagacatgctactctgtggaagttttgagaaccaggtcattcgcctcgcgtccgtgttgagatttgatgaaaagctactttctagagcacaggattctggaaaggatatatcacttgggagtgatgatgaatatcatgaggattcaaagtttgagactgctgaatttggtagttctgacaaggaaattgaagacaatattgtggaagatagacttgtcaagttggagaatagtcacgttggagcacacaaggactggaggagagttagaaaaatatacagacgcagcaagcagtatgtctttgttgctgccacccttcctcagagtgggaaaaaaactgctggtggtgtgctacaacgtatgtttccggatgctgtatgggttagtggcacttatctgcaccgtcacaaccccagattagaacgaagatggatagaggttactgctgatacacaagttgatgctcttctgaatgcagttaaatatggcctgaagagtgaagttcatgatgctaaagatgttccaagacgcactatggtctttacaaacaccgttgatgctgctaattcagtctctgatatattgcatcgagttggtattccatgtattttgtaccatcgtgagagttccttgaaggagcgggctaacaatttacagtcttttcgggaaaatggtggtgtgcttgtatgcactgatgctgctgcccgtgggcttgatgttccaaatgtttctcatgtcattcaggcagaatttgctgcctgtgctgttgattttttgcacagggtgggccgcacagccagagctggtcaatctggtatagttactagcctatacacagaggcaaatcgtgatcttgtaagagcagttcgtcaagcagaggagttggctcagccagtggagagagcattcagcaggaaaagaagctttcgcaacaaactaaagaagcaagcattacaaaaacgcgaagcactgctatcttgatagcgtgactcactatatttgtagtaaggagaaaatatatgttttttttctctattactgggtgatgaatgtttttgtagtactatatagaaagctgctacatattaaatggaagttgtattcagaccgagtgcgttgaagtaatctgaccaacatgtagtctcttggaataattatatccttatggcgttttcgtggtatttttaccgcattattgcaagtgattacaggtatttttgagaaaattaactatatggccaaaaaaagtctgccttcctttctaaaaaaaa

SEQ ID NO: 16017 - DNA, 987 bp, Zea mays
agacctggacttactgtgactgtgatcataaacgactccaccctagtcggccggggcccctaccggcctacccgaatgcggctggaggcagcccggcccagcacagcagacactccgccacgtcaccgtcgccatggcgctgcaccacctccgcctcgcgccgctcgcgctccttcgcgccgcaagcctcccgcccctcgcctcctcccgtatcgccgcgcgcggccaccgccgcgttctcctctttgcgccgccgtcgtggccgtggcgccttctgtcgcccggtgcgaggccgcgcgcgcttgccaccgctgcggcagaggccgacgatgctacctcgggctcgggcaacgaattcttcgcagagagcacgtcgtgggcttcactcggcgtatccgaacgcctcgcgtccgccctttgcagcgccgggctctcgaggccttcccttgtccaggcaacctgtataccacatgttctcatggcaaatgatgtaatcgtcgcagcagagactggtagtggcaaaacccatggttaccttgtacctttgattgaaaagctgtgctcaaaatcttctaccaccaaagatgacaattgtcaggacaccaccccaggagcacatgacatggtgttggtcctttgtcccaatgtcatgctctgcgagcaagttgttcgcatggctaattcattacttgacgagtctggcaaaccacttaaaagagctgctgctgtttgtgggccaaatggctggccagctgttcatccagatattcttgtagccaccccagctgctctattaaactatctatttgactatgacccggaaaagaggcgaagagagggattcatgcgtaatgtaaaatttgtagtgtttgatgaagcagacatgctactctgtggaaagttttgagaaccaggtcgttcgtctcatcaatatgttgagatttgatgaaaagctactttctagagcacaggattctggaaaggatg

SEQ ID NO: 16018 - DNA, 2720 bp, Zea mays
  misc_feature (202)..(202): n is a, c, g, or t
  misc_feature (239)..(239): n is a, c, g, or t
  misc_feature (241)..(241): n is a, c, g, or t
  misc_feature (277)..(277): n is a, c, g, or t
ccgctgccgcctccctcttcgttttcccgcctctgcgggtggggcgcgttcccccgctgcttttttgtgggtctccgccgggttttccgccttctcttttttttgccgcgccgccctgtttttgtttccccccccccttggggcgcttgggggccctttttgtctctccccccccgccccccgtggttttgttttttccccntttccccccttggcgggggggccccccccggggggcntnggttttttttttctttttttttttttttttttttcnttttttttttttttttttttttttttttttttctttttttcctcctctttttttttttttttttttttttttttccccttttttttttttttttttttcaatgcagtatcgttccgagcatcactactttaaaaaatatatgaagtttcatttttcaagttacatcagtgagctgagcatgtcacgacgggcaccttagcaacaatcagagatcactacccaataatcatggcgttggtttaggccggtcaacaataaacaaaataaaaaagactagcatctccggtacagcatggttcacttcacaagcggtgaagtcggcggcatgtatatgtctatttcatccaacatggggcgatcacagagcttcaagttgtgctcatttgccagatgcagaaggcagatgaaatacaggtgtggcgaaatatcagttgctacagcatctgggctgctgcttggaaggtcatgtaacacctgagataggcgcagcggtggtccaggttcctctctttcctgaccagtctcagcagatgcatggatgtgattccaaagcacttcttttaaagcatgaacatccacttgttttgataccttgtcatactgtatatcaatcttgttgacctgtctcggtttattgataagatttactggctcttctacatcactacacacatgtccttcatcaatgtggtcattgcaaaagttgtcatcttcccaaggttcagatgggataaagtcatcattattatccactggagcatcaagtgattttcttctcttagcaagacacaaaacatctgggagaagaaataatttaacaaggctttcaggccggtaatggcaatcttctggaagtttattgctgcaaatagccctgtttgcaggaaacagtaatgtctttggatttttgggagccgcgaagatatttggaagctcattgtccaatgcttttgtgaaaccaatgtcaggtttatccttggttcttttctttatcttatttgttatttctgaatcacctgatgaagttggagcagcctccaaatctttagctttccgatatttccagtgctcaggtcctgcccaagcatttgcttttgatgaggccatgccaagtaacacaagagatgcaattttgtcaactctatcgtttacaatagtaccctgaggaatctcaacagtgtattcattgaattcctcttgaaagtttgttgagatggaatccattggattacagttttgatcatatgtatcctcatggtcatgacaatcaccaaaatcccaagttccagaatcaggtagcatgctatcgttatcgtctgcttcattaccatcatccatctgatcttccattactggcatttgaccaggagataacctatgtgatggcctttggttttcttcatcaaattgagcaacaatatccctcagggttggagaaatatcattacatagacgcatttgagtgaccatttcctcaatttgctctttagcaaatgaaaggtcaattgtctcagcctgctcagtttgcatatcacttaagatgcatttgtctggagcttcaaatgaatcgaacagcacacggcagctaccataaactccaaggttatacaacaaaaggccctttgccccaccttcatcaaactgagcggtagtttgatggtatagaggatccaccgtgaaagcaacatcaaatttctttacattgagagcctcaaatgacgactccaacgttgaagcaggtgaaatcctcctatcagcatcctttttattgattgcttcatcctgtgcaggttcaacattgctgccttcctccaaatcagcctcttcaccccttccggcacggtttatcccaccaagcaccttgtaagcctcggagtgcactgaatccacacgaagtgaatatatcttgacccccgcctccagtgtgcagcttgccttctgaaagttggtctcctcgtcctcgtccacccccgcttggatgatctcgctgagatgatcgattaggcctagctcccacgtgttcttctggttaattttgttctccgatgcgagcttgatacagttatggaagaggtccatgacctgctcgcggttgaggaggtcgtggcgcgggtccttggagggcgcaatggaggcggcgagggatcggcggcggacggaggcggcacgcgccgccgcgcgggcgcgggcgcgttcttgctggtcatcattggatccgagcgggaacgctggaggcggagactgcagcagcacccgcgacccggccgccgtccagcgcgcgggagggggggtctgcggtggggcgtcctcggccggcggcatctcgtgcggtcgacggcggcggcggagcggaacgggacaggatgggtagagggggttgggtagggaaaattttggaccgtcgttctttttgattaggatgttctaggtaatggtctcgtgc

SEQ ID NO: 16019 - DNA, 2736 bp, Zea mays
tatattcaagtataatatatgtatttatatgaaaaaatagaaaaataaaatcggcccgtgtcgggcctagcccgtcgtgccacgtcttcggcctaggcacgacccggtgaccgggccggaccgacatgggcccggttcactacgtgtcgtgctgggttcgtgtcagaccaaacccttgccgggttttgggccgtctgacaagcccgatccgtttggacatctatactcggacgacatctggttccgaatcctgcttcaagcaaaaaaaaaaagaaaaaaagaaaaaaagaaagacctaaagtatggattacaatgggcacctcgatcgataaaaaccctattagaatacgggtataacaaatgttgatacccatatgtgttttattgggtcaattgttataccgatcgagtatggtgatcacgaatatgttctctgttgccttatatccgctactcgatagaaaacctgctaacatatgatatgtgtgttcgaattaaggagtttgttctctctcgtgcatgggctagtataatgttgacatttaatagtgaatgttgttgaccttatgatacatttatgttgggttcgatgaatttgtcatgctggcataaaacaatatgttattttagcatctttcaatattgataaggtatgagatttcaacattttatatttggagattacttttatgatttaagtgatcatgtgtaatgtaatattagtggatcgtggtgagaatgagtataacataattttgtatctatgatggacaatgggtatgtgtatgagacattttttttctagatgatataagtatgactttgcgtattagataccttacccactaccatcactagtcaaaatagaaataacgtcggagcaaaaacctgacctgacaccgtctctccataaaatgcaatccggtatttaaacttgtctgtctgtatcaatctagtttatgaaattttaaagtatgacttttagagttttatctctgtttgcatcctaatagattgttacgacccacatgtcatccgtcaaataagaagagagaaagatagacgggtctaaaagaccacgacactcatatgtgagttatagcagcccgttataacgtaatagagactaaaatagagattagacccttaaaaacatattttaaaagtgaacggattaatatagacaaataaatttaaagacaaataaatttaaaaacactgggagtgcactctactccatccttgctcctacaggttcagatctctcatcggcccccactccattagtccatttccattcccatcccgaccccgtcttgccaccggctacacgctctcggagtctcggacgccgcccaaatggaggccatccggaagcaggcctcaaagctccgggagcaggtagctcggcagcagcaggtgaacactacacgcctccccctttcgcaagatctccgccatccgttcctccgcgacccggccacggctcgcaccgcccggctcccgccctttctcttaacgcgggtccttcgagatctggtcatcatctctaggtttgttattgatcactgatgccgcgtccgtgctcgcggccgcccgtgtcctgtttcgcaggcggtgatgaagcagttcgggggcgggtacggcgcagacgggcgtgttcgctgacgaggctgaggcgcaacagcactccaagctcgagaaactctacatctcctacgcgcgcggccaaggcacctttccgggatgtagtcccctcgtcacggtggtacttaaatccgtctaggatctggatctgctaacataatgtgttgccttgtcgttcttcccagcacttccaaagggatatagttcggggcgtcgagggctacatagtcacggggtcgaagcaagtcgagatcggtggacagctgaaaccctgttgccatttcggtgaacacataaatttgaatttcgaaattgttaatttaatgtgctttgtgttaatagggaacaagttatgtgaggatgggaagaagtatggcactgagaacacttgtaccagtggtagcacactgtcgaaggcggcattaagttttgctaaggcacggtccatgatggaaaaggaaaggggtaacctgctgaaagcccttggcacacaggtattgcccattgttgcctttatatcggtaacacatgaatgcattgagttatggaatatgagccatgtatgagttccacaatacacttggaataattctaaatttattagagagtagacctgggaaatgtcacaagtgttggattaattgtcagtttgacacagaataagacacaagcgtttctgttggtttatctcttttttgtatcataaaaaatgtactagtagcaatgcttgttctgttttttttctttgtgatgtactgataggatagcaatgtatgttagtgtgatttattctaattaaataacttgtaaatttcccatcttattgcaagtgtatctagaacttgcaacagttaagtacttgaagtggattgaaactgccagtcatcaattaaatactgaagtggattggtagtgccagtttgaggaccttttctttatttcttattcttattcttaactggaagtccaaaatttttccatgtgtgccataatatcctttgtcactttgtacatttttcttaaaatcaaacctggacaaagcttgttttaagtaatacaaactgtcatcaggttgcagaaccactgaga

SEQ ID NO: 16020 - DNA, 1701 bp, Zea mays
gggtacctcgacgccggccgcctcgccgcccgccgggactatttactgcatcagcaccacccccgccgccagagccggcgccgtccgacttccggccatctcaggcacccgaactccgccccgatcccttgcttcaaaaagcaaaaaacaacaacaaaaaaaggactgaaagagaaagaacgccggagcgggagcctgaccctgacgccatctctccatccttctcctcctccctggttcagatctctcatcgtcccccgctgcattccatcccgaccccgtttgccactggtcacaccctctccatcgcttcctgccaccgaccacaccctctcgatcgccattcgccaccggccaaatggaggccatccggaagcaggcctcaaagttccgggagcaggtggctcggcagcagcaggcggtgatgaagcagttcgggggcgggtacggcgcagacggcgtgttcgcgaacgaggccgaggcgcaacagcactccaagctcgagaagctctacatctccacgcgcgccgccaagcacttccaaagggatatagttcggggcgtcgagggctacatcgtcacggggtcgaagcaagtcgaaatcgggaacaagttatgtgaggatggcaagaagtacggcaccgagaacacttgtagcagtggaagcacactgtcgaaggcggcgttaagttttgctaaggcacgatccatgatggaaaaggaaaggggtaacctgctgaaagcccttggcacacaggttgcagaacctctgagggctatggttatgggagctcctttggaggatgctcgccaccttgctcaaaggtacgacagaatgcgtcaagaagctgaagcgcaggctattgaagtttcgaagcgccaaatgaaactaagagaggcgtctggaaatagtgatatggtttcaaggctagaagcagctgagtcaaagctgcaagagttgaaatcgaatatgggggtattgggcaaagaagctgttgcagcaatgactgccgttgaggcccaacagcaaagattgaccttgcagcgtcttattgcattggttgaatcagagagaaactaccaccaaaaggtcctacaaattcttgatcaacttgagagagagatggtatctgagcgccaaagaatcgaaggagcacctccggtggttgagagttccatgcctccaccgcctgcatatgaagaagtcaatggtatattcatgagaaatacagttgcagaattggtcgagactgtggagtatttcttggctgaggcaatccagtcataccaagccgaaagcgataccgagctcaacctttcaactggtgactacatagtggtccgaaaggtgtcgaacaatggatgggccgaaggtgaatgcagggggaaagctggttggttcccctacgactacatcgagaaacgggagcgtgtgcttgcaagtaaagtcgcccaagttttctaagtcttccgctgagccatgtagtatccccggggttgtacaatgtgtgttgtttatgcttgtcatcttcagagaatcagaggagatctgtaattttgctgaaagctgcctgttgggtggtttgtttctgcctggccgccttaattgttcaaattcatgtggcaggaactgaatatattcattcttcagttatcctgtcaatatatataatttttttgtttgaagcacacaacaaaacg

SEQ ID NO: 16021 - DNA, 1626 bp, Zea mays
cctcgaggggccggcccgggaaaaaaaaaaaaaaaaaaaaaaaaaaaaaaaaaaaaaaaaaaaaaaaaaaggcagcttgggtacctccaggcccgcccaattagtccattcccattcccatcccgaccccgtcttgccaccggctacacgctctcggagtctcggtcgctgcttgccaccgaccacaccctctctatcgacgccgcccaaatggaggccatccggaagcaggcctcaaagctccgggagcaggtagctcggcagcagcaggcggtgatgaagcagttcgggggcgggtacggcgcagacggcgtgttcgctgacgaggctgaggcgcaccagcactccaagctcgagaaactctacatctctacgcgcgcggccaagcacttccaaagggatatagttcggggcgtcgagggctacatagtcacggggtcgaagcaagtcgagatcgggaacaagttatgtgaggatgggaagaagtatggcactgagaacacttgtaccagtggtagcacactgtcgaaggcggcattaagttttgctaaggcacggtccatgatggaaaaggaaaggggtaacctgctgaaagcccttggcacacaggttgcagaaccactgagagctatggttatgggagctcctttggaggatgcccgccacctcgcccaaaggtacgacagaatgcgtcaagaatctgaagcgcaggctattgaagtttcaaaacgccaaatgaaactaagagaagcatctggaaatagtgatatgatttcaaggctagaagcggctgagtcaaagctgcaggagttgaaatcaaatatggggggtttgggcaaagaagctttggccgcaatgactgccgttgaaggccaacagcaaagactgacactgcagcgtcttattgcattggttgaatcagagagaaactaccaccaaaaggtcctacaaattcttgatcaacttgagagagagatggtatctgagcgccaaagaattgaaggggcacctcctccggtggttgagagttccatgcctccaccgcctgcatatgaagaagtcaatggtatattcatgaggaatacggtcgcagagttggtcgagaccgtggagtatttcctggctgaggcaatccaatcatatcgagcagagagcgacactgagctcaacctttcagctggtgactacatagtggtccgaaaggtgtcgaacaatggatgggccgaaggtgaatgcagggggagagctggctggttcccctacgattacatcgagaaacgagagcgtgtgcttgcaagtaaagtcgcgcaagttttctaaaactaaaacttttgccgagacatccatatattcccggggatgtgcaatgtgtattatgcttgatcgtcagaagagaagatctgtaattttgctggaagctgcctgttggatggcttgttcctgcctggccgtctgcattgttcaaattcatgtggcaggaactgaacattattaatgcttaatcttcattcttcagttatcccgttaatatgtatccatactttttgtttgtttgtttgaagcatacaacaagacgagaaatcaagcgctaattattctgtatcgacagcaaaaaaaaaaaaaaaa

SEQ ID NO: 16022 - DNA, 1515 bp, Zea mays
acaggttcagatctctcatcggcccccactccattagtccatttccattcccatcccgaccccgtcttgccaccggctacacgctctcggagtctcggacgccgcccaaatggaggccatccggaagcaggcctcaaagctccgggagcaggtagctcggcagcagcaggcggtgatgaagcagttcgggggcgggtacggcgcagacggcgtgttcgctgacgaggctgaggcgcaacagcactccaagctcgagaaactctacatctctacgcgcgcggccaagcacttccaaagggatatagttcggggcgtcgagggctacatagtcacggggtcgaagcaagtcgagatcgggaacaagttatgtgaggatgggaagaagtatggcactgagaacacttgtaccagtggtagcacactgtcgaaggcggcattaagttttgctaaggcacggtccatgatggaaaaggaaaggggtaacctgctgaaagcccttggcacacaggttgcagaaccactgagagctatggttatgggagctcctttggaggatgcccgccacctcgcccaaaggtacgacagaatgcgtcaagaagctgaagcgcaggctattgaagtttcaaaacgccaaatgaaactaagagaagcatctggaaatagtgatatgatttcaaggctagaagcggctgagtcaaagctgcaggagttgaaatcaaatatgggggttttgggcaaagaagctttggccgcaatgactgccgttgaaggccaacagcaaagactgacactgcagcgtcttattgcattggttgaatcagagagaaactaccaccaaaaggtcctacaaattcttgatcaacttgagagagagatggtatctgagcgccaaagaattgaaggggcacctcctccggtggttgagagttccatgcctccaccgcctgcatatgaagaagtcaatggtatattcatgaggaatacggtcgcagagttggtcgagaccgtggagtatttcctggctgaggcaatccaatcatatcgagcagagagcgacactgagctcaacctttcagctggtgactacatagtggtccgaaaggtgtcgaacaatggatgggccgaaggtgaatgcagggggagagctggctggttcccctacgactacatcgagaaacgagagcgtgtgcttgcaagtaaagtcgcgcaagttttctaaaacttttgctgagacatccatatattcccggggatgtgcaatgtgtattatgcttgatcgtcagaagagaagatctgtaattttgctggaagctgcctgttggatggcttgttcctgcctggccgtctgcattgttcaaattcatgtggcaggaactgaacattattaatgcttaatcttcattcttcagttatcccgttaatatgtacccatactttttgtttgtttccttgaagcatacaacaagacgagaaatcaagcgctaattattctgtatcgacaacaagatttatttg

SEQ ID NO: 16023 - DNA, 1685 bp, Zea mays
aatctcaggcacccgaactccgacccgatcccttgcttcaaaaagcaaaacaacaacaataactgaaagagaaagaacgccggagcgggagcctgaccctgacgccatctctccatccttctcctcctccctggttcagatctctcatcggcccccgctgcattccatcccgaccccgtctgccactggtcacaccctctccatcgcttcctgccaccgaccacaccctctcgatcgccattcgccaccggccaaatggaggccatccggaagcaggcctcaaagttccgggagcaggtggctcggcagcagcaggcggtgatgaagcagttcgggggcgggtacggcgcagacggcgtgttcgcgaacgaggccgaggcgcaacagcactccaagctcgagaagctctacatctccacgcgcgccgccaagcacttccaaagggatatagttcggggcgtcgagggctacatcgtcacggggtcgaagcaagtcgaaatcggtggacagctgaactcccgtgtctcttttattgaacacatgaaatttgaattcggaattgttagtgtaatgtgctttgtgttgttcagggaacaagttatgtgaggatggcaagaagtacggcaccgagaacacttgtagcagtggaagcacactgtcgaaggcggcgttaagttttgctaaggcacgatccatgatggaaaaggaaaggggtaacctgctgaaagcccttggcacacaggttgcagaacctctgagggctatggttatgggagctcctttggaggatgctcgccaccttgctcaaaggtacgacagaatgcgtcaagaagctgaagcgcaggctattgaagtttcgaagcgccaaatgaaactaagagaggcgtctggaaatagtgatatggtttcaaggctagaagcagctgagtcaaagctgcaagagttgaaatcgaatatgggggtattgggcaaagaagctgttgcagcaatgactgccgttgaggcccaacagcaaagattgaccttgcagcgtcttattgcattggttgaatcagagagaaactaccaccaaaaggtcctacaaattcttgatcaacttgagagagagatggtatctgagcgccaaagaatcgaaggagcacctccggtggttgagagttccatgcctccaccgcctgcatatgaagaagtcaatggtatattcatgagaaatacagttgcagaattggtcgagactgtggagtatttctcggccgagtgcaatccagttgctgtcggccgaaagcgataccgagctcaacctttcaactggtgactacatagtggtccgaaaggtgtcgaacaatggatgggccgaaggtgaatgcagggggaaagctggttggttcccctacgactacatcgagaaacgggagcgcgtgcttgcaagtaaagtcgcccaagttttctaagtcttccgcggagccatgaatccccggggttgtacaatgtttgttgtttatgcttgtcatcttcagagaatcagaggagatctgtaattttgctgaaagctgcctgttgggtggtttgtttctgcctggccgcctgcattgttcaaattcatgtggcaggaactgaggtaccgtttggttcaaatatttgtaacgtaatgggtaaatgataacgttaaatcaaaaaaaacgaca

SEQ ID NO: 16024 - DNA, 3006 bp, Zea mays
cctttattagtccccatccacctctttttttccttttgccaagctttgcacatgtctagaattctagatgtcctcgtcacaagctctttttcatatccttgtgaccttgtcaatgaagccttagcctattaattccccgggtttcctggagatctaaacactttttatttctcatgctagcttggtcatgtttttttcactacagtatgattcaattgcagagtttgttcttgcgtcaagctggttattaaatattcacctctctgtttattttgtttttgtctactatgttgttgcaggcaatgggaccgcactcgtgctcttcctctccccagtgtaagaatcaattcatccatttgtgtctcagtgtacagtaagaaacaaaaaaaattaaaaacatgcaacaatataatcatagtactagtacgtgtgcatagatacatacaattcgtacgacgtatgcatggcatgtatgaccttttcttaatttcttgttcttatgtttaatgagagtccaaattttacccgtaagtgccataaaatcctttcatacttcgtacatttttctaacaatcaaacctggacaaagcttgttttaagtgaagcgaactgagatcaggttgcagaacgtatggttatgggagctcctttggaggatgctcaccacctcgcccaaaggtacgacagaatgcgtcaagaagctgaagcgcaggtgatttcgctatgtattacactattgcataatgaccgcaggaatggcttcagaggcggccagtagccggcacacagctacctggtggatggcgtcttgtccttcaggtgtctcacggggtgaggaggtgagggagtatgagtgggggtataggagagaaatcctattgggtttgagcctaacagctagcccagtaagtttagttggccaaaacagctagtcagatgattaattaggttaccaggtttctaatcgctctggtcgagtcggagtgcccagccgagtgttggggaccagcggccagccaggacaattaatcagatgactagataacattgcatggtacaccttacgtttctcatagttaactgataaaacatttagaatcaaggcatgctattttaggatatggcatttgagtgatctaactagtgccacatttgatgcatgtgtgtaactttcttttcttttttggtacacttgtgctggaattcaaaactgtatgttctgttttcagctgagcttttagtctgttatctgttgcactgagaccagatgaagtagttgagaacttgagacatgactaaaataatcaattggtgtagcaagtagttatattgataacttattaatcaatatcattttcagatttggttttactcggccggggagggaaagaccgccctcccggtaatatattaagaagagactgaaacatgatctcggctgagaaaatccccgaaccctggccccccatcgctagcgggccgtcaccgcccactctgcaatggcccagtcagatttggttttaaatgtgcagtgataatcgaaccagaccctcgccccttcttgaaattacattgttgagaatttttttctccacttattcttctttccaaatattgctcagccacttgcgtttcccattttattcacaaagctttttagttgcacgagaccattacctagaacatcctaacaaaatcttttttttttgttcctgtgatgaactgagagagttggtttttgagttctgcaggctattgaagtttcgaagcgccaaatgaaactaagagaggcgtctggaaatagtgatatggtttcaaggctagaagcagctgagtcaaagctgcaagagttgaaatcgaatatgggggtattgggcaaagaagctgttgcagcaatgactgccgttgaggcccaacagcaaagattgaccttgcagcgtcttattgcattggtacattatttgtctagttgggtgatttgggccacttgactttttgtttgtttgtcttgaagttgtctattgtgtctcataacatttgtggacttaattgaaggttgaatcagagagaaactaccaccaaaaggtcctacaaattcttgatcaacttgagagagaggtctgatggtttcacatccacatcctttccatccttgcccattgtgctaaagaaagtttacaacttcaagaaaaatctggtcggttatgttatcttgattgagctttcttattttttttctagatggtatctgagcgccaaagaatcgaaggagcacctccggtggttgagagttccatgcctccaccgcctgcatatgaagaagtcaatggtatattcatgagaaatacagttgcagaattggtcgagactgtggagtatttcttggctgaggcaatccagtcataccaagccgaaagcgataccgagctcaacctttcaactggtgactacatagtggtccgaaaggtagtgctttcagatttctcttacacgtcatttacgaattgctcatgtagtcatgttatgctgcggccagcttcacacatattggttgcccatttcatgagtatctcaatcacatttcacattgtacccgaacttgattaccgaatttacataaaaaaccctttcctaatcaggtgtcgaacaatggatgggccgaaggtgaatgcagggggaaagctggttggttcccctacgactacatcgagaaacgggagcgtgtgcttgcaagtaaagtcggccaagttttctaagtcttccgctgagccatgtagtatatccccggggttgtacactgtgtgttgtttatgcttgtcatcttcagagaatcagaggagatctgtaattttgctgaaagctgcctgttgggtggtttgtttctgcctggccgccttaattgttcaaattcatgtggcaggaactgaatatattcattcttcagttatcctgtcaatatatataatttttttgtttgaagcacaaaaacgaaaaaaaaaaaaaaaa

SEQ ID NO: 16025 - DNA, 1424 bp, Zea mays
ctagtgaactgagaccacacaaacaaggcacggagctgtcggcatgaatcacgttctagtgttctacagttcgtcatagttcccgtgatggtcgactgattgacactgccaacctcccaacttcccaaatatatcgtcgtcggtcaatgtcgacgagctcgcagtgcacgctcatggaaggcgctatctcccttcctcgcaacacaagaattgccgtggttaccggcgcgaacagaggtatcgggctagaggtgtgccggcagctggctggcaatggcgtcaccgtcgtcttgacagcagtggacgaggagctaggcgcgaaagccgtcggcaatctccaagggctagctctctccgatgttctttctcaccagctggatatcacggatgcttccagcatcgctcggttggccaacttcttgaaggcccgattcgggaagttggatatcctggtcaataatgctgcggttgctggggtcgtgtactctcaagatcatttggatgatctagaaccgagagaggaaaagttcaatctcatggatagggatcagaggcttgaatggctgtggaggaactgccgggagacctaccatgctgcaaaggaatgcctgcagacaaactactacggcacaaagcatgtgatcgaagccttgctgcctctgctgaaagcctccgatgatggaagaatcgtcaatatatcctccgactttgggttgttaaggcatttcagaaacgaggatctgaagcaagtgctgaacgacgtcggcaacctcaccgaggagcggctggacgaactgctggaccagttcctgagagacttcaaggtcggcacggcagaagcgcgcgggtggccagtggcgttcgcggcgtacaaggtgagcaaggcggccgtgaacgcgtactcgaggatgctggcggcgaagcagcccgcgctgcgcgttaactgcgcgcatcccggctacgtcaagactgacataaccttacactcggggctcctggcgccggaggagggcgcgagtaatgtggtgaaggtggcgctgctgccggacggcggggtgaccggcgccttctttgaggagggcaatgagctggcctccttcgtgtgatgtcaggatcggcctggttcgctagctgcggctgtttgccatcgcgtgagctcacggagtgtttggacccctcggtctgatgtttaagtgtgtggtagcaggatgcaagacgattctggtaataaactgattatgtttgtgaacggtgataacctgatgatgtatgtgttgtaaatttagagaacggtgataacctgatgatgtatgtgttgaaaaaaaaaaaaaaaaagtgacatgcttccttcaaataatataatcagacatgcattcactaacacctatgcgcagactctatgacatttcctcaagaagacggat

SEQ ID NO: 16026 - DNA, 2377 bp, Zea mays
ctgagaagactttgatgaagtgtgcttttgcaaatttgatgagttggtaatatccatatgtcattactatagactggtaacatggtcgataaagctgaaagaaaatatgggcatcacacttgtaatgtgttgctgacaattactccactagtaaattgcttcgaaccatcagtactgattatttgaagtttgggcataacaggagggaaaataggaaaagactaaggccttgttcgtttctatcggattgatgggtcggaacgattcctaaccggattgcttctctaatttatataaactttgattaggtggaacaattccgggtgcaatccgatagaaacgaacaaggcctaagggaaacatgtcaaatgttctaatgaacatacatgtaacacgaaattgagactcaccttgaacatcatatattactgcagggcagccaaataccagtcacttgtacttagagggatccaaatcaatgcataatcgtgggtgacatgactccatattctgacaggcaatgtgaagcttggaaaggaaatgaaacattgaaaccctaactattccctatgtcagccctattaagaataatataacttaacctcaagagttaattattctatcgcttggctagtcagatcagaatatttcccaaaggaaataaagaatagctttttttccttattgtagattacggcaatgaggcaaggtcaacaaaattatcaaccagaacagcatcaagaaatgaccagtggaactaatgggactcatgctgaggctggaaggtttctgactgtccaaagtacactataaagtcaccaccacctgaagatcaatctcatgctcagtaggaacagacttcccaggatcatccttggattgcaaaccaagagattcatttaccgaatcagtttcaggtgtaaggaccagtgcctcattgccagatatcctactgctgttgaagtgttctgctagacagtcacctgaatcttttggacttccattgttgtccagctctttagaactattttcattaccgttctcttttagacagttatgattatcaagttcttccaagatgttatgactgacaagcttcaggctactaaaaccgtcaagttccataggacatggtatttctttaggagaaaacttgctatttgtagtacagtcaagctcctcttgactgttatggctgtcgagcagtttccaactgttatagctgtcgagtgctttccaattgttgtctccatctagttcatttagacaattattatccttcatctctttgtcacttctacagttgccaggatctttcagattgatgtgactgttgagatccccgcgtacctcggccgccaccacgctctttctcagagccaagatcgtcaagcgccctcaactcattatggatgtctgcctttctcaaacttttaatcgtcctctagatctttcctcagtgctatgagcatcaaactctttcgaacagccatgatcattcagctcctctagacagttatcgtaactgaattctatctcagtaatatgaacattgagcccctgctcaatttcatgatcatgaagctcttgcagactacccggagcaccaagatctttgggacaattgggatcctcatcctccacaaacttgccaacacattgatctacaaacttgatgcaatgatcctcatctgactggcctttgacaactgttacagtctctgcatacgggcagacaggtagacttatccggcggcatctatggcacttgaaaccaatgagattgttcacattctcaatgttaacagaatatatatccccatggaaccagtcttcacatttttcacaggcaatatagatatcctcttcattatagcatttttcacacaagcagcatactgggctgacttcagaaatttcagcatcttctgatggaaaaactactctttctttcctgaaacttcttgctcgttcatcatgtggattttgtgaccatcggaggccattcaaccagtatgaatactgtgaaacagtcctcttcctcttgctagagctagctgcattctcggatacatttgagttacttttcatgtatttatcatgtaatcgttttgatatacgtttcactggttcatttttggaaacatttgatggttcactttcatggatctttgatggttcattctttgacagatccgttgggttcttcctgggccggccacgcttaccctttttgccaattttcgttttgcatttcagaactatctgattcctcctggtctcaatcttgcgtgattgtttcttttgtttcttctgcttctttttgggagacagcttctttggtgcagtctttttctgaggagactccacctcgagc

SEQ ID NO: 16027 - DNA, 814 bp, Zea mays
cattgggtacctcgaggccggccgggaatctatctattctaccattctacctcacctgacccgccggtgcctcaaccgcttccgcgcggccaacgcgtcttccggtctgccccgtcggcgataatccgccgcctagcaaagcggccgagccgagccgatggcgctggcgctggccgggctcccccacgccgcttcccgcctcgtgcctcgtgtccgccagcctcccttccgcgctctctgcgccgcagctgcggccggcgatgcctcgaagcggatgctggtactgtacaccaagccggggtgctgcctctgcgatggactcaaggagaagctccacgccgcgtccatgcttgctggcacgccctactcactcgcgtctctcgagctccaggagagggacatcacgacgaatccggagtgggagcggctctaccagtacgagattccagtgttggccaaggtgctccccgacgggaccgaggaagtacttcccagattatcgccacgtctaagtgttgagctcgtacaaaagaaaatttattttgcgtttgatcagtagggagaccgttctgggggaaacggtaattttattttattaattaatagctccagctgtaagattgccagttgttatattttcatgattttgacacatgaatttcaatttgcttgacttatgtttgcaaggaattactttaggtttgttcattgctctgatgaaatataaattatatggagtgacatccaaataaaaaaaaaaaaaaccgacctcgagaaaaaaaaaaaaaagaaaaaaaaaaaaaaaaaagcggcc

SEQ ID NO: 16028 - DNA, 872 bp, Zea mays
ctcgggtcttttgcgggtacctaggagccggccccttcagtccaattcgcaaccgcacatctctggccaccaccaccaccaccaacagctccagaggctgtctactccactggacgctcccaacataccattcatgttcagctcggccgcggctgccgctgcggcggccaccacgcccaccacggccgagggccagttcgccgcgttccagctctggaacggtttccagcacgcagacatgaaggagaagggcaagaactgaccgacacctgcccatcgcggtgcagtgctatctggatggatgtgaaggcatcaaataattgcaacctgtccctgcaagcaccatttcattgctcgaagctgccataagtgcgttggggacgatgtttccccgaattctttggaagcagattcatccttcagacacttgtactctggtcatcactgaagaacctcatcgtccttactctgacgaccttctggacttcttttttccgcctgctgttgtacccatttcctggaggtgagattctcggagcgtgatttgccagtgtgccctgtcagaaaagccattgtaatcattcccattctgaactttaccaatgggtggagattcgattcggccccttgatcggcccgctctttcgagtttcggggatcagttatatccctggcatttttatggttctcggttgtgtgttgtacgagaaagtgagaggactcctatgaatggattgaactcatatgtgggcaactttgtgcccccctgttgtgtgctgaaatactggcataatgggagtctcagatgtaaatttgctttcttgttttgcagcgattatttcgtattgctctcgaaaaaaaaaaaaaaaaaa

SEQ ID NO: 16029 - DNA, 1137 bp, Zea mays
ttttttttttttttttcaacagtttaggcatcatttgccgactcatgaagaaagaagataacaaggcatgtggagtggattgagtgccatactgccatctgctgcgacgtgaaagcaagcacatcacatggtatggtgaactgaactctacatatgagggattacaagtttgcatataccatataccaccatctgcaattgttctaccgcactgggtataacaatacaacaacgtacgcgcagtcagacgcagattagaagcaaagaagtagatgcagggaggtgctgcatgcatctcatacaacaggtcatctccgtttgctggtgctgccaagagacagagtaaccctagcggcgccattcttccagggttggcgtgtccactccgatgttcttcatatccctgatattggacaaatggatttctggtcttgcagcagctgttgcatcaattagaaccgtaactttctcatagtccagtgctatagcatcgaacacagtctgccgaatgcaatttggtgtctgaactccaacaataaccaagttctttattcctgcagttttcaggacagaatcaagatgtgttgcgaagaaagcactaaatctagtcttcaccaacttgtattccccttctttgataacaagcccatcagccagctccgctcctttcagacctttcactgttggaccctttcccccagaataatggtgcctacggaaaagttcaacatctcttccagaagggtcatgctctctgacaacccagacgacgaaaatgccgcgctcccttgcgacggcgacggccccggcaacggcagggacgacggcctcgccaccggccaccagcatcgggctgcgcatcgccgggtccacgaagtccttctgcatgtcgataacgagcatggccgtctcgctccacttggcggccgccatgttccgcctcgatttggcggggggccttgggacggtggcgccgctgccgccggagaaccagcggcgcttcaggtagtggaagaggaacttgtcgaaagagaggagcagtaccagcaggcacgacagcagcgccagatgtgatggcataaatcgccagcgaaaaaaatgggcaaaacaaaaacagaaaacgataaggattcgatc

SEQ ID NO: 16030 - DNA, 785 bp, Zea mays
ctgtgcgccgctcgaggcggccgggttgcgacacccgtagtttcaattatcataacctccgactccgacgatctgaactgtgaagatgagcacttatccaccgccgacgggggaatggaccaccggcctctgtggctgcttcagcgactgcaagagctgttgcctgtcgttcttgtgcccgtgtatcccgttcggacaggtggcagaggtcttggacaagggcatgacatcctgtggtctggccggcctcctctactgtttgctgctgcatgccggggtggctgtggtcccgtgccactgcatctacacctgcacctaccgtcgcaagctccgggcggcgtacgacctgccgccggagccgtgcgccgattgctgcgtccacatgtggtgcgggccatgcgccatctcccagatgtaccgggagctcaagaacagaggcgccgacccggccatgggatgggaagtgctctcgaaaaagacgactatggctcctgtaccaatgcaagacatgacgcgctgacgacagcaactcgatctcctagcaaaccaggattacgtgttgcatatatgcacagtttgtgtgttatgtggctatgtcagcaagtaaatggatcggagtctatgagtggataaatttaagtggatgtgttcgcgtcttagtaataagtgaataaaatttcataagtgttacttaaatatgtaaatagggtacatgtatgtttgtatcccattatgaactatttgtaataataactatatataccaaaaacacaaaaagagcggcc

SEQ ID NO: 16031 - DNA, 841 bp, Zea mays
gccggccggttcgggatcaacccattacccgtagtatcaatcatttactataacctcccactccgacgcgcgatccggtctgtgaagatgagcgcgtatccaccgccgacgggggaatggaccaccggcctctgtggctgcttcagcgactgcaagagctgttgcctgtcgttcttgtgcccgtgtatcccgttcggacaggtggcagaggtcttggacaagggcatgacatcctgtggtctggccggcctcctctactgtttgctgctgcatgccggggtggctgtggtcccgtgccactgcatctacacctgcacctaccgtcgcaagctccgggcggcgtacgacctgccgccggagccgtgcgccgattgctgcgtccacatgtggtgcgggccgtgcgccatctcccagatgtaccgggagctcaagaacagaggcgccgacccggccatgggatgggaagcgctctcgaaaaagacgactatggctcctgtaccaatgcaagacatgacgcgctgacgacagcaactcgatctcctagcaaaccaggattacatgttgcatatatgcacagtttgtgtgttatgtggctatgtcagcaagtaaatggagtctatgagtgggtaaaattaagtggatgtgttcgcgtcttagtaataagtgaataaaatttcgtaagtgttactaaaatatgtaaatagggtacatgtatgtttgtatcccattatgaactatttgtaataataactatatatacaaaagttgtggaattagcttgcagtaaaaaaaaaggaaaataagtgatacctataagaaaaaaaaaaaaaaaaaagcggcc

SEQ ID NO: 16032 - DNA, 1074 bp, Zea mays
gtgtggtgtgtctgtgctgtggtttagaaaagggagagagacagagagagagagagaaaacggacgcagcggaatatgaagagcagatggtgccgttgtaagtgtaacgtgccggttggcacatgaacgtacgcaacgcaactgggcagcatcacacgagtctcctcctgtctcccacgtgatgagttcgccacgccctcgctgtcgacgtgccgttgcggccgcgggggcgtgcgtgcggtgcggccgtgcgccactgcacccgccatgcgcgcgcgcggccggcagcccggacagacagcgcatagattccggcacacgggcgtcctgccaaccacccgtacgtcgtcccatccacgcggcctcgctggcacgccaccaacccggcccagcggacccgaggccgcagccgatcgcaccgccgcggcgccatccctccctccataaactcccgccccccgcagaccactccccctcatttcgtcgtgagccccagcgtcccgcgctcgcccggaagcacatcaacaccagacagcactacagtctacagcagcagggcaccaccaccacagcaatgcagcagaacgccgcccgcctgctggccgccgccgtggcctgcctggcgctggcgctggcgccatcctcggacgcgcaggggacggcggtgccgtcgtgcgcggcgaagctggtgccgtgcacggggtacctcaactccacgtccacggcggcgcccgcggcggcctgctgcgggccgctcagggaggcggccgccaacgagacggcgtgcctctgcgccatgctgctcaacagggccgcgctgcgggcgttcggcgtggcgcccgagcagggcctggtcctcgcccggcggtgcaacgtcaccaccgacgcctccgcctgtgccgccgccggaggtataaagctagctagatcgcgtgtcgtcttccttcataccgctgccgccgctgctgctgctaagtactcattcgatcacaactggctaccacaatgagatccaaacctctccaagatctggatctcattaattgggctgctactagcagaatcatgacctgt

SEQ ID NO: 16033 - DNA, 892 bp, Zea mays
gccggccgggtcgcgggaaactgaaacactccccctccctcagtagtcaaccccagcgtcccgcgctcgcccggaagcacatcaacaccagacagcactacagtctacagcagcagggcaccaccaccacagcaatgcagcagaacgccgcccgcctgctggccgccgccgtggcctgcctggcgctggcgctggcgccatcctcggacgcgcaggggacggcggtgccgtcgtgcgcggcgaagcttgtgccgtgcacggggtacctcaactccacgtccacggcggcgcccgcggcggcctgctgcgggccgctcagggaggcagcggccaacgagacggcgtgcctctgcgccatgctgctcaacagggccgcgctgcgggcgttcggcgtggcgcccgagcagggcctggtcctcgcccggcggtgcaacgtcaccaccgacgcctccgcctgcgccgccgccggaggctcagccacgggcggcagtactgctgcatcttcagcttccaccggcagcgcttcctcctcctcctcttcttcttcagtggccaaaccaacagccaacggaggcggcgtggcgcgtcgcctgagcatgactggcgcgtcctcattgctaggcttcagtttcatctggtggtgggcggtcatggcgtaggagtatctgccgtggcaccggcgattttcctggctggatccagaattccagacttatatgtactactgttgagtagcaggtttcattgcttctttttatatataatatgccctgttgtaccactaccattgatgccgtgagcagaacaagagaaaaaaattgtcaagaacgatgcaaacaaccagaaggaaagaacgtactctcattttaaataattaaaaaaaaaaaaaaaa

SEQ ID NO: 16034 - DNA, 898 bp, Zea mays
attgggtacctcgaggccggccggggcaaatgttttttaacaggttggatgctctgcacggaactttttaattttcttcttgagcgtaatctctttttgcaaagaggccgccaactcttgtaccatcacggcgtcggagggccagtcgacctctctgctcgcgaaaaatggcggcggcagcggaaggtttggctgcctacagggcggtgctgcgggcggcgcggcggacgttcgcgggcgaccagctgatgctgaaggagtctgcggtggagatccggcgccgctttgaggaccaccgtggtctaaccccgggctccgacgatgcagcgcgtgccctcgccgacgcccgcgaggcggcgcacttcatcacccatatgatagtccaggccacacgcgcaccctccggatccttcgttgtgaagcctgagagtgttcatgctggagctacactggaagttccttccgaggagatcctttcaaagttgaagtaggtcactagcattgctgaagtaggtcaccatcttcatgctagtaaaataagaccagtttgcaacggttgattcttgtgttgcatactggtgcacttagtagcttcacacttttgcttttattattattattattattactgagagcatttagcggcaccaaggtaccggtgtcttcgatgcaaagtagtgtgaaacggctattgaggtttttgaaaatcgactgtatgatgaggaattatgcaaataggaaaattgcagtgccgtggacttgatcaaaaaaaaaaaaaaaaaagcggccttgttgttgtcttgtttgcgagagcgtgaggtgctggagatacgggtcctgcgtcctttggccggacgtgaaacgacggcgaagggggcaggcagacgtgccaccatcc

SEQ ID NO: 16035 - DNA, 1414 bp, Zea mays
ccggccgggatagctctactcctatatcttagtggtgacaatttccccgtgcggcagccagaaaactgcactcgaatccgagcagccacaattgtttttatgacaaagacaaggccctcaattccactctgcccgagcaagccgaattgtcgcccgaattcgctcgcggggagcacttgctacctcgcgcccgccttctgtcgcgcggattcgttgctgcgcctggagatggacccgatggacatcgtcggcaagtccaaggaggacgtctccctccccaaatcaacaatgtttaagataattaaggagatgcttcctcctgatgtacgagtggcaagagatgcacaggatcttcttgttgaatgctgtgtagagttcatcaatctcctttcgtctgaatcgaatgaagtgtgcagcagagaagagaaaaaaacgattgctcctgagcatgttatcaaggctctaagtgatcttggcttcagagagtacattgaggaggtttatgctgcatatgaacagcacaaacttgatactttggattctccaaaagctggcaaattcactgggattgagatgacagaggaagaagctgttgctgagcaacaaaggatgtttgctgaggctcgagcaaggatgaataatggagcccccaaaccaaaggagacagaacaagagccgccacagcaaccacaagcacaaccccaacttcagctgcatactgaaccacagcaacccgtggaatctcaagtgcagttgcattcgccaacacagcattccctccaacctcaagtgcagctgcacccccagccacaacagcttccacaagtgcaggtgcactctcagacgcagctgcaccctcagccacagcagccccaagtgcaggtccatccgcagctgcagcaactcccacattacaggccccactcgcagccaccgcaacccaagtgcaaatccacccacagccgcagcagtccccacaagtgcagttgcagtcatcagtccagcagacctctccaaccccaacttcaggtacatctgcaatcacagggggccctcacaatcgcagctgcagccccaactgccaggtcagctgcagacacaggggcaaaccggacctggcattgacagttagagactgtactgctggcatctactaggaacctgtatgcttgcttgtgactcgttagatcctgatttaggtttctgtgcttcctgtacaatgtaaatccagtgtgattgcagttgccttgttgctaataatgcgaaaccgttagttactgattatgtccttactgtgtcgaatactgaatgtcatggcgtggcttatgtgccatgctgaatgatgttctgtggtcattgtaatagcctaacttgacatctgtccatgatgatagtgattgatttgaatgagccc

SEQ ID NO: 16036 - DNA, 1494 bp, Zea mays
gaggctcggccgggaaaaaaaaaaaaaaaaaaaaaaaaaaaaaaaaatgccaaccttctggtagggtgctgctgttggtggccctcgctgggctggcattgtgaatggtggtggtggtggtggcagctttggtgctcctcgccagggccatggtggcggaggcgggggccgtggtgcttggaactcccgtcctggtggttgggaccgcagagaccgggagccagatccgtttgcgaaagccgaggctgaagaaattgatttcgacggccaggagaatactggcatcaattttgatgcctatgaagacatccctgttgagaccagtggccatgatgtgcctgcaccagtcaacacatttgcagagattgatttgggtgatgcattgaatgacaatatccggaggtgcaagtatgtgaaaccaacaccagtgcagcgttacgccatcccaatctccattgctgggcgggatctcatggcctgcgcacagactggatccggaaaaaccgccgcattctgttttccaatcattcgggcgaccttgaagtcaccaaagccacaccagaggtcacggagtacaaggaccgcttgtcctctagctctgatcttatcacccactcgagagctctcagtccaaatccatgaggaagcaaggaagtttgcataccagactggtgtcagagtcgtggttgcatatggtggtgcaccaataactaaccagctgagggagttagagagaggtgtggaaatcctggtggcaactcctggtcgcttgatggatctgttggagagggctagagtctcacttcaaatgataaagtatttagctcttgatgaagctgatcggatgcttgatatgggtttcgagccacagatacgtaaaattgttgagggcatggacatgcctcaacgtggtgagaggcagacaatgttgttcagtgcgacattcccaaaagagatacagaggatggctgcagatttccttgctgattacatctttcttgctgttgggagagttggttcaagcaccgatttaattgttcagagggtggagtttgtcctcgattcagacaaacgaagctacctcatggatcttattcatgcacaaaaggctaatggcacacatggaaagcacgctcttacattggtctttgtggagacaaagaggggggctgatgccctggaggactggctttttagaaatggatttcctgcaactagcattcatggagacaggacacaacaggaaagggagcatgcccttaggtccttcaagagcggagcaactcccatccttgtggcgactgatgttgctgctcgtggtcttgacataccacatgttgcccatgtgattaattttgacctccctaatgatatagatgactatgttcatcggattggaaggactggacgtgctgggcaaatctggtcttgcgactgcatcttcaactgccgcaacactacgttgcaaggccgttgagtgatccatgaaagagg

SEQ ID NO: 16037 - DNA, 1549 bp, Zea mays
gcgcctcgagcccgcgggctggtgcctctccgttcacccgggtctcgctttcctttcccgttcaccccaagcccccaacctgcgagctgcgacaagttcgtctctctcgtggccacgactggccgccgcccccgcctccgtcccctcgcagattcccaggtcttcgccgctcccttcgccgccaaagagcacccactaggttaaatccgccagggggaaatctccatcaagtggctcgtgctaattatgcgatcttcatgggctgactcagttgcgaacgccgaggaatcggcgcccgcgactgctgctgctaatggctctgttgcaactcatagcacctcgcgccctacgcgcagctcctacgtgcctccacatcttcgtggccgctcagctggtgctgctgttgaagctcaagcaggcttagtagcaccagcacaaggtggaccactgccattggctgctgcacaaccttctggtcagggtgctgctgttggtggccctcgctgggctggcattgtgaatggtggtggtggtggtggcagcattggtgctcctcgccagggccatggtggcggaggcgggggccgtggtgcttggaactcccgtcctggtggttgggaccgcagagaccgggagccagatccgtttgcgaaagccgaggctgaagaaattgatttcgacggccaggagaatactggcatcaattttgatgcctatgaagacatccctgttgagaccagtggccatgatgtgcctgcaccagtcaacacatttgcagagattgatttgggtgatgcattgaatgacaatatccggaggtgcaagtatgtgaaaccaacaccagtgcagcgttacgccatcccaatctccattgctgggcgggatctcatggcctgcgcacagactggatccggaaaaaccgccgcattctgttttccaatcatcagtgggatcttgaagtcaccaaagccacaccagaggtcacggagtacaaggaccgcttgccctctagctctgatcttatcacccactcgtgagctttcagtccaaatccatgaagaagcaaggaagtttgcataccagactggtgtcagagttgtggttgcatatggtggcgcaccaataactaaccagctgagggagttagagagaggtgtggaaatcctggtggcaactcctggtcgcttgatggatctgttggagagggctagagtctcacttcaaatgataaagtatttagctcttgatgaagctgatcggatgcttgatatgggttttgagccacagatacgtaaaattgttgagggcatggacatgcctcaacgtggtgagaggcagacaatgttgttcagtgcgacattcccaaaagagatacagaggatggctgcagattgccgtccccgccacgcccgcctccccgcccgccgcggatccgcccgccggcgacgccatggatgccgaccccgcgccccccgccggggaggaggccacgccgcagaagcagcagccggagaagaagcggcccggccggaggaagaagggcgaggcg

SEQ ID NO: 16038 - DNA, 1456 bp, Zea mays
ttgggtacctcgccgccggccggacctcggctctttctcgctttctttctcccgttcacgccggctctacctgcgataggttcgtctctctcgtggcaacgactggccgccgccctcgccctcgcccccgcccccgcgcaggttcccaggtcttcgccggtcccttcgccgccaaagagcacccactaggttaaatctgccagcaggacatctccatcaagtgactggtgctaattatgcgatcttcatgggctgactcagttgcgaacgccgaggaatcggcgcccgcgactgctgctgctaacggctctgttgcaactcatagcaactcgcgccctacgcgcagctcctacgtgcctcctcatctccgtggccgctcagctggtgctgctgttggagctcaagcaggctcagtagcaccagcacaaggtggaccactgccattggctgctgcacaaccttctggccagggcgctgttgttggtggccctcgctgggctggcattgtgaatggtggtggtggtggcagcgttggtgctcctcgccagggttatggtggtggtggtggggggccggaggccgtggtgcttggaactcccgtcctgggtggttgggaccgcagagaccgggagccagatccgtttgccaaagccgaggctgaagaagttgacttcgacggccaggagaatactggcatcaattttgatgcctatgaagacatccctgttgagaccagtggccatgatgtgcctgcaccagtcaatacatttgcagagattgatttgggtgatgcattgaatgacaatatccggaggtgcaagtatgtgaaacccacaccagtgcagcgttacgccatcccaatctccatcgctgggcgggatctcatggcctgcgcacagactggatccggaaaaaccgccgcattctgttttccaatcatcagtgggatcttgaagtcaccaaagccacaccagaggtcacggagtacaaggaccgcttgccctctagctctgatcttatcacccactcgtgagctttcagtccaagtatgtcaaaccaataaacatttattcagtagtgctttctttaaatctttctgatttttactgttttctcttctaactattgatgtcttagatccatgaagaagcaaggaagtttgcataccagactggtgtcagagttgtggttgcatatggtggcgcaccaataactaaccaggtacccattttgttgttgatgtgtttctattgtgattcctggtattttaattgctgcctatatcttcacctattttatgtttggtaattattgtggttccttccagtttaaattatcaatgatgtttttccactttggaatatctactgctgtaaactttattttttacattggtattttcctgtaagaataaagtgttatttatatggcacttagtgtaaaactctgcaggggt

SEQ ID NO: 16039 - DNA, 1464 bp, Zea mays
acactctgaccgagcgcggattcgttctattcctatcaggacttcaacgccttatttgtacccgccttaccgcgcgccctaaccctaggccctcaattccactctgcccgagcaagccgaattgtcgcccgaattcgctcgcggggagcacttgctacctcgcgcccgccttctgtcgcgcggattcgttgccgcgcctggagatggacccgatggacatcgtcggcaagtccaaggaggacgtctccctccccaaatagttgtttaaaatcttctactgctgattgaactttctgctttgcactttagcaacaatgtttaagataattaaggagatgcttcctcctgatgtacgagtggcaagagatgcacaggatcttcttgttgaatgctgtgtagagttcatcaatctcctttcgtctgaatcgaatgaagtgtgcagcagagaagagaaaaaaacgattgctcctgagcatgttatcaaggctctaagtgatcttggcttcagagagtacattgaggaggtttatgctgcatatgaacagcacaaacttgatactttggattctccaaaagctggcaaattcactgggattgagatgacagaggaagaagctgttgctgagcaacaaaggatgtttgctgaggctcgagcaaggatgaataatggagcccccaaaccaaaggagacagaacaagagccgccacagcaaccacaagcacaaccccaacttcagctgcatactgaaccacagcaacccgtgcaatctcaagtgcagttgcattcgccaacacagcattccctccaacctcaagtgcagctgcacccccagccacaacagctcccacaagtgcaggtgcactctcagacgcagctgcaccctcagccacagcagccccaagtgcaggtccatccgcagctgcagcaactcccacaattacagggcccactcgcagccaccgcaaccccaagtgcaaatccacccacagccgcagcagcccccacaagtgcagttgcagtcatcagtccagcagacctcccaaccccaacctcaggtacatctctacaatcacagggggggctcacaagcgcagctgcagccccaactgccaggtcagctgcagacacaggggcaaaccggacctggcattgacagttagagactactgctggcatatactaggaacctgtatgcttgcttgtgactcgttagatcctgatttaggtttctgtgcttcctgtacaatgtaaatccagtgtgattgcagttgccttgttgctaataatgcgaaaccgttagttactgatgatgtccttactgtgtcgaatactgaatgtcatggcgtggcttatgtgccatgctgaatgatgttctgtggtcattgtaatagcctaacttgacatctgtccatgatgatagtgattgatttgaatgagctcttggtgcaaaaaaaaaaaaaaaa

SEQ ID NO: 16040 - DNA, 1443 bp, Zea mays
attttaacaaattttacgactgtcgtgcatatgtccggatatcaacccctcccctcgtattaggccccacctccccgcgcgccctaaccctagcttctcgattcaactctgcgcgagacgaattctctcccgaattcgctcgccgaaagcacctgctacctcgcgcccgccttccgtcgcgcggattcggtgccgcgcgtggagatggacccgatggacatcgtggggaagtctaaggaggacgtttccctccccaaatcaacaatggttaagataattaaggagatgcttcctcctgatgtacgagtggcaagagatgcacaggatcttcttgttgaatgctgcgtagagttcatcaatctcctttcgtctgaatccaatgaagtgtgcagcagagaagagaagaaaacaattgctcctgagcatgttatcaaggctctaagtgatcttggcttcagagagtacattgaggaggtttatgcggcgtatgaacagcacaaactcgagactctggattctccaaaagctggcaagttcactaggattgagatgacagaggaagaagctgttgctgagcaacaaaggatgtttgctgaggctcgagcaaggatgaataacggagcccccaagccaaaggagccagaacaagaaccgccacagctaccacaagcacaaccccaacttcagctgcatactgaaccacagcaacccatgcaatctcaagttcagttgcattcgcaaacacaacactccctccaacctcaactgcagctccaccatcagccacaacagctcccacaagtgcagctgcactctcagccgcagctgcaaccccaagtgcatctgcaccctcagccgcagttgcccccacaattgcaggtccatcagcagctgcagcaatccccacaagtgcaggtccacgagcagccccaagtgcagccccaagaagcgcagttgcaatcatcagcccagcaaacctcccaaccccaacctcaggtacaactacaatcacaggggcactcacaagcgcaactgcaagccggactgctgggtcagttgcagacacaggcgcaaaccggacctggcatggatagttagagactattgtgtagcctgagtataagcaaaaaagggaaaaaaaaccaggcacttttgctgcatctactagaaacctgtatgcctgcttgtgactcattagatcctgatttaggtttccgtgcttcctgtagaatgtaaatgcagtgtgattgcagttgccttgttgctaataatgcgaagccgttagttactgatgatgtcattattgtgtggaatactgaattcgtgacaagtgtcatggcatggttttatgtgacgtgctgaaagatattccgttgccattgtaatagccgaacttcgacatttgtccatggtgatagcgactgatttgaaatgagtcttgct

SEQ ID NO: 16041 - DNA, 2914 bp, Zea mays
tagtcaatcttagttgtatctataacaagatgaaagtggtggcagccaagatgaaagtggtggtggccgcatcaaaggagaaggtgcaacaagacgaaccgaaaggtgaaaagatttcttttcccaaatcaacttgcatctacctgtgattgtttgtgaacaagttttttatgctaattttttatgtagctgctatctcagatgtgaaatgtgacaacccaaaagaggagggcaatgtgcagcaaaccaaaaggttagaggatttcacttcctcaatttctttggttacactgtttgtttgatgctgattttgttatcatgtagttgttgcctcaaatgtgaaatgtgatgacctagagcaggaggaagattccaataaaaatggggaactggaggagtgtaacaaatgtgtaatttattttttccactctatatgctatcttagaagtttcaaaagttccttgtttgtgcgtaattcaaaatttactattagtcattgttcctgaacaacccttgattttatttcttgaatgtgcacctgattcgtctaatggaatcatggaaccacatgttgtgctactattttggttaagaattacaatgatcttaaggcatttgttttgtatgttgtctcttaattttgtctactttttatatttcattttccatctgtattgttgtgtgcttattacaaaatgaaaaatgtatgataccaaccattaatattttaggactcactaagcaaagccaaagataagtgtttgaacaactatccatctacctatgtgatatataaaacctgtaacaacgcttcatctatgtaatcgttgtgcactaaaatttatcgaataatttgtacgccgtcgcaacgcacgggtacatacctagtaatttcataagagtttagccctttcagaagaaaagtttacgtccatatgtaaaagtcttttgtttatgaaaatctggtctgggcccggcccatgtgtatacttttagaaatcctgtcgccgatccctcttgcttcccgtcgtcctcctcgtcccaagttccaaccccgtgggccgctacatcgccaaaccctaactaggtttttttcaagcctccccttccctaccctcgccccccatggatccgttttccaagaagcgcaagcccgacgacaacggcgccgtcactgcttctcccgccggtggggctgccacgctgggtctcacccgcgaggacgtcctccgcctcctcgagccgctctcccgggaccagcttgcggacatcgcggccgccgctgcactcgtctcggcgcacgcgctcgatgccgtgcgcgcagccgccgaccgcgacccggccctgcgcaagctcttcattcgggggctcgggtgggagaccacatccgactcgctccgcgccatcttctccgcctacggtgacctggaggaggccgtcgtcatcactgacaaatccacggggcggtccaagggctacggcttcgtcaccttccgccacgccgattccgccgtcctcgcactcaaggagccatccaagaagatcgacggtcgcatgactgtcacgcagctcgccgccgccggctcggcaggcgggccgtccgttggggctcccggcagtggcggtgctcctgtggctgatgtgtcgctccggaagatcttcgttgggaacgtccctgcagacatgtcgtcggagcgtctccttgcgcactttgcctcctacggcgagattgaggaggggccgctgggatttgacaagcagacgggcaagttccggggctttgcacttttcgtatataagacacctgagggtgcgcaggcctccctggtggactcggtgaaggtaattgatagccaccagcttgtatgcaagcttgccatagatgggaagaaggggaagcaggggcaatcacagcaatctggacctggcaaccagcagcagcaacagcaacagcagatgctgccgggtggtccgcaggaaattcagggaggcctggggcttggttcacaaatgggagcacagtatggtggccctgggagtggtatgccttcgtttggttttggtggcgttggcggtgggtttgggggtccaaacccttatgctaacatgccatcttccatgggtggaggaggcgcaggtgggttagggtcggtgggaggccaggtgcccactgggttggctggtgctggtggatttgggcctgggggattgggtggtggctcatttgggggatcatctcagtttggtgctgctgggatgggggcatatggtggccttggaatgggtggaggctccatgtaccgcatgcaacagggagcaggtgggctgcctgcaggcgcatttggtgaaggaggaaactaccctcttccaggttctggtttccgaggccacgaccctcaaggtggaatgtctcctcctgggccaggtggcagggctcctcctatgtatcccaacgtgccaccttatttctaaggtgtgtgacaactcttgggagcatatcctttgaaatggttgtgctgaattcagaagtgttgtctgcttacatggatgccttgcatattctggctacttctgatctggaatggaatgtggaatgagtttgcactcgcagtttcccttattaagggatacatgaagctaggtagttgtgataatgcttagccgtgataatgcttcacatgtactttcttatgagtcatgactgctttgcagtttcattttctatatagataagtgaagttgcattaagtgtgtgttgtgttgattattgtcgtattatcctatgaaacccctttattttcatggtatgatgatgtgtttaatcttatggatttctatttgtcttgtctatctgttgatactcttggtgagcgattggtgactgtaatgcagtttatctctttctttagaattt

SEQ ID NO: 16042 - DNA, 3517 bp, Zea mays
ctgcagggactgccaactgcatcattatgaaggtaatcatagcagaagtgtgcaataaatgtgagcttagaatgaccttagaatgaagtaagtgggtattctgcaagttacaaaaaactgttttaagataaatgttttcttcacttgagttctaatcatgtctgctgaaccgcaatcttataatcaataataaaatgtttctcatacttgctccagacttatttcaaacttttttggcaccttattatggaatgggatgacctattctacaattttatcttttcacactatttcacttgttacaaatcttacctttctggttgtttgccttttacttattgtgtgttgttacaggcaaatgatggatccttcatggaagaaccaggatctggtgctgtggctaccattggtgagaaacaggtttctgttggaacattagattggattagaaggtacatatgagttttttgttctacagctatgccctatgctaaattcactaacaacatgagacacttctaatcgtctcttgttcctggtataccaccttatgtaaatgctatctgttttaaagttttctccctgcactgtcttgtaaaagtgtatgttgagtctgtttgctagtaaaattacaatatttcaggcatggggtcgttcacaaccccttcccacaagcagagcattttggccagtctgttgcatatgtagcagtgaatggtgctctggctggtcttatttgttttgaggataagctcaggggagattctcgtcaagttattgacacactatctaagcaaggaattagtgtatatatgttatctggggacaaggaaagtgctgctatgaatgtggcttcagttgtcggtatccaggcagataaggtaatatcaaccgaatcttgttgtgttttgttcttgtaaatgacttaattctctatagtaaaatgtggctaggcccgactaacttggtctattgatacaacacccaaccctgagttaggattagggtttcccggggtgagactataattacaagggactaacccccaaaccctaacgggtactctaacatttggcactcaagtagccagaatgaacatgttatgggttgattgctgtctgttgctgttagctgcaccaattacatgacgcgtagtgatcttggagatgcactgcagataatggttctattagtttcagaaacactgcagaaatttctgtggctattgttttgaattaccagaaaatcatgaagtcatttgtcatcaagttgccatgtcatgtattccctccctttatttttatagggcgtgcatgcactccaagcttcaaattctttaaatgaccaaggatttgtctaagaattgtaggttgtagaagatcataacatgagtggttttggatatttggattccttttctatatacccactcatgtctcatgtggtacttcctacgattgatcttatcatataagatacatctgtaatctgtttagagattgacatatacatctagagccatgtgctttggaagcagatcattcattttgggaaaaaggttcgtatatgaaagtacattcttatgatgtcaatttcatgatccgaacaattcagtgctgaaggctgtaccaggttaagccgtgccctactctttggtaaggagggggtatgacttaggaagacaaatttgtcaaaggaaaggatgaatatgtgaaatcatttaaatgctattctaagtcatcatcatcatccacttgaaaaatgttctgtttgtgaagtgcattcgtttctaaaaaaagaaagtaggtggtagcaggttcataaactaacaaacaaaatatctatcagatgatcagattagaaccccctgaagcacaaaaggcagcacaaggaaaaactgtttcagtttctttcatttagattgactttgtgagcatgactttttattgccatttcttctaaatataaacgaaagggtctctagccgagttggtagatggtctgagtagcactcctcaggtcctgggttcgactccctgtgggagtgaattttcaggatgttgttaaaaaaatcctctcgtctgtctcacgctaaagcgcaggtctaaggttcggccccggttgtggtcgttctcacatggggctacaacgccgctgtgtatgggtggggggcaggggttcttaacataatactgtgggagcggtccacagtgttaaggcccattaggcccaggcttactgcctatatatataatagtccttagggactgatgatagactgttaatcctaaggttagtaacatggtaacagaggaggttttgattaggggtttttagccgccgtcgcggccttcctcctggccgccgtcgcggccctcccctaccctatcccacctcgtccgccaccgtctgcgcgctctgcctcgtccgctgtccgctgccggtgttgcgtctgtttcgaccgccgccatcacgtccatcttctacgtcgactcggccccgccagtgtcgtccacagcgccgtccgtccggctcgccagggacttgagcaccgccgcgaccttcttctccgccgccgtccgcgaagtctgccacatctgcgaccttctcctatgccgtctcgttgtccgggcaaccatcgactttttttcttctaaatataatgatacgcagctcaactgtgtgttcaagaaaaaatattgccatttcagtatggtccgcttatctatttatgtgggaaaatgtcttaggttcttgctgaagttaaaccacatgagaaaaagaagttcatatctgaactccagaaagagcccaaggtagtcgccatggttggtgacggcattaatgatgccgcagcactagcttcagctgatgttggaatcgcaatgggtggaggtgttggggcagctagtgatgtatcttcagttgtacttatgggcaacaggttatcccagcttatcgatgctttagagttgagtaaagagaccatgaagacggtgaagcaaaatctttggtgggctttcctgtataacattgttggactacccattgctgctggagcattgcttccagctacggggacgatactgacaccatcaatagctggagctctgatgggttttagttcggtcggtgtgatggccaactcgttgcttttgagggtgaggctgagctcaaggcggaagcgagaaccactgaaagccatctctgatgaggttgagaaaaattactcatcgaaatggagtacctgagtagttcggatcttagaccatgttcacgttcactcattcatatgatttggacacacgcatcaaaggcagttgtcagttgaacaaatgaaacagatgtagtatgcaattgctgaggtcagtcagttcctgtggtttggtagatcttcatggtgtgctataatataataccccctctattccaatttataatttatttgacttttttttaccaaaaaaaaaaaaaaaaaaaaaaaaaaaaaaaaaaaaaaaaaaaaaaaaaaaaaaaa

SEQ ID NO: 16043 - DNA, 1041 bp, Zea mays
atcgtctcttgttcctggtataccttatgtaaatcctatctgttttaaagttttctccctgcactgtcttgtaacagtgtatgttgagcctgtttgctagtaaaattataccacgcctcccatggggtcattcacaaccccttcccagaagcagagcattttggccagtctgttgcatatgtagcagtgaatggtgctctggctggtcttatttgttttgaggataagctcaggggagattctcgtcaagttatcgagacactatctaaacaaggaattagtgtatatatgttatctggggacaaggaaagtgctgctatgaatgtggcttcagttgtcggtatccaggcagacaaggttcttgctgaagttaaaccacatgagaaaaagaagttcatatctgaactccagaaagagcacaaggtagtcgccatggttggtgacggcattaatgatgccgcagcactagcttcagctgatgttggaatcgcaatgggtggaggtgttggggcagctagtgatgtatcttcagttgtacttatgggcaacaggttatcccagcttatcgatgctttagagttgagtaaagagaccatgaagacggtgaagcaaaatctttggtgggctttcctatataacattgttggactacccattgctgctggagcattgcttccagctacggggacgatactgacaccatcaatagctggagctctgatgggttttagttcggtcggtgtgatggccaactcgttgcttttgagggtgaggctgagctcaaggcggaagcgagaacccctgaaagccatctctgctgaggttgagaaaaattactcatccaaatggagtacctgagtagttcggatcttagaccatgttcacgttcactcatttatatgatttggacacacgcatcaaaggcagttgtcagttgaacaaatgaaaccgaatgtagtatgcaattgctgaggtcagtcaattccctgtggtttggtaaaaaaaaaaaaaaaaaaaaaaaaaaaaaaaaaaaaaaaaaaa

SEQ ID NO: 16044 - DNA, 1192 bp, Zea mays
agaaaatctcgtataacgcaagtcgtcaaaataccgaaggttaacaggcagattatggacagtataagggaagatgaaatagatcttgatatggagaatgttgataaatcaagtattaagaagaagaaaagaaaactagaactgaataaggccattttggatgatgatcggttcaaagaaatgtttgagaataaggattttgaaattgatgaagaatcaaaagaatacctcgcacttcatcctcaggcagccacaaaggagcctcgcctgattgaagaacattttgatagtgttagcgaggacgatcaacaatctgatggtaacatatctgacactctagcggaatctgacagtgatgatgtcatgcataattcaaagcgtataaggttatacgaggtcaaggatgaacaccatgcggaagcatttttgaacagcgtctctttatcaaacgaggatgctgctccccttgaggataggatagctgccctggaaaggaaacagaactccaaagcacttgatgcggtcaagtacgggcctggtggctcacgagagatttcgtttttctctaaaagccggagaaggcacaaggaagagtcgtctagcgacgatgaacccaagggtgtcaaaaagagagctgtgcagccgctgggcttgaagcagggaaaagccgagttctatatgtttggcggaaatcgtggcagaggtagaggcggtggtggcagaggtggaggcggtcgaggaagaggtggaggtggtcgaggaagaggtggaggacgaggccaggggcaggggcagaggatgaatggggcccgtcacattgaccccgttcctgcctttgcaggggttttggtaagcttgaaatggattgatcctgcacatgcagtgggtagaaagtgtgttccttcacaacataggcaagagctagagtaactgaggattgctgcttcagaatttttgggaagagaactttgttagaagacaatattacatatcttatggtctaccttgtaacggatcgttgcattctggtgggtgtctatgggtacggtatagcattttttttgtaataggcaacataactgctggcattttcatttttgagtactgaaggctctccaaagccatgattagtagacatgcgttcatagaaacggctccaaaaaaaagaaaaaaaaaactcgagggggggccc

SEQ ID NO: 16045 - DNA, 1924 bp, Zea mays
ctttggccttattcaattggggaaatgtgcacatgtgtgaagcaaggaagcgcatccctctcgatgaatctgctccaaaggaagtcatggctgctcagctccgcacagcttattattgggtgaaggagaggtatgctcttgcagggcacaaatatgaggaggcccttaaaatcaagccagacttctatgaagggcttcttgctttaggccagcaacacttcgagactgcaaagcttcattggtcatatgcactggcagataaggctgacctatctacctgggattctttggaaacattcaagctttttgactgcgctgagcagaacatgagggctgcaacagagatgtgggagaaggtggaagaacagagaatggcagagttaaaagaaccaggcgcatgtgataaggatggggtactgaggaaaaggcatcacggtgcaggtggtcaaccggagttgacaccagaagaagcagctgagcaggcagcagtaatgaggcaacagattcacctcttctggggtaatatgcttttcgagcgttcccaagtggagtttaagctcagtgttggtgactggaagacaaatcttgatgcatctgttgaaaggtttaagttggctggagcttcagaatcagatattttgacagtgttgaaaaatcacttttctaatgtagcctctgagtgtgaagagaagaaagtcatgacttcaggcacagaaatttcccaaacaaatgacaatgttgaggataagtgtgtggttgaaacctaagttttcatggttcaaggtgaatgacatcaatgtgtatcatattcatcaattgcttgataggctttatttgttcttggtattatcatggtcctttgtcattacatctaggcgagagcttcaagcacactgagttttgtgattgccattgccaactggtgcagagtcgacatgctccatgaaatcttgataatttactagaggtcttagatttctgaatatatgttatcattcttctaccagttttagtggtatttgatgttgagttagttttctttttctgtcagaaaccaggtcttggcaatatctccctgctcacattgtttaaaatatcggacacatacttagtaaacacggaatgttacccatgactcatttattgtgccaagttgctgatccctacataatagatctgtattttagtttttgtgtatctattcttgccgcttttgcatccagcaatcgaaggcagttgtgcctcaaatgtggctgctttgtaagttgtaacatagtgtactttatgcactctacagtaccgaattattttggcactgtacatgtactgaattccttccgcagaaaatattcaaacaaaggtactggccaggttcagccaccattaaactaccttttccctttgtccaagctaatggatattcaaggtcaaatggaaaataacagctaggacgtgctgtgaaacggtggaagttatgacaaaattcatacgaatattctgttttttgatacggttcatcacatttcactattcagttacatggttactggtagaaatgagttgctttcagtgacgaatccctagcagggaggcaaacgccatggatcaaggtatatttggagctgattggttattcctctgttgcatcctagtttttcagctgtatctctcttttatgtggtagttcactttgtatgtactctgttttcgccacttttcatggaggctagcataccattctggtacaactaatcatgattccaggttgattcaaacaaggtaaaaacctatgatgtgtcacatgggtggatctttttctttttcatttctcgttgctatgatatgatgaaaaagatgccttttcttcttcagcgattttatttttgtttatgaagcccatttctattagcagcttggactgcag

SEQ ID NO: 16046 - DNA, 1581 bp, Zea mays
ggacacaaaggaggcggcggcggcggcggcgggagcgagctagtcgcagcaactagcgggtctggtgattcccctgacgcagtcgccgtggatgaggatggggatctcgttctggaccggaggagaagaaacaaatatgctagaggtgaccgccatctgttcactattcagcatggtgttaccagctcgcttaagagcgttgggcttcagccgtgcaggtttggaaagcggccttactattatctgacttgattctgcacgaaagcttttcatcgccaaactttgatggtgttactgccattgagataggtgctggaacaggtttggtaggtttagcactagctcgagttgctagaaggatttttgttacagatagaggcactgatatccttgataattgcttggctaatctccatatcaactctggtatgctaaggttcgatgaagctaaagtctgtgtacgagaactggactggaaaatggcatggcctccacctgtgggtacatatgacccttctgatccaagtcggtatttatggtctgcaagtgaagttgaggaggctgagaaagcaacagtcctgtttgctgcagatgttatttacagtgatgatctcacaaatttgttcttcaacacggtgaagaaattgatgtcggtcggtgctaagaaggtgctatacttggccctggagaagagatacaacttcagtgtagacgaactagatgtcgtggccaatggttacacgcacttccgaagtttcttcacagcccaagatgagcacggtgatccgagcaacagatctggaccaggttttgttggaaagcagatagaccctgcagagattcctcagtacatcagagagtatgagaggggcaaggatttagagatgtggatgatcatgtacagtccggaggagaaacagcacagtaactctacaaaaaccgtcttttccttctaggaggacgaagagagcaatgagtgcttggtgcaaaaagacgaattccgttaaaaagacgggaccccctcccacgggcatccatactatcttgacaaaaatgaaaactgctgcttggtgcaagatccgtgtggtgtcgaagaatcgcagttcggcatcttctctgcggggaccgcgacagaaacgaggtcatcagaagagagaaataagttacacctaattgcggcagggcagggcagtggtggctggcatatattaagtggtggacaatcaagaacatgctctgcatgcttagcttaagtatatcatacgtatataataacgccgttgggactcgttttctttgtcgcccggaaacagcatctgtttggtccaagattcttggcacgccattgcgatccaaccctgtcgtgctcaaacatactctctccgtcggctggtgctctcgtttcatttcatcacaagttaattaattttaattttaactaaatatgtataaaaggttagtaatttcaatgatgtatactaataaatattattagatcgattatttaatctattttttctaataaaattatttgcaggtataaaatgtttcctaattttttctataaatgtaataaaactt

SEQ ID NO: 16047 - DNA, 2761 bp, Zea mays
agcaaagcaaaccaccgtgcctcaggcagaggcctcagcctctctctcgtctttgcgttgcgccgctgctttaaacaaacgtcaggtgaaggctgcggcacgcgtcccctcctccgcctccagtctccgcccatctcaaaaccctagcaaccgcgcctccacccctacccgaatcccaatccaggtccgatcccccggcggcgaggacacccggcgccgattcgtccccgcagatcggcgggcaggacagattcagattcgggttcggggtccgctcgggtcgcctcgccggggtccaccgcggcggtcagggagcatggtgggcggcgggaggcggggtggagcggcggaggaggtcaagctcaacaccggcaacgtgttcgcggcgctcgagtccctcaagaagaagaagaagggcgacaaaggcaaggcggccgggtcttcctccaggaagaagcacggcgagggggccgcgcagcgacaagagccaccgcagaaggagctgttctgggcgcccgcgccacttaccaccaagtcctgggcggacgtcgaggacgacgacgacgacgactacttcgccaccaccgcgccgccgcgccccgtctggggcactgccggtgagcccgccaaggaagaggaagacgtcgatgatgctggtgcgtgccgcccttcaggagggtatatttttccaccttctctatgtgccttgtgatttgggttgtgggaatgtgcctatggaaatgttcttataccttcagactgttcgttgctgtttaatctccgtactggttagttgacagttggcgctgccgcggaatccttggagtaaggccaatctgcaggtttacttgtccattatgccattttttttgcgattggtgtcggtaacggatgcaattattcgccttggccgtgcgtcttgtgtgcaatatggcaatcaatttctggtgtaggtattgaaacactaaatttcagctgcaaatcatgtgaaaataaatttgtcctttgaatgatagaagggttgttctgctgtatagtgtatgattagctgacaaactgacacgcgtagttaccccacataagcagaattggtaaattggtgtattaatgcccatatcggtatatatatagcccatattatcttttttggcaattactagattcagtaatgaccaatgaggagagaatgcttggtaattaatagattgagcaatgaccaatgaggagagaatgctggataattgtattatcacatattgccagtaaagaatcaaagaggctcgtcgtgtgtattatggatgttttctcactactttttactgttccaattagctgtggtctaaaggagcatattgcaattgagagcaacagtgatgctctttacaagctgtgtttgtactaatactgttggggataatccgtctgctaaagaaaaggtgtactttggacagggatttgttccaagtttttctatgtcttgggtaagcaaagtgatttggaaatgtttatacatgacatgtgctgcatgtctgtcatagcaaactctggttattgttctacttgttttctgtcaaattttctttgaattgaactttgttaagtgggcgtataatttactcatctcgagggaatggaacatgtttggctgattgtcgttatagctagccacttagcctctctgataatattcttagatgtacttctatatattctgcaggacattgagagtgatgatgaggaccttgatgatgaggttgatgatggacctgaggatgaacctgaacatgatgcagaagatgccccagccgaacctgctatcaggacagctgcggccccggctgcgccacccaaggacacagaaaggcagctgtctaaaaaggagttgaaaaagaaggaactagcagaacttgatgcagtattggctgagctgggactctctgcaaattctagcagcactgcacaggatggtgagaatcatacatgctgccactaaaactgcctgatatcaatagctctcttgtgtggttttgttgattgtatggactcgattttctcatgctatgttttcttgcagctgagaagaaaggtaccaaccaaattaccaaccaaattgatgcagagaaaaaggaagatgctcctgctcctcccgagagcaaggcctccaagaagaagaaaaagaaggacaagagttcaaaggagggaaaagaaacacaagaagcacttgatgggtcagaggagactgccagtgcaggacctgatgaagatacttctgctgtggatgtgaaggagcgcttgaagaagatggcatcaatgaagaagaagaaatcgagcagagagacggacacagctgccaaaattgccgctgccgaggctgcagcaaggagtgcaaggcttgcggcggccaagaagaaagaaaagagtcattacaaccagcagcccgtgcggtaaatgggcataaagttttgagtttgggtgctgtgagtttgatatccccttgttcgttttggactcgcaataaaacttttttgagttatcgtatttatgactgggaagtgcctttctgagtttcattttcagaatttaatgaaaggcctttgtggttgcaaaacggtggtgtaattgtgctttaaattgttcatccaatgataaacttcatgaacaactaaagaaaaaaaagggtccgatttttaaatccttgcattgatgaggagggcgggggtacacttgccgaaattaaaaaaaaagtaaaaaaaaaaaaaaa

SEQ ID NO: 16048 - DNA, 1673 bp, Zea mays
acggcagcaaagcaaaccaccgtgcctcaggcagaggcctcagcctctctctcgtctttgcgttgcgccgctgctttaaacaaacgtcaggtgaaggctgcggcacgcgtcccctcctccgcctccagtctccgcccatctcaaaaccctagcaaccgcgcctccacccctacccgaatcccaatccaggtccgatcccccggcggcgaggacacccggcgccgattcgtccccgcagatcggcgggcaggacagattcagattcgggttcggggtccgctcgggtcgcctcgccggggtccaccgcggcggtcagggagcatggtgggcggcgggaggcggggtggagcggcggaggaggtcaagctcaacaccggcaacgtgttcgcggcgctcgagtccctcaagaagaagaagaagggcgacaaaggcaaggcggccgggtcttcctccaggaagaagcacggcgagggggccgcgcagcgacaagagccaccgcagaaggagctgttctgggcgcccgcgccacttaccaccaagtcctgggcggacgtcgaggacgacgacgacgacgactacttcgccaccaccgcgccgccgcgccccgtctggggcactgccggtgagcccgccaaggaagaggaagacgtcgatgatgctgtgcgtgccgcccttcaggaggacattgagagtgatgatgaggaccttgatgatgaggttgatgatggacctgaggatgaacctgaacatgatgcggaagatgccccagccgaacctgctatcaggacagctgcggccccggctgcgccacccaaggacacagaaaggcagctgtctaaaaaggagttgaaaaagaaggaactagcagaacttgatgcagtattggctgagctgggactctctgcaaattctagcagcactgcacaggatgctgagaagaaaggtaccaaccaaattggtgatgcagagaaaaaggaagatgctcctgctcctcccgagagcaaggcctccaagaagaagaaaaagaaggacaagagttcaaaggagggaaaagaaacacaagaagcacttgatgggtcagaggagactgccagtgcaggacctgatgaagatacttctgctgtggatgtgaaggagcgcttgaagaagatggcatcaatgaagaagaagaaatcgagcagagagacggacacagctgccaaaattgccgctgccgaggctgcagcaaggagtgcaaggcttgcggcggccaagaagaaagaaaagagtcattacaaccagcagcccgtgcggtaaatgggcataaagttttgagtttgggtgctgtgagtttgatatccccttgttcgttttggactcgcaataaaacttttttgagttatcgtatttatgactgggaagtgcctttctgagtttcattttcagaatttaatgaaaggcctttgtggttgcaaaacggtggtgtaattgtgctttaaattgttcatccaatgataaacttcgtgaacaactccagcaccgcctgtagtccgatttttaaatccttgcattgatgaggagggcgggggtacacttgccgaaattatccccagcctgatttcttttctcgtcctatatatataaatgtgcctttttataaaaagaaaaaaaaaaaaaaaaaaaaaaaacaaaaa

SEQ ID NO: 16049 - DNA, 536 bp, Zea mays
atagggtgagagaagaaaattgattcgatatattgacatgctatttttctaatgttcaacttataagacactgttctacttgcttctgtatagcataagtgtagtatataatgtctctcatatgatttagcgtaatatacaaatatactacatatacaaatatattaacttaattattttatgtctaaattatgattaatagaatggaattcaattccaacgaaacaaaggggtctaatgtctttgtgtgtagaattcaaagattttttgaagaaactttgtgatcgatctgttaagttatgaggacaatttgtgccgatatgtcatccctagttcatttatatgcattgtgccgccattacttcaagaattgggaaaatgcagctaatccaggaaaatgaaaccctataggtttggttcactccaatatctcaacactacaaatcaaacaccctgcttgtttcagcaatgtcaaccaaaagcatgtgattttttagataatggaacgaagttcaagaatctaccacgagccgaat

SEQ ID NO: 16050 - DNA, 5117 bp, Zea mays
  misc_feature (3311)..(3311): n is a, c, g, or t
  misc_feature (4099)..(4099): n is a, c, g, or t
tacgagttcacaaaagtctagatcatgtgcaagatcattgcattgaggcctcgggaagtgtggatggtagtcttagatgcttgggtgggcttaatttcttatacaaataaaacaacaaataatgacatgatttttggtataaacacaagatccgtaaataaggtcgtaaaaatacctcaactgttttcgtttccgtccccgccactttttctcgggaattctcttgttgctgttttgtgatacattatacgctcggatattatggtacaccatgtcgatcgttacaagatttttctattttgttttggtccctacttgtgcccctgttgtgaacaaaaaaatctaggttgtacgtacaagttcgaacaatttttagagtcaggaattggaactacaaagggatgactgatatgtgagagatccattcaagatacggtacatgggtttaacccctattaaccgaacatggccttagagacatagttttttatccgatttttaaaaatcgaaaggccaaaaccgttccatcaatcatgcatttccatgcctttagaaattagaatctgaaataaaaactagccatccacttgcatttcgggcccgcggggcgcgaatcacgcgcccctaatgcagcgcactaccgaattcgtgttcccttgggcagttgggcccttcctcaccacgaaagagtcaccacatcgctgacagagtgatagtgacaccgagacacaccaaagccaacacccccatcgccgccgtgcacgcgctcggcgctcctcattgacacgtttgcagttggagtagggccgcggcccgggcatatagcccacccgtcattgacgcgaagcgggacctttctagatatttcccaaccccctcagaaaggagaaataatcctccctttctctcctctcctgcctttccccattactactccccagtcccactcccacccgcaggccgcgccgccccagcaaatctcacgcacagaaacaccaaagccccaaaggcccaaactcaccacctcccaatggagaacggcgacgaaaccctcgcctcccccacggccgccgccgagacggacgcgctcaacggcggcgtcgcggaggaggagcaggtccccatcacccaccccgcaaagtcctacgtcacgctcgccgacgacaaccccgctcctaacggcggcgtcgtgaaagaggaggagggcggtgcccacaccaccgcgaagtcctacgcagctgtcgccgcccaagccgagatcgaggacctccgcgccgccaagctcgacctggaggagaagctcgctgaggcccgccgtgagaacaagtccctcgccgaggagacgcaccgcagcgaggggatcttcacgcaggcccgggaggaggtcaccatcgccgagttcgccgccacctctgccgagaaggaggtcgcctcgctccgcgcggaggtcgaacgcctcgatgctgttctcaggatcgagaagggcgagcacgagctggacaagcagagacacgagaaggtcgccaaggaggtggatgccgtgcgccaggagaagctcaagctagaggaggagatcagagccctgaaggcttccgccaccgccgccgccaccaccaaggagagggaagctgcgccggcttctgaggccccgaaggaaggggaagtcgcgtggctggggatggcggtggctgcggctgccggcgccgccggcacggctgccatcatgctagtttatctccgccttaagaggtaggtgttctggtgctcggttgcgtagcagtaaagggagttttcgtcgtgatgctgctattactgaactgggaggtatgcgacttctatgagtagttgcttattagcctacagaaaatatagggatctggagactggttatgtttcatggctgttcttctttcaccggtaccattttatgacgaacgttgtatgactgattatcttcttgtttacgttactgctacggcatggcctcatgacccttttttgatctaataatggtccgtgttctgctgaaaaaagaaaaaaattgcttacttgaaattacttaattacttggtgatgctgtctattttgtgcgattggtgagtgaaatcatataattatctcaacagttgatatgtattgcatctgattgcaattaactttgttaacgaattatgcttcttgacgctttcatcatttgtattgcgctgcttaggcacggtttggtcgattagaggaactgctgtgctccatgcttctgtttgtgcattagcagtatatcgaattctattacacgcctcctagatttgtcgtctggacatcaatttaggcaactgcagttagggatggtggcatttttcctggtgagatactgtcagaccgaccagcagaggcgcctggtgcaggggcggggaggcatggtggtggggagacaggaatgttggcagccatgggcagcagggagattgtctgatgggctgggaaagggtgggggcacatagcagcaacgatgaggctgcccgcagtcgcgcgctgcacgtagaactctatccagatagcgtaagaaaagttgctgcagtggagaactgtaaacgctactctattttaacgctactctattttaacgcatggaactgtaaatcaaacgcccggccggtgtctgcgctatgcgctgtgtctgcgcatgctacagtacccgtgggacacgtgcagccgagtgagcggatgaactcaatgaagtggctgctcgtgtgtatagggttaatatatggagtaaatatgactgcggagtattatgttatagagtaaagaattttgctgacaaggacagaatattccttttagggtagaaatttagagttgtatgagtgcggatagcctcaggaaaaaacctgtttagcataacagcaggggtggcataggcatactccgctgttggggataggtgagcagaggagggaggggctgcaatgtgtaggccaacaatgtgaagaacacagggttaaagaactattgcctgaacagttggctctgttgactgaaattttaacaagaataggcatctggtatattgcattttccttctttgcatttgttttggccagttcaagctattgctaatatagtttctctgtttactcgtgattttttatttttggtgcttttaagtgggcattgcacaggctcataattttcgttttatttggatatcaaaagaaacgatgtgattggttctgtcgatggacatgttcttttgccttgctataaactaaatggccttatgtagatctcaattgcaattgttacttttggtngtgatgctgctgctgctaaattgagatttgtattactttagttgcttagcagaaacatgtggtcaactagaatgagttgcttagcatggttatgtttgttccttcactagtactatcattctgcatgtttttgatcggggcacaaaactgtttagtaatgggacggggcatcatacaacgcgtgacagaggaagtgtttatgcatgtaatttgtttatgatgtatgaaatgaggtctaattatgggtgacaataggttctaaattttacactaagatttaaggatccgattaggatcgggttctatttctattcatctatgaactaaaatttatttaggaccctactattttataaagaatcatttggattgtgatccattaccacccatatgtgtagtatatgtaaatgaggacgtaactagttactgtcctagtacgtgaaaagtatttcgttctgcttctaatggtttgggcagatttagttgattttgacccgttagatcacttattttgtcctgcagttactatttagtaatttagatcatgtggcatgctgggtggaaactgtgtatgtgaaatgtgtatatgccttctatgtttggccagtgcaagctgataataactaatatgatatctcgaattattagacaaatttgtgaaatgtgggtactattactctcttagctaatacgatataggtctggggccgccgcaagcgtgctgatagagtgacacggtagtacgtagacgcacgatatagaggttcagtttattaggttttgggttncctgatcgaaatttcttacgttttctatgtggtgaatgattagatttaagtacgagaagaacttacgtactcagatgacttgagctagcgagtagaaataatcttaggaatcttagggtctgtttggttcatttagttcatggactaaagtttagtctctactttaaaagtatttggaacacattaaatgaattataagaagatcaaaatatatcttagcattatttcattattagtgcgctgaaataaacgaggggcaaaaggtgaaattaatatggtttaatttcttttagtcatcttttgagtgactagagataaaaacagtttagttcctgttttaatcttacggtttggtaatttaaggactaaatagaaataaaatagaggacaaaccaaatggggtcttagccagttcttgcgattctatgtattgttttatatctattttgaccagtggcggatcctggaatagataaaagacgagactactaagttagccaaccgtggcgttgttggtctgcgttgttggtctgacgacaagcagttagtaccttgtcctgggcaacttggccagttagctattgtcgatctagagcctaggatgggtggctgtcaaccgtaggtgtggcatagagaaaatggagggcaatcactggtgagacaatagcgggccgatgactagcggttagcgcggacacaggacgctacatgactagagttaggacgcattgtaggctcggacactagatgactagagttaggacgcatgctaggactaggacgaggctgtagttatggtgcacaggtgttggataaggatatttaatcttatgttgtctttacagatgaaactaaataattagttagtaacaactgagtcgttaacatagcattttatgatagattgtcatgttagatgcagacatgctatgtgttggcttatagagtgggacatttaagttggtctaaagatctatcactacctttaacacacgacgggcgggtaaggcgtagcctt

SEQ ID NO: 16051 - DNA, 934 bp, Zea mays
gctgccccagcaatcccgcgcacagaaacaccaaagccccaaacctcaccctctcccgaatcccgatggagttctttgacgaaaccctcgcctccgccgccgtcgagaagcccgcgctcaacggcgtcgttgcggaggaggagcaagtccccatcacccaccccgcaaagtcacacgccgcggtcgctgccgagaaccccactcctatcagcagcgtcgcgaacggtgagggtgagggggtccccggcgcccacactgccgccaagtcctacgctgccgtcgccgtcctcgcggagatcgccgccctccgcgccgccaagctcgacctggaagcgaagctcgacgaggcccgccgtgagaacaagttcctcgccgaggagactcaccgcatcgagggtatcttcccgcaggttcgggcggaggccaccatcgccgccgccacctctgccgaggagatcgcctcgctccgcatgaaggtcgaccgcctcaagaccgagaagggcgagcacgagctggacatgcagagccacgacaagctcgccaaggaggtggatgccttgcgccaggagaagctcaagctcgaggaggagatcagggccctgaaggcttctaccaccgccgccgccaccaaggagagggaggctgcgccagcggctgaggccccgaaggaaggggaggttgcgtggatggggttggtggtggctgcggctgcaggcgtcgccagcatggctgccgtcatgctgatctgtctccaccgtaagaggtaatctgacgttctggtgatcggtttcgtagcagtactggaagttttcgtcgtgatgcttctataactgaactgggagtgatgtgacttctatgagtagttgcttattagcctacagaaatatagggatctggagactggttatgtctcatgacaaaaaaaaaaaaaaaa

SEQ ID NO: 16052 - DNA, 797 bp, Zea mays
  misc_feature (11)..(11): n is a, c, g, or t
  misc_feature (704)..(704): n is a, c, g, or t
  misc_feature (747)..(747): n is a, c, g, or t
gccggccgggntatcgcccccgccaggcgccagcctcccgtatttgatgtttcacaaacgtgagcggctcgccctcctctccagtccctcctccctccggtccgcacaggggagcagccggcagcagctagctaccacagtaccagcagcaagaagctaatcagctacgatggcggactacgtgtatggccccgggcggacccacctgttcgtgccgggccccgtgaacatcccggaccccgtgatccgcgccatgaaccggcagaacgaggactaccgctcgccggcggtgccggcgctgaccaaggtcctgctggaggacgtgaagaagatcttcaagaccacgacgggcacgcccttcatgatcccgacgacggggacgggagcgtgggagagcgcgctgaccaacacgctgtccccgggcgacagggtcgtgtccttcctcatcgggcagttcagcctgctgtggatcgaccagcagcggcgcctgggcttcgacgtggacgcggtggagagcgagtggggccagggcgccgacctggccgcgctggagcgcaggctctgcgatgacgcgccgcggcacgccatcaaggccgtggccatcgtgcacaacgagacggccacgggcgtcacaaacgacctggccgcagtgcgcgcgctgctggacaagcacgcgcacccggcgctgctgctggtggacggcngtgtcgtccatctgcgcgctggacttccgcatggacgagtggngcgttggacgtggcgctcacgggctcgcagaaggcgctgtcgatgccgac

SEQ ID NO: 16053 - DNA, 840 bp, Zea mays
ccggccgggtagttcctccatggtttaccatcactttcagcttttctagtatatctagtgcttgctatgtttcataaaaaacattgggtacctcgagacccgccgggatcgcccccgccaggcgccagcctccccccgtatttgatgtttcacaaacgtgagcggctcgccctcctctccagtccctcctccctccggtccgcacagggtagcagccggcagcagctagctaccacagtgctagtaccagcagcaagaagctaatcagctacgatggcggactacgtgtatggccccgggcggacccacctgttcgtgccgggccccgtgaacatcccggaccccgtgatccgcgccatgaaccggcagaacgaggactaccgctcgccggcggtgccggcgctgaccaaggtcctgctggaggacgtgaagaagatcttcaagaccacgacgggcacgcccttcatgatcccaacgacggggacgggcgcgtgggagagcgcgctgaccaacacgctgtccccgggcgacagggtcgtgtccttcctcatcgggcagttcagcctgctgtggatcgaccagcagcggcgcctgggcttcgacgtggacgcggtggagagcgagtggggccatggcgccgacctggccgcgctggagcgcaggctccgcgacgacgcgccgcggcacgccatcaaggccgtggccatcgtgcacaacgagacggccacgggcgtcaccaacgacctggccgcagtgcgcgcgctgctggacaagcacgcgcacccggcgctgctgctggtggacggcgtgtcgtccatctgcgcgctggacttccgcatg

SEQ ID NO: 16054 - DNA, 1759 bp, Zea mays
cggccgggcgtgctactgctacttccggcacctcgaggccggccggctacgatggcggactacgtgtatggccccgggcggacccacctgttcgtgccgggccccgtgaacatcccggaccccgtgatccgcgccatgaaccggcagaacgaggactaccgctcgccggcggtgccggcgctgaccaaggtcctgctggaggacgtgaagaagatcttcaagaccacgacgggcacgcccttcatgatcccgacgacggggacgggcgcgtgggagagcgcgctgaccaacacgctgtccccgggcgacagggtcgtgtccttcctcatcgggcagttcagcctgctgctggtggacggcgtgtcgtccatctgcgcgctggacttccgcatggacgagtggggcgtggacgtggcgctcacgggctcgcagaaggcgctgtcgatgccgacggggatgggcatcgtgtgcgccagccccagggcgctggaggccagcaagacggccaggtccgtgcgcgtcttcttcgactggaaggactacctcaggttctacgacatgggcacgtactggccctacacgccctccatccagctcctctacggcctccgcaccgcgctcgacctcatcttcgaggaagggctggacaacgtcgtgaggaggcacaaccgccttgggacagccaccaggctcgccgtcgaggcgtgggggctcagcaactgctgccagaaaggaggagtggttcagcgacaccgtcacccggccgtcgtcgtgccgcccaacatcgacagcgccgaggtcgtcaggcacgcgtggaagcggtacaacctcagcctcggcctcggcctcaacaaggtcgccgggaaggtcttcaggatcggccatctcggcaacctcaacgaggtagtgcactgcagggttgcgttaccgttatatattggcaattcgtttaattaatcagtgcaacgtactatatcttgtcttgatgctcccaaaaaaaattcttctcttctttgtcagctgcaacttctgggatgtctgagcggtgtggagatggtgctcaaggatgtggggtacccagtgaagctaggtagcgtagcgtggtcgcggccgaggtacctgtcaaactccacgccgctcatcccatctaggatctgagaacaatgtaagcgaagtatatcgcaaacaaggccagcgacaacgagtgggcaaacgaacaaacaaagcgtgcagacatctccggctctgctgactcgtagagcgacttattgcctgcagtaacgaactatctcagaatgtaaagttaaatttcacacccagctgttgctacatagtagtatagttttatgaattacaggtttgattaaacttcaaattaatctacatgtatagccctgcccagatttaactataatgggatcgtagtaccgatcaactctgcttcttccattacaatagtagtttttttgtgattattttgttgtaatttgttttatcatttaggtagtttatgcttaacttaaaattttatattttaaataaaacgattggtcaaagtacggaagcagtagtagtttttttttcctgagtctaaactaaaatcagatcataggacatgccattctcacagacaaaaaaaaacactctcacaagtcacaaatcactggtatgtattgctgtcaagtctttgcgcgatcatagaataagtgtttcgaaaaacgaagtacataacatatactgttgtaactcaatgtaaaat

SEQ ID NO: 16055 - DNA, 4950 bp, Zea mays
tctcctaatttatcgcgattaatcagatatggaccctgaccattttttttttgttaagtaaccggtttggtgaaccttgctcgtcctatactcttctcagttctcacagatgtcagcgccaaccttgccgtcgatcgcggcccagagcgagcagtaacagacccgtcgaataattagtgtgtcgtcacaccaacatagaaggagacgcagaagaagaaaaaatcgtcctgtagttccacggacagcggagagccaagcggaagggataacacacatcttccccgggcgggggcgtgacgtggccgcgtcggcgccccaggcctgcagattggcacccactggactggagccgagttgctgctgctctgtcactttatccggcgtcgccggctgcattcctcccattctggagatgacacacatccgacgagtctgaactgaatctttcttcatgcgagaaccgccactaaaaacaggatcgatctgaattgaaggacactgagctctgtcgatagtatctctgtgcacctgtaggcgtcagtcagtgttgtttggatgtgcagtgcagcagcgccgtcgtccacacaagctggaggagcgctgcaaagccagccagccactccaggacaggccggacggcttatctgccacgccggacgacggctgggcccgcgaaaggatcgccctttggagtttggacgccatggctcctatcctatcctatatagccgtcgtcatcctatgcctatcctatcgcccccgccaggcgccagcctcccgtatttgatgtttcacaaacgcgtgagcggctcgccctcctctccagtccctcctccctccggtccgcacaggggagcagccggcagcagctagctaccccgcgtgcgcccgccggtacgcctgtctccggtccagtgcaatcttgtcttctttttggatttgtgatcgacgatgatgtagtatgtagcaaagtgtttgcttggcatgtgggctcaagggcgtaagtaaggatcagtctagaggtttggttgccaagttcagtgcactacgctgacactccctcctctccctgcgtgcactgctgctagtaccagcagcaataagctaatcagctacgatggcggactacgtgtatggccccgggcggacccacctgttcgtgccgggccccgtgaacatcccggaccccgtgatccgcgccatgaaccggcagaacgaggactaccgctcgccggcggtgccggcgctgaccaaggtcctgctggaggacgttaagaagatctccggccccgcgacgggcacgcccctcatgatcccgacgacggggacgggcgcgtgggagagcgcgctgaccaacacgctgtccccgggcgacagggtcgtgtccttcctcatcgggcagttcagcctgctgtggatcgaccagcagcggcgcctgggcttcgacgtggacgcggtggagagcgagtggggccagggcgccgacctggccgcgctggagcgcaggctccgcgaggacgcgccgcggcacgccatcaaggccgtggccatcgtgcacaacgagacggccacgggcgtcaccaacgacctggccgccgtgcgcgcgctgctggacaagcacgcgcacccggcgctgctgctggtggacggcgtgtcgtccatctgcgcgctggacttccgcatggacgagtggggcgtggacgtggcgctcacgggctcgcagaaggcgctgtcgatgccgacggggatgggcatcgtgtgcgccagccccagggcgctggaggccagcaagacggccaggtccgtgcgcgtcttcttcgactggaaggactacctcaggttctacgacatgggcacgtactggccctacacgccctccatccagctcctctacggcctccgcaccgcgctcgacctcatcttcgaggaagggctggacaacgtcgtgaggaggcacaaccgccttgggacagccaccaggctcgccgtcgaggcgtgggggctcagcaactgctgccagaaggaggagtggttcagcgacaccgtcaccgccgtcgtcgtgccgcccaacatcgacagcgccgaggtcgtcaggcacgcgtggaagcggtacaacctcagcctcggcctcggcctcaacaaggtcgccgggaaggtcttcaggatcggccatctcggcaacctcaacgaggtagcgcactgcagggatgcgcaattcgtttaattaattaatcagtgcaacgtactatatcttgatgctcccaaacattatttttttttcttcttctttgtcagctgcaacttctcccacgcctccgccctcgcgtccgggtgctcaaggatgtggggtacccagtgaaactaggtagcggcgtggcagccgcggcggcgtacctgtcaaactccacgccgctcatcccatctaggatctgagaacaatgtaaggggaggatatcgcaaacaaggccagcgacaacgagtgggcagacgaacgaacaaagcgttgctacatagtactctctcagaatgtaaagttaaatttcacacccagctgttgctacatagtagtatagttttatgaattacaggtttgattaaacttcaaattaatctacatgtatagccctgcccagatttaactatattgggaccgtattacttaccgatcaactctgctttacagtagtagtctttttgtttctgaaatcagatcataagacatgccattctcacatacgggcttttttctctctctcttgtcacaaatcaccagtatgtattgctggtatcaagtcaagtctttgcgcgatcatagaataaaactgtttcgaaaaacgaagtacatatactgtaactcaatgtaaaaacggcgaaaaattcagtaacgaaaccgaaaaacttcaagcgaagtactggctgttgcgctgaagaacatcaggcagctttggcgagctccctgtcgacggcgaccttgaggaagctgccttcgtctaggaccatctgcacggggaggaagccgaggccgttggccacgccgagcatcacctccttcatctccgcgcggaactcgtgccggtccaccatgccgctgccgtccctgtcgaaccgcgcgaacaggccgcggtacagcgccccgaggtcctccggcgccaccgcggcctcgtccacgccgaagtgcctctccagcacccgcaggctcatgagctccccggccatctcggcgtaggtgagcaggccgtcgtggtcggcgtccagcgcggcgaagcggccgtccaccgaggagttgaaggcgcgctcgtcctctacgaagctccgcaccgtgctcccgtccaggatctccacgctcatcgtcggattcctctcgctgttcgtgttccttggatgtgttggtgtgtgagtttgctctgggcccgccccgccgccgttgcggccagagtcgcgactggacgtacctggaaagggcgcctgggccgacggtttctgcagacaggttgtgctgtgggccggtgggttttgacgccggtcagatgccgtgggcgcgagttgtgtggcgggtgcttcggaactacgcgaagtcgcccgtccccctgtcgtttcatcgtaccattactgggtctattctacggagaaaacgtgtgccaggtcggttgttagttgacggccagtagtaaactggcggcgtgacaacaaatagaactgacgtggttcaaaaagtgatacgatcatcgcaaactaattttctacattaattgtcaggtacgtatattccgagcaatggaaacgatacataaactacatctacataacaaaaaaaactaagcgaagccattttaaaagttaaatttagaaagaaaaaataagaagattaaagggcatctcttcaacgagccattaaaataaaataacaggttttacacctcggtggcgacataaacttgttcctgaggttctacgatgatactaatgttaataatgatgtaggtcgttaataatgaagtttctcttttgccattgtgtttacgccaaaactttccttgaaggacagaatgaactccagatgtgtgcttggaccatagcgaatgaatacatgtcaccaaaacaaagaatcagcatcgagttcttaaaaaagagcatgaattagtgtaatcccatgcttgtaatattcatatttacctaatatagaatttcttttgattttttaagtgataaaaatataaaaattctacttttcaatgctattacattgtccaaatctcaagtttatttcaatactaatacaaattccaaatctcaagtgtattataactatatattatgattggttttagaaactattacttttagagtaccaaatttgtaatcaaaacaaaactaaaacgcattacagtttgaaatacggaaattacattatatgtaaacatagcaatgtcatatatattatatacatatacgcaccatatataccatagtcttatgcgaagggaacaaaatataccatagttcctctctgaaaatagatggttactatagatgtgtccaacatccaagcaaataccaagttagcgaaccatactagatgctgccgcaagttcttgctccaaactgtagcacccagacatcattggaattgttaaatgttcctcattataaattggattgatacgttcatgtgggtgctgagcttctgcgcataacaaaggttccatttctccacccttttcaatcaaaagatgtgttttattccgtagcctctttgttcttagacattgcaatctcatatctacttctttcatgcttggtctatgtcctcctttggatcttaagcacacttctataagtgaggagatttcattaatctcttcttggtctgcctcttccacaacttgagaatctattatttccatgagagtcccttcctgtagtccttcaatgaagtaatgagataagttt

SEQ ID NO: 16056 - DNA, 1598 bp, Zea mays
cgtatttgacatgcgtgagtgcctcggctgcctccagtagtccagtgtccagcccctcatccctccgctccggtccgcacagcacaagggagcagccggcagcagcacagtgctgcggcaaagctaagatggcagactacgtgtatggccccgggcggaaccacctgttcgttccgggcccggggaacatcccggaccccgtgatccgcgccatgaaccggcagaacgaggactaccgctcgccggcgatcccggcgctcaccaaggtcctcctcgaggacgtgaagaggatcttcaaaaccaccaccggcacgccgttcctgatcccgaccaccggcaccggcgcgtgggagagcgcgctgaccaacacgctgtccccgggcgaccgcatcgtctcgttcctcatcgggcagttcagcctgctgtggatcgaccagcagcagcgcctgggcttcgacgtggacgtggtggagagcgactggggccacggcgccgacctcgacgcgctggagcggaagctccgcgacgacaccctccacaccatcaaggccgtcgccatcgtgcacaacgagacggccacggggcgtcaccaacgacctcgccgccgtgcgcgcgctgctggacaagcgtacgcccacccggcgctgctgctggtggacggcgtgtcgtccatctgcgcgctggacttccgcatggacgagtggggcgtcgacgtcgcgctcacgggctcgcagaaggcgctgtcgatgccgacggggatgggcatcgtgtgcgccagccccagggcgctggaggccagcaaggcggccaggtccgtgcgcgtcttcttcgactggaaggactacctcaggttctacgacatgggcacgtactggccctacacgccctccatccagctcctctacggcctccgcaccgcgctcgacctcatcttcgaggaagggctggacaacgtcgtgaggaggcacaaccgccttgggacagccaccaggctcgccgtcgaggcgtgggggctcagcaactgctgccagaaggaggagtggttcagcgacaccgtcaccgccgtcgtcgtgccgcccaacatcgacagcgccgaggtcgtcaggcacgcgtggaagcggtacaacctcagcctcggcctcggcctcaacaaggtcgccgggaaggtcttcaggatcggccatctcggcaacctcaacgagctgcaacttctgggatgtctgagcggtgtggagatggtgctcaaggatgtggggtacccagtgaaactaggtagcggcgtggcagccgcggcggcgtacctgtcaaactccacgccgctcatcccatctaggatctgagaacaatgtaaggggaggatatcgcaaacaaggccagcgacaacgagtgggcagacgaacgaacaaagcgttgctacatagtactctctcagaatgtaaagttaaatttcacacccagctgttgctacatagtagtatagttttatgaattacaggtttgattaaacttcaaattaatctacatgtatagccctgcccagatttaactatattgggaccgtattacttaccgatcaaaaaaaaaaaaaaaaagcggcc

SEQ ID NO: 16057 - DNA, 967 bp, Zea mays
  misc_feature (872)..(872): n is a, c, g, or t
ttgggcacattgggtacctcgaggccggccgggatcgcccccgccaggcgccagcctccccccgtatttgatgtttcacaaacgtgagcggctctccctcctctccagtccctccttcctccggtccgcacagcacaggggagcagccggcagcagctagctaccacagcagcaagaagctaatcagctacgatggcggactacgtgtatggccccgggcggacccacctgttcgtgccgggccccgtgaacatcccggaccccgtgatccgcgccatgaaccggcagaacgaggactaccgctcgccggcggtgccggcgctgaccaaggtcctgctggaggacgtgaagaagatcttcaagaccacgacgggcacgcccttcatgatcccgacgacggggacgggcgcgtgggagagcgcgctgaccaacacgctgtccccgggcgacagggtcgtgtccttcctcatcggacagttcagcctgctgtggatcgaccagcagcggcgcctgggcttcgacgtggacgcggtggagagcgagtggggccagggcgccgacctggccgcgctggagcgcaggctccgcgacgacgcgccgcggcacgccatcaaggccgtggccatcgtgcacaacgagacggccacgggcgtcaccaacgacctggccgcagtgcgcgcgctgctggacaagcacgcgcacccggcgctgctgctggtggacggcgtgtcgtccatctgcgcgctggacttccgcatggacgagtggggcgtggacgtggcgctcacgggctcgcagaaggcgctgtcgatgccgacggggatgggcatcgtgtgcgccagccccagggcgctggaggccagcaagacggncaggtccgtgcgcgtcttcttcgactggaaggactacctcaggttctacgacatgggcacgtactgggcctacacgcccctccatcagctcctct

SEQ ID NO: 16058 - DNA, 1760 bp, Zea mays
aagccttaagaaggaagggcacgggtcaccagtcaccacatccctccctccctgccatttgtttggttgttcctctcgcagtctcgctcgccaccaggcagcaggcatcccaatctcgcgagagccagtagcggcggcggcggcggcggcggcggcggcgcttccggcttcccttcccattggcctccaggatggcgctccgcctccacgacgtcgcgctctgcctctccccgccgctcgccgcccgccgccgcagcggcggcagtttcgtcgccgtcgcctccatgacgtccgccgccgtctccaccagggtggagaacaagaagccatttgctcctccgagggaggtacatgtccaggttacacattcaatgccatctcacaagattgaaattttcaagtcacttgatgattgggctagagataatatcttgacacatctcaagccagtcgagaagtgttggcagccacaggatttcctccctgacccagcatctgaaggatttcatgatgaagttaaggagctcagagaacgtgccaaggagatccctgatgattattttgtttgtttggttggagacatgattactgaggaagctctaccaacataccagactatgcttaacaccctcgacggtgtcagagatgagacaggtgcaagccccactgcttgggctgtttggacgagggcatggactgctgaggagaacaggcatggtgatcttctcaacaagtacatgtacctcactgggagggtggatatgaggcaaattgagaagacaattcagtatcttattggctctggaatggatcctaggactgagaataatccttatcttggtttcatctacacctccttccaagagcgggcgaccttcatctcgcatgggaacactgctcgtcatgccaaggactttggcgacttaaagctcgcacaaatctgtggcatcatcgcctcagatgagaagcgacatgaaactgcgtacaccaagatcgtggagaagttgtttgagatcgaccctgatggtacagtggttgctctggctgacatgatgaagaagaagatctcaatgcctgcccacctgatgtttgacggtcaggacgacaagctgtttgagcacttctccatggtcgcgcagaggcttggcgtttacactgccagggactacgccgacattcttgagttccttgttgacaggtggaaggtggcggacctgactggtctgtcgggtgaggggaacaaggcgcaggactacctctgcacccttgcttcaaggatccggaggctagacgagagggcccagagcagagccaagaaagcaggcacgctgcctttcagctgggtatatggtagggaagtccaactgtgaaatcggaaacccattgcgactgcttgagttggagcatagtctatcatgcaccctatgacgcatcgcgacgacaagacctggtgtgtcgcgtgacatagttgttcaggttttgaccaaatggtctgggagcatttgttttgccttgtgccgtctcatagagcgttaggatagtgtacgtctgtgttctagctttgttttgtctgctgctttgatgtacaacttgtggccatgaggctggacatggagtgaacatgttgtacattgtcgctggcggtatgtttcggtatgttatttcagttgttgagatctgttaatttttttgtgagctatggaggtcgttctgttctggtcgtggaaaaaaaaaaaaaaataaaaagatcaaaaaactct

SEQ ID NO: 16059 - DNA, 4110 bp, Zea mays
ctcaatttggatctagcccataaatcctatcaacactttctaaaatttctatagttcaacaggatcaagtcggataagatccagctaacacaaacgtgcaaatcgaatgacctttcatcattttgcgtgacacagggcagcaccggtcaatgcagcagcaggtgcgcatcggagccgtgcgttcaacgacgacaacgagatgtgagacacagaaacgaaacgagactgcgccggctactaaacttgccagggcaaatcgtggggttattacgtggaagctgcgtatggcttactacagtgttggttttatgtggtttattatgtcctatttacggagtaacgatccactaatagagttttggatagcttttatgacctatgtagcatatagattgcgctaacgtcacgatctcgtggagcggagggtagggatcaacgggcggtggcacgaccgcacgagtggagagattgatagcgacgaggacgacacaaggcttgaggcggtggggtcaagaagaggatgatggaagagtgattattcaaataatattgtcacgatttaagaataaggaagataagttattcatgtaaatctgaaccttttgttttttgtggtgggtaaagtctaggtgaattgtgttttaaccggtcgcgacctgtgccggccgacgatggagatggaggggaggcgcacgcgcccgaccgatccgcatccttcgggttcgggtccttgtgtcctcccgcccaggagtagagcagaggtacctccgttctggcgtcgccagcctcggtatcatcggcgccccgcgacgtacttgactcccgtggcccacgtcaaaaaaacgggcgcttttaccgcgcgggcatatgctctctcgctgctgtgcggcgccctggcttggttgctgcaggagccaccgcacacttgtccgtcgtggcgcgcgcggctgtgctcgccgcctcgtgtacatcgaaggatgcggctgcaagtgtcgcctcgtcgtcgccgcctggactcgtgtgccgagcgacgtgacgggactgccgcagcgagtgacgccagcaggcttggcaccactgctcctctacggcgcgtcacgacgcccacgtgagtcagcgcggcctcgtaccactcgacgacactgacagaggcggcgaggcgaggcgaggcgagacgtgccgcgccgtgcgccgtgggacggggagggtgcgctgaccggctgaccactggtaaaacgaaatcttggacgggccccggccggcgtctgcacaggccgatgattcattgattccccccgcggctttgcgaggccagcggcgttccattccacgccacacgagtgcgtgcgtgcgtgtgcgacaaggtgagctcctggttaaatctaagctaaaccaaaagcatcgtcactttgcctctcgcaagcaaataaaaagcgacgggtggcacgccacctcgttttttctccgctcacctaaaacgttttcccttctccgctatactagtcgcagggatagatagcgatggctggcctgcagcagcagctgctgccgggtgcactgcacaccacgcatgctatgctcccatgggatctggagggctctcgatactcctaatgccacgatggcttgttgtcttagtaagaagcgaaaagacgtgcgctctcgtttcttaatccccccactcaaagtcataacaatggtaatgacacgaggaagattactccacgagccaaagaacaacttgactagcgagccgaaagggaggcgcgagagggagggggcaccgcacgggacgtggaaagagacataaatatggacccacccactgccgagtggcgtccagcagtgtccgcagcagcggtggtggcgagacgagaggccgctaaaacccaagcgcggcccgagccgaacctgaacctgaggtggagagatcgcacgcgccctctgccgcttgttcgttcctcgcgcttgccaccaggcaccaccacacacatcccaatctcgcgagggcaagcagcagggtctggcgggcggcggcggcggcggcggcagcgcttccggctcccctttcccattggcctccacgatggcgctccgcctcaacgacgtcgcgctctgcctctccccgccgctcgccgcccgccgcccccgcagccgccgccgcagcagcggcaggttcgtcgccgtcgcctccatgacgtccgccgtctccaccaaggtcgagaataagaagccatttgctcctccaagggaggtacatgtccaggttacacattcaatgccacctcacaagattgaaattttcaagtcgcttgatgattgggctagagataatatcttgacgcatctcaagccagtcgagaagtgttggcagccacaggatttcctcccggacccagcatctgaaggatttcatgatgaagttaaggagctcagagaacgtgccaaggaaatccctgatgattattttgtttgtttggtgggagacatgattaccgaggaagctctaccaacataccagactatgcttaacaccctcgacggtgtcagagatgagacaggtgcaagccccactgcctgggctgtttggacgagggcatggactgctgaggagaacaggcatggtgatctgctcaacaagtatatgtacctcactgggagggtggatatgaggcagattgagaagacaattcagtatcttattggctctggaatggatcctaggactgagaataatccttatcttggtttcatctacacctccttccaagagcgggcgaccttcatctcacacgggaacactgctcgtcacgccaaggactttggcgacttaaagcttgcacaaatctgcggcatcatcgcctcggatgagaagcgacatgaaactgcgtacaccaagatcgtggagaagctgtttgagatcgaccctgatggtaccgtggtcgctctggctgacatgatgaggaagaagatctcaatgcctgcccacctgatgtttgacgggcaggacgacaagctgttcgagcacttctccatggtcgcgcagaggcttggcgtttacactgccagggactacgccgacatcctcgagttcctcgtcgacaggtggaaggtggtgaacctgactggtctgtcgggtgaagggaacaaggcgcaggactacctttgcacccttgcttcaaggatcaggaggctggaggagagggcccagagcagagccaagaaagcaggcacgctgcctttcagctgggtatacggtagggacgtccaactgtgagatcggaaacctgctgcggactgcttagacaagacctgctgtgtctgcgttacatagttctccaggttttgaccagatggtcccgtgtcgtcttatagagcgataggagaacgtgttggtctgtggtgtagctttgttttttatttttatttttctgttttgatgtacaacctgtggccgcatgaactggggcgtggagatgggagcgaccatgccgttctttgtctgtcgctggcggtgtgtttcggtatgttatttcagtcgttcagatctgttaaaaaaaaagtgagctatgcagttcagttcagctctacccagttcgttagataccctaggtttctccgtggcctgaattctgcagtgtcgaaaacaaagcagaactccaactgaagtgtagctgactacttgacacatccagcatatatgtcttccaaaaaggtcgacacatcttgcagacaatgagctccaaccgacgaaagagcagctacctttctgcttgcactgcagataagcggcatacgattcatctatcagttcgtggagtggcatttttgcactgcactgcataaaccacccaccggtcgtcgctattctcgctgcatcgggagatgtggcttaacgggcaccgtggttagggcatttcagagatcgacaagtactggcctgtggacaagagcatatccggttgaagcggtgcccaggcccagcagaatgcaatacgtttccaaaataaaaacccagcatgcaatatatgtgtcgctcatgtgcataatacagttggtcaatatacgaaatgctgtataccaagacaaaataatatgcgcagatgatat

SEQ ID NO: 16060 - DNA, 3832 bp, Zea mays
tttttttttttttttgggtaatatttgttttttttttttttttaattaataatacacctttcatttgctgtcgctcttaagaatcaaccgtgctcgcagaaagcgcatataagtttttcttaacacacacacggaaacgctaattttccattctgaacacatgggcgctgcttctagcccgttttacttatctctacttccaatcttgctacttcaaaagcatcccatatataattaattcttaattaacatgccttacgcctatatttctcctgtgtcctgtgttctgtctttgcagttttaccacagcactggctttgttacttgctcgatatgatggatgaaactgtccttgtcatcaacctcacattggatgacagttaattctcgccgccgcaccggcccgggcccgacgacgggacgccgacccacggctcgccgaccctgatcatcttgatgggccgctcgctggccgccgcttcctcgcaccggcccctcttcctcgcggcgtcctttaagagtacgccgaacagcttcacgctcttcccctcctcgccgccgccgcgctccagctggctggccactgcgtgcgcgcggcgctgtgcgccgtcgtcgcttgcccccgctcgcacgtcctcctgcatgagcagccggaggtcgagctgccggacgtcgaggaagcgcgagaggaagcccaggagctcctcgcagtgccggcgcgcctgcgccagctcgacggacagcgtgtggttgtccttcttgagctgctcgttctcgctggccaggtcgggcgcccgcggtggcgacgacgccgacgacgagctgcgctcgtggacgccggacgtggtggccgacgcgggaggtggagggggcagaggcggggggaacgtggcgttcacgccgccgctgccgccggatccggacttggacatctgcagcgccgttgacttgcggcggcggatgccggacaggagaccctgctcgcctcgacggaagttgtcgttcgcgaactcccaccggtccggcaccaccttccggaaaccgtaggtgttgagctggcggacgaaggaggagaagttgcagtgcttgaagtggagcgggaggaggtcgcgcgccagctcaacgggcttccacaccacgaaggagcggccctgctccgcccacgagatcacctcgtccgtgccccgctcctccaccatctggtgcgtcttggtcaggaacggcgccggcccgccgccgcccctcttcgacgccgccacggccgaggccgcttctcccatctctcgccgccggctatgtatatagctcgatcggcacgattggctctgcttgcacgcgaacctcactcacctttgtatgtatatatgtatgtgttgtataggctactaactagctagtaactgatgacttgtgtgctgttgtgtgtacggctgagctacctaagggaatgaaagaaagaaggtaggtagcttgctagtaggagtctgcggcggcgacggcggccgagaagagaaggagggcggtgaggaactcccagccccagacgtagaacccggtgacgaccgccctccgcccgcacccgcccgcctctactcccatgtaagcgcctgtgcgcctgcgccgccgctcggccggcacgatcggtgatctggtgcttccagctgcgtgtgggctccggccggctagctctccgccctggcgtcgcgagaggcgctcatcgcctcgatccgccgatttaaagggcgggctttatcggggtcggggccggggtagctggacaggacaggaggaggacggaagtgaggggcttctcttcacgcgcgatcgagggcggcacaggcgagagaccagcgcggtggttgctttcggcgttgggcttcttgctttctgagtgtaggtaggagtctgtctggtactggccacgcgcgggtagcgtgatgacctccgtctgcttcttcgcgcgggtacgtatgctcagcagtcagctcgcccacccctttcagccgctcttccttgcagccggcccgcggccggtccaaataagaagcttccaccgctttgtcgtccaatatccaggagccgtgagccgagccgagtcaaagcgcccgaaaattcgtcgctcgcccaagcggggcccgccgctcctggctggctggctggctcccacgcacaggagggaggagggcccggcccgtctcgaccgcgccaggacgaaccgactgtcctttggatcctcctcggcaccggaatgcctcgtcaccacctgtgacgctggcgggcgcctgcctcgccgtcgccgggagagaaagtaaaccacccaaaggcgcgtggaaaatgcgcgcgcgagcgcggacttgtgctcggagcgctcgtcgcactccactgcggtgcggcacacccccgatttgtccacatctcgcttccgcggaccccgaagaagccgcgcccgcctgcgcgtgagtgctctcactgatgactgatcccttccctttccctacacgtacgcgcaacagccgcgccagccaaacttcgctgcggcaaatttaaaactcttggactttgaaaacgaaaagtgaaaaaaaaaggaaactagctaccgtgtgtgcaagccgtcgatatcgatgatgcttgcagtcagatcgaataataagctgacgtactagctactttgaattatcgtaacttatcactaacttctagtagttactttcatcagccgttgatttcatttcttctccgtgccaaaacaaaaacagattcgaggtaggtgcgaacaagatggctggctaccacgatcattaaagcttggactttttcgtcgatcggcacacgaaacggcgccgggaaagtgaaatcatcggccgggccgagcttgacacgcacacgcagccccggccggcgcgtcgaccatgccgtcacactgacgacgcggattgtactactgtatttatactaggcggacttgatgtctaatttcatctagctgtctttaactactagtgcgcaattaactttctcttaactcaaattacttagtagtaatggtctttgaaccctcaacccgtctatatatattggaggtttatgtatagacttagggctcgtcatcagtcaaaaatagctcagactctgtttgaatgttatggttttacataactgtagtacaaagaggtctagaatggcgtttctagaactctccaacgacatatactccctccatcctaaaacattaagtcgtttaattttagctcttcattttttatgtcaatgtttaaatggatggcgatgatgaatctaaaaatatatatataaaacaaacgtattaactattgtatgaaatcaactaaaaaggtaaaacatgttttattttgggaacggagggagcagtttactttaggtggtctttaataacacataatggaacgagtcattacattataaatcagatcggatgaccgttactaataacaatgattatattatgccaagtagatgactggatgtgtttatcttttttttttcaggattctctaatatctatattctttctagcgtgtcttgatagcattcattcctccagttagcagttccaattttcataaatataagcgaataaatggaaataaaaaatcagccattcataacaaccttgaattaagtgcaggctgcacggtactgatggtggctggtaatcctagaatgttggatgtatgcttaaaagttttccgatggaatgcttggatcatggtctatctcgatcgtctctctctgtgtgtgtacggagaacacgtgcacgaaacaaaagagagcacctataaagtactagtgcttt

SEQ ID NO: 16061 - DNA, 2117 bp, Zea mays
  misc_feature (190)..(193): n is a, c, g, or t
  misc_feature (195)..(195): n is a, c, g, or t
cagtgtcctcagcagcggtggtggcgagacgagaggccgctaaaacccaagcgcggcccgagccgaacctgaacctgaggtggagagatcgcacgcgccctctgccgcttgttcgttcctcgcgctcgccaccaggcaccaccacacacatcccaatctcgcgagggcaagcagcaggggtctgcggcgnnnncngcggcccgctttccccctcccctcccctgcggccgccacgatggcgctccgcctcaacgacgtcgcgctctgcctctccccgccgctcgccgcccgccgccgccgcagccgcagccgcagccgcagcagcggcaggttcgtcgccgtcgcctccatgacgtccgccgtctccaccaaggtcgagaataagaagccatttgctcctccaagggaggtacatgtccaggtgacacattcaatgccacctcacaagattgaaattttcaagtcgcttgatgattgggctagagataatatcttgacgcatctcaagccagtcgagaagtgttggcagccacaggatttcctccctgacccagcatctgaaggatttcatgatgaagttaaggagctcagagaacgtgccaaggaaatccctgatgattattttgtttgtttggtgggagacatgattaccgcgacagcaacgccatccgaccagactatgcttaacaccctcgacggtgtcagagatgagacaggtgcaagccccactgcctgggctgtttggacgagggcatggactgctgaggagaacaggcatggtgatctgctcaacaagtatatgtacctcactgggagggtggatatgaggcagattgagaagacaattcagtatcttattggctctggaatggtaacatattctctcatccatttttttttaccgagtcttgacacattttttcagctgttcatgcttctcaagtgtttattttggcttgttgggagtttggttctttggcgaaatcattttgatagtaactcagtatgctgccatagtttttttgagcaactgttgttctgaataatattcaaccgtggttccatttcacggtcattggttaattatctgttgttcatttcgttttttttttctttaaatataggccacttcttataaatatgtaggagggctaatatgtactttctttactgtgtccttttcaggatcctaggactgagaataatccttatcttggtttcatctacacctccttccaagagcgggcgaccttcatctcacacgggaacactgctcgtcacgccaaggactttggcgacttaaagcttgcacaaatctgcggcatcatcgcctcagatgagaagcgacatgaaactgcgtacaccaagatcgtggagaagctgtttgagatcgaccctgatggtaccgtggtcgctctggctgacatgatgaggaagaagatctcaatgcctgcccacctgatgtttgacgggcaggacgacaagctgttcgagcacttctccatggtcgcgcagaggcttggcgtttacaccgccagggactacgccgacatcctcgagttcctcgtcgacaggtggaaggtggcgagcctgactggtctgtcgggtgaagggaacaaggcgcaggactacctttgcacccttgcttcaagaatcaggaggctggaggagagggcccagagcagagccaagaaagccggcacgctgcctttcagctgggtatacggtagggacgtccaactgtgagatcggaaacctgctgcggactgcttagacaagacctgctgtgtctgcgttacataggtctccaggttttgatcaaatggtcccgtgtcgtcttatagagcgataggagaacgtgttggtctgtggtgtagctttgtttttattttgtatttttctgctttgatgtacaacctgtggccgcatgaactggggcgtggagatgggagcgaccatgccgtactttgtctgtcgctggcggtgtgtttcggtatgttatttgagttgctcagatctgttaaaaattttgtgagctatgcagttcagttctgttctgttctgttcgtcagaaaaaaaaaaaaaaaaaaaaaactcaaggcggcgcccggtaccca

SEQ ID NO: 16062 - DNA, 1629 bp, Zea mays
gggtaccccgtacctcgaggccggccgggacgggtcaccagtcaccacatccctccctcactgccatttgtttggttgttcctctcgctcgccagtcgccaccaggcagcaggcatcccaatctcgcgagagccagtagcggcggcggcgcttccggcttcccttcccattggcctccgggatggcgctccgcctccacgacgtcgcgctctgcctctccccgccgctcgccgcccgccgccgcagcggcggcagtttcgtcgccgtcgcctccatgacgtccgccgccgtctccaccagggtggagaacaagaagccatttgctcctccgagggaggtacatgtccaggttacacattcaatgccatctcacaagattgaaattttcaagtcacttgatgattgggctagagataatatcttgacacatctcaagccagtcgagaagtgttggcagccacaggatttcctccctgacccagcatctgaaggatttcatgatgaagttaaggagctcagagaacgtgccaaggagatccctgatgattattttgtttgtttggttggagacatgattactgaggaagctctaccaacataccagactatgcttaacaccctcgacggtgtcagagatgagacaggtgcaagccccactgcttgggctgtttggacgagggcatggactgctgaggagaacaggcatggtgatcttctcaacaagtacatgtacctcactgggagggtagatatgaggcaaattgagaagacaattcagtatcttattggctctggaatggatcctaggactgagaataatccttatcttggtttcatctacacctccttccaagagcgggcgaccttcatctcgcatgggaacactgctcgtcatgccaaggactttggcgacttaaagctcgcacaaatctgtggcatcatcgcctcagatgagaagcgacatgaaactgcgtacaccaagatcgtggagaagttgtttgagatcgaccctgatggtacagtggttgctctggctgacatgatgaagaagaagatctcaatgcctgcccacctgatgtttgacggtcaggacgacaagctgtttgagcacttctccatggtcgcgcagaggcttggcgtttacactgctagggactacgccgacattcttgagttccttgttgacaggtggaaggtggcggacctgactggtctgtcgggtgaggggaacaaggcgcaggactacctctgcacccttgcttcaaggatccggaggctagacgagagggcccagagcagagccaagaaagcaggcacgctgcctttcagctgggtatatggtagggaagtccaactgtgaaatcggaaacccattgcgactgcttgagttggagcatagtctatcatgcaccctatgacgcatcgcgacgacaagacctggtgtgtcgcgtgacatagttgttcaggttttgaccaaatggtctgggagcatttgttttgccttgtgccgtctcatagagcgttaggatagtgtacgtctgtgttctagctttgttttgtctgctgctttgatgtacaacttgtggccatgaggctggacatggagtgaacatgttgtacattgtcgct

SEQ ID NO: 16063 - DNA, 1353 bp, Zea mays
cattgggaccccccgaggccggccgggccccacccatcccaatctcgcgagggccgcagcagcggcaggttcgtcgccgtcgcctccatgacgtccgccgtctccaccaaggtcgagaataagaagccatttgctcctccaagggaggtacatgtccaggttacacattcaatgccacctcacaagattgaaattttcaagtcgcttgatgattgggctagagataatatcttgacgcatctcaagccagtcgagaagtgttggcagccacaggatttcctcccggacccagcatctgaaggatttcatgatgaagttaaggagctcagagaacgtgccaaggaaatccctgatgattattttgtttgtttggtgggagacatgattaccgaggaagctctaccaacataccagactatgcttaacaccctcgacggtgtcagagatgagacaggtgcaagccccactgcctgggctgtttggacgagggcatggactgctgaggagaacaggcatggtgatctgctcaacaagtatatgtacctcactgggagggtggatatgaggcagattgagaagacaattcagtatcttattggctctggaatggatcctaggactgagaataatccttatcttggtttcatctacacctccttccaagagcgggcgaccttcatctcacacgggaacactgctcgtcacgccaaggactttggcgacttaaagcttgcacaaatctgcggcatcatcgcctcagatgagaagcgacatgaaactgcgtacaccaagatcgtggagaagctgtttgagatcgaccctgatggtaccgtggtcgctctggctgacatgatgaggaagaaagatctcaatgcctgcccacctgatgtttgacgggcaggacgacaagctgttcgagcacttctccatggtcgcgcagaggcttggcgtttacaccgccagggactacgccgacatcctcgagttcctcgtcgacaggtggaaggtggcgagcctgactggtctgtcgggtgaagggaacaaggcgcaggactacctttgcacccttgcttcaagaatcaggaggctggaggagagggcccagagcagagccaagaaagccggcacgctgcctttcagctgggtatacggtagggacgtccaactgtgagatcggaaacctgctgcggactgcttagacaagacctgctgtgtctgcgttacataggtctcccaggttttgatcaaatgggcccgtgtcgtcttattaaagcataaggaaaccgtgtttggcctgtggtcgtagcttttgtttttatttggtaatttctctggctttgaatgaccaaccct

SEQ ID NO: 16064 - DNA, 1530 bp, Zea mays
cttgccaccaggcaccaccacacaccccccacgcgcgcgcggcccagtcgcagccgccgccgcagcagcggcaggttcgtcgccgtcgcctccatgacgtccgccgtctccaccaaggtcgagaataagaagccatttgctcctccaagggaggtacatgtccaggttacacattcaatgccacctcacaagattgaaattttcaagtcacttgatgattgggctagagataatatcttgacacatctcaagccagtcgagaagtgttggcagccacaggatttcctccctgacccagcatctgaaggatttcatgatgaagttaaggagctcagagaacgtgccaaggaaatccctgatgattattttgtttgtttggtgggagacatgattaccgaggaagctctaccaacataccagactatgcttaacaccctcgatggtgtcagagatgagacaggtgcaagccccactgcctgggctgtttggacgagggcatggactgctgaggagaacaggcatggtgatctgctcaacaagtatatgtacctcactgggagggtggatatgaggcagattgagaagacaattcagtatcttattggctctggaatggatcctaggactgagaataatccttatcttggtttcatctacacctccttccaagagcgggcgaccttcatctcacacgggaacactgctcgtcacgccaaggactttggcgacttaaagcttgcacaaatctgcggcatcatcgcctcggatgagaagcgacatgaaactgcgtacaccaagatcgtggagaagctgtttgagatcgaccctgatggtaccgtggtcgctctggctgacatgatgaggaagaagatctcaatgcctgcccacctgatgtttgacgggcaggacgacaagctgttcgagcacttctccatggtcgcgcagaggcttggcgtttacaccgccagggactacgccgacatcctcgagttcctcgtcgacaggtggaaggtggcgaacctgactggtctgtcaggtgaagggaacaaggcgcaggactacctttgcacccttgcttcaaggatcaggaggctggaggagagggcccagagcagagccaagaaagcaggcacgctgcctttcagctgggtatacggtagggacgtccaactgtgagatcggaaacctgctgcggactgcttagacaaggcctgctgtgctgtgtctgcgttacatagttctccaggttttgatcagatggtcccgtgtcgtcttatagagcgataggagaacgtgttggtctgtggtgtagctttgttttttatttttatttttctgctttgatgtacaacctgtggccgcatgaactggggcgtggagatgggagcgaccatgccgtactttgtctgtcgctggcggtgtgtttcggtatgttatttcagtcgttcagatctgttaaaaattttgtgagctatgcagttcagttcagaacaaaaaaaaaaaaaaactgagactagttctccctcgtgc

SEQ ID NO: 16065 - DNA, 2769 bp, Zea mays
ccgggccgcaagcaagcagcgactcccgccgcgcacggcaccttcccctcccccgcacggccgcacacaccagacaccaccaccactcgcaagtctcttcgccgtctcgccgagttattagaaggcggggaaaaaaatcaactcgaacgggcgggtggcaaccaaccaccaagcggcgagggcgatggcggcgtccccgccgcggaagcggctccctgctgcgcgcctcatcttcgccctccttctcctgatgtcctccgtgctgccgagggacgccggggcggtggaactggggctgaagctgcccttcagtccgggggacgtgctccccgtcctgccgcggcaggtggcgtggcccgtcatgaacacgctccacagcgccgtcgacctactgccgtccttcgtcgccgccgtggcgcccgggtcgccggcgccggcggcctggaaaggcgcgtgcttctcggagaacgaggccgctatcgagctcacgcccggggaccgcaacgggaccgacgtcggcggtgccgtactgcgcctcaagactgcttcagctcatagttgggcgtgcatggatctctacgtttttgcaacaccatataggataacatgggactattattttgctgctcgggagcacactttggagattaaatcatgggaggaagaagcggaattgaaatatgtgaaggagcatggcatttctatttttctcatgccatctggaatgctcggaactttgctatctttgattgatgtcctgcctttgttttcaaacactgcctggggccaacattccaacctagcctttttagagaagcatatgggagcctcatttgagaaacgaacccaaccttgggttgctaacattagaaaggaggatatacaatctggtgactttttggctttatcaaagattcgaggacgatggggtgggtttgagacattagagaaatgggtgactggtgcatttgctgggcatacctcggtttgcttaaaagacgagaagggtgatctttgggttgcagagtcaggctatgaaaacgagaagggagaagaaatcattgctatagttccttgggatgaatggtgggccatggctctcaaggatgaatcaaatcctcagatagccctgcttcctttgcaccctgatgtgcgtgccagattcaacgaaagtgctgcatgggaatatgcccggagcatggttggaaatccttatggctaccataacatgatatttagctggatcgatacaattggagataattatccacctcctcttgatgctaacctggtaatggcagttatgtcaatgtggactagattgcagccagtttatgctgcaaacatgtggaatgaagctctaaacaaacgacttggcactgaggatttggaccttcaggggatcattatggagattgaaagacgtggaatgtcttttgatcagttgctcaccatacccgagcaagacgaatgggtgtacagtgatggtaaatcaactacttgtgtcgccttcattcttgcaatgtacaaggaggctggaatattcacccctttctcggagtcgatccaggtcaccgagttcactattcgtgacgcatacatgctcaagatatttgaagacaacccggcaaggcttccaggttggtgcaacgcagacacggacaagcttcccttttgccagattctcggagagtacagaatggagttaccagagtacaacacgattgaaccttatgcgaaaatgaacgagaactgtccgtccttgcccccaacgtacaaacgacccgcacgctgctgactacgagattgtctactatgtatctttctgcagctgcttcgtttacacagtggcagtagagtgttgttgctatgttctgtaaataaaagacactatatatataggtgcttggtagatggtagttcttaccagtaatgtagctgcgatgtattcaggttcacggttttcagtcgatcagttctgaagccacggcgtcggcgaccaatatgaaggttaggatttgtcagctccggaaagttgcttatatgtatcaatgtatgtatgtaggcaacattatggcttggtcataaattgtgaactccgtcaagaaataaatctataatgcaacgtcaggtgattctgataaaaaaaaaaaaaaaagacgaaaacataacaaagattactccatctgtcccaaatctatctattattatagagtagctgtagattcctaaaaacctaattttagctataagctgtggcagctgttgcacggtgacggttgtagctaaaatatatttagttaaaataactgtcaattatagattctgtaagagcatgatagcttaataaattgatagcagaaatctgaaaaatttaggtagaagaaaatttttaattgaactatagaaatatatatatatttagaaatttattctctatttgtttggtagagattcaaatttctggcggtgaatctagtttagatagctgaaccaagcacaccatatgatatggatattaatcaaaaaagagaaaatatgtatagttgaattttaggaagatctaactgtctagcttaaacaatatacctgtaccacatacaatataatagtttggagcccaagaaaatggtatgctcatcctattatagctcagcaggtgcaggtttgattctttttggaaggtgaattttaaaataaggaaagagtccggctactaggccgtttttatttgcattggccaaacaaaggaaacactgcaggcatgca

SEQ ID NO: 16066 - DNA, 2328 bp, Zea mays
cgcagtttatataattgggggcccccgggccggccggcggcacacaagcaaagaacttggccccgcctcccgtctcttaccgcacatgcgcgtcgggccgcgtcgacatagctgcttgccgccgacacccgcagccgcaatggccgtcgcccacgcgccgccgcgccggggcgtgctccccctcctgctcgtcgccgcgctcgtggcggcgttgccggccacctgcgccgcggccaggagcaagaagtcgtacacggccatcttcagcttcggggactcgctctccgacgccggcaacctcatcgtcaacggcacgcccaaggcgctcaccaccgcgcgccctccctacgggatgaccttcttccgcaagcccaccggccgctgctccaacggccgcctcgtcgtcgacttcctggccgagcatttcgggctgccactgccgccaccgtcgcaggccaagggcaaggacttcaagaagggcgccaacttcgccatcaccggcgcgacggccctggagtactccttcttcaaggcgcacggcatcgaccagcgcatctggaacaccggctccatcaacacccagatcggctggctccaggacatgaagccgtccctctgtaaatcggagcaagactgcaaggattacttcagcaaatccctgttcgtcgtcggggagttcgggggcaacgactacaacgcgccgctcttctccggcgtcccattttctgatgtcaagacttacgtgccccttgttgcaaaggctatcgccaatggcgttgagaaactgatcgagcttggggcaacagacctcctggtgcctggcgttctcccaattggctgcttcccgttgtacctgacgctgtacaacaccagcagcaaagcagactacaacgcccggaccgggtgccttcggaggtacaaccgcctggccttccaccacaacagggagctgaagcagcagcttgacgagcttcagaagaagtaccccaagacgaagatcatgtatggagattacttcaaggctgcactgcagtttgtcgtcaaccctggaaaatttggttttagcacggccttgcaggcgtgctgcggcgcaggagggcagggcaactacaacttcaacctgaagaagaagtgtggcgagcagggcgcgagcgtgtgctccaacccgtcgtcgtacgtgagctgggacggcatccacatgaccgaagctgcgtacagaaaggtcgccaatggctggttgaatggcccgtatgctcagcccccaattctcaagtcatgatcgagattactaggctgtgcgtaataccgccgcagctgcatgctgcggctagagatatatatgaggagtgtttcaggcaatagatatgctaagttatggtaaagctatttggtctgttcattggaagatctgtataaactgcgccggtatagatatgttcccagctgaaatggctctagcacagatgtgcatggcatgttctctgattcttttcatttgttctaaaaaaatattgcggcagtaatatgagttgataaaagtaactaaatttctgcaaaaaaaaaaaaaaaaaaagctaccattaaatttcccccatccaggtcgatctagtgttgcaatttctattcggtcatgacagttgatataagccacgttacagaacacagcatgcctggctttgatgtggacgggtgagaaatagaagtgccaacaactggtatgattacgaaggctgctcaattgctgcttgacaactcagtgaggtagctgcatctgaataatccttggaatggattaatttgtagcaccagcaatcctgcattttggaatgctgcacgcctgggtttgtaagtcgaatgcacctgagttaatatttagctgctaaaattagctgaggacatttaaacaatctagctagtagctagctacttttagtaaattagctaatagttagctagataattccagtagcaattgtttagctactaactgttacatctagtagattcctgtcaaacaaatgggacctatatctctgcgtaactctgcttcatgctcacgtacggaagccatgattttgttatttttttttgccgaggacatggtgagcaagaaacctccattcatgtgagtatacttctatgactggagggtgtacttgccttccgtccttggaggacaactggataagataactgatgtctgcatctggtcatagcttggagtgatgctggatcatttgccaggcattccggaacaatccaccggcggagttcacgaggccgggtgttggattcaaaagtttcaatgctgcaggtcgactatagagg

SEQ ID NO: 16067 - DNA, 1217 bp, Zea mays
caatcgttgagactcccatgtccctgaagttggaaatcaccagccatctgtaccaaggatgaagcaattggcacgcacaattaccaattcatcttcgtcctcgggaaacctgggtctgaatcatacagtatttggaagggtaaagcagattagcctttcatcctatcttaggcattctttgcatactggaggtggttctgatgcaccgagtcctgcacccatgcatcaccatggtcatcatggcgatcatcaccatcaccacagtcatgacgacaaccggcatctagctcctgctccagctccagctccagctccagtacattttgctatgccgcaacccagatatggtgctccacctccatctgggtgtccatacagcaaaaacaagccaaataaaagagggcccgttacaattacaccagctgctgagcctgcagctaatgatcaccgatctacttccattgctttaccaccacatccatcgtcaccttcatctgctagtcgctctcgacatggtcccagtatgcagggtggagctcctgtttctcaccctcctgctctaccagagccacctttgcccactgtttcgttcgctcatccacatcttccaagtgaacgtggaacagggataagtcctgctccaagtgaagaggcggcaacactagcagatcctgctgggatgtcacaagtggcacctgcacctcatgcatcttacgccgccaggatgcagggcgatgctccctgccgctggattctttttctcctcgcgctatgcaccataacgagccttctagtacgatgaaaggagtacacgggccggccaacatcagcaaccgccgccgctgtttgtacgtgctaaagaggaccgaccgcacgggtctcccaccggcaaggcgaccatcagaagaccataacgagctcgcccctcgttgctggtagctgtcagtttgtcgctgcatgtaaatattggatgggtttacaaaaccgcgagacgcgtggtggtcaaagccacagggggtggcaggcccttgtccagcgtgtgtgtagtgctgctgctgctgctgattctcaagtctgaattcggcagacgcggcctcgtcaaaagtgtaaagaacctccagttccggagggttcgttccgcatctatccacgcgctcagttttgctgtggcggtagttcaaaaaaaaaaaaaaaaaaaaaaaaaaaaaaaaaaaaaa

SEQ ID NO: 16068 - DNA, 540 bp, Zea mays
tacacatcataagaagcagagcaaggatttgatccttggaggccagaagaaggaagggaagaaggacaaatctggcaagaaatctaggtctgaggaagaccctagttcttcaaaaacagagaacgacaggatgacaaatgggcaagagtcaacagatgccaagaaaaagtctaccagaagtgaacggcggaagcgtcgcaagtctgagctaaggccatccagtgatcgattagaggcatatggaaagataaattcaaagcgtcacaagagccattgaccttctgagattcatcaaagtacatctggggaattttgctgttctttttatgcattggacaggtgaaagtcttagatttagctgtccttgcttctattttgggagatgcaaaactagtgttgccctagtagaaacatctgttgtcttagagttttgcagacattgtgttgtgcgcctccttttaattttaattgttttttttgtagaccatatatataatataatttccctgcaatttttcttgtcaaaaaaaaaaaaaaaaa

SEQ ID NO: 16069 - DNA, 547 bp, Zea mays
ttttttttttttttttgccatggtacataacctacttacttatttcgtgtacagatttctctgcctgtgactatgactgtataattgccttttttcttttttttgcagacctgcagttacatgatccgcaaggtgcgtgtgtttctaatagcttgattccctttcgctttctctccctctctctctcagatacatgttgctgtagtgctgccaaccgctaagctgactcgcacgttttgcagtcaggaagcgttttgcctgcaaggaaaccctggacaagcacgagcgctcgccttggctggtagctgggcacctcgtgcccggctcctctgacggtgaccaggctgaggctgcccttctccttgcccttgtactgcacgacgtagccgcccacctctccggcgccctgagtgctgctgaaccatgccctccattttgcggcaactgggagctggagctggttcacggagtacctgctggaagtgaccggcactctcccatcggtgtctccactgtacacccagaccctgatgtcgttgttgaggag

SEQ ID NO: 16070 - DNA, 1260 bp, Zea mays
ggttctctctatataaaatcagttctttttttagcacacttctctagtgatagctcattcatttcatcactgtaaagatttgcttaaagatccgtgtgattccatcttcattcgtgtacagattgctctgtgtatgactgcatttttgcatgattctctgcaaggtacggtgggtgggtgcgtatgtttctatctctgactatgtctgtcgtagtggatcaaatggatggggggtacatgctgttgcagcgcttctcttctcttgtgtgctgcgtgctgcttccaaacgctagctacgcttaaaccgactcgcaggtttcgcagtcggggagcgccttgcccgcgaggaagccctggacaagcacgagcgctcgctttggctggtagctgggcacctcgtggccggctcccctcacggtgaccaggctgaggctgcccttctccttgcccttgtactgcaccacgtagccacccacctccccggccccctgagtgctgctgaaccatgccctccattttgcagccacggggagctggagctggttgacggagtacctgctggaagtcaccggcactctcccgtcggtgtctccgctgccaacatcacagcgacatatgcttccacgttgtcaatttgcctcatcagtggagctgaaaatagagacgactgtgctgtgctgtgctggcgtgtacctgtacacccacaccctgaggtcgttcttgaggagctccgcgagaatcggcaggacggtcgcggcgctgtcagtccagcgtctcaagacatcgctgatgagaacagattgtaaacagccttgtttcaaaccaaacaaaaaaaaatctttttttttgggccccaaggccccaaacccaatcagttctggcgccacgcagcatgggccggaacaagtggagcaatcatgcaccacaggttacttccaagatgcgcaagcgattttataattccatccccccactggtctggaagctggagctggagcagcctgcacgcgattttacaattccaaccgactcacactcactcatcagttctcccggcccggccggctgcgcatgcagttggtggaagttgggaaggcttttgtttgagcacgcaagtgcaaccacctacctcttttgcgttgttcctgtgctaaacctaccgtgcacagaatatgcatacatataatctgaacctaatcctgttatgttgttatggataattattaattatgcggccaccagcaccaggtgtacctgcag

SEQ ID NO: 16071 - DNA, 1191 bp, Zea mays
taccttcctggacccacgtttcagtgagcatgggtgtcacctgacctgacatgccctttcaaagcctggtcctgaactcagaccaccatctgttttactatatggtctgtatagtatggttttatttcgtagtgattgaggagaatttcatttttcttccccctcttgtttcaatggactgtaagacttctaagagacctactgggctactggcgcctattgctttggttggtgtggttaactgacggtactgtggtgtattcgaaagaaaagaaaataactgatgatggtgtccagtactagatttttaaggtacacacggtgtaacttgtctatctgatacagaagttgtttgaggtagtaccttcttagagcctgttgcttctaatacaagccttgtcagcgttcctgtaagcctagaaaataactgatggtgttcagtactatatttgcacaaagtttgctttttcacaacagtggttctctctatataaaatcagttcttttttatagcacacttctctagtgatagctcattcatttcatcactgtaaagatttgcttaaagatccgtgtgattccatcttcattcgtgtacagattgctctgtgtatgactgcatttttgcatggttttctgcaaggtacggtgggtgcgtgcgtatgtttctatctcagactttgtctgtcgtactggatcaaatggatgcatgggggtacatgctgttgcacagcgctctcttctcttgtgtgctgcgtgctgcgtgctgcttccaaacgctagctacgcttaacccgactcgcatgtttcgcagtcggggagcgccttgcccgcgaggaagccctggacaagcacgagcgctcgctttggctggtagctgggcacctcgtggccggctcccctcacggtgaccaggctgaggctgcccttctccttgcccttgtactgcaccacgtagccacccacctccccggccccctgagtgctgctgaaccatgccctccattttgcagccacggggagctggagctggttgacggagtacctgctggaagtcaccggcactctcccgtcggtgtctccactgtacacccacaccctgaggtcgttcttgaggagctccgcgagaatcggcaggacggtcgcggcgctgtcagtccagcgtctcaagacatcgctgcagacgaacag

SEQ ID NO: 16072 - DNA, 4223 bp, Zea mays
attttcattaaactgtgatggtctatttctttaaaaaataaatgcttgcatctgtatgtttcatacatctgttagttcttctcttctttacacttaaaagttaaaacatggattcagttgaactacaatcaaactgtgatggtatacctggttataaacaaaggtttatttctgtgtgtttcatgctactgttatctcttctccttttgagttactgatgtggattcagttgagttaatatcaaattgggattttatatttcattcagaacggatgctaagtatgtttcatgcatctgttagctctctttttttacacttaagatgtgaattcagtcgagttaagagagattgtgaattgtgatgctgtacttcgtccaaaaataaatgtttgtttctgtatgtttcatgcttctgttagctcttctctcttttacacttcagatatgaatttagttgagttaaaagaatcaatttgagacgctgatgtttgacgttcttttttgttgatgttccaggaaaatgtcaacgaatcctgatgaacctaagagtcgtgcccggacagactttttgctcaacaatgaactggaggtccagaagttttgggatgagaacacggtttttcaggctgatcctggcaatgactctccaagccccggggaaaaattctttgggaactttccatacccttacatgaatggcttgctgcatctgggtcatgccttctcattgtccaagcttgagtttggtgctgcataccacaggcttcgtggctccaatgttcttttgccctttgctttccactgcactggaatgcccatcaaggcctccgcagataagctagctagggaaatccaacaatatggatatcctccggtgtttcctgtggcagagggttctagtgctgcagtagcagatgctacccaggctgaccaggctgatgttgttgccccagataagtttaaggggaagaagtccaaggctactgcaaaggctggtgcacaaaagtaccagtgggagatcatgaagagctttggtctagatgatgaagaaattgccagatttcaagatccttatcattggttgactcacttccctccgctggcaaaggaggttctcaagaaatttggcttgggttgtgactggaggaggtcattcataactactgacccggccccgctctgtgatgcttttgttaagtggcagatgaggaagctgaagaaattgggcaaagttgttaaagacatgaggtacacaatctactctccgttggatggccaaccttgtgctgatcatgatagggcaacaggtgaaggtgtgcagccacaagaatacgtcttgattaaaatggaggtgatatcaccttttcctcccaagctgaagtcattggaagggaggaaggtatacttggcagctgctacactaagacccgagacaatgtatggacagacaaattgctgggtccttcctgatggaatgtatggtgcttttgagattaatgacactgatgtcttcatccttacagcaaggtctgcttttaatcttgcataccaacacctatccagggtccctgaaaaaccaacctgcttatgtgagctatctggcagtgatttgattggtttgccactgaaatctcctcttgccttcaatgaaacaatatatgctcttccaatgctcactgtcttgactgacaaaggtactggcattgtgactagtgtccctagtgattcacctgatgatttcatggcactgcaagatttagtcacaaagccagcattgagagcaaagtatggagtgaaagatgagtgggttcttccttatgagattataccaataatccacattcctgaatttggagacaagtcagcagagaaggtttgccatgatcttaagattaaaagccagaacgacaaggagaagcttgctgaagcaaaaagaatgacatatctgaagggatttactgatggaacaatgattgtaggtgagttcagtggtagaaaggttcaggaagcgaaaccgctgattaaaagtaagcttttggaagaaggcacagctgtgttgtatagtgagccggagaagaaggtcatgtctagatctggtgatgaatgtgttgttgccctcactgatcagtggtatataacttatggcgaggctgaatggaagcagaaggcagtcaaatgtttggaccgcatgaatacattctcaactgaaacccgcaatggttttgaacatacgctgggctggctgaaccagtgggcttgttcacgttcatttggactcggtaactcgaattccatgggatgagcagttccttgtagaatctctttctgattctaccctatacatggcttattatacagttgcacaccttttgcaaaatggtaatatgtatgggaaagaaatatcttcagtaaggccagaagaaatgacagatgaagtctgggatttcgtgttttgtgatggcccggcaccaaaaagcgagatccctgccgctctgttgaacaagatgaaacatgaatttaagtattggtatccatttgatatccgtgtgtctggtaaagaccttattcaaaaccatttgacattctgcatatacaatcatacagcacttcttcctgagcaccactggcctattggtttccgctgcaatggacatctaatgcttaactctgagaaaatgtccaagtccacagggaatttcctaactctggaagatgccataaaaaagtactcttctgatgccactagatttgcccttgctgatgctggcgatggtatggatgatgcaaattttgtcactgaaactgcaaattctgctgttatgaggcttacaaaagaaatttcatggatggaggaggttacagctgctgaatctaaattaagaactgggccgcccactacatatgctgaccgtgtgttttcaaacgagatgaacattgcaatcaaagaaactgagaagagctacaatgctttcatgttcagagacgccctgaagtctgggttctatgacctccaattggctagagatgagtacaggctctcttgtggtgcagcaggcatgaaccgtgatctgttgtggcgatttatggatgtccagaccaggcttatcacccccatttgcccacactatgccgagcacgtgtggcagaagatcatgaagaaagaaggctttgcaataaaagctggctggccagtcgcggacaccccggatcctacactgagaattgcaaataaatacctgcaggattccatagttttgatgaggaaactgcttcagaagcaagagtctggttctaagaagcctaagaagggagctgcaccggcacctccgtccgaggaaaagaagatgagcattggtctcatatatgtgaacgagcactactctggatggaaagagcagtgcttgagggtgctgcagtccaagttcgacagccaaagccgctccttctcacccgatcaggaaatagcagaagctctgaaggagtgccccatcgggcaggaaatgaacctgaagcaggttcagaagctgtgcatgcccttcatcaagctgaagaaggacgaggcaagggaggttggtcctcaggcgctggacttgaagcttccgttcggtgagatggatgttctccgggagaacttggagctgatcaagaggcagctgggccttgagcaagtcgaggtgctctccgcgtccgacgaagctgctcgcgctaaggctggtgaacatgcttcgctgctggagaagaacccaccatcacccggcgaccccatcgccatcttcctcagcaaacagagctgaaaactgaccttgcatatggcccttttgttatttacttcgccgcacatttgcttcttttttgtttttgtttttgtgaaaccagtttcgtgtctgtaaacatagcatgttgtcctccggtttggtgaaaccagttttttctttttctttttctgtcaacagaatatgttatccattgtctgggtaaaccagttcggctattgtcgacaaagtatgttaaggtgatgcggctttacatcattttgatctggtgtattcatttctatgattagattatgtgcagaagtgcaggcgaaagctcgtggtgattacattctgggtaattattgcaatgtttgaaacaatgtgtttatgaacaaggtacaatttcttcgttgcttgctatagccaggcgtttatctgacatcctcttggatgcacacgggcagaac

SEQ ID NO: 16073 - DNA, 2519 bp, Zea mays
tgtgttgtatagtgagtcggagaagaggtcatgtctagatctggtgatgaatgtgttgttgccctcactgatcagtggtatataacttatggcgaggctgaatggaagcagaaggcagtcaaatgtttggaccgcatgaatacattctcaactgaaacccgcaatggttttgaacatacgctgggctggctgaaccagtgggcttgttcacgttcatttggactcggtactcgaattccatgggatgagcagttccttgtagaatctctttctgattctactctatacatggcttattatacagttgcacaccttttgcaaaatggtaatatgtatgggaaagaaatatcttcagtaaggccagaagaaatgacagatgaagtctgggatttcgtgttttgtgatggcccggcaccaaaaagcgagatccctgccgctctgttgaacaagatgaaacaggaatttaagtattggtatccatttgatatccgtgtgtctggtaaagaccttattcaaaaccatttgacattctgcatatacaatcatacagcacttcttcctgagcaccactggcctattggtttccgctgcaatgggcatctaatgcttaactctgagaaaatgtccaagtccacagggaatttcctaactctggaagatgccataaaaaagtactcttctgatgccactagatttgcccttgctgatgctggcgatggtatggatgatgcaaattttgtcactgaaactgcaaattctgctgttatgaggcttacaaaagaaatttcatggatggaggaggttacagctgctgaatctaaattaagaactgggccgcccactacatatgctgaccgtgtgttttcaaacgagatgaacattgcaatcaaagaaactgagaagagctacaatgctttcatgttcagagacgccctgaagtctgggttctatgacctccaattggctagagatgagtacaggctctcttgtggtgcagcaggcatgaaccgtgatctgttgtggcgatttatggatgtccagaccaggcttatcacccccatttgcccacattatgccgagcacgtgtggcagaagatcatgaagaaagaaggctttgcaataaaagctggctggccagtcgcagacaccccggatcctacactgagaattgcaaataaatacctgcaggattccatagttttgatgaggaaactgcttcagaagcaagagtctggttctaagaagcctaagaagggagctgcaccggcacctccgtccgaggaaaagaagatgagcattggtctcatatatgtgaacgagcactactctggatggaaagagcagtgcttgagggtgctgcagtccaagttcgacagccaaagccgctccttctcacccgatcaggaaatcgcagaagctctgaaggagtgccccatcgggcaggaaatgaacctgaagcaggttcagaagctgtgcatgcccttcatcaagctgaagaaggacgaggcaagggaggttggtcctcaggcgctggacttgaagcttccgttcggtgagatggatgttctccgggagaacttggagctgatcaagaggcagctgggccttgagcaagtcgaggtgctctctgcgtccgacgaagctgctcgcgctaaggctggtgaacatgcttccctgctggagaagaacccaccatcacctggcgaccccatcgccatcttcctcagcaaacagagctgaaaacttaacttgcatatggcccttttgttatttacttcgccgcacatttgcctcttttttgcttttgtttttgtgaaaccagtttcgtgtctgtcaacagagtatgtcgtccttcggtttggtgaaaccagttttttctcttttttttttcctccgtcaatagaatatgttatccattgtgtgggtaaaccagttcggctattgtcgacaaagtatgttaaggtgatgcggctttacatcattttgatctggtgtattcatttctatgattagattatgtgcagaagtgcaggcgaaagctcatggtgattacattctgggtaattattgcaatgtttgaaacaatgtgtttatgaataaggtacaattccttcgttgcttgctatagccacttagccaggcgtccatctgacatcctcttggatgcacacgggcagtactcgtctactttggtagcacgtggtgataggaggatgcacgtagttattttgtgttctttttttttaatctatgcagccatctaggtaggataactttattctaagacaagatcaagatgcgatcgtgggtattataactttggttgtgtcgacacttggcacctgcctgccgtggtgacgtttgcgcgtgcgacgagggatttaaaagggaaaggattggagctaggagttgggagcgccgatgagccgagcagcagtgcgctccgatgcaatggcccttcacgcattcaggggccgaccagcaccaaccggcgagaccccaaaccagcaagagacacc

SEQ ID NO: 16074 - DNA, 2021 bp, Zea mays
  misc_feature (1116)..(1116): n is a, c, g, or t
agcgctgctggtgccgaggccgcccggctgagaagatatatgccgcccagcctcacttacattacatatgcacattctgttctcagttctcttcctctctctcaactcaactactcaaagcggtagattaaccggctctagcgtagcgagtgttgctacatctctcttggccatgggggcatgcgcgacgaagccgggtgacctcaaggtcaagggcgaggcgcctctggtcgcggaggacgccgcggcgccactggcggctgccgacgagaaggcgaaggccgccgaggtccccgtggccgccgctgccgaggtcgaccaggccgatgtcagccgccggaggtccctcagcgacctgcttaaacgggacgccgagggcagtgacggggaggaggaggtcgaccaggaggcggagaaggtcgtggctggggagccagcgagtgctgccgctgccggggaaacgatggggtcaccgcaagcaacagtgcaggcctcggtcgcaaccgagcaggacgacacggccgaagaactcaaggatggtcttccgagtggtggcgacgcgcatgcggcggaagaagagaagcggatggatcctgaatcaatccaagctgctgttgctgctgatgccccaagttctgaggaaagcaaggttgctgctgctgctgatgccccaagttctgaagaaagcaagcttgctgctgctgctgatacctctgcctgaaaaatggggcatcgtgttgtgattctttgttcttttcgtctctctcggggttttttcgtggcgaaatacgctttaatggcgcgagattcatagcaggcagcttggttgctgtcttgctccgtttgtgccgcggtcaggatgtgcatggctggattttactgttgttttatttctcttggaggtactccgtgcaatcaagctgtcttttctataatggcggactcggccggcaatcaaagctataaatttctaaagtttaattaagcggaaaaaaaaaaaaaaaaacctaatcccacgcgagtctagccagtcaggtacagccatttttagcttatgtgtagatgcaggtaaattgcctcgtaatgatttattttgtatccacttatgcagccacngttcctcgcgtacagtcaacaaaacagacactcaaccaaagtcaacgcacgagatgatttaggatgaaaaggtgcaggtaaccaaccagctagttagagtctcaaatcaattatagattaataattttaagaaaatagataatactagtattcaaacaaacaattattaaatgctaacgaatttaacacaaggaatacaatatggtagagttctttgaatatttcccgcttgatgtagtacgccatcaaatgattgaaccaatcatcaatcttatttgtaaataagtcttcataatattcgtcgctcaaaatgccctttcaacagatgttgtggacaccgacaatattaatactaatttaataagtatataaactaatagaaaaatcatatgcttaattgtctcaactatcttagaagcgaaactagcaatatctacacaggtagataatgttgcatgccttcttacttcaagaatataagtctcaagttgttgtctaatttgtgcaatctcactagtagagaaatcaatattataaatttgagcaacccgaacaaggttatctttatgaaacctagagaggttattcgttagatcaaaacataaaaaacatgtcaacatcttaaagttgatttcctaaatcgctgatgcacctcaaaacatattttatcaagaactgtaaagaaaatcctagcataataatgatgtaggaaagtagtagtttcaatttggtcttttgcacaacctctaatggacatgtcacccatcatatttgccttttttctcacaatattgtttagcctcatcaaacacttatcaaacacttgtacctaaccactatccctcaatgtggtatttccaaattgcctcaaaaagaaacttcagaagttggtccctttttaatgt

SEQ ID NO: 16075 - DNA, 2099 bp, Zea mays
ccggccgaaatcccagatcccgcactctctttcagaacccaacacgccactgcctagctagtagctagcagagcagctagccaagcaacccagccgagtagccgaccagagagagcgagagaggcagagaggagcggacctgcccgtcgcaatggcgatgccgccgaagcccggcgacccgccgcagcgctcgcctgcgcggagccccaacctcaacctgccctgcccgctgccgccggtcccgggcgggccgcctgcgccgtcggccgccgggttgcccccgccgcgcgcgagtcaccaccgccgcgccagatctgaggtggcctttcgcttctcggacgacctggccggcggcgtgggcggcggcttcgacgagatcggctccgaggacgacctcttctccaccttcatggacatggacaagatcgccggcgccgaccgcgaccgtgccgccgagacctcctcgccgccgcgcccagccaagcaccgccacagcgcctcctttgacggcttcgggatgggggctgccgccggtggcctggccgggcagcaggacggcggcggaggcatgtttggagaggtgatggaggccaagaaggccatgtcttccgagcagcttgccgagctcgctgccatcgaccccaagcgcgccaaaagaataattgcaaacagacaatctgcagcacggtcaaaggaaagaaaatctagatatataacagaactggagcggaaggttcaaactcttcagacagaggctactactctttcagcgcagctcacactattccagagagacacaactggactttcggcagaaaatgctgagctgaagataaggttgcaggccatggagcagcaggctcaactgcgggatgctctaaacgatgcgctgaagcaagaagtggagaggctcaagatagcgacgggcgagatgccgaagtccaacgaacaattcaacatggggatgcagcacgtctcgtacagcggcccttctttcttccatctcccggagcagcacgtagacattcagctgccgcaccatttccagcagcctccgcggaacgtccagatgctgtcccaccccaactccctctcggatatggcgcagcaagactcgcttgggcggctccgggggctggacattggaaaagggtccatggctatgaagccagaggcagaggtcgtggtgaagtcagagggcagctctgtatctgcaggtgaaagcaacaccaccttctagctatacaatacatctgccttccaagaagcctccgtttggtttagagttcttttgttcatagtctgacatcctccttccttgagctgcttcgtccttctcagtaggcctattttttttattccattggttatatctactagttaacattggtcggttgccaatcgttgttgtcgtggtggctgatttctatagggacattgatgtgttggtttcgagtttgttgttgttgttgtgtgtgtggttggttgtttcgagctaggggctgaaagggcaccgagtgtttttttctccacctgttttagttttgttatagatttgacaacaatcgttatgatttctccttctggaaaggtgtacattgtgttgctatgctaatttgtagtgatatttttgatgattccaactgtgaaaaaaaaaaaaaaaaaagcggccctgctgtgcctgtgcgcgaagctgttgtttcagctgtgtagctggtgacgggaagtggcctgcacgccttcctgtttgtgctgaatggttcgccacatttcttatcgatttttgtaataactagcgagtgtttgaatgtgttagagttaatagttagttggctaaaaaattgctagtagaattagtttggatatctctaactaattttagctattaattattagctttagtatattcaaataccccttaggccttgttcgtttccatcggattgcacccggaatcgttccaactaatcaaagtttatataaattagagaagcaattcggtcaggaatcgttccgacccaccaatccgacacaaacgaacaaggccttaattgttttgatagcattgatatagtgacacaatgttatatactgtagag

SEQ ID NO: 16076 - DNA, 1678 bp, Zea mays
gggtacctcgaggccggccgggtttcagaatccacacgccactgtcgcggtaacagagcagctagccaagagtagtagccgcgtgcccgcgtgcgcttcccgaaccccgagtcccgaccagagagagacacggagaggagcagacctgcccgtcgcaatggcgatgccaccgaagcccggcgacccgccgcagcgctcgccggcacgtagcccaaacctcaatctcccctgcccgctgccgccggtcccgggcggggcgccgccaccgccgcagcagcagccgggcgccgggctgcccccgccgcgcgtgggccaccaccgccgcgccagatctgaggtggccttccgcttcccggacgacctgcccggcggcgggggcggcggcttcgacgagatcggctccgaggacgacctcttctccaccttcatggacatggacaagatcgccggcgccgaccgcgaccgcgccgccgagacctcctcgccgccgcgcccagccaagcaccgccacagcgtctcctttgacggcttcggcatgggggctgccgccggcggcccgggcggccagcaggacggcggtggaggcgtgttcggagaggtgatggaggccaagaaggccatgtcttccgagcagctctccgagctcgccgccatcgatcccaagcgcgccaaaagaattattgcaaacaggcaatctgcagcacggtcaaaggaaagaaaagctcgatatataacagaattggagcggaaggttcaaactcttcagacagaggctactactctttcagcacagctgacactattccagagagacacaactggactttcagcagaaaatgctgagctcaagataaggttgcaggccatggagcagcaggctcagctgcgtgacgctctaaatgatgcactgaggcaagaagtggagaggcttaagatagcaacgggcgagatgtcgaagtccaataacgagcatttcaatatgggaatgcagcacgtctcctacagcccttcattcttccagctctcggagcaacacacaatgcagcagcatggaaacattcagctgccgcatcatttccaacagcctccgctgactgtcccgagccaccagatgctatcccaccccaactccctctcgaacatggtgcagcaagactcgcttgggcggctccaggggctggacattgggaaaggatccatggctgtgaagtcggaggctgaggtcgtggtgaagtcggagggcagctctatatctgcgggtgaaagcaacaccaccttctagctatacaatacgtctgccttccaagaagcctttgtttggtttagagttcttcttttgttcatagtctgacatccttgaactgcttcctccttccctgtagtttttttattccattcgttatatctagttaccattgatcggttgtgtcgatcgttgttgtcgtggtggctgattttatagggacattggtgtgttggttttgagtttgttatgtgtgtggtatggttggttgtttcgagctagtgactgagagggcaccgagtgattttttggcagattttcttttctccacctgtcttagttttgttatagaacaaccatgatttctccttctgggaatgtgtacattgcgtgaagtgtgttgtttcaggctatctaccaaaaaaaaaaaaaaaa

SEQ ID NO: 16077 - DNA, 298 bp, Zea mays
cggactatgagagcggacgggccatacccaataaccaggtgcttggcaaaatcgagcgggccattggcctcaagctccggggaaaggacattggaaagcccatcgagaaggggcctagggcgaaatgaacacaaagcctcgaaatcagtgcgctccagctgatctcgttccgccggttccccttggccgccagttccgttctcctcacgggccgaacggaacaaggggtccagcttgcgggggacctccccagcccattcctgctgtcaaacaaacaaaaccttgcaaagcgcaaaaa

SEQ ID NO: 16078 - DNA, 1149 bp, Zea mays
  misc_feature (939)..(939): n is a, c, g, or t
  misc_feature (982)..(982): n is a, c, g, or t
  misc_feature (1002)..(1002): n is a, c, g, or t
  misc_feature (1115)..(1115): n is a, c, g, or t
ccgcgagcccccgggcgggccgggattttaactctggcaccggaatgtattggcccctcacctgctcggctgctccccttctgtccagcccacgggagggcgactagggttagggccttaggggcgacgccaaccatctagccaccggaggtcgccgcgcctgcccagatccactcatcccttccgttcaagccgccggagctcccaggacgctggtgtcgaagccgtcgtcccttccttccaggcccgcctcctctctgtccgttctgtcttggtcgccgaagctcaagaccacagtgtcaggaagctctccaatcttccagccaaacacaattcatcagtcagatacacttttaccaaggaatttttcagaatcactccacgagaggttcagctctcgaagctagagaagcagagctctaccaaacaggccaggacgtctctcaaatccccagttcagtaactagctaactgcaggagaaggagagagatggagaacggcggcgctaaaggcgacgtccccaacgatgcgaacgagcattgccctggaacacagtccgaggaggcaggcaaggcggatgcctgcgctgggtgccccaaccagcagatttgcgccaccgcccccaaggggcctgatccagatgtggttgctattgttgagaggttggctactgtgaaacacaaattgttagttttgtctggaaagggaggtgttggaaaaagcacattctcagcccaactctcgtttgccctagctgaaatggaccatcaggttggccttcttgacatagatatatgtggccctagcatccctaaaatgttaggccttgaaggacaagatattcatcaaagcaaccttggctggtcacctgtgtatgtcgagtccaacctgggtgtgatgtcgattggtttcatgctgcctaatccagatgatgctgntcatatggaggggtccccgcaagaatgacctgatcaagcagtncttaaaggatgtcgattggngggggagattgactatccttgttgtggacgctcctccaggaacatctgatgagcacatctcgatcgtgcaataccttcaagccacaggaatcgatgggcgcataatcgtccgnacttcgcagcagggctctctgattgacgtgagga

SEQ ID NO: 16079 - DNA, 2300 bp, Zea mays
agttttgtaaacccactgaacattcacgttcgcagcgcaggcatcgaacacaaagtagctggcggctcggcgcacctacagcgccgtataccgagtccgagaccacgactccacgagacgacacaaaccccagtttaggaacagttggaaaagagggagaaatggagaacggcggcggcaaaggcgacgttcccaacgatgcgaacgaacattgccctggaacgcagtcggaggaggcggggaaggcggatgcctgcgctgggtgccccaaccagcagatttgcgccaccgcccccaagggccccgatcccgatgtggttgctattgttgagaggttggctactgtgaaacacaaattattagttttgtctggaaagggaggtgttggaaagagcacattctcagcccaactctcctttgccttagctgaaatggaccatcaggttggccttcttgacatagatatatgtggccctagcatcccaaaaatgttaggcctcgagggacaagatattcatcagagcaaccttggttggtcacctgtgtatgtcgagtccaaccttggcgtgatgtcgattggtttcatgctgcctaatccagatgacgctgtcatatggaggggtccccgcaagaatggactgatcaagcagttcttaaaggatgttgactggggggagattgactatcttgtagtggatgctcctccaggaacatctgatgagcacatctcgattgtgcaataccttcaagccacaggaattgatggcgctataatcgtcacaactccgcagcaggtctctcttattgacgtgaggaaggagataaacttctgcaagaaggtcggcgttcctgtcctaggtgttgtggagaacatgagtggcctgaggcagccactttcagatctcagtttcgtcaagcctggtgaggcgggcgagacagacgcgacagagtgggccctgaactacatcaaggagaaagcccctgagcttctgtcagtcatggcctgcagcgaggtatttgatagcagcaagggaggcgccgagaagatgtgccgtgaaatgggggttcctttccttggcaaggtgcccatggatccgcagctgtgcaaggcggctgaggaagggaggtcatgcttcagtgatcagaaatgcggtgccagtgcgccggctcttcagagcattgtaaagaagctgatcaagactgggtgagaaaataatgttggcctgctgggaatctggtagtgagaattgagatgaacaggtgtcagagttgtcatgaccaatatatatgttattgtgttttgaacactgaatctgtgtattagactattagtgccagtactagtattggatctgtaagtttttttttgttcgtgaatcaccagtgggtggactgggtgtacaaactgcggccatatttctgctccacgaagtgaaatatgtttcgaggcactgcctgtatcccgaatcatgcttagcctaggttaataccatctcgcttgcgtgagggggttatggctggcttataaaggtgagcttccctcttctctcaagcccgggttttaacgagtgggctgagcttgttgctgaaagctgtcgcgtagtctgtgggagggggcgtggccgacttgtaagggcaagtttccctcctctctcaagcccgagttttgagatgtgagtgcggggctcgctgctgaaggtcgacccacgagcgtatgaacgccgaaatgcatatcgagtgtgtgcttttcggcggactggcccatgtacgttgacaaataccatatcgcctgtgtgagggggccgtgttcgacttataagggcgagctcccttctctctaaagctcaggtttttgagatgtgagtgtggggctcgctgctgaaggccgacccacgagcacatgaacgtccaaacgcatgtcgagtctgggcttttcggcagacgacttaggtacgctgacaaatggtatcagagctagcatcaccatgccccctaaggggcttcctagggggatggggtgctaggagctcgtatagatgggcaaatgggtcgcccggcacgacacttacactagcaatataaggcacgtcactattaggcactattagtaatcgtgttgtgccgtgccagtactagtgcctaaccagcgccccagacactacactatagtgcctaatcgtgttgtgctggcattatacggtactaacacctaatagtactcgtaccagctcagacactatttcattaaaaagctcaaaaaatataaaagatctttaagattatgtatataatttaaaact

SEQ ID NO: 16080 - DNA, 1926 bp, Zea mays
cagttgtctccaccccaaaacaacggtcaagggcctagctatttgttaactctggcccctcacctgctccccttctgtccagcccacgggagggcgactagggttaggggcgaccggaggtccccgcgcctgcccaaatccacccatcccttccgttcaagccgccggagctcccaggccgctggtgtcgaagccgtcgccccttccttccaggcccgcctcctctctgtccgttctgtcttggtcgccgaagctcaagaccacagtgtcaggaagttctccaatcttccagccaaacacaattcatcagtcagatacactttgaccgaggaattattcagaatcactccacgagaggatcagctttcgaagctagagaagcagagctctaccaaacaggccaggacgtctctcaaatccccagttcagtaactggctaactgtaggagaaggagagagagatggagaacggcggcgctaaaggcgacgtccccgacgatgcgaacgagcattgccctggaacacagtctgaggaggcaggcaaggcagatgcctgcgctgggtgccccaaccagcagatttgcgccaccgcccccaaggggcctgatcccgatgtggttgctattgttgagaggttggctactgtgaaacacaaattgttagttttgtctggaaagggaggtgttggaaaaagcacattctcagcccaactctcgtttgccctagctgaaatggaccatcaggttggccttcttgacatagatatatgtggccctagcatccctaaaatgctaggccttgaaggacaagatattcatcaaagcaaccttggctggtcacctgtgtatgttgagtccaaccttggtgtgatgtcgattggtttcatgctgcctaatccagacgatgctgtcatatggaggggtccccgcaagaatggactgatcaagcagttcttaaaggatgtcgattggggggagattgactatcttgttgtggacgctcctccaggaacatctgatgagcacatctcgatcgtgcaataccttcaagccacaggaatcgatggcgcgataatcgtcacgactccgcagcaggtctctctgattgatgtgaggaaggagataaacttctgcaagaaggtcggtgttcctgtcctaggtgttgtggagaacatgagtggtctgaggcagccgctttcagacctcagattcatcaagtcagatgaggcgggcaagacagatgcgacagaatgggccctgaactacatcaaggagaaagcccctgagcttctgtcggtcatggcctgcagtgaggtatttgatagcagcaagggaggcgccgagaagatgtgccatgaaatgggggttcctttccttggtaaggtgcccatggatccgcagctgtgcaaggcggctgaggaagggaggtcatgctttgctgatcagaaatgcagtgccagtgcgccggctcttcgaaacatcgtgaagaagctgatcaaggccgagtgagaaaataatgttggcctgctggggaatctggtagtgagaaatgagatgaaatgacagatgccagagttctcgttaccaatatatatatatgttacggcgttacacactgaatctgtattagtgcttgtgttggacctgtaagtttttgttcgtgaataatcagtgggtgcacagactattaaaagcttagtttctgctctaccaagtggactatgtttgcttgaacgatatgtactgtacgcaccagaactgaatgagagtgtacggtgttagcaatcaaaaaaaaataaaaaaataataaattaaaaaattaaatttaaaaaaaaaaaaaaaaaaaaaaagattaaaattataaatatataaatttatgaaaaaaaattattataatagaggggcggcctttttaaaggatctaatt

SEQ ID NO: 16081 - DNA, 1863 bp, Zea mays
  misc_feature (1815)..(1816): n is a, c, g, or t
  misc_feature (1836)..(1837): n is a, c, g, or t
  misc_feature (1850)..(1851): n is a, c, g, or t
  misc_feature (1858)..(1859): n is a, c, g, or t
cgatcgtacacgatatgcggacaacgccgcacccttctatctaggccagactagaaggtagaagaagcaacgacggtcaagggcctagctatttgctaactctggcccctcacctgctccccttctgtccagcccacgggagggcgactagggttaggggcgaccggaggtcgccgcgcctgcccaaatccacccatcccttccgttcaagccgccggagctcccaggccgctggtgtcgaagccggcgtcccttccttacaggcccgcctcctctctgtccgttctgtcttggtcgacgaagctcaagaccacagtgtcaggaagctctccaatcttccagccaaacacaattcatcagtcagatacacttttaccaaggaatttttcagaatcactccacgagaggttcagctctcgaagctagagaaccagagctctaccaaacaggccaggacgtctctcaaatccccagttcagtaactggctaactgtaggagaaggagagagatggagaacggcggcgctaaacgcgacgtccccgacgatgcgaacgagcattgccctggaacacagtctgaggaggcaggcaaggcagatgcctgcgctgggtgccccaaccagcagatttgcgccaccgcccccaaggggcctgatcccgatgtggttgctattgttgagaggttggctactgtgaaacacaaattgttagttttgtctggaaagggaggtgttggaaaaagcacattctcagcccaactctcgtttgccctagctgaaatggaccatcaggttggccttcttgacatagatatatgtggccctagcatccctaaaatgctaggccttgaaggacaagatattcatcaaagcaaccttggctggtcacctgtgtatgttgagtccaaccttggtgtgatgtcgattggtttcatgctgcctaatccagacgatgctgtcatatggaggggtccccgcaagaatggactgatcaagcagttcttaaaggatgtcgattggggggagattgactatcttgttgtggacgctcctccaggaacatctgatgagcacatctcgatcgtgcaataccttcaagccacaggaatcgatggcgcgataatcgtcacgactccgcagcaggtctctctgattgacgtgaggaaggagataaacttctgcaagaaggtcggtgttcctgtcctaggtgttgtggagaacatgagtggcctgaggcagccgctttcagacctcagattcattaagtcagatgaggcgggcgagacagatgcgacagaatgggccctgaactacatcaaggagaaagcccctgagcttctgtcggtcgtggcctgcagtgaggtatttgatagcagcaagggaggcgccgagaagatgtgccatgaaatgggggttcctttccttggtaaggtgcccatggatccgcagctgtgcaaggcggctgaggaagggaggtcatgctttgctgatcagaaatgcagtgccagtgcgccggctcttcggaacatcgtgaagaagctgatcaaggccgagggagaaaatagtgttggcctgctggggaatctggtagtgagaaatgagatgaaatgacagatgccagagttctcgttaccaatatatatatatgttacggcgttacacactgaatctgtattagtgctagtgttggatctgtaagtttttgttcgtgaataatcagtgggtgcacagactattaagtggactatgttttgaggcgctgcttgaatgatctgtactgtacgtaggggagtgtacggtgttagcatttccaaannaaaaaaaaaaaaaaaaaaannaaaaaaaaaaaannaaaaaannaaaa

SEQ ID NO: 16082 - DNA, 2020 bp, Zea mays
aagacaaacaattcgtgaccgtgtgtgacccgggcgcgccacatgtgcagctcaaatccacatgtttgcgtggaatggcgacagtcgcacagagcacttttgctaaatcgctagttcgtttcctaaaccctagcaaagtaggaatggcgtcggcgagcatgctcgcgcgctcccttctccgcaccccagaccctacccaaacgagccacccgaaccgccggagcgccgctgtcgtctccttcccccgccgccaccgccgcctgtccgtgcgcgcctccgtctccacggcctccccttccccaccgccacagcccgcggcggcggctgccggcgtgccgaagcactgcttccggcgcggggccgatggctacctgtactgcgagggagtgcgggtggaggacgcgatgacggctgccgagcgcagccccttctacctctacagcaagccacagatcctccgcaacttcgccgcctaccgcgatgctctccaggggctccgctccatcatcgggtatgccgtgaaggccaacaacaacctccccgtgctacgcgtcctgcgtgagcttggctgcggcgccgtcctcgtcagcggcaacgagctccgactcgccctccaggcgggattcgaccccgccaggtgtatatttaacggaaatgggaagacactcgaagatcttaaattagctgctgagagtggagtatttgtaaatgtggatagcgaatttgatttggagaatattgtcagagctgcaagagctactggaaagaaagtgcctgttttgcttcgaataaatccagatgtggatccgcaggtacatccgtatgttgccacgggaaataaaacgtctaaatttgggatccgcaatgagaaattgcaatggtttttggactctatcaagtcatacccgaatgaaatcaaactcgttggtgttcattgccatctgggatctactattacaaaggttgatatattcagagatgctgcagttcttatggtgaattatgtcgatgaaattcgagcacaaggttttaagttggagtacctgaatatcggaggtggtttgggaatagattaccatcataccgatgcagtattacctacacctatggatctcatcaacactgtgcgagaattagttctctctcaagatctcactcttattattgaacccggaagatccttgattgctaatacttgctgcttcgtcaatagagtaactggtgttaaatctaatggtacaaagaatttcattgttgttgatggcagcatggcagaactcatcagacctagtctgtatggagcataccagcatatcgaactggtttctccccccactcctggtgctgaagtagcgaccttcgatattgttggaccagtttgtgagtctgcagatttccttggaaaagatagggaacttccaacacctgatgagggagctggactggttgttcatgatgcaggtgcctactgcatgagcatggcttccacctacaacctgaagttgaggccaccggaatactgggtggaagcggacggttcgatcgtaaagatcaggcatggagagaagcttgatgactacatgaagttctttgatggtcttcctgcctagatgtttattatctgcgactgctacggacgatgttttcttggggataattggattttctttgtcaagctcatttttgctttcttgtggttatgtaatgtttctggatagctagttggtgcatcctcctcaacttccttttcatttctgttagtttcgtcaccaagttcgttctcaattactatttggttgtaacccagctgtaggatgcctggcttgcctgtatccgtctgagcgtgatttggttgggaactgacggtttcacctggtacctggtgagacatgcctgcgaaccaaatctgtccctgggctgccttatgtgtgataccaaaatctgttgtagccttgtaggtttactattgctgcgtatagtataatgatgtctttgaaattaaaaaaccccacaccccccc

SEQ ID NO: 16083 - DNA, 1876 bp, Zea mays
ggtaccctcggagctggccgggaatctctcgtgaagtcgtggggtcctcgaggccggccgggggtacagaacacttcgcttcctggaaggctggaacagaaagaaccctaaaccctagcaatggcggcggcgaacctgctgtcgcgctcccttctccccaccccaaacactatccgaacgagccaccccaccccgcggagcccagccgtcgtctccttcccccgccgccgtgcccgcctgtccgtgtgcgcctccgtctccatggcctccccgtccccaccgccacagcccgcggcggccggcgtgccgaagcactgcttccggcgcggcgccgacggctacctgtactgcgagggagtgagggtggaagacgcgatggcggctgccgagcgcagccccttctatctctacagcaagcttcagatcctccgcaacttcgccgcttaccgcgacgctctccaggggctccgctccatcgtcgggtatgccgtgaaggccaacaataacctccccgtgctacgcgtcctgcgtgagcttggctgcggcgccgtcctcgtcagcggcaacgagctccgactcgccctccaggcgggattcgaccccgccaggtgtatatttaacggaaatgggaagacactcgaagatcttaaattggctgctgagagtggagtatttgtaaatgtggatagtgaatttgatttagagaatattgtcagagctgcaagagctactggaaagaaagtgcctgttttacttagaataaatccagatgtggatccacaggtacatccatatgttgccacgggaaataaaacatccaaattcgggatccgcaatgagaaattgcaatggtttttgaactctatcaagtcatactcgaatgaaatcaaactcgttggtgttcattgccatctgggatctactattacaaaggttgatatattcagagatgctgcagtgcttatggtgaattatgtcgatgaaattcgagcacaaggttttaagttggagtacctgaatattggaggtggtttgggaatagattaccatcataccgatgcagtcttacctacacctatggatctcatcaacactgtacgagaattagttctctctcaagatcttactcttattattgaacctggaagatccttgattgctaatacttgctgcttcgtcaatagagtaactggtgttaaatctaatggtacaaagaatttcattgttgttgatggcagcatggcagaactcatcagacctagcctgtatggagcatatcagcatatcgaattggtctctccccccactcctggtgctgaagtagcgaccttcgatattgttgggccagtttgtgagtctgcagatttccttggaaaagatagggaacttccaacacctgatgagggagctggactggttgttcatgatgcaggtgcctactgcatgagcatggcttccacctacaacctgaagttgaggccgccagagtactgggttgaagaggatggttcgattgttaagatcaggcatgaagagaagctcgatgactacatgaagttctttgatggtcttcctgcttagatgtttatttgtgactgctaggggcgatgttttcttggagataattgaatttttctttgtcaagctcattttgctttcttgtggttgttatggaatgttactggatactggatagttagttcggcctgtaggcgtatcctcctgaacttacctctcattgctgttagttttggcaccaagtttgttcccaattgctatttacggaagttattgcataaagggctgtttggttgtaatcttcccgtaagaataagatgcatgtttttgagttagaggaccaaaaaaaaaaaaaaaa

SEQ ID NO: 16084 - DNA, 873 bp, Zea mays
ctcttattattgaacccggaagatccttgattgctaatacttgctgcttcgtcaatagagtaactggtgttaaatctaatggtacaaagaatttcattgttgttgatggcagcatggcagaactcatcagacctagtctgtatggagcataccagcatatcgaactggtctctccccccactcctggtgctgaagcagcgaccttcgatattgttggaccagtttgtgagtctgcagatttccttggaaaagatagggaacttccaacacctgatgagggagctggactggttgttcatgatgcaggtgcctactgcatgagcatggcttccacctacaacctgaagttgaggccaccggaatactgggtggaagcggacggttcgatcgttaagatcaggcatggagagaagcttgatgactacatgaagttctttgatggtcttcctgcttagatgtttattatctgcgactgctacggacgatgttttcttggggataattggattttctttgtcaagctcatttttgctttcttgtggttatgtaatgttactggatactggatagctagttggtgcatcctcctcaacttccttttcatttctgttagtttcgtcaccaagttcgtcctcaattgctatttggttgtaacccagctgtaggatgcctggctagcctgtaaccgcctgagcgtgatttggttgggaactgacggtttcacctggtgagacatgcctgcgaaccaaatctgccccctgggctgccgtatgtgtgataccaaaatctgttgtagccttgtaggtttactattgctgtgataatctgttgcaggtttactattgctgcaaaaaaaaaaaaaaaaaagcggcc

SEQ ID NO: 16085 - DNA, 3452 bp, Zea mays
  misc_feature (83)..(189): n is a, c, g, or t
  misc_feature (208)..(256): n is a, c, g, or t
  misc_feature (798)..(802): n is a, c, g, or t
  misc_feature (1245)..(1250): n is a, c, g, or t
gcacgagcgcagtgaacacttcgcttcctggaaggctggaacagaaagaaccctaaaccctagcaatggcggcggcgaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgcgcctccgtctccannnnnnnnnnnnnnnnnnnnnnnnnnnnnnnnnnnnnnnnnnnnnnnnngcactgcttccggcgcggcgctgacggctacctgtactgcgagggagtgagggtggaagacgctatggcggctgccgagcgcagccctttctatctctacagcaagcttcagatcctccgcaacttcgccgcttaccgcgacgctctccaggggctccgctccatcgtcgggtatgccgtgaaggccaacaataacctccccgtgctacgcgtcctgcgtgagcttggctgcggcgccgtcctcgtcagcggcaacgagctccgactcgccctccaggcgggattcgaccccgccaggtgtatatttaacggaaatgggaagacactcgaagatcttaaattggctgctgagagtggagtatttgtaaatgtggatagtgaatttgatttagagaatattgtcagagctgcaagagctactggaaagaaagttcctgttttacttagaataaatccagatgtggatccacaggtacatccatatgttgccacgggaaataaaacatccaaattcgggatccgcaatgagaaattgcaatggnnnnngaactctatcaagtcatactcgaatgaaatcaaactcgttggtgttcattgccatctgggatctactattacaaaggttgatatattcagagatgctgcagtgcttatggtgaattatgtcgatgaaattcgagcacaaggttttaagttggagtacctgaatattggaggtggtttgggaatagattaccatcataccgatgcagtcttacctacacctatggatctcatcaacactgtgcgagaattagttctctctcaagatcttactcttattattgaacctggaagatccttgattgctaatacttgctgcttcgtcaatagagtaactggtgttaaatctaatggtacaaagaatttcattgttgttgatggcagcatggcagaactcatcagacctagcctgtatggagcatatcagcatatcgaattggtctctnnnnnnactcctggtgctgaagtagcgaccttcgatattgttgggccagtttgtgagtctgcagatttccttcctctggttcggggtcttccatcgcccgtggagggagctggactggttgttcatgatgcaggtgcctactgcatgagcatggcttccacctacaacctgaagttgaggccgccagagtactgggtacacactacaattcatatttggtgcccattggggtctggcgcctcattaactaaaatatcatgttgcaatatttcaaaagaccattaacataaatcatgtccaaacacgccttatatggtatctgttcgtttgcaattaaagccagccgttcaggctgcagctgctgccaactgaagacacaacactgtaggaatgatagaattcagcagcagcagcgttgtaaagaagtcaacctaacatgcctaaaaaaataagcagtcaacctgtcactgttcatcatgtgcagacagtgacacttattttttgaatctcaacatcaaagatgaatttcaaactgaattgtttcagctacacttaactttaggtactacataaatcatttttttgaaacattgcaacatgatttttttagctaataaagagggcgccagcctccctctgtgtgtgtgtgtgtgtttggggtgggggacatactggcatactgccacctactttccctttttctcgtgattattttgtaggaaaaatggaaaaagccactgcaagctagggaatttcaattacttacctggatattgcttccttagagcaactatagcagttttgggggttgattctaagaaatgagtccatcagggctgcaaaccccattgctcctgagtcctgttgagggctgaggagcctactgttggtagcttagacgagcttaaaggaaccaagcctggcaaggcttgaggtcgtagaacatgtaagtcaagaaggtgaaggggatcatgtaaaagagcttgacaacctgcacattctatgtgtttgaaatacccactctgcctattgccatccaatgtttttcagagttctgcatgttaaccatcgaaagcaacttggatatgaaaacgcataaagcttgcaggtggtagactaaccgtaaggagtcgactttggggatgaccattaatacctctccctgtgttgcctcttttgtctttatcagttttgttcatttctgttttgcattgcaggttgaagaggatggttcgattgttaagatcaggcatgaagagaagctcgatgactacatgaagttctttgatggtcttcctgcttagatgtttatttgtgactgctaggggcgatgttttcttggagataattgaatttttctttgtcaagctcattttgctttcttgtggttgttatggaatattactggatactggatagttagttcggcctgtaggcgtatcctcctgaacttacctctcattgctattagttttggcaccaagtttgttcccaattgctatttacggaagttattgcataaagggctgtttggttgtaacaaaaaaaaaaaaaaaagatgcatgtttttgagttagaggaccatgcctgagcgtgatttgtttgggactgaatgttttacctggtgacttgcctgcttgtgatccaaatctgtcacctgggctccggttattcccatcatccatggattagagtccatggattagagaggattggaaaaaaataagaaagattttaatttattagaaaattaagaaagattttgatttgttagaaatttaaacttaatcttgtccaatccatatagattgggactaaaactaacaagcacttattggttttagtgcctgaccagtgaccgtggagtagtttcactaatgaattcagatcattagtgaagcttcagatttataaaggccattttagttggaatgacttgttttgtttcttggaaagacctcatatgttaatgattcatcctttctctggcaaaaacgtcacatgtcaaacgagtgtttgcatgccgatggcacggtcggtccagggcgggaggcaatgggtatagataaaaaaaaagactgatttggtgactagaaaatccaagagggattcataagaaaactccttgttttccgtttttctcaagtatataactaggactcggcgttcggttcctcgattcttgtagaaattcgattcttcaaaaac

SEQ ID NO: 16086 - DNA, 4637 bp, Zea mays
cattcgttttgttggtcttgtgtaagtattaggaacattttaataaaataagattattgattggttgatgtgcttttggttttagcgatctctttatctccattgaagcaaagtgatcgagtttcgtttttaagcaacagaattatacttgaagaagagatatagatgatacatataaaaaaatgaagttatgtctagaatatagggaaaaatcttctgtgtattaaaatagaggagcttacgatgctgatgcgtctcctcctcctccataaatacattcgtcacgagcagcattggccattgggtgcagtcgagtagttgccacctaaccgtggcggaggcgcagtgctgttgcgagatgtggctgtgatcgagcgagataactaaaagcctccccacataaatgcaagggcgacgagacggcaagcaagcggacgcgaacaaacccccttattccatagcgagcgcgagcagcggcgccgggaggactgctgcgatggggggagacgccagcaccatcgaggggggcccgctcccgcatctcggcggccggccggcctcccgcgtgcccgacaccccgctggtgcgcacggcgggggacgccgcgcgcatggtctgggacgagtccaagcgcctctggggcatcgggctgcccatcggcgtgggcatgctgagcatgtacgccatcagctccatcacccagatattcatcggccacctcggcaacctcccgctggccgccgcctccatcggcctctccgtgttcgccaccttcgcgctcggcttcctcctcggcatgggcagcgcgctcgagacgctctgcggccaggccttcggcgccggcgaggtcgccatgctcggcgtctacctgcagcggtcttggatcatcctcgtcgccgcctgcgtcgtcatgacgcccgtcttcgtcttcgccgagtcgctgctcctgctcatcggccaggacgccgacgtcgcgcgggagtccgccaggttcgccacctacatcgtcccctccatctacgccatgggcatcaacttcgccgccagcaagttcctccaggcgcagagcaaggtcaccgtacccgcctggatcggcttcggggcgctcctcgcctgtgccctcctcaactacctgttcgtcagcgtgctcggctggggcctccccggcgccgccgccgcctacgacatcgcgcactggatcatcgcgctcggccaggtcgtctacatcatcggatggtgcaaggacggatggaaaggatggtccgtagccgccttccacgaaatctggccattcgtcaggctctccctcgagtccgccgtcatgctctgcctcgaggtatggtacatgagcctgatcaccgtgctcaccggcgacctggaggacgcccagattgccgtggactcactaggcatatggtacgtacgcacgacggaggatatgctaacggtagattattagatcagaatgtttcttggattcctttgttagatcagaatgtttcttggacaaacaaagctcatctcctacataattgtgtatgtcttcagcatgaacataaacggatgggaggccatgatcttcatcggcctcaatgccgctatcaggtgcagtccagatatggcctctatgtgtactatataatatagctcaatattctgtgctggcagaatatatgcttgctgttgccgggtactgatacagcctctgctctgttgtgttcctttgccatctaatttcagtgtccgagtctccaacgagcttggctccggccgtccgagggccgcgtggaacgccgtcatggtcgtcgtcggcgaggcgctggtgatcgggattctgtgcatggcactcatcctcatcttcagagacagcttctccatcattttcaccagcgacaccaccctgcagcgagccgtcgccaggatcgccggcctgctcggcctcaccatggtgctcaacagcgtgcagcccgtggtttcaggggtcgcggttgggggcggatggcagggcctcgtcgcctacatcaacctcggctgctactatatcttcggcctgcccctgggctacttgctcggatacaagttcagctttggagttggggtaattaaactctcgcagctgcatgctgtatgcagtcagaaaagctgccgcatgaacgaaacacgcataattagccaaagaaaaatccttgtagtgaattatattccctcacattttagttttatcgcaggggatttggtccggcatgctttgtggtatcacccttcagacgctcatcttgctaggtgtggtttggaggacagattggaaagcagaggtaaacaacctactagcgtcatgttctttgttttcttcttctttcccttacaatcccttagttcttgcaagcagaggtgtacatataactaaattctggtgattgactgatcttctttgttctggcaaacaactgcaggccgcacaagcttcaggccgtgtgcaaaagtggggcggcaaaggcaccgatgaagtcaagcctctcctggaatagaattagtgtagtactatcacgcacgaagctcgtttcatttgaataaacaactgggcaatacgccttatccctttcagaagcacagctcatttgctttcccatcgaatctgatagcttccctttcccctcctccgtgtagttaaattgatgtctctgtatgaacactgtttgaggcgactagtatgaaccctgtttgcggcgactagacgtattgaacatactttttttttcttccagttgactcagcatgacttgaacagtctcaaattgtgtgtaaaggatttactcgctagcagttggtgtaatggtggcaggaatgatgttcttcaggatcagatgagacaagataggaccccttaattttaattttagagactctactacggaggaaaggatggagatacgagtacacttatttaggattaattgttcttttagtggttgacgtgtaagtgattgtgctaaattttcaatatatacacacacaattattattattattatagtacacggcaaagctgctatccgatgtaacagatatttgttgcttgtgtgaatgcgggaatccttgaaagcaacgagagaagcagaagccgcgtacaagatctcactcgcacctacgacctcatcaatcgtaagtgttttttgttagtataataataaaaaatagaaacctacatttaaaccaagaaagaaattggtgtctagaagattggaatgcatgatggcacctaccacggtaccacctcatcaatcttgacccacatgtataccaaccgatcaatcgatcagtagattatttcctgcctttcgccgtgtggtatatctgtacgatgtcttgtgcatattatcatgattgacgctcatgcttaaaagtctcttccgttcggaatcaaacattcaatgtgaaaacaactctggcttcaattcctccaactccaatactccacttcaaattttccaggattattacgtgtgaaagtagctatttctgtttttctttcatccaaaaagatagtgctattctaaaaagggttgagaaaaaaacacaactaatagtaaaagtgaggacaccaacaagaaaaagggcaggattattacgtgtgaaagtagctatttctgtttttctttcatccaaaaagatactactgctaaaaaaggactgagaataaaacacaactaatgataaaaagtaaggacacaaggaaaaaggagggataaaagatatatgaaggcaacacggggctcatgacatcgcttacacaccacaacctggcagtcctgacatccgcaacgccatcctcgccggcaccgcctcctgcgctccgctctcctggtggcagggagtgcagcagatgcatcccatggccgccggggacctgaactcctgatcccttcgctgctggtggtaaggagagtccctggccctagctgctcggacggatctgttcccctgtcgctctggcgatccgcaaccacatgatgttccgaatccaatccgcccgcccgctggctctcttcgatttcttccgttttgttttttttttttttttttgcttgctgctacatcgtgcaagaaacaggagttctaactcgtgcgtacctacccactaccatcttcgcgcggaaatcgttgcactcttcccgcgtccctcggcgctcgcccatcgccatcttcccgctcgcgcgcgcttgactcagctcatcgccatggccgtcgccattttccctgtatcctgtagaatttatttccgccatggccacgcccagcgagctcagcgcgtccgcccgctctcggcttggcgccttggccgcgcgcacgcgcgcgcaggcggccccgcgtcctatgtattggccgcagcttcctctcgtccgcacaccctggccgtaacaaaagaataaagcagcatggatgggacaagagcaggataaagtaacataaagcagaatagcagcataaaacagcgtaaatcagcataaagttcaccagaaatggccaaatgggacagaagctcacgtgctggcaaaagaaatgggggcgaatagccacacatagggacgaaagtaggatgggaaaatcttctgaccgttatcatataaccgattttg

SEQ ID NO: 16087 - DNA, 2036 bp, Zea mays
attgggtgcagtcgagtagttgccacctaaccgtggcggaggcgcagtgctgttgcgagatgtggctgtgatcgagcgagataactaaaagcctccccacataaatgcaagggcgacgagacggcaagcaagcggacgcgaacaaacccccttattccatagcgagcgcgagcagcggcgccgggaggactgctgcgatggggggagacgccagcaccatcgaggggggcccgctcccgcatctcggcggccggccggcctcccgcgtgcccgacaccccgctggtgcgcacggcgggggacgccgcgcgcatggtctgggacgagtccaagcgcctctggggcatcgggctgcccatcggcgtgggcatgcctgagcatgtacgccatcagctccatcacccagatattcatcggccacctcggcaacctcccgctggccgccgcctccatcggcctctccgtgttcgccaccttcgcgctcggcttcctcctcggcatgggcagcgcgctcgagacgctctgcggccaggccttcggcgccggcgaggtcgccatgctcggcgtctacctgcagcggtcttggatcatcctcgtcgccgcctgcgtcgtcatgacgcccgtcttcgtcttcgccgagtcgctgctcctgctcatcggccaggacgccgacgtcgcgcgggagtccgccaggttcgccacctacatcgtcccctccatctacgccatgggcatcaacttcgccgccagcaagttcctccaggcgcagagcaaggtcaccgtacccgcctggatcggcttcggggcgctcctcgcctgtgccctcctcaactacctgttcgtcagcgtgctcggctggggcctccccggcgccgccgccgcctacgacatcgcgcactggatcatcgcgctcggccaggtcgtctacatcatcggatggtgcaaggacggatggaaaggatggtccgtagccgccttccacgaaatctggccattcgtcaggctctccctcgagtccgccgtcatgctctgcctcgaggtatggtacatgagcctgatcaccgtgctcaccggcgacctggaggacgcccagattgccgtggactcactaggcatatgcatgaacataaacggatgggaggccatgatcttcatcggcctcaatgccgctatcagtgtccgagtctccaacgagcttggctccggccgtccgagggccgcgtggaacgccgtcatggtcgtcgtcggcgaggcgctggtgatcgggattctgtgcatggcactcatcctcatcttcagagacagcttctccatcattttcaccagcgacaccaccctgcagcgagccgtcgccaggatcgccggcctgctcggcctcaccatggtgctcaacagcgtgcagcccgtggtttcaggggtcgcggttgggggcggatggcagggcctcgtcgcctacatcaacctcggctgctactatatcttcggcctgcccctgggctacttgctcggatacaagttcagctttggagttggggggatttggtccggcatgctttgtggtatcacccttcagacgctcatcttgctaggtgtggtttggaggacagattggaaagcagaggccgcacaagcttcaggccgtgtgcaaaagtggggcggcaaaggcaccgatgaagtcaagcctctcctggaatagaattagtgtagtactatcacgcacgaagctcgtttcatttgaataaacaactgggcaatacgccttatccctttcagaagcacagctcatttgctttcccatcgaatctgatagcttccctttcccctcctccgtgtagttaaattgatgtctctgtatgaacactgtttgaggcgactagtatgaaccctgtttgcggcgactagacgtattgaacatactttttttttcttccagttgactcagcatgacttgaacagtctcaaattgtgtgtaaaggatttactcgctaaaaaaaaaaaaaaaagtggcaggaatgatgttcttcaggatcagatgag

SEQ ID NO: 16088 - DNA, 2384 bp, Zea mays
catatatatagattaaattattttaaactaaaagaattatatattatggtagttcaagtcatgatgaatctagtaactttacttttatattataaaatcttatgaaatattcgttataacgggttaaagttaatagtggttaacttaaaacaaacccaaaacgactaaatcacgtggacgaaaaaataagacataatattttttaggtttttaagaaaaaaaattattttttttagaaaaataaaatttacttaaaaatagagttatcaaattagttttttaagtcagagaaacaaggtaggagcaggacgatgcgaatagccttaccgacgcgtcctagtccaacactgaccaggccaaatgaagccaccgcaccgccacagccacgacgcgtaggccccgccacaccacccgagcgacttgccttgggcacctcgaggccggccggggattcctccactccggccttgcccgccgatctccagctgtcctccaatcaaattatcaacccaacgccatttcggcgctcccccatctcacagctcaacaaatccctacccaaatccacctccccgccccccaccgctatggctcacccaccaacctcgcgccgcttcgccctcgctctcatcctcatcggcgccctctgcaccgccgtcgccgccgcgcggttcgccccggcggacaaccacctccttgcgtgcggcgcggcggcgcccgccgtcctccccgacggccgccgcttcgtgccggactctggctgcgcatccacccgcctccggtcatcctccccgtccctctcctccgcggcgccgcccggctccccgccgccgccgtcctcgctcctcgcctccgctcgggtcttctcctgccgcgcgtcctacgacctcgatgtccgccgccgcgggcaccacatcctccgcctccatttctaccccttcgtccccgccctcgccgcgtcccgcttccacgtcggcgccggggggctcctcctcctccacaacttcacggcctcgtcccccgtcgtcaaggagttcatcctccccgtggactccgacgtcctcgtgctcaccttcgtccccgactccggctccactgccttcgtcaacgccatcgagctcgtctctgcgcccgaagagctcgttggcgacatcggcaccctagtcacgtccggcggcgccgctcagatacacgggctgtcgtctcaggtgtttgagactctctacaggatcaacgtcgcggggcgcaaggtcacgccattcaacgacacactgtggcggacatgggttaacgatgagaaattcctcatcgacaccgactcctccaactacatggtgtggtcgtccagtggccggattgcttatcccaagggtagcaagcagatgacaagagaagtggctcctgacaatgtctacaactctgcaagatccgtgaggccaggggtgaatgtgacttggggtttccctgtgcctgctagcagccggtaccttgtgcgtatgcacttctgtgacattgctagcaaggctctgtatgagctctacttcaatatctacgtcaatggtgatcttgcagtcaaggatttcgatctctccagtgcaactggattcttggcctatccttattacattgactttatcgtcgatgtgaaggatgaggggatactgaaattggcgattggtggcttaaagaagagtcgatctgatgaagtaagtggtatccttaatgcactggagataatgaggatgaacaagaccagtggaggtatggatggagacttcccaattgatctacacatggaatatgtggtgagtaaggggattggagaatttgcccgctccctgctctgtggtttcatctttgttgggttgtttgtggctttggtcacgctgatggtgaggttgaggaccgagttgaggaataacggcacagcttggtcctggagacagatgaactccgatgaagggaaactggccagaacatatcagcttgtgcccagtaagacggactattgaatattgcaggctgggcatctttgaggagtgacaacctgcggctgttgtgtgcatctaatcacatcatactttttattaagttgtaagtattgtagttttatcacctctctaaaagtattgtagttttgtatcatcactcctttcatgcttggactttgcattctccatgctttgtcaatggtcaatggaggacatgctcatgatgctgtaaaagtactctaccctagatgtggctgtattgctattgcctcatttattcagtttgacttctgaaacatggattcacagctgaattgcatttgaatataattagttgtagtggagacatttgattataaaagaaaaaaaaaaaaaaaaaagcggccagcggcc

SEQ ID NO: 16089 - DNA, 739 bp, Zea mays
attggcgagctcgacgcctgccggcactccggccttgcccgacgatctccagctgtccttcaatcaaattatcaacccaacgccatttcggcgctcccgcttcccacaggagtcacagctcaacaaatccctacccaaatccacctccccgccccccaccgccatggctcccccaccaacctcgcgctgcctcgccctcgctctcatcctcatcggcgccctctgcgccgccgccgccgccgcgcggttcgccccggcggacaaccacctccttgcgtgcggcgcggcggcgcccgccgtcctccccgacggccgccgcttcgtgccggactctggctgcgcatccacccgcctccggtcatcctccccgtccctctcctccgcggcgccgcccggctccccgccgccgccgtcctcgctcctcgcctccgctcgggtcttctcctgccgcgcgtcctacgacctcgatgtccgccgccgcgggcaccacatcctccgcctccatttctaccccttcgtccccgccctcgccgcggcccgcttccacgtcggcgccggggggctcctcctcctccacaacttcacggcctcgtcccccgtcgtcaaggagttcatcctccccgtggactccgacgtcctcgtgctcaccttcgtccccgactccggctccactgccttcgtcaacgccatcgagctcgtctctgcgcccgaagagctcgttggcgacatcggcacccta

SEQ ID NO: 16090 - DNA, 1445 bp, Zea mays
  misc_feature (1)..(1): n is a, c, g, or t
nacaaatgggtgacttatatcgtatcggataaaagcccatagggtcgggaccgcgggagtaggtggtagaggggggtggtgtgaacgggtgagtgagagaggtgataatgtgaagggtctggaggcgttggtggaggctgaacacagaataagaatattaatacggggggcggtggggcggcgacctttcgatactgaggtacgtaagtcgtggatgttgtcgtgctttcgtagaggtgggaggtggaagtagaggctaggagggtgcccacggggtgagtttgttcaaacgctggttgctgcagggttcaggcagaattcgcagccaactgtgagtattgatattctagtatcgggcggtggcgtgtgtgcgaggttaagactaattgcacgcagagtggggggtgggggcgcctggggtacatgtctggcgcggggcgacggctgtctggagggtggcgacgtctttatgccggtgtgaccggtcgaatacttggagcaaagaagagtacaggcaaatgatagagtcaaacaagttgaaaggcacattcggcctccctcgaagtccatgccatctcgaccagtctcctctaatggaattcgcgatgatcatgcaaagagaaagcaagtggtaaaaagaagatttgatgacgacgacgatgaggacgaccccttggcaatgatcagaaatatgttcgggtacgatcctagtagatatgcagggagagatgaggatgtcagtgacatggaagcagattttgctactatagaaatggaagagaaaagaagtgcgaggatagctaggcaggaggacgaagagcaacttcgcttgattgaggaagaagagagacgcgagcaggagaggaagaggcgaaagatggcacgaggccgatagtccaacacgcgtcatatttgggtgttataattgcacagacctgattgcctgaagacgaggcccatggtcgatcatacgggcgcgttgcagacaacaggaaaacttgccacgtggattatatggcggcaaatcaaggaaaacggcaggtgggcaacgctgggcacctgtaacaagcagaatgttaggcgcagtggtttagttgacgaagctgacatagacccatatataagctctcatcagattgtttggatcacacaaggctcccaacgttgcagcgcttcatcagattattctaaattctagccacatgctgattctttctgttaagcctatataaggatgcctaatccaagtagctcctttgttcatttttgtttgggtgtagtgttgtactccctccattttttttatctgacggttgttagtttaaatttgaactgtccggcgccaaataaaaaaatagaggtagcaacaaacaatgtgtttgatttttttggtacaattttgaccttcgtcagacgatcactgcacagcaaaaaaaaaaaaaaaa

SEQ ID NO: 16091 - DNA, 2174 bp, Zea mays
cggcggtatggatgaagagggaaacgagggagacaaatggttggtcgtagctctcggacagggaaggggagttttatagcactgcctagctcggcgccaagatctatggcgccgtgctaggtgccacgtcgactgccacgccagcccgctagtgccagcaatggacgttcctcggtgccataggccatggcgccgagaagtgttaccttgtcaccatggcttatagagccgagaaaagagtccaaaaacgacattaagtcctttagggggtctaaacgtgattttttttcaaaaagtgctaaaatacaaaaaaaatctgacactttatgtacttctaaccgattttctgcctctccagtttaccaaataagttttattgcttgtgaatttgactaccctctgcaatactattttgtctctctacaatacttgttgtcttgtgttagtgataacattagataatttatttgcatagaacacaacaattaggttcatctgccaccttttcattattcaaatttcaaacaaacacattcaatctttatatatgtgagtatagttactaggcaacacttggagcatgtaaaatgagtgacatcctttaactcctcactattgccataccggaaaaaaatcgatcttctgtttcactctgttataacttcataattttcagttttttggtcatctttatgaacttagatttgttcacaggttgctgcttttgtccccttgatgtatatgtgcatttgcacatattattcattattcaagattggcatgttgatgttctattctctgactccaagacaaaccagctctgtcagcttgcttatgatctgttcaatggttgcaagatatgcacctcctatttcttataactttctgaatctcatccgccttggtggcaatgctaaaactacatttgagaagagaatggggaacattgatgatgcagttcctttctttggcagaggcttcaacaagatctatccactgattatggttgtttatacactattggttgctagtaatttctttgttcgtgtgattgactttttgggaagatggaaaaggttcaagttccaacgtgaagaagagaatatagatggtttagatccatctggaatgattattctacaaaaagagagatcttggatcgaacaagggtgcaaagtgggcgagcaggttattccattggcaaggaatttcaatggtgtgaacgctgatattgaatcacaaaatgtgccattggttgaaaacactgtggagatgaaagtaggggcaacttcttccagaaatgacgggagagctggccagttgaagtatgcaaacaacagggagactatcgccagcaaatacacttctattagagaacagaaccggcagtcagggaaggtagtgagaaaggaaatttcaccgaactctatatctttgctcgaagaaagaaattcagagcaggggtccaatgctggtgtaccaccaactggtgtgtctgcaacatgggcctcgatgaagattggttttcaaaatttcaaagcaaatatgggttctaagaagtttcttcctttgcgccaagatccaggatttgttccaaatttgaatgtctcttcaccagaatctcttgatgacatattccaaaggttgaaacggcggcctgcaaatgtgcctgtggattaccttgacgatgacgatgatgacaacataggagatacagatcttcatttccaagatcaatgaaataggttgtgatattcttttaggtttagaatatgcatacacagaaaaactaaaagaattggtagcaatagatgttcaaaggaagatacaggatgtatagatctgatgatggtttggtgtgcttcctggaagctcatgacgcctgtccatctggaaaactgcaaaatgtaagtacgatatgatgacagcctttacagaaaggtttggaattctcccgccgaaaagggttgggactaatctactacgtaccactatattcaggtaaccttgttggtttctctcacctttttttttggaactgtattggagatgctgatatgtgatggaagccaaaaattgtaaatgtgtacctacaataccatatgaaaattaacgtgcttgagttgtaaccagtaaaaacatactattgaatctatacttgatcgggaggatac

SEQ ID NO: 16092 - DNA, 649 bp, Zea mays
attttacttaatatataccatacacatttcactcatcgcgagcggctgccctttctttctttttttgttttttttggatagacgatgcaacgcttctattatttctttcacatacatataaacagcatagcatactacgaatacgtgtataccatgtccagaatccagcccaataatccaaacagtatacggcccaaccgagtaacctcatacaagaacctaaagagagaggaaaaaaccgcggatccaacaaccaattacaccgtccctactaaggtaatgttaaaaagaacactgcattcatccaccacgaagcagagttgaaaacacgggggctgcctgcctgcctcgatcaagctcctttagttgtaagggcccatgccaatgctggagccagcaccaccagcggcatctcgggatttggagtagctgaggtagtatacctcgcccaggatggccgtgaagaaggtaaatgccgcgccagcagcgaagacgcccttccgcaccgtctcgcatgagagggactcgccgtagaatacgcccctgtaccgggtgtggtacgcgttgcgtactgatcccgccagcaggcacgcctccgcgatgaggaaggtcacccatgtgaagaggaagaggatgagggcgcaggcgc

SEQ ID NO: 16093 - DNA, 1287 bp, Zea mays
agggagaaaaatagcaggccgccttgagctggcataggatgcgacggtccggcaggggcagggctcggcggtcgacggaggccaattctttaacttccttcctccgtcgatcatccagcaccagcaggagaatcccgtcgaatccccctccccaacccaagggagcgcgcgcgtatgcctcctccagatccaaagcaacaagcaacagacagcgaggggcaccggggtccgccgcatgtgtgtggttcatggaggatcatgctttcctgcttactgcattagctcctgacgcgccaccctcccctcgcgttcattgatttctgttataattactcacattattattggtaaagaaagatagggcaccgcttctaatttgatgggcattccgttaccgtctcaacgtcaacaacaggtcttttcagcggctcgggcaaaaggcgacaagtcagtgcagagaagatagtgtttgatctaaccccactacaggaacagaggctgcaaagtctgaaggaaaggctaaatgtgccatatgacgaaactcggacagatcatcaagaatcgcttagggctctatggaatgcctcctttcccgatacggagctcactagcttagtttcagaacagtggaaagacatggggtggcagggcgtgaacccagcaactgatttcaggggctgtgggtttgtttcgctcgagaaccttttgttttttgcaagaacatacccggcttctttcaagaggctgatgctgaagcagcaaggaatgcgaactacatgggagtacccatttgcggtcgcgggtgtaaacatctcatacatgctgattcaactgctggagctcaactcagggcgcccgaagtctttgccagggattaacttcatcaaagtgttgacagaacacgaggatgcgttcgacgtgctgtactgcatagcgttcgagatgatggacgcccagtggctagcaatgcgagcctcgtacatgcagttcaaagaggtgctggaggccacaaggcagcagctcgagagggagctctccctggaggatctcaatggcatccatgacctccctgcctgcaacctcttgtacaaatagtgctactggtacttagattatattactgggatgcagtcaaaggaaaatttgatcaggttacatcgtaaccagcatcatcagcctgtaaaaaagaaaaaggaaaagaaaaggagagaagggagacacacatctctggttgtcagtaattcacgtacgccacagttttgcccaggattaaaaaaaaaaaaaaaa

SEQ ID NO: 16094 - DNA, 1958 bp, Zea mays
catttgtactggcctaccgggtacgatgctcatgagctttcttaccatccttctgcgctgggtcatgcgcttctgtacattgatgcaacggacaggagcattgtccatgtaactataataaaaaaatgtctggtcttcaaatgatagcttaatagctgatgcgggaaggacgttaattaaaattttaatagcgaaagctgtggttgaaacggaaaatgtgaaaatcctgaagctcgaaacatcagctagttggacttcttatcttcacgtgttttgagttcataaaatttcccaaccatagaaatcctccaattattcgattcccaagccactaaggcccttggaggaacaacagaatccagaaaccgaaaagaggcctcactgctgccgcctgggccaagtcgtcgtcttgcttgccaatccgtcgctccacctgaacacaccggcgaagaggaggcgaagaagcgatgggcgtgaccaaggaggacgtcgaggcggccatcacctccgctctcagcccttccaatctcgtaagcctctcgtcgctctaaacccggcccgctagtccatcgatctccatcataaaccctaaccacaccgcccctctgtgtctgcgcaggtggtgacggacacgtccggagggtaagctcgcttccaatgcctaaacttttatttttttttttcaattagcatcttcagtttgtcgactaaccaacaaagagcgggtccttttgttgcgccgttgatttgattcgtcggtgcgaaggtgtggcgcgagctacgagatcgaggtggtgtcggagaagttcgaggggaagcggctgctggagaggcaccggatggtgaacaccgcgctggcgtctcacatggcggagatccacgccgtctccatcaagaaggcgctcaccccggctcaggcccagccccaggcccagccggagccggccgccgataagccccaggcttaagtgcttaacaccccccaaaacggtttgatcccatatgccgatgcacgattacattggctatctgcttgaataatgcggcggatgcacttgctaaattgcaggatgttatccttgactgattagaaacttctgcaccgtgcatttaacttctgtgtcactgtgtgtgtgttctggatgcttctgccctggtcgtttgctcgagactgtgtgttgcagttcatgctgttaatgttctgccagggtggggttttcagtcctggaatttttatatttgactgttgctatgtctttccttgcttgtaggggtaaggggtttattctttaaccttgtggattagattactgtatccatcatggtctgcagtggggagtggggtgtgatgatgatggctgcatcttgtttacccaacattttaatttcctggttgatgttgccgcaatcaagatgaatgtgtcgtccttgccgatataagaccgtatccagcggttcacccatatgatcaccaaaagcactgtgttctgcattattttagaccacactattcacagactatagtttgaatataggtacggggatgggtagattgctggagatagcctaaagctggctggaagtattttagtgctggaactgcagtagtttacagtttaagctgtgaaaataatttatgcaagcttctatgttatatcgtatatattgtagcgattgcattgaattgtacattgtagtacctgacgatactcttttttgtgcatatggggctgctggagttgtaatttctttctgtcataaatattccaaggtgtctgtgcacgtttgcatggacccccgtgaacagcagcacatcggtcgtggcagcaccatagctgacttgtatttgcacatgttgctagcacgtatgcacacagttccgtctgatggcaatagaaatatggagtagtagcatgccttgcttgtattgatatatacttgcagaccataactcgaag

SEQ ID NO: 16095 - DNA, 1092 bp, Zea mays
  misc_feature (1089)..(1089): n is a, c, g, or t
aatagctgatgcgggaaggacgttaattaaaattttaatagcgaaagctgtggttgaaacggaaaatgtgaaaatcctgaagctcgaaatatcagctagttggacttcttatcttcacgtgtttccagttcataaaatttcccaaccatagaaatcctccaattattcgattcccaagccactaaggcccttggaggaacaacagaatccagaaaccgaaaagaggcctcactgctgccgcctgggccaagtcgtcgtcttgctttgccaatccgtcgctccacctgaacacaccggcgaagaggaggcgaagaagcgatgggcgtgaccaaggaggacgtcgaggcggccatcacctctgctctcagcccttccaatctcgtggtgacggacacgtccggagggtgtggcgcgagctacgagatcgaggtggtgtcggagaagttcgaggggaagcggctgctggagaggcaccggatggtgaacaccgcgctggcgtctcacatggcggagatccacgccgtctccatcaagaaggcgctcaccccggctcaggcccagccccaggcccagccggagccggccgccgataagccccaggcttaagtgcttaacaccccccaaaacggtttgatcccatatgccgatgcacgattacattggctatctgcttgaataatgcggcggatgcacttgctaaattgcaggatgttatccttgactgattagaaacttctgcaccgtgcatttaacttctgtgtcactgtgtgtgtgttctggatgcttctgccctggtcgtttgctcgagactgtgtgttgcagttcatgctgttaatgttctgccagggtggggttttcagtcctggaatttttatatttgactgttgctatgtctttccttgcttgtaggggtaaggggtttattctttaaccttgtggattagattactgtatccatcatggtctgcagtggggagtggggtgtgatgatgatggctgcatcttgtttacacaacattttaatttcctgattgatgatgccacaatcaagatcaaaaaaaagggggggcccggtaaaaaaaaaaaaanaaa

SEQ ID NO: 16096 - DNA, 785 bp, Zea mays
  misc_feature (736)..(736): n is a, c, g, or t
ctcgaggccggccgggagaaactggaaagaggcctcactgctgccgcctgggccaagtcgtcgtcttgcttgccaatccgtcgctccacctgaacacaccggcgaagaggaggcgaagaagcgatgggcgtgaccaaggaggacgtcgaggcggccatcacctccgctctcagcccttccaatctcgtggtgacggacacgtccggagggtgtggcgcgagctacgagatcgaggtggtgtcggagaagttcgaggggaagcggctgctggagaggcaccggatggtgaacaccgcgctggcatctcacatggcggagatccacgccgtctccatcaagaaggcgctcaccccggctcaggcccagccccagccccagccccagccggaaccggccgccgataagccccaggcttaagtgcttaacacccccaaaacggtttgatcccatatgccgatgcacgattacattggctatctgcttgaataatgcggcggatgcaattgctaaattgcaggatgttatccttgactgattagaaacttctgcaccgtgcatttaacttctgtgtcaccgtgtgtgttctggatgcttctgccctggtcgtttgctcgagactctgtgttgcagttcatgctattaatgttctgccagggtggggttttcagtcctggaattgttatatctggaaaaaaaaaaaaaaagcggcctgttgctatgtctttccttgcttganggggtaaggggtttattctttaaccttgtgggattagattactgtattt

SEQ ID NO: 16097 - DNA, 1112 bp, Zea mays
cattgggtacctcgaggccggccgggagtggtatggctcgccttggccaccagacggtggccgttggcgtgccgcgtgcacgcctagacgacgatgcagctccagcatggccctcggcctggagtggccggtgctgctcgtccccgcagtagtctcccccgccgacctagcctcccgcgccgccgccgcagcagcagcagcagcaggaccaggacgacgacgacggcgctggtggtgctagtagccgcggcgacaagagacggggccagaaagacgacggcgtcgggcagcagggccacggcggcggacgtggtgaggcagttctacgacggggtgaaccggcgggacctggcggcggtggagccgctcatcgcggagggctgcgtgtacgaggacctggtgttcccgcgccccttcgtggggcgggagcgggtggtcggcttcttcggcgagttcatggggaccatcagccccgacctgcagttcgtcatcgacgacatctccgccgaggactccgccgccgtcggggtcacctggcacctggagtggagggggaggccgtttcccttcagcaggggatgcagcttctaccgcttgctcggttcttcggactcggagcagcagcagcggctgcagattgtgtatggtcgagactgcgtggagccggccgccaagcccggggatttggcactggtaatcatcaggggagtgacatggatcctcgaacgatttccgagccttgcaagcaggctctgatgaccccaaccgaggcaatagctacaggatacgctacgcatggcttaatttgctctcaaaagtccagtgagatcgagctagcagacgtgtataatgttatacaatacattattctgagaaactggcgaaacgtatgtctcgtcgtgaggaaaagaaaaataaaaatataggcccaattacttttaaaaaaaaaaaaaaaatatagttctgcacctaagtaagagcttgttactatacaaaaactgattattagtaagatgagatgtatagtttacaatcggtctaccggataaaccattagccttgctctaattatatatatataagcataaacccatacccaaagatgtttgggg

SEQ ID NO: 16098 - DNA, 2411 bp, Zea mays
ctcgtgccggtttttttttttttggttgctttgtactaacaataacaggtattttcatcactcatcagtcaacaccacaaagactctttctccatccatccgggtacagcagctcagctcgcagttaataataaaaaaacaaattttaactcgaaaataacccaaaacagtaacagcaatgcagtgccaagcaaacagcataatcaccacccaccttgctaacaatactactcacctacagcaacatctttacacgtgcctttttttttaatgttacaaacaaaaagggcacctcagctcagctcctgaacccgaagttggaccacctcctcccggcctccttcttcgcccgctgtgagttggtaccgaacaggttctccagcgacttctgcttccggttccgcgaccgccccgcctccttcagcagctctgccagccgcttcttctcgtcctccacgtcggggttcgccgtgccaagcttctcttccctcaccttcagcacgtgctccaggatctcaatcgcgtcctccactctgaacatacatgtactaccttgtgaataaaaaaaaatgactcaaggctgcagtgcagtgcaggctactcgatcgacatgtaccttcccatggcgtcatagattgcagcaaggttgctgtacacgccaagagtgtcaggatgagaggcgccacactcctgctccagcaccgccctcgcctcctcaaacagctgcgcagcctcgtctatcttgaacagctgcacgcaggccagccccatctggttcaacagcacgccgaaaaacgccgacttcctctcgccgctggccctcagcttcgcgaccgcgctctcgaacgagctcctcgactccgcgtacctccccaccatgtagtacagcacgcccatctgcgcctcgatcccagcgacggtgctccactgccccggcgcgtcctccagcagcttcagcgccctctgcagaagcttcagcgcctcgtcgaggtcgtcgagcgcctcgtagatggcagcgatctccatcaaccctccgccgatctcgtcgggggcagcgccgggcgcgggcttggcgtagacgcgcagggcgttctcgcagtaggacttggactcgcggagcctgcccgtgcggtggtacaggtcggcgaggcggacgtagacggacgcgacggtagggtggtcgtcgccgcgggcagacttgaggacggtcagcgctttctggtacgagaagacggcctcgtcgaatcgggcgagggccaggtacgtgttgcctatggcgacgtcgatggtggccacctcgatgtcgcggccgttggcgaccatggtcatggaggcgagcacgaggtgctccagcgcgccgtcgtagtcgcccttggcgtccaggatgagcgccatcaggcgccggtccgaggcctcctccagggacgccggcgcgctgtgctcccggtggatctccagggccttgcggcacagcttctcggcctcgtcgaactgcagagcttgcacgtgcgcttccgccaggtacctgctcgtctcggcgtcgcgggggtcgccgtccccgtgcttttttaacgccgattctgtcgagatccacgggttctaacgaccaacgatggagaaaaaaaaaatgtaacttctggggagaggcgagatctagatcgagaagcagcaaagggagggagcgggacgatcacctacctgcaggtctcggcgacgcggggatcgcggtcgccgagcgcggccatctggatctggagccccttgccgtagcaggcgatggagtcgtccatgcggccgagcatggcgtgcgtgtcgccgagctgcatccatccggagaaggcggcgagggaccactcctcgcccaacttgtcgtcggcctcggcagcctggtcgtcggcctcggcagcgggggcaggcgtctctggcggcggcgtgacgacggcgactgcgcgctcgaggacggggatggcgtcggcgtggcggccgaggccgcagtggatggcggcggcgacgtggaggctcatggcgagctcgagctcggcgccctcgccgcggcgctcgagcgccctggcggcgcgctcggcgaactccagcgcgcgcgcggcgccgccgccctcgcccgacagcatggcgtcgcgcgcctgcttcaggaggaagggccccagatccgggttgtccagcgagtcgtcggtgggggcgggaggggggcgcggcttggcgcgcgtggaggcggagggcgacggggacggcggcgcgcggcggggcagcggcgacgagagacggcgcggggccggcgccgccgccgggggcgagttgcctgaggcggcgaggcccggcatggcggggcagagtttggtggctcctagtcctagcctaggtggggggaggcgagcagacagctgctagctcgg

SEQ ID NO: 16099 - DNA, 2600 bp, Zea mays
ctcatcacccaccagtcaacaccattcctccacgacaaaaccaatgttctcttctcaaggtataacagcacccagttaacaataatcgctactgaaaatataacccaagacaagtaacacagtaatgcagtgccacacatacacaaacagcaaaccaacaccaccatcacattcctaataataataacctacagcaacatctttacacgtgcttttttttcctttcccatccctcctttatgttacaaaggccacaaccgcccgacgacgacgacgaccaacagtgcagcttcctcagcttctgaacccaaagttggaccacctcctcccggcttccttcttcgcccgctgcgagttggtcccgaacaggttctgcagcgacttctgcttccggttccgagaccgccccgcctctttcaggagctcccccagccgcttcttctcgtcatccacgtctgggttcgccgtgccaagcttctcttccctcaccttcagcacatgctccaggatctcgattgcatcctccactcttcccatagcatcatagattgcagcaaggttgctgtacacaccaagagtatcaggatgagaagcgccacactcctgctccagaaccgcccttgcctcttcaaacaactgtgcagcctcgtctatcttgaacagctgcacgcaagctagccccatctggttcaacagaacgccgaaaaatgccgacttcctctcaccaatggccctcaactttgcaaccgcactctcgaacgagttcctcgaatctgcatacctcccaaccatgtagtacagaacacccatctgtgcctcaataccggcaacagtgctccactgccccggtgagccctcgagcaacctgagtgccctctgaagaagcttcagggcctcatcgagatcgccaagcgcctcatagatggcagcaatctccattaagcctccagcgatctcatcaggggcagcacctggcgcgggcttggcatagacacgcagggcgttctcgcagtaggatttagactcacggagcctgcctgtccggtggtaaaggtcagcaaggcggacgtagaccgacgcaaccgtcggatggtcgtcgccacgggccgatttgagaacagtcagtgccttctggtaggagaagacggcctcgtcgaagcgggcgagggcgaggtacgtgttgcctatggcgacgtcaatggtggcaacctcaatgtcacggccattggcaaccatggtcatggaggcaagcacgaggtgctcaagggcgccgtcgtagtcacccttggcgtccaggacgagggccatcaggcgcccgtccgaggcctcctcgagggatgccggagcgctgtgctctcggtggatctggagggcttcgcgacacagcttctctgcctcgtcgaactgcagagcttgcacgtgcgcttccgccaggtacctgctcgtcagtcagttttgaaaagtaacagaattgtcatgcttcgtcccttgtaagaattattgggtgtttgcacgcaagaagtcagttctaacttctaatgccgagatccacggttatgtgtaacgactaacaaccaacgatgggggaagacatcacttgtttggcttcggcgaggtttgattggaggtagtaaaaagaagaagaaaatgacgcctttatgggagaggcgagatctagatcgagaagaagtgaaggggggttgatgatcacctgcaggtctctgcgacgcgaggatcgcgctcgccgagcgcagccatctggatctcgaggcccttgccgtagcaggcgatggagtcgtccatgcggccaagcatggcgtgcgtgtcgccgagctgcatccagccggagaaggcggcgagggaccactcctcgcccctcctcggtcaggctcggcaggctgcagctgctggtggtcgtcgccgccggttgcaccggcctcggcttcggcctcgccgtcggcaggcgcctctggcggcggcgtgacgactgcgacggcgcgctcgaggacggggatggcgtcagcgtggcggccgaggccgcagtggatggcggcggcgacgtggaggctcatggcgagctcgagctcggcgccctcgccgcgtcgctcgagcgccatggcggcgcgctcggcgaactcgagtgcgcgcgcggcgccaccgccctcgctcgacaccatggcgtcgcgcgcctgcttgaggaggaagggccccagatccgggttgtcgagcgagtcgtcggcgtcggtggggaaggccgcgggagagggcgagggcttccgaggcttggcgcgcgaggaggcggacggcgacggggacgacggcgcgcgacggggtagcggcgacgagagccggcgcggcggcggcgccggcgccgggggcgagttgtcggaggcggcgaggcccggcatggcgggcggggttaggtggctggttcctgggtgtggaagggagcactagctgggtgtcgtctaggagggagcgaggtggctggcgacgactacaggtcgcacgataccattccgggaaggaaagggcagcggccagcaggtagcaggaagggagcgggacgggggctcgcttgacgggggataccgctagag

SEQ ID NO: 16100 - DNA, 1083 bp, Zea mays
aaaaaagatgggcacaacccacacgtttccttaccctaaccgacagcagccgccgtttcttcatcttcctcgcagcggcggcgctccgtcttccgctcctccctcccccgacacgcgctcggcacgcaggcgacggcggcagcgctcaggctcgggctcgggctctcagcgacggcggggcagtcccagactcggcggcggcgtcaccggctccccctcccgcatctcgccaatcgccttgcgccctcgcctccggtcctccgcacaacggccggcgaccctgcgtgcgcgcttcccgctcccctgccgcctccggtggaccgtagacggcgctcgaccccggcggctgcactgcgcgccgcgtgcgaccggcgggcagcgggatccagctgctgctgctccacctaggcggctgcgccgatttggtagcgcttatgccccaaacgaagtgttacccgtccgcttagggctgaagcgtgcgcttagtgacgctttttagaacctaggcaattaatcagtttggggttctcatatatctctttggagatgcatccacatctgactttacataggcatcctatgtgtgccgagattattgaagaattccagaagtgccatctggatcaccctgtcaagaagttcttcggagagtgcacagaccttaaaatcaagctagatcgctgcttccgacaggagaaagctttgaagagaaaggcaaactttgaagagagcaagagatttaaagaacagttgaaggcttacaaaagggaaattgcagagaaaaacgaggaataataacttggaacggaggacaaggccgtagaggctcttaatctgtgatgacctgccctcgattttgtgaaggatctgtcgagtatttttgaatataatgtttctaaaaaatattatactcttttcctggtagcagctaaactttaacagcttaaagtttcttccattactaccgaatatgtgtccaatttgttcatgcatgcgttgcgtgcagaggagtcctttgtatcaaatttggacaacccactcttgttgcctagtataagcagtttattggcgagttccttttag

SEQ ID NO: 16101 - DNA, 1142 bp, Zea mays
cattgggtacctcgaggccggccgggccctctaccctaaccgacagcagccgccgtttcttcatcttcctcgcagcggcggctctccgtcttccgctcctccctcccacgacacgcgctcggcacgcaggcgacggcggcagcgctcaggctcgggctctcagcgacggtggggcagtcccagactcggcggcggcgtcagcggctccccctcccgaatctcgccaatcgccttgcgccctcgcctccggtcctccgcccaacggccggcgaccctgcgtgcgcgcttcccgctcccctgccgcctccggtggaccgtagacggcgctcgaccccggcggctgcactgcgcgccgcgtgcgaccggcgggcagcgggatccagctgctgctgctccacctaggcggctgcgccgatttggtagcgcttatgccccaaacgaagtgttacccgtccgcttagggctgaagcgtgcgcttagtgacgctttttagaacctaggcaattaatcagtttggggttctcatatatctctttggagatgcatccacatctgactttacataggcatcctatgtgtgccgagattattgaagaattccagaagtgccatctggatcaccctgtcaagaagttcttcggagagtgcacagaccttaaaatcaagctagatcgctgcttccgacaggagaaagctttgaagagaaaggcaaactttgaagagagcaagagatttaaagaacagttgaaggcttacaaaagggaaattgcagagaaaagcgaggaatgataacttggaacggaggacaaggccgtagaggctcttaatctgtgatgacctgcccttgattttgtgaaggatctgtcgagtgtttttgaatataatgtttctaaaaaatattatactcttttcctagtagcagctaaactttaacagcttaaattttcttccatgactaccgaatatgtttccaatttgttcatgcatgcgtgcaggagtcctttgtatcaaatttggacaacccactcttgttgcctagtataagcagtttattggcgagttccttttatttatgctatttattctatgttgatgtaatgggtataacatttgaatttataaatccaaataaattgttctgt

SEQ ID NO: 16102 - DNA, 1531 bp, Zea mays
gccgtttcttcatcttcctcgcagcggcggcgctccgtcttccgctcctccctcccccgacacgcgctcggcacgcaggcgacggcggcagcgctcaggctccggctctcagcgacggtggggcagtcccagactcggcggcggcgtcagcggctccccctcccgaatctcgccaatcgccttgcgccctcgcctccggtcctccgcacaacggccggcgaccctgcgtgcgcgcttcccgctcccctgccgcctccggtggaccgtagacggcgctcgaccccggcggctgcactgcgcgccgcgtgcgaccggcgggcagcgggagccagctgctgctgctccacctaggcggctgcgccgatttggtagcgcttatgccccaaacgaagtgttacccgtccgcttagggctgaagcgtgcgcttagtgacgctttttagaacctaggcaattaatcagtttggggttctcatatatctctttggagatgcatccacatctgactttacataggcatcctatgtgtgccgaggtaacttgctattattttttttattttgtcctggccttcttcatatatatgttgttgcactactttagtaaaacttacaattatgatgtacttgtccagattattgaagaattccagaagtgccatctggatcaccctgtcaagaagttcttcggagagtgcacagaccttaaaatcaagctagatcgctgcttccgacaggaggtgagtggttatcatcccttgtttctattttgttatcctctaaaccacaacatggtaaataaacctccttcttctaaatgtcatgttactgtacttaaaaccagaaagctttgaagagaaaggcaaactttgaagagagcaagagatttaaagaacagttgaaggcttacaaaagggaaattgcagagaaaagcgaggaatgataacttggaacggaggacaaggccgtagaggctcttaatctgtgatgacctgcccttgattttgtgaaggatctgtcgagtgtttttgaatataatgtttctaaaaaatattatactcttttcctagtagcagctaaactttaacagcttaaagtttcttccatgactaccgaatatgtttccaatttgttcatgcatgcgtgcaggagtcctttgtatcaaatttggacaacccactcttgttgcctagtataagcagtttattggcgagttccttttatttatgctatttattctatgttgatgtaatgggtataacatttgaatttataaatccaaataaattgttctgcagacctgcttagtgtaacacacctagatgtgttttagctattgtaggaatcgtccgctttccattaccaatttataatgtgagagaattgttcctgttgaatgaagaatagaaggtatttcttttttcaggtcactgagatctgaataaaattgtgcaggctacttagcacccgctttgtaaattatcagggaaaaattcctggtatggcatcgacattttatactcattttttgtg
